United States Patent 9,328,346 (POLYCOMB-ASSOCIATED NON-CODING RNAS) - sequence listing, part 66

SEQ ID NO: 12606 - RNA, 89571 nt, Homo sapiens
aaccagcuggucccaccucucuaagccucaguuuccuuacuuguaaaauaaaagggcugagacucgaucucuccagugccauccagcuccaggaugacuccuguugauaaugacuuugguuggaaacucaauuuggaguguuccucucuugucucccacuuagcacuagacuuuuucugcuucuaugacagccuuuccacugugcccgagaccuagaacaucuuucuaccugucugauaccuugucuugauaccuugucacgugcagccuaaaggcaccuuguucucaacagaccaaaggcagaacucuuagccccaccaccccacucaacauggcagagcuccuggccccaccgccccacucaacauggcagagcuccuggccccaccgccccacucaacauggcagagcuccuggccccaccgccccacucaacauggcagagcuccuggccccaccgccccacucaacauggcagagcuccuggccccacugccccacucaacauggcagagcuccuggccccaccgccccacucaacauggcagagcucuuggccccaccaccccacucaacauggcagaacucauggccuccugcuaccucacaccugggccucuuucccugcuucucuaccucagugaaaaguacuagcuuccaucuaguucuaccugggugucauccugacacagccaauuccccacauccauguuaucaccaagccuuguaagacacucuccuaaauaacucuaaaagccacucucacuauccucagcuuuauguauuucuaaaaccaaccaccucccuagacccagcuacuaucaacucuagcuuccucucaaauuccauccccguacucuguggccagagaggucuuuaaaauagacaacuugauuuuggucccucauggccaucaggacaaaggcuucccaugguuuauggcuguucaagacaacagaaagacugcaguuuaaccuguugggcccagagaucccugcccagcccuccagauucaucucuguucuccagcucugcugaccugugaguuucccuaacaggcuuagcuucuuuccgccagagagcuggcaaauacacuauuccucgcuuggaacugcaccacccucuggcuacuccucaacuuggaacugcaccaacccccugcugccacaugcucacccuucaguucucagcucaagugugcacguaucacuuuuucaguaaaguauucccugccuugcccaaauauaggguggcuucuucugcuguauacucagggggaaaaaaacaaaagaacaucuuucuuuuccagugcccuuagcuuagguuauaaggagaccuuccuuagcgcgaugacucauuauuuccagaucccccucacugcaugcauucaccauuguauucccagugccucgcagaguacaggaccuagaaugggcauccagugcaguugugcagaccaaacucuacagcuucuaaggcuuuccauuaagaauccacuaaaagagaacuggaaagugaaauuaaaaagaaaaauccaacucgacugccaacuccaacuuuauuuuaggcucuuucugcauggcugggcuccucaaacuccugcccccucacucucucaccucuuggccauuaccaccaccauaccaccaccaccaccacugcuauaccacuaucauaaccaccaccaccacaucaccaucaucaccaccaccaccacaccaccaucaccacaaucaccaccaccaccaucaacgccacaccaucaccaccaccgccacaccaccaucaccaccaccaucaccaccaccaccacaccaucaucaucaccaccaccaucaccaccacaccaccaucaccaccaccacaacaccaucaccacaaucaccaccaccaucacugccacaccaccaucaccaccaccgccacaccaccaucauuaccaccaccaccaucaccaccaccacaccaccaucaucaccaucaccaccaucaccaccacaccaccaucaucaccaccacaccaccaucauaccaucagcaccaccaucaccaccaccaucaccaccaccacaccaccaccaccacaaucaccaccaccaccaucaccaccacaccaccaucaccaccaccgccacaccaccacaccaccaucaccaccaccaccaucaccaucaccacuaccaucacaaccaccacuaccaucaccaccaaugcuacaccaccaucauaaccagcaccaucaccgccaccaggcauagucacuggucagcuagcaagcagaaggaggcaagauuuauauccaggccugugugaucccaaaucuggcuucugguuucucaccuccaaacuuucuguugagcccucucauaagauaccaucuauuuucccuuugaagcccaccuaaauacugucagagaaaagacauuagagaaaaaucccuuuaaaaacagauauaaaacgagggugcccccauuucacccuucucucuccuacacacuuucagaggacaacgcaaggcauagacaaaggaugaagucagagaaagccaaaauaaguaacaaaaacaucaaucuaacuggcacuacuaacuagaagaacccaaaagaauaaacuaaaaaugauuuuaaaauauaaaaagaaguccagauuuaccaaauaucacaacuguaaaacccaaaggacaucgaauuggagguuccuagauuuugagauuuuagaccaaaaucuacgaacaguggcauaagccacugugcccggccagaccacgcuaauauuucaaaagaaauguguggcacucacaucggguugccagcuguuuugcuuuuuuuuaaaaaaaucugcuagauaaagucacugaaaacuaaauaaaagcaaaauuuaaaaaacaacaucagcgggcgcaguggcucaugccuguaaucccagaacuuugggaggccgaggcgggcagaucacgagaucaggagauggagaccauccuggcuaacauggugaaaccucgucucuacuaaaaauacaaaaacaaaauuagccgggagaauggcaugaaccggggagguggagcuugcagugagccgagauugagccacugcauuccagucugggcgauagagcgagacucugucucaaaaacaaaaaaaaacaaaaacaaaaaaagaucuaaaaucuuuuggggaggguagaauucaagcaguuuuauucauucauucauucauucauuuauuauaaggauuucugauuuauuuauuuucaaagacucuaaaaucuuaaagcaaaacaaaaccccuaauuaucaucuacaauccuucuagaaagaaaugauaucaaaauucuaaaaggcaggaagcuuauauagccucaaaaucaagaaucaaaaucaaaagucccuccccugaauaaauuuggcuugaugaaagccccacuacaacaucuuucguuuucucauuucacuguggacuggcauuugggaaccgcugacuuaguucaacucuuucccugaugagguagucucuucuaccaaauccuccagaaaccuucucugaguguuugccugaguaggcugcugguugccucaaaaaccaaccaauucugaaaguggcagaagaugagaaaaacguacaaaaaucaauaccauuucuauaaauacauaauaagaggccugaaaauauaauuaaaaaaagagugcccacucacaaugcaacaaaagcaucuaauacuugggaaauauaugauauauauucacauaucaaacucacauaggauauauuaaaauuacaugaagaaaacacaaauccuuaaugagagaaauagugaccugaacagauugagaggccauacuucuggcuuaagacuaaaugcagaaaagaugauaauauuucccaacuuaauuuauaaauugaacgccauuccagucaaaauaucaccaaggucauuuauaaaacuugauaaaaaugguucuuaaauucauauagaaaaauaaauggacaaaacaucagagaaugcugagauacugugcagugagaaggcauuugccccagcagaucuuaaacuacagucuaaaaucaucauuauuaaggcuguagggcagucacgcuaagauacugggaaaaugucgcaauuucacuaacugagcaggaaugaaaccacuagcaauuaaaacuacagaacccacagaaggccacaacacuccgaggacagagagaugucuugcaaaacucucuuaucucaguuguggacaggaagcuuuuguuuuuguuuuucuaacuaacugagcaaggucaaaaauuuacgaagugacaagaugaagauuuccugacagcauaaaacaagccucuccuuaaguauuuuccaagguucaucucaauccccacacagcaccucauuccuagaaugcuuauggucaaaaaucacacuuuggaaguuaauuaaauucccguuguccucuaauugugagugugagugugugacacaggcuggcggcuacaacuccugucccagaggcucuuuugccagggacccugcaccaucuccaccaggugcccaggcacucaggaggcacugcuggacuucuugcugggccauuggcucccuaaauacacagauuauugcuuaaaggcgaggaucuccuccacuuaagucaaaucucacaugccucaaugccuuuucuuuuuauauguggcuccucacaugccugaaaccaaaucugccauuuggaaaaccggaaagucuucucuugcuccucuucccucccuccucagugaagagcagggagagaagugacggcugcuuccugagggaacuucuagaccaguaaagggaaggacucccaauuuaugaugacuuuuagccgaaacaauggauggggaagcggggguccagaaguaaucaccagccuccagugcauucucauuucugacguugagaggcccuucuuucauucuccuggcuccaugauauuuuaucaugcacaauguaugucacucaugggcccuauuaggaauccuaucauccuagcaguggaggugaccuuguagaccaacccauccaacaccucaggguucucauacacaaggaaagaagaaguggaaagaaaacccugauguggaaaccaaguauccaccacaaggaagccaaggaugcacccggcuagggcacugaucugauuaucaacucguccagaucaaccccacacacaccugacugagaccuaagggguccacacauccuaacaccagcacgaggcaggaccucaucuucacuggacugucuuuuagaaaaaugaagccaagcgaaaauaacaaacaaauaccuuagaauucucuuuaacgcaaagcaaugcuacagugaaugacgccgauuucuccccaguuaucaggauggacugauuacagugcccagauucauuugccugaagauaauugccucaauuauccacuucacuuugcacauauagaaauagucccaaucuacuggagccucagugacuagacauguaaaauuggucuaaucauauuuugaagagcucgagcugcaaggauuucuaugagcgugugccuaaaccgugacaacacuaaggguuucuccccuccgggcucgaggcgcgcucgcucucucccucccagaagucugauggggugagucagauccucagcagauaagaugaaaacaacuuugaggcucucugucagggcuaggggcuagaggaaagauaggauguccaggacagcuggacaaaagacaaagcuaugagccgagagcuuuccugacgguugagugguccuuugcaaucagcaguguuuucacccacagcucacuggcuggcauggcugcuggugggcagggcagagguggacaucuggggccagaaccccguagacuggggguguccugggacaaugaugucucaacuggcugcaggaaagaaccagacaagcucaguguagguccggcugggcagacagccggaacucaagaugaagcaaggcagggugucagaguccagggucugaaccggagaauacagaaugccaagcuccagggccacgggagagaaaugagacaccacguccaagagggccuguaccccucuuggguacugaugcuuugccugagcaagggggcuucuagaugcuucccguuggauccagagucuagaaauugcuccuccuguggcagagggagagagagggagauaggcacuuaucaguaggagaagcucaacagagcacgaagugaagagaaaguaagggagcuccugggaagacagcuccgagcaaucucuacgcacagaacgaaggcuccuuucugauccuacgcccuuuaaaaacgaauggcacaaauacaguauuguaaucccaaaaauggccuggacagaaaccagccaugucaaaaaggugauuauuucccucuauuguuugcuuuuagcucuagauggcauucccccaaaucucaaaaucaggagcucgagguuuucaccauuucuacuggugagagccaauugauaucagcgcagucugaauagcagcaaaauagcacccuagagagcugagccaaaugcuucugcauuguaccugguccucucuggggaacaggcgggaggggccaauaccaaauucucggugggguugagccuuacuggcugauugccacagugagggguagcgagugcugcaaacucccugaauucauuucuguccaaaggaaaguuggaaaagcucuucaucuccaaaaauaguccuuuccaaugauuauccaaaaaauaucuucaagagugauuauacccgcucaccaggcagggcagaaccaauccauuaucuugaguuucaucuuagaaaaugcauugaggucugugggaccucugacaauagccugcaagccuucugagaacccaugauucaucugucucccccagggccacuggcacauggcuuugcacacgguagacacaugguuagaaacaaguggauugaaagcaauucucaugggcuuuuaaaaaucaaaagaaaaucucagagucagacuagguaaagacucaucucuuucugaaaaucacaagaugaacuguaccucugauucuaaccaguuacucaacuucccucccugucuaucugggcuggaauguauuacucuacaccugucagcaaucugguuuuaauauuugggggcacuucacaucaaugugugugauguuggauggcaggaauugcucauccucaauuacuucgaucuccccacagugcccggaauagugucuugaucauagaaguggcucaauuuaugauugcuaaauagccaauuucauuuguaauuuccgagacagcuccaggagaggaggcaaagagaaccaauguaauuaacagauggacuugacucauuucuuugcuucaacaagugaugaguuguggagcaaagagccuccacgcccugccuuggugaggaaagcuccacaggccgcuggguccauugcacacaucuguuugcccugucuuaaaacugccaccccaacacuccuuccugucacugagccacuugcacuuucaaugcuuccaaaauaguaaaaagugggggcgggggggaggaucguguccaucaguagagcccccaaacccuucucccacagccuacagaggccuucaauggaaucagaggcuaaccugauaagacugcggugggcaccgaguuccaaccccacuugcucacgcacaccacgaaaaacaucuccagugugugguuaccuguccuuugacuucacauugcuucugacaaagcgccaacuuucugacagcccacuccaugucagauucuucuuuggguugcgcugaaggcuuucugcuacaacuaccaccgauagguucuaauuuugcccucuagagccauauauaauaaaucuuaaggccucuuccacaugaaaauccuuuaaggagcuagagacaauauucuucacaauuuauccgaaucagaagcuuacuguaugauacuguagugagcugggaacugcgcuuuccuguccaacugguuuaggagccucccuccagcagagacccgcaagugauauaugcccauacuuuauuuaccagcagacagagagagccccuuguuccucagcccgguaacaacagaggugguucaucacccacuugcuccuuuuugaaauucacucugcagcgagcacuuuuuaaagucacgcacguaaugcauuuuaaagagcaucugcuguacggcuccauuugcucgaccucggcacuaagugugagauggaauggcaucucagugcagucccccacuccuuccucccagagccuguggugaauguacacugagauguauuuauaacuacacaggacuggggcucaaaaaugcagucuuuuguuaaauguguguuugcugauuaaaaugcaucuugcaaagaaagcgcauugcuaaugcagaaucuaguccaaauauauguauuauguaaugcacauuuuuuaauaaugcaggcaaucucgguguaucuauauuagugaaucagcucugggcugccaucuccuuuauaggcauaaaagcacuccaucugaagaaugaaguacuuucuuauguacacuaaagaaucauaaucuaccucguugcugacagcugacauuaguuuccauucaaagggcauuuacuagcacccauauauuccugauuuuucccccaacgugcccugaaaucagcuugaauaauauauuucuguuccauaugcugucgauggagcugugcuaauuagaagaaauaaagugggugggucaguguaggcagacucucuggaaacgugccccauuaguugggacucagaagcggagaugaggauuugaaauauacagcucuaaaugccccugcccagugucccaugauaauauccacacagugacuacagccacgcaggcaccugugauaauaaaacccuugcuguuccacaggaaaagugguagagcagggcacaacuggaacauagacauuuguccuuuugugggguuugacaagucaauccuacuuuaucagacuaaccucccagguucaagcaauucuuguggcucagccacccgaguagcuggaacuacaagcgugcgucaacacgccuggcuaauuuuuguauuuuuaguagagacaggauuucaccauguuggucaggcuggucuugaacuccuggccucaagugacccacccgccucggccucccaaagugcugggaucauaggugagagccaccaugcccagcccaaucacuauuuuaaugcuacaaacuaacacagagugcaagauacaagcuagacacagccaagaugcagaaaggaaaaccucaacacauccaaagcaguugcuggucucucacugggguaugaacucugcacuuagugguuuuaauacgggugugguguugaaggugugagguuaaguuccaucauggugagaauggcuguggguaccugacugacucuucagacaccaggcagaaguaccaguaccaggagggccuggugggccacccagugguagagccucuuuuuuuaagauuccccauacugacucaagaaggagaaaaggaccacaacccaugacauguguccuaagugaaacaaccuucuugauacucccagggauuuuaggaugauggcuuugcucugaguuguuucgccuuuggacuugucacuauggccaaaaaggcaccccauaaucaucauggagggccagacugaagacacgcacaccucaaaagcagcagccagguuagcucccacuguagggaucuccuccuguaggccaucauuugauuuucuagggccaagaaagagcggcacuauuuacuccaaaucuucagccuugcagaguacaacaacacgaucuaguggugucugaccgcccccuagcccugauccaaucauuuucucauguggaauucaagcuagauuaaacaauguugguggguacagagggauucugacugauucaaucuccugauucacagcaaauuaauccaaaauauccuuuccuuaauacaauacuuuuguuguuguuguucacuacucuaccuucagcaccuaaaacacagcuuggcacaugcaaggcacccaaugaguauugcugaguuaccuuuguuaaaaaccuaucuaggagccgggcgcgguggcucacgccuguaaucccagcacuuugggaggccgaggcgggcggaucacuugaggucaggaguuugaaaccagccuggccaauauggcgaaaccccucucuacuaaaacuacaaaaauuagccgagcguaguggugcacgccuguaaucccagcuacucaggaggcuuagguaggagaaucucuugaagccaggaggcagagguugcagugacccaagaucacaucagugcacuccagcuugggugacagagcaagauucugucucaaaaaaaaaaaaaaaaaaaaaaaaaccuaccuaggaaauggcuguaaggggccuccagugaggauuccgugucacccugaacugccccgcaggagagaagugguugugugaacugagagcgcaggaaagacuucccuuuacccaugcucucagcuccaguccacuuccagcaccaccuucucagcucaaucgagcucagggcaguccucagaugggcuugcagacuugcaaacuacuaccucaaccgugggggcccuuguugaagaagaugagguaauuagccaauucagacuguuugagcacguauuguuuggaaacuuuucuaauuacagucacuauaacagaucugcuaaagguaguuucaugauuaauggcugcccgaaguuaccauccucaaacuauuaagccauuggaaaaugcuagaggcuuaauacucguguauagacagacccucauuccccugaauauuugcuauuugggguucuggguuuuuagcugcucccaggcuguguuuauuuccccaauaacuggggaaacuggggaggggcacgaccccacgggagccugcgcccaccugcccaaguacuggaccuggggcuagcuugccgcuugcuccuugccacccgccaggccccccgcccaucgcuucgcccaaauccuuucaaacaagguucccuccugccaccugccggcccacuagggucugcgccacaggcucggcgccaccacgcagcucgcggggagguggcccccaccuccuuacugcacaugcccggcagaaguccgggcgcgcaacuucgcagaaccucacugcccgucccuccucgccucagucuccucuguccucucccaggcaagaggaccggcggaggcaccucucucgagucuuaggcugcggaaucuaagacucagcgagaggagcccgggaggagacagaacuuuccccuuuuuucccaucccuucuucuugcucagagaggcaagcaaggcgcggagcuuuagaaaguucuuaaguggucaggaagguaggugcuucccuuuuucuccucacaaggaggugaggcugggaccuccgggccagcuucucaccucauaggguguaccuuucccggcuccagcagccaaugugcuucggagccacucucugcagagccagagggcaggccggcuucucggugugugccuaagaggauggaucggaggucccgggcucagcaguggcgccgagcucgccauaauuacaacgaccugugcccgcccauaggccgccgggcagccaccgcgcuccucuggcucuccugcuccaucgcgcuccuccgcgcccuugccaccuccaacgcccgugcccagcagcgcgcggcugcccaacagcgccggagcuuccuuaacgcccaccaccgcuccggcgcccagguauucccugagucccccgaaucggaaucugaccacgagcacgaggaggcagaccuugagcugucccuccccgagugccuagaguacgaggaagaguucgacuacgagaccgagagcgagaccgaguccgaaaucgaguccgagaccgacuucgagaccgagccugagaccgcccccaccacugagcccgagaccgagccugaagacgaucgcggcccgguggugcccaagcacuccaccuucggccagucccucacccagcgucugcacgcucucaaguugcgaagccccgacgccuccccaagucgcgcgccgcccagcacucaggagccccagagccccagggaaggggaggagcucaagcccgaggacaaagauccaagggaccccgaagagucgaaggagcccaaggaggagaagcagcggcgucgcugcaagccaaagaagcccacccgccgugacgcguccccggaguccccuuccaaaaagggacccauccccauccggcgucacuaauggaggacgccguccagauucuccuuguuuucauggauucagguuaguugcccaccgcuaaacuggggagccugagggcggugugggagcagcgcagguggaaaggaggugagaaggaaaggcaggucaggggcgagugggaagagaggaggcucagcuggucagccugggaucgggggucagggugaggcggcgagggcucccccaaacuucccaggaugccaggggcgcccugguggccaaaggcuuguuggacggcggggcgcacgccgugcgucccgcuggagacaaccugaggucuccgagcuggugccccggcuacgcgacugaaucccgaacgcaccccagauuuggagcugcacacccaaacggcauugguaagucacuuguuuugcgcgcuuuucuuccuccuagaaagacuagucucaaauaaguuggccuucucagguguccaaaaugugguucggaggugcgcgcgccaacuuucacgaugugagagcagccgcgcuguagagacaccguugaaaugugcggaaaguaaucugaaugggaaugggcgagaacucuagagacugaccacccgggagggaagucacgcgcgcgcggcgccuaagcagcucagagccggagcccaggucccagagcugacaauuaagccgcgggaccuccgcgccagugccuccagcugccgugcgccagccuuggccgccacagcccgccucccgucgcucgcgggacagagaccgccucaaagagcgugcgcaccugcccgcgcgcgccggagcugaccucucccggcggcgggcgguuaggggaaaguaccugggggaaagguagaggagguaaggggacccuuggggaugccccuacgggcuaccaggguugaacgcacaggcauggucacgucgggguauugccaagcuuuuggcgcagcuggucggguggccaggcugcaugcggcuuagcaggagacguccugggcuguuugcgcaggaccucuggaggcccucgagaucgucgcaaguggaaagguaaagcggaacaagggacaggcuggagacgggggucgcgucuaacaucaggauaacuuacaauucguuuccaaagagcgcgguacgcgcagagcuggggaaagguguuggauccggcgccaguccuuggacgaucagucgucgaaaaggaggcaggggccggcggcuccggcagccuuggggaggggaggcgaggcggcgugcuccggccauuuucagcacggguagaguuaaguuuaaucuguaaccuggaggggaaucugcucugaugacccagcacaaaaacggcagcaaucugguaacgcaccuucggaagggaaggcgugcucuccucgccaguccuggggggaaagacugauaagugaaaugucuuuaaaaaaucucauccgacuuggaaauugauuuuuuuuuuccuggugugcgugucucauuuugcgccggcuuaauuauacggaugacaacgauuuggaggaauaguaaagcguuuugagggcuugagaugaaugacggucagguucuuaacuccuaagaaaaggaugaugauagaaggaaaauaccuuaaauggucuuccuuccaggaccuauuccguaggaaaggcgucgcggcgcccaagacuuaguucugccgggcugcagcgcagacugugguuggaugcuuuuguggucuucccuaguaaauacggagaaacuaguuuauuugcaagugguuuucugcgacagcaauguuagucucagaaguuuggaggcugcggaagggcuaggcgugccccgcuuuuggcuugccccuaagucgaaauuccugcuuaauguaaacaaugaugguguguuggcuuucugugacauuaaguguucaguuuuuccucugguaaugucucagccugaguucaccaagcaaaaugucucuagggacaagcaagaaaaacuagggauuguguugaauuucuuuggugugccuuucaagugugggagcuaucuucagacuggguauuccgggagacccguuuucccacagagaauuauucauuagagaaaugagcauguugccuuguugcaggaugaauaaacaaguuuuuuaaaagcccuccgugucgagcccacaccucacacccaucuugcuguuuuuuaaacagaagcccaacauagggauguuuccugaacuguaagcaauguaccauguucacauguagcgaggaggggcaaucuaggaacacacacugucuuucagacagucuuccacaaacugccucgccaucugcauuacagcccaauuguaaaaaccuguuaccuaccggcacacacucucccccgcucaauuccccucccccgcucaauucuccucccccgcucaauuccccucccccagcuucccucuuuacacccugauucaaggguggaaaagccagugcagaccauaugaagcaacugagagcuauaccaacccccgaggaaagcaccuauggcccucccugagaagacaggauuuugcuauauagacuucgcaaaccuucucucugccugagagacugguacucagcuccuuccuuuuccagagccauuuuuagcaacuuccccaagcauucccaacucacuagucucccagcuggcccuuugccccacccugcucaacugggguuagcaucugaauaggcccacuugccccuuuuacauaggugaggucugcggggugaggauaggcucccaagaaaaagcagaucuuauggugaaccacauaggugaauuaccagccacuuuuaauauuucaaauggagggugagggaggaggaggagcaggagaauaaagcuagcuaaacaugaugauaugcccccaauauugaaguuguuuccuuuaguacauuaaucauuugcuuaauggaaauuugcuuuugugggggaggggagggcgacccaaaggugcucuuguaacugaacuuaucugagcugggaauuuauguugcaauguuccaauauuguguggggucaaccugauguagguuuaaaguuuugcaaacaaaacucuuuuauguucaucagaauucaagaauuagaaauguuacaguuugggauuguuuugagauguuucuuuaaugcacugcaagccuuucucacccuggaguugcuuacagccuuuaacucuucagccuucauuuucugcagcuguguggaagguuaaggaggaagaaagcugaaacuucaguguugguaagaaugagguuuuuugguuuuuuaauaaucuacauggauuuaccucaauuaucaguuauuauuauacugcucuucaagaagagggaagcuuuugagaggaaacugagcagaaaccauggugugaguaaagcaugucuccuaacugcuuaccuggaaggugaccuaucacaaaaaccaaaucacuaaaauaaaauuaagcuuccaggccagugaugucaugugcuggcucaacugcugcucuucucuaaaaaaucacccagcagagggaugagaugcucaaaugacaucuuuaauccccauguucaagaaugagagauggaauuucuuguucuguugugggguuuugacacuaaugacucuauuuccuauaacuugaugucccaaacuggagcagugggaucuaagacgaaaggcccagggcuagcagcccagguugcuucuagccauggucaaguggccuuaggucagacccaacaccccucugccucaguuucuucuaaaaugagaucgcugaaugagaugauccuauuuaucccuuucagcuccaaaugucuagauugauuagcuuaagaagccugggguuguccaauuugacucuacacuagugauuuaacccuaauggaacucccaaaaaacaucgaaaguugcucaaauaaaaagcaccagcuagguaucgcgccauugcacuccagcccggccuacagugugagacuccaucucaaaaaaaaaacaaaacaaaacaacaacaacaacaaaaaaccccgaaaaacaaaaaaagcaccagcuaggaagaaaucuguuuuguguuggcuucauguaaauuuugucaaaucugcuuuacaguugguugcaaaauggucucaaaaggcaguuuagagaaugcagaauuccacuguguccuuucccuaaacuggaaacacuuagccauccugagagucguauuuaguguguguuuuacguguguguguguguuccccaccuucugucccugaccuuggugucuaagaacaagcuuuucagagcaggagcaggcagcaagguugcaaguacugaccuaguacugcagcuuggagaggcuaaccacugugggggacggcagacugaugggaacauugguugagugaccacaagugcuguugaaaguuuuuugguaacaguuuuaaguguuuugguuaagcuagaccugaaaaaaaugguauagaagcuacagcuauuugagauaaaccaguuuucucaaccuuuguuuuuuucaugaucacuccccucuucgcuucuucagacauaugcuucuuacuugccccuccccaugacauuuuaauaccauggacauacagcuagaccccacugucuguuuaugcacugcaggaccuugucacagcuaagacuuguuugcgcaccgcaucccccaaaaccaguuuugccuccaucauacaugcaugggauaaacaaagcaagcauuucaaaaacaaaaaaaucugguucugucaaauuaagugauguagcacccauuuuuguuuuauaauuucuuucuuacauaucaaaaggccauaugugggggguggggggcauaaauuuuuuacugguauuuguuuucuuucccuuguuuaaaaaucucaugaguuuuuucaaacgccuccaauagcuaugcugguccaagcacuaguggccauuaauucacagggcagagaagccagaauaaacagccuagugacuuaguucucccaaggccaagagccugcaaugcggggccaccauuaccuguugacagugcucagccagcagaggcaggacucugccugcaacuauucccggguagaaauggggaggcugccuucccagcucccacugggcauagccuguguguuuauuuuuuguguuuauuuuaggguaaguauguuacaaauuagcagggcacauggcuaugagaaaggccaacauaaacccaggcagcagggacagaggguaaguggugacaguaaaguggggagagauuuaaggaagacaaaaggaaaagaagaauuugagggaucacagaaaaaaaggaagauguggguagauaagagaaccccugggaaggagcagaaaagaagauuuagaaauggggaagggggucacaaagccaggaaauuuggcgguuauaaagaaagucguuugaaggaauaaagagagucuugaagagagaaagguugagggcagcuucaaguaucugguggcuaaggggguuagaaccaggugcaucaagggacagacuucagcucaacauuaggaagggcauuuuuaaaagccaaauauggcauuggagggcuaccaaugaggcucacagauucgacaccauuaacaucacugucccccugagaguuucguacagaccugguccaaaaauuccaauuucauagguguggaguuuucauacaaguacuucaauugcuacacucaaagagaaagauuuaacaccuagaaaucuagcugucuagcuccaaggcuaaagcuuuggguuuugguucacagcaagguuggucuucaagguccccacucucaaacuugagggguccaaggggcacaggccaaagaccggcagccagcagaagaccacguuucuucuccccucaaccccaugugagagcugguuucugaguguccuggcuuaugucgcugucuuaauuagauuucauuaggaaaauuugcccuggguaauugagguuguucuagaaggugaaauauaccauuccccuuaaacaaugaugcccagaagcccccaggguggcuggaauucccacuaugaauugcagaaauuuuaagcagagcuuccacuaaagccaaauuuaccuuccgagauucccucuuuccccuccaacccccacuuuugccucucucuuaguugcuuucccauggugcuguucaucuuuucuggaauggccucuccuccccugaaauucuuugcugcaucaucagcuagucuggagaaggaauccacaaaugucuggacccacuguucaagcacagguggucagaggacaguggcaugccuuggcugaaacagaauuuggggcaccuuuugagaagguugcugagcuacagcuaauuagcugagugaaggggucugaacucacgaugggggcuuuuuaaucugagcauaucaaguauuuucauaaagacuuuuuccacuaccucuaauaucagccuugcaucugccucuaaccugguaucuugccucauccauuugaggcuuuuuuccuuuagcuggcauuugcuucaaacagccuggccacgcagaccccucugcagauagcaguaugcugcugccuccaccggccaaggcgggcagaggagagucugaagggaaaaggauggcagcagcaagucuugauugaaaaguaauuaauuguacagcuucaaagucuauuacuacucacucagcacucagaaaacauuugucacugggaggcugagaagcuucauaguugccuaaauucuuuucuaccuucucuuucugcuuuuacuuuuuccucaauugaaagaaacccacugacaaccaaugacaugaaugggcugcagagaaggcacuucugcaaacuucaccacccaccuccucccugcaaagccgcagaccaaaaggaaaaugacuaccaaaaaaauacuguuuuucgugguuucuguucccuucccuuucacccaccucccuucccucucucuacuuugccuucucuuuguuggcuacagggauaaacccagaaagcugacagguagcuaccuaaacuugagauaugccuuaugcuuuugguaaugaguaagaaucccagaauguaaguagaaacacaauuacucguugaauacauaugccaugaaagcaucaauagagaggugagacuguuugggaggcccagggcaucacgugcggcuuccaaggaacggggcuguaauggugcuguucagagagucaaugguaaagaaauacacacauucuuucuauuggggguuccauauuuucaaaacgccacuguuugccaccuguggcaccugggccauuuggcuuuccucagacaugcagaguuuaauggaagcaugagaaauucuucccaugccuuucuuaguacaucaagugcagacgcuauuauuuuuaaguagccaaguauacacaauuuucaaguaaaccaucccuggguuucgacagccaauccuguccuccccuacuugacacaucaucucacugcagcccuacacuccagcacacagccccucaugacaggggucaagacccuggcacacagcgucuauccaucccaacucggccuuuuuuuucaggcaccagccucuccugacuuccucuuccuuagcugcauaaacacauuaauagacuuuccuuccucaguccuaucacauauuuaucuuuucccaugauggcaauccauccagcacuggaaagcuauguuuaagguacuuugcuauuauacaauuauaauggcagauccuaaaaaagccccggcaagguuaggccccagacgaugcugcccacuaacauccagcacuggccaucucccuccagaucaaggccauguuucugucuugagcuagcaaaauuaucagccuucaggaggaucaccagacaagccaaccaaucaggccaaucaagguggaccccaguaaacccacuagccgaucacccccagcucuuacuauaccggauuccucaggucccuguggccuugcaggugccacaggugggucaacuccucgaacauuuggccacacuucuggggucccugaccccauuacugauguuucagcucuuagcuccacucaccuaaaggacuuagguuuuucagagucugguagccagucacuacagagaaauaacaggaguggaaaaaagggggaauaucaggguuaaauacugggauuuauucuuccuagucuuaauuuaucuuuaaauuaaggcaauuccuauuuaaaucuaaggguccuuucucagcuuauaguggugauuuucaacugggggagauuuugccccccagaggacauuuagcaaagucuggagacauuuuugguuguuaaaacuaaggggaugcuacuggcaucuaguggguagaggcuagggaugcugcucaacauccuacaaugcacagggcagucaccacaacaaagaauugccuggccccaaauaccaccagugcagaggcuaaaacaccaagucuagaugagaugugcugagugguucugaaaccccuuccucuggugugcucccaucucucccuucugaguccucccuacucacuccuggacugucucccuuuuuccuguccagugcgccaauuguucaagauucuauuaccaaauguauuucuccccuaaagaguuuucucugacuccauaaauucaucuuuguaaguacgauugccaauuugaaugugugaucuuuaucuuuuucugaacuucagaccuuuccucccagaaaaugggcugcaaaaaucuccaucccaacugcccaaaguuccuuaaucugccaugucuaaaaccaaaucagcacugccaccuugccagccccucccacugacuucccugucccacucccaguguuccauccaucugggugccacacuuuggcuccuccaucuuuugugucuuucuagcauaagagcugcuccaggaggauccuuugggaccccucuugagugccguccuucagccuuccugcuuccuucaccgugcuaggucucuccuuuaaacaucuccuuugugcauaaccccuuuccuuuguucucgaucaggaucauccuccaugcugcuucugcuuuuccuaaaaguaggcucaaauccucacuugcagaacaaaaaacuuucaacauccuuuccguuuccugccaaaauagccucaaaagugcuugcccucauacuccauggcauccucagagagauucuaucuaauuucuccuaacuuuucucccccugcuccccaagagccagccaagguggccaguuguguuuacccagccacgccccauguuuccuaccauuaaauccuuuguucguggugggcaaaccgucucccaucccccacuaccaccuucuauucauagccaaggcgucuauccuuccuuggaggcccauauaaaaagucauuuucuccagcaagacuuucaagguccccccagguggaguucuuuucuuccauuuguaugcugcucuacucuccaggaugaggaacugguauuugucuaacuuguuaaauuuguuuuagucaccuccaugcaugugcuccccuggcaaagcucaugauaucagaaagaaugaacaaaggggucccacagacccaugagggugucgaacagagacccugaacccguuccucgacaaaugguacuuugggggugagcgcgaggccugacgaaagcaaacaaccccuuuggagcacccauggcagccucccuggggcuccaaccccaaugucuacugaccuuccacuugugcaggcucagcaucccuggggccucaacuccuuauccauccugggcugcuccucgcaguaagcccucuccuugggguccuggcccucuaccucccagcccuggaaaucuucuugcuccucaccuugcccggcaguggcaccccguuggcuggguuagccugccgccaucaacacacccaaggguuggccccugggaccccaccucucccccgaggcucggcaaccuguggcaugaggaagagugaccccacggcgcuagcgguccucguggucuuccaggccuagccgccauacacccgccccccaccggcuuccaaccaccccagcagcaccucuucgggcguuccaacgcggcgcccccuauuggaccucccacccauauccgguuuccggucugacgcccccugcucauucgccaggcagccuugauuggcaugaccccugcccaauggcugacccggcgcuggggucggaggggagugaguugguguugggacccaguugggccauucaguggaugcucaagugguuaagccgucuugcguggguguaguuggccaaaguuugaaucaaaguucaguguugacaucuggaaguguguagacccauagagcuaaagcgauauaucuuugggggaucccaaacguuucccaggguccaacuguguucgccuccuuccgugcugcguggccacauggaugguggaugcaggggugcaaggaugcacggugccugugguacccuggcucuaagagggaugcauuagacuaaacgggaucgcaacuugcggugguucgcccgccugcagcucuuauacagcagcccgugccgugcgcccugcuugcugcagcccgcccuguguaacucauccagccuccccucccccaggguucugcaggucagaugacccccugccuccugcccaguugcucugugccuagacguggcucgccaaucugucucacuggugagaccgaccugaugcgcaccugccgaguuuuaugugacccccuuacagcagcuuuucucccggguuccaaucccucugcagaccccagaccagagcauagcaugugcacacaucaaggccaccagguggugugggcauuuaccuuuggcuagcucugagcucaccgcagcaugguagcgggagcgcagcugcgcgggcaaccgccggguuuguggccgguuggcgggcucagugccgccucagugggcucuagcaguagaaaaguaaagcgacuacccuaagauacccagagcgagaggagaggggcuagaagggugcuggaggcaggcuguaguggggcuaaaggagcugacugaccagcgcugcggccggugcccgaagcagcgagcagcgcaccucagcuccgguugccgcgcggcaugguauuuaucuguggguucagugcgcacagcguuguccagucucgaaaccacccuaaaccggcauuaaaccccaaccaaaauccccuuuaacccuucccuagaacagcaggaccugcgaaacucugaggccgcuuugugagguccuccucugcgcagcacgccccccaccccucucuuggugccgccgcagcuacucccuagggggcuuugcucuuggugguacgcacccgagaccuucuuauuccccugcgucaccauccacauaaacaagagagcacccugcuugcgccgcugugggccacugcggagaccccuagagugugaugggggugggggcuguuaaagugcuuuaccggagccaaccucagcaagugacaaacaaaagcagcaaaaaguacacccaaggcauuuaaaaaacaaauugcgugcuugcauacucggcauccccucucccucgccucucucugcuucuuuggugggcucacgaccaccugucgcaucccuacgcgugccugcgccccuucccaggcaccaaaagccuugcgcuccggacuaggggcuugagauccggggcugccuggaggcugggggcuaugacucagaguuucagggguauccuggggugaugaaauccuucuucaguccccccucccccgaggagucgguuggguuggggagggaggguuucagcuccuguacuccagcguuccgaggcccacgucuugcgucacgugucccgcaacgcaggagcgcuuucucuggccagcggagaagcgaggagaaagacuccaaaucagucagggagaggaguggaaggagccaaaacgucccugcgaggccugcgcucaccagcccccuuacccaaagucccgggccccuggcgccaggagcaggcuccuggagccggagccagcucggcacuggaaccggcguccucugguggcagagagagagcgcuacuggcgauuuucggaccgaaucggcacgcucgucagauccaagcaggcgggacuggccuggagcaaaaagaaagagagaggagggcguaaggauagaccaaggaagaggggcuggggggcagccugggggcaugaaaaguggccaggaaggagccaagacuccaccagcaacaauugaguugcuucagccucagucuaggguuccuuccaggccuugaaccccccaaccucacaaggguuggaaagugaggccggugaacuuuccagcugguacuuugauuuuaaaauaauaauaauaauuuuuucacccuaguucgguugggugcuccaucuuacggagccccaaacuuauuuugagaggccgccaccguguuaugggcgugcgcaacugccucuacggcaauaauaugucaggacaacgcgauauccccccugaaaucggggaacagcccgagcaaccaccuuuggaggccccaggggcagcugcccccggugcugggccuagcccagccgaagagauggagaccgaaccgccucacaacgagcccauccccgucgagaaugauggcgaggccuguggacccccagaggucuccagacccaacuuucagguccucaacccggcauucagggaagcuggagcccauggaagcuacagcccaccuccugaggaagcaaugcccuucgaggcugaacagcccagcuugggaggcuucuggccuacacuggagcagccuggauuccccagugggguccaugcaggccuugaggccuucggcccagcacucauggagcccggagccuucaguggugccagaccaggccugggaggauacagcccuccaccagaagaagcuaugcccuuugaguuugaccagccugcccagagaggcugcagucaacuucucuuacaggucccagaccuugcuccaggaggcccaggugcugcagggguccccggagcuccucccgaggagccccaagcccucaggccugcaaaggcuggcuccagaggaggcuacagcccucccccugaggagacuaugccauuugagcuugauggagaaggauuuggggacgacagcccacccccggggcuuucccgaguuaucgcacaagucgacggcagcagccaguucgcggcagucgcggccucgagugcgguccgccucacucccgccgcgaacgcgccuccccucugggucccaggcgccaucggcagcccaucccaagaggcugucagaccuccuucuaacuucacgggcagcagccccuggauggagaucuccggacccccguucgagauuggcagcgcccccgcuggggucgacgacacucccgucaacauggacagccccccaaucgcgcuugacggcccgcccaucaaggucuccggagccccagauaagagagagcgagcagagagacccccaguugaggaggaagcagcagagauggaaggagccgcugaugccgcggagggaggaaaaguacccucuccgggguacggauccccugccgccggggcagccucagcggauaccgcugccagggcagccccugcagccccagccgauccugacuccggggcaaccccagaagaucccgacuccgggacagcaccagccgauccugacuccggggcauucgcagccgaucccgacuccggggcagccccugccgccccagccgaucccgacuccggggcggccccugacgccccagccgaucccgacuccggggcggccccugacgccccagccgauccagaugccggggcggccccugaggcucccgccgccccugcggcugcugagacccgggcagcccaugucgccccagcugcgccagacgcaggggcucccacugccccagccgcuucugccacccgggcagcccaaguccgccgggcggccucugcagccccugccuccggggccagacgcaagauccaucucagaccccccagccccgagauccaggcugccgauccgccuacuccgcggccuacucgcgcgucugccuggcggggcaaguccgagagcagccgcggccgccgcguguacuacgaugaagggguggccagcagcgacgaugacuccagcggagacgaguccgacgaugggaccuccggaugccuccgcugguuucagcaucggcgaaaucgccgccgccgaaagccccagcgcaacuuacuccgcaacuuucucgugcaagccuucgggggcugcuucggucgaucugagaguccccagcccaaagccucgcgcucucucaaggucaagaagguaccccuggcggagaagcgcagacagaugcgcaaagaagcccuggagaagcgggcccagaagcgcgcagagaagaaacgcaguaagcucaucgacaaacaacuccaggacgaaaagaugggcuacauguguacgcaccgccugcugcuucuagguaaugcggcggacucugccugcgggcagcagggccgccggggaaccggggaggggguggcagggcugccugguggggcuaggggcuccgcagugggaggaggggguccagccaaaggcgggaagaacuugcuagaaaguuccagggagggacccuaacugcccugggagcgggaggggaucuuugguggauucggguggccgaaguauaugcccuccagggagaaaaguggugccgagcgacacugagggucguuuccggcuggacaggccagcgccagcaaccguaagcuggacaggcaggggcuucaggugagccaggaacugccggggaggggccccggggccccgggacuccccuggcuaggcuggugggguccacggugggcuggggucauuggggaaggcgcgccccgccucgccuggcacggcugcuuggacucagacagcuugucguugguguguguugguguccauauucuguguucgccugugcaugauacgcugaaguguccccuguuccuaucccggcacccccaaauuacccgccgacuguguacuuguacuugggaacgggcuguguugugguuugcgccauggcccgggcaaaaaacuuucgcuguucgcacacucuggugguaccugcgcccgggcgcucugcggcaagcggugcggaggacacgcggggaagguggcggggccucccgggaaauaagcggggcccuuggccugggggagcggggaaucgcuuuucgccggccuccgcguaaccuuguuucuguaugucuuucucucuuuuuccuuuugcgcuaagcguuuccucacuucucauucguucgccaaacccucccgccuuuacaguugaaaaaccagacacacagguaucuggggcgcccggggcugcacaccucaguucgguauucugcacacacacagcucgccuggucgggggaugggggaaaggggaaacacaaccugcuguaggcaaguccggaucccaaaccacuugggggcugguuccaagggggugggcguggcuguguuuaaaaaauaugaaauaauuuuucuuccuagcgaagagcccgagguaagccaaucauuuuuacaaagaguacaguaggaggggcuugguuuaaaaagauggggguuauguguugugaguggaaugucaccuuuguguuugaaaugcaacuaaaauaaaaguuuucaaaaaaugcucugaguguauuugaaguguguggacaaaguauggcaaaaccgugaauaugacuugugaaaacaaguaaauguuugcaugugaauuuuuucaggcagcuuuagcugggggcaaagaggcuugucaaagguaaggucuucugcaaauuggcucuggauacaaaaaauauauaaagguauuuugauuacagaaguuaaaaaucaugauauucuugucaggaggguauuuugguggccuucuaccuucccccuccuccucugcucacauuuccccaccucucggugcccuccccucuccaggaucccccuccucaccccacagcaagacccucuccuguaucucccagucuuucccuggccauucccaguuccccacccuccccccagccccccaagacuucuuaacuucaaaucuggggcauuaaauauuuuugccacauuuaaacaaagcaucaauuagcaauggucugaauaugugguuuaaaugaaaacuuccaaacaaacuucacaagcuuaauuuuuacauuuuauucucuaagacuuucucuaagaccuuccaagggauuucaagaucacaguuuuuaaggcugcgcuacauuuguuaaauauguuagaaugugugaugguuuuuuauuaauggcauuauuggcauauaacugugcuauugugauguggcucucacaaaucacaauuuuaaaugugaggaucauuuuguguaugcccauccagguagaucaugacauugucauuuaccuaaagacauauaauauggucguuguuuuaaauuucaaaugucucaacuacacuaaagcuaccaaacauuaaaugacaaugcacugguuucccugcagacaacugauuuugccauaacagacccauuucaauauuccaagcacagcucugggaagcaaaccuguagauugggggugggaggacauaaaugcauacagacaggagacccaagugacagugugcaccugaccccuaauugucaaauuggugaugugccuuacaugcggggccucaguugccuccuuugugaaaugaagcuuuccuagcagaucuccacuaaggaaugcuuuugcaccaugauuugagucuucuauucuuccuggaggugggggguggaggagacacagucuacuuacaucaggacuggagacuuauaccauagauugugcagccaucaauccugcagcaaacuguccauguuugggaccagucuuaagaauauuagaaguuuccuuugucuccccuuauuuugucaccaggaguaaaaauuaacuuuaagaaaaggaaauuugcuggggucaccuuguaccuuguccuggcuuuguucucgggugcugguagccaaacaccuuuggaugcagcauaguccagaaggugggcuggcaaaccaugggccaugucuaacauaagccugaaauaugauagccaguguuagcugcuagcugaaacuguaccacugcaguuugucaaagcaggcuacaguuuuugaccaggcuuccuuuugcagaggugacguaccucuucuggaccugaauuauugaugggggacagggagaggaggaaggaugaggacuuacucacauguaggacaagacuuuuuacuaacuuuuuagucccaacauauaaaacaagacauccauacaucccuaccacugaaaaugcagaucaaauggcuguccuuugauaugguugcuaauuugugacaugcagauucaucuguugcuugaaaaaauguauguucaugugcuuauccuuucuguuuuuauugccgggacaauuuaaucucauuacagggaauccuaagaaaucaaagagagagagagagagagaaagauagauagaaaucaguaauaugauuaaaauucuaaaauaucuaaagaguucuuuuuaaagaagccuuuuucuuacucaacacuauccaccaauagacuguuuccauguuucuguuacguuuuuaaauaauuuugguggcuuaaacauuuuuuaaaacuucauuuaggugugauuuccuccuuaagaacugaauggggcuaauagaucagaguuucuuaguaucugccacauuuauuaaaauuguguaggcaaaugcuauauauaauaauggcuauucugcuaugaugcuuuauuuauacagugaaucacaauuaauuguaugauuauuuaugccaccaagugcaacaguaugcauuguauuccaucuugcagaagcaccuuuuuauuuuucuuuucucucucucucucucucuuuuuuaacauacagccauuuuuuuauauucuaaaugccuccacugagcuuuuggugugguaggaaggacauggcuuaucaggccacaaaauuuuggaguccagauagauuuauuauuuucucuuuucagucuccuaguaagauucaugcuucucaaagucugaaauucuaccuugguuuuaauucuuacagauuucucucaaaaaaaauuuucccauauagguagauuaauguuuaaaauuuacccccauuauuuacaauggaaaacugguuuuaagcaaaaagaauugggggucauccccuuacuguauguauccuccuaacuugaaaaggaaaaucucacugcucucaguaugauuaguaaccaguaauaauaauaacacauucugauuacauuuuuuguuuguuugauuugaaacaaagucucccucugucacccaggcuggagugcaauggcaggauuucugcucacugcaaccucugccucccagauucaagcaauucaccugccucagucuccagaguagcugggauuacaagcgugugccaccaugccuggcuaauuguuuguauuuuuaguagagaugggguuucaccauguuguucaagcuggucucgaacuccugaccucaagugaucuacccagccucccaaaguacugggauuacaggcaugagccacugugccuggccacauuuuacauuuuuuaaagccuuucaucuagucauauuugucucuugaaacaguccugggcaauaaaaacgugauagggccccauuucauaggcaaauaaaccaaaagcucagagauuaaauaucagacacuuuuuuuuuuuuuuuugagaaggagucucgcucuaucgcccaggcuggagugcgauggugugauuuuggcucacuacaaccucugccuccuggguucaagcgauucuccugccucagccuccugaguagcuaggauuacaggugcaugcaccaugcccggcuaauuuuuguauuguuaguagagaugggguuucaccauguuggucaggcuggucucaaacuccugaccucgugauccgcccgccucagccucccaaaguucugggauuacaggcaugagccaucgcgcccggccauaaggcacuuuuacucaaagacugcaagguagguaaaggaucacaaauuucaaauucagauaaugcuuaccagaaaugugaugauaagcuauaaagcauuauuuaaauguaaagcaugauuauucuaaguauacuaugugcucuuaaaaucccuugccaaaugacacgugucgaguagucugcuacuuucugaauuauagcaaaacgcacagaucccugguuauaaauguccauugaguauacaugaaacaugagcucccccauuucugagauggcugucauugcuuugguaauauuucauuuacacauuugcuuuaacucaucugccagcacugcaacguugcagucuuaguuuguugggcuacuguuuuccuuuuuuuuuuuuuaaaugcagguuuuuuuaaaaguuuuuugguuuuuuuguuuuguuuuguuuuguuuuuuugcagggucuaaagcuuuucuucuuguuuagguuuccacuaaauaauaauuaaucauuauaauaauaaaaugcaguuacuuuucugcauagcucuauuauaaguauagcguuagaauguuuagaauccuggucuggaucucaugaucuuaucaaaauaacucugcuccauagucuuuguagugauuuuuuuuuaaaaguaugccuuacuucuaguccaggcuaauuuccauuuagcaagagucagugcguggucuuagaaaucaccuuugacuuuuaugcaggaagguuaguuguuguuguuguuguuuuuaagauggagucucgcucugucaccuaggcuggagugcagugguacuaucucggcucacugcaacuucugccucccaguucaagggauucuccugccucagccucucgaauagcugggauuacagacaugcaccaccacaccuggauaauuuuuuguauuuuuaguagagaugggguuucaccauguuggccaggauggucuggaaauccugaccucaggugaucugcccaccuuggccucccaaagugcugggauuacaggcaugagccaccgugcccagccaggaagguuaguauuaagcaaaacauaaauuuauuuuuagagaagguaaccuagauuugaaauucccaaaggcagccaugcuccuucuucuuuuuagaguuaguuuuuccuccaaauaaaacuuacccccaaccccagcaaaauuguggcucuucaaaugccucuaaauaacucucaggagacacaucaguagugaacaacaauucguuucuacacuucuugguuucuuuuagcuguaguagcaaaugugagguuccucucaaacccacucacgccauuugcccauuuaaaaaucaaauuucucaggaggaguagcaauuuucaagagagaagggacagggccaauugaugucacaagguccucaccaucaauuaagacaagucaacggagggaacuaaaagcacugggcagccuaauugaccaucucugaccccuuggaauagggacuaggagacucuggcccuaacacgcaccuucacagauuucauuaaauuagacugaauggagcuuuuguucccaucagauuccuguucuggccuguggucacccuaagcauaagaucauguucucuuuaggaaggaagaggagaauggaccugagccucucuuugggaguucugcugaaaagucugcaaguccuaaguggccuuuaugcaauuuagagacuggaaggaaggcacgaauauaaauugggggaaagaagccccugaacaaaggagaggagagguauuucaaaaagaggauauauucuuuuuuuuauugagacggaguuuugcucuuguugcgcaggcuggagugcaguggugcaaucuugucucacugcaaccuccgccucccggguucaagcgauucuccugccucagccucccgaguagcugggauuacaggcaugcacuaccacgccccacuaauuuuguauuuuuuguagagacgggguuucaccauguuggucaggcgggucucgaacuccugaccucagaugaucugcccgccucagccacccaaagugcugggauuacaggugugagccauggcaccuggccuuuuuuucuuaauucccccaaaaagagggccagcuacuagaagcaguuacaauuugagaaaucuggagucuuuuuuaaaggguaacauguucaacccagugcuuggcacauauaaguaccccaaaacauguuuuggguuuuuuggguucuuuuuguuguuuuuuguuuuuugagacagggucucacucugucgcccaagcuggaguacaguggcaugaucucggcucacugcaaccucugccucccggguucaagugauucuccugucucagccuccccaguagcugggauuacaggugccugccagcaugcccagcuaacuuuuauauuuuuuaguagagaugggauuucaccauguuggccaggcuggucuugaacuccugaccucaggugaucugcccaccuuggccucccaaagugcugagauuacaggugugagccaccauaccaagccucgacuuuuaauuuuagaaauuuauuuuccuccuagauuuuuuuuuuucucccugcuccaagugagguuuuggguuugguuaguuuucuguuguugcuggguuuuuuuuuuguuugugucuuuguuuuucuguuuuuugcauuucucauuagacuauuaacauguaaguucuaaaagugccagccaucucauucugucuuucugucuccaccuuucagaguacauucuuuguuuacauuuuguaaauaaaggucaacucaagcaguagacgaaugccaccuugccacauuuauaauugugugaagucacucucaggugaaugaugugccagagagagaugaggagauaacuuacuuuuugacuuguccuguaaaagugucaccugucaccccugccuauccagcucccccuucuguuuugauuagcuccuaacuauaaaucaacucaauaccgaggcugagcucaaggaccugagcuuggauuguucuaugguuauuacacaugaaaaaaaaaaaaaaaagaaagaaagaaaauguguuuaguuuccuuuccaacagccagauggugaaccaggccagcucaugggaauugaagaugaagagaccuccaagaaagagguagggaacaacacaacaaaacaauguuugacuuuucauuauguugaucgucacaugcucuuugagcacacacgagucacacaccuuucaaguuagaaucaguggagcgcuuuucuacaugcaacaacugggagcuaugcuaugggaagaauguuaggcaacugaucugugacagggcaauggaaauuaagggagugugccucuguuguacuuccuuagaguaaaaucccaaauugcauugcagaguaauuuguuaaaccucaggaguauuuaaauucaggaguauuuugacuuguggaguucugcccacagaacugcacauuggaucuuacuaaauguuuuuuaaugauucaauuuggggcgaggagagagguauaaagguaguauaaauuguuauccaaucucaaauuuauuaugagucagucaauguuuccgacauugucacacacacacugugugugggacagaguaaguacuuuuaacuuccuuuaaugaguugauaaugggaaggaaaaaaaucucuguacuacuuucuaaagagugucacaguugagcuuucacaagcucagugucaccacugagugagcaucgauucuuacaaggaaauuaagacuugggcugcaagagccucgccucucucuucugauuuaucuggcucuugccucucccccuccaucaaaagaccacacuaucucucuccucuuuuccauuugaacgauuuugccauucaucaaacugauugcuaaugugcaaauuacaugaugguauuuuuacagggaaccugcauucagguaaguuugaagcugugggauauuugagggggaaaaaaugaauaaugcuuaucaugauccacagaaacuaaagucaggcauuguaggacaguccagaacccaagaagggccauggacaggacccuuccaaaggaaagagaaucucgugucccguguguuagcgaguauccauuccagcucccccagggcucugggacccacauaucugugccuccauuuuucuaggguuguaguagcuggugguccaguugaaaaaaaugaaaacaggaaaccugucaagaauagauaguguuauuuaggaaguauauagguacuuacauuacugagaccacuugaacacauccuuuuaaauagauaccuuuuuuaaaaucuaugguuauguaacaucuguguccgagggauuuaagcagaaagcccuguggguuucucuuuucaaaagacagaccuuauuuauaaucagccccucgauuuuuuugggggggccuucaugggcuuuugaaaucuuaggaaguguccauccuaauuccuuauagcugcucuuucuguggcucuacuagggccuucaagaugcugaauucacuuauuaauuaaaucauugacgucauucaggggguuccuuuugcccacugccccccaacaugggaauuuuuaaaugacuggcucuagaagggcccaaagauggugaaggugaauugauauuucaggugaccacuagauggugagacaguauaaggcagaaaacagguggcacgugucugugaaaaugagagggauggccagggcuggcaaaggcaaagaagggucccccuugacuuuuaaugccagcccccaccccaggacagaccuuggauucaaauaggccccaaagcuuuagccagaccagcuuuuuacuuuuacgcugugacuucuccuaguuagcuauaugccaggauuuuagaagcauuuuggggggcucagucuaacagagggguccuccaaguggcuuuauugacauuuuuucauggggugguuguccuaugcacugugggauguguagcagcaucucugaccccuaccuaccagacacacacacacacacacacacacacacaaacacacacgcacgcacacucucucucucucucucugacaaccaaaacuguuucuagucauugccaaaugucaccccucauugauaacuacugcccuaacaucaucaguaucaaauucuggggacaguucaagaucauacauacuguaacuugcguaucuuaaaaauauauauauuggggcugggcgcgguggcucacgccuguaauccuagcacuuugggaggccaaggugggcagaucaccugaggucaagaguuccagaccagccuggccacguggugaaaccccaucuuuacugagaauacaaaaaauuagccgggcgugguggcgggcaccuauaaucccagcuacucaggaggcugaggcaggagaaucgcuugaacccgggaggcagagguugcagugagccaagauggcaccauugcacuccagccugggcaacaagagcaaaacuccaucucaaaaaauauauauauacacauauauuuuauauuauauauauaucauauauaauacaaaauauauauaauaugauauaucauauaauauauacauauauaauauauaucaucuauaauauaaaauacuuuuuuuuuuccagagaaaaguuuguccacugcaguuacuuuuuuuuuugagauggaguuucacucuugucgcccaggcuggagugcaauggcaugaucucagaugacugcaaccucugccuccugaguucaagugacucuccugucucagccuccuaguagcugggauuacaggcaugagccaccguguccaacccugcagaaguaauuucuagaaaucucagagaagaaagugacccagaugacccuaacuagaauagaaaaggaaauuauuucagggaaguaaauagugagcugacuuugauuaaccaagucagucccauagcuaggcuaaaucaaugcuuaaauagccuuuacccuuaaaugaucacaucuuccacuuaggguuucuuaaggaugccuuuuccuguagcaggcuaggaauucucucucugacuggugcacacucaauuaauucacucugcauuguagagaaggaugccaagacacgaaggacccaucugucagauggcugcugacaacguaucagcucuaggguggcaggagccccacuuuauauguguuccccaaaacaacagcagagccuuuaacugauaauguguacacaccagcaagcagugugugggccccaguugcugggucucccuagucucaggcccauagagaaccagccuacugcauggaggugaccuauaaacuuucagcaacugaucuuucaagacagacaguuagauugcaggagagaggggcaguggaaggaacggcucugaaugacuggacugagaaagagcauaagaucucucaggaauaauacauagcuaagccaauagaaguaacaauccaaggacauuuccuggucaagagucuugcgcuuggucucugauaaaguggacacccccuucuccauccuagggcagacucuguaaccauuauuucuuggaauaaucauaauaggacuaaauugugaucuuaauuuuaaacaguggucuaagccccuaauuugcaucugaccagccucucucaaguaaccauuauggaaggggacuuuauaacuucuuuguuauauuuugacauaacacauuuacauuuuugcccccauuuggucuuucuauagaguuuucagauuguaacaucugaauucaucucaucaaguuuucaaauugaaacaucugauuguaacaacugaaacagauucauuagggaucuaauuuuuucaaacaaaggagauuuuuuucuuuuuuuuuuuucccuagggaguuucaaauuuaugaccucugacuucauugcaaaggccagaaaaauaaauaaauagauagacaaugaccacucuccacuccagacaugcagguguauuucaacacuuuagcuuuuacuaucaggauuucuuuaggggaagguguagaaauauauugguaguuugauaaauuauauaucagacauguaaaauuuaaaguaucauuugaaaucaaaacuugucugaagacuagcuuuuuaugucacaaguucagcuaagcaaaguguccccuaacuauaaaaccuccuuacugcagaauccuagaaauuaccaaaggcaagcuucuugaauguugauuuugaaauuuugccugcgaaagugcaacaucuuuccaagcaaaugcuuagaagacucagggcagaacccaaaaacaaaugccagacguuaggggaaaauuuuuaaaaguuggauugccagaaaacuucuagcuauuuauaauuaagcauuuuuagcugcuaaaaggaagcacauuagaucauuuuguuuugcaaaacaaauggccaguguggguuuuaggauggacacucccaggagggcuccccuuucugagugggagucuuuggaaauguuccugaugggauccagucauucuggagcgcucuuacgaaaucguucauccuagggcaguuugguguuugugagcuuacagcguuuacuccuugcugucuucuaccauaggucugaucugaugggggaggcagugggcagaggagcuccagcucuuugggaggguccuagaauaguacaaacagcacuggguuagaaguuggggguucucauuccugggaccuugguugauuauagaacuuuauucuaggauuccaugaauuugccaagcugacaucgggaaaaggcuaaaguuugauucuugaaaguauugacaaggccccauuuaggaaugauucugccaaguauuccugggguccugccauggucaggagagcaccuuaaauuugaugaguugucagggaagaagcagaggguaucucuguguucagcuuuauguaugagaaagucaagacacaagaugggggcaggacagggacagcuugagaaaggaggcuugagauugagacuuggaacucaggugccagggaugaauccaaaaggcuugcaggcaucucagccucagacuuaagcuaacauauagcagauaguggacaccucuccuguuucuuucuuucuuuuuuuuuuuuuuuugagauggagucuugcucugucacccaggcuggagugaaguggcaugaucuuggcucacugcaaccuccaccucccagguucaagcaauucuccugccucagcuuccugaguagcugguacuacaggcgcacgccaccacacauagcuaauuauguauuuuuaguagugaugggguucuccauguuggucaggcuggucucaaacucccgaucucaggugaucccccugccucagccucccaaagugcugggauuacaggcgugagccaccgugcccugccaauauuugucuuuuuaguagagaugggguuucaccauguuagccaggcuggucuccaacuccugacuucagaugauccgcccaccuuggccucccaaagugcugggauuacaggcgugaaccaccgcagccagcuuuuuuuuuuuuucuggcccugcaaucuugauuccccagaguuagggucugauuucagauguuaaggcaggcucaaaguggggcaucugcucgccacaagaaggugagaggucagaaagaagaagcaagaccauuagggcugccuuaguugaagaaagggggcucaucucucauuuucucagaaguuucacaauccagaaaggggagaacggaaagcagccuccuaaggaguucucgaauuucuuucucacuuuuccuuuguuuucucgcucucucacucucuucuaagauuuauuuuuaaaugggguucuuauuuuggggggacuuucugagcaggaacuaccuuuuuuuuggagggaaauaaaugagaacacaaauuauucagggcugggaaguggaaacaaugaaagaaagcaaggcuacucagaaccggcuggcagauggcgcucggcuuuuacgauugacagccuggcuuucaaaaauucacccuugcgccggcgccuaaggcagaacccgcaucccccucccuaaauccuccuucccaaggacacggccccugccccuaaggcugaggaauguuuuuaaaagguuucaguugagcaauugacaucuaaggacaaaucccggcaacuuuuaacgaguggaucugaagaucuuagccaaggcaggaaagcacacgaucagguaaccuccagauucaccgcccuggugccccgguucuccugggaacugguccugagaucuuggacaaaucccugguucuaguuuuucucaauugaaaaaacaggagggaugucuuucucacuuuaaaacuuauuuaauuaucuuauaaaguuucaauagaugagguaugccaacccccuauccaacacaaauuuuuuuaaaugucuguuccaaaauggcagauuguauaggaaaucaaaugguagggcccucuguuguccuuugguaaauaauuaauaguuucugggucccaaucaccgggagaaucuuugugggagcagaguuuggugguaaacucuuucacaccucaaucaagggcuagaaaagagguucauaggugagcagagcuccaguuuccaccagggaaaucuaaggggccuaccuggagaaguuagcauuuaagacaauauggagagaugaaguagaauuugaggugcauggucaaugauuguuuacagagaagggacuugcuagggauacaucauugcuuuuccauucaugcaaguaucauuguguuuuucaggaucucugagaccucagggcuaguuuuaaguucuuccccuccucaaccccucuccacuucucagugcuucacggcacacuggggcauucucacuagcgaagguguccucucuaaggaugggaccccuacuguccaucucaggcucagcacugccuuggggcaggccacuucuggcuucuuuaggccucguuuccacgggaggggaagcuggguccgauggugucugggucaaauuccuugguuccaagaacagguaccguugccauucccuuccauuucugcccccugcaccaccccacccagcagcuggaaaaugaugaggucaucuauuugagaagggccacacaggccucccacacaaggaccuacaaaguccuccaaugggaauuuauuucuuucugaucaaauuuacccuccauaccccauucauauacacauucuuucuccccucucucuuaagauuguaaaguuaaagaaacugaauacacaggguugauuuaagguaaacgucccucccacccaucuauuuaaaaaauuuucuuuuacuugauaacuuuccuacaacaugauucucuuaugcccauauuccucugaggauucuuuaaagcuuuucuugcacuuucuccuccucacagucccugacuucuagcccugagugguggcugagggcaggugacccuguagaccguggggaacagaggaggccagggcagguggcugccucuuuccaaccuuuccugggccaugggagcuccuccccaccagaggucagcagagagcucagaauggcugggucugcucucagaaauugggaucuuggaauucucuagaugaaauguaggaugcccaaauggaaaaaaagccccauguuuccaggguguuuugguuggggcucucauccugucuugggucccggggaccuuacuuuuaacaccaauacagccauucugugcuuuucucaggggaggggugguuggggguuuggucuguuuauuugguggcuuucuuggucagucuucucccugcgccagacgcacaaaucccucccuuagagggaaccacacccucuuagaacucucccuucuggggcccaacugcccacuuucgcuucccacaugacauggaacccacaucccacacuuggccgggcgccuuuucuucuaguuguauuuauuguuaaaaugacaucauaauauuacaggaaauccccccagccuacccucacccugcugugauuuuacugaucauuaucucccccuguucuuuacucagguguaugcauaguuuugagagggcaugaaucauggugugcaguuucauauuaaucccccugcuccacaaacacacacuacaggacaguuuccuuagagcucuuccauguucgccaucguccuuccacaguucuuucacuuguucaguccuuucgcuagcggggaagagcagggaaagaauugagguucccucccuuuguuuuuccuucucugaucuuuugaaaucccgggguccuugugaacgacucagaaauuaaaaccaauucccuuuggccaguuguuuauuguugaaagagagagacaaagagaaauuaaggugcaaacggaaggaaagaaguaaauagagauuaaauuuaaaaauuugaaagggagcagugguucacgccuguaaucccagcacuuugggaggccgaggugggcagaucaccugaggucaggaguucaagaccagccugacuaacauggagaaacaucaucucuacuaaaaauacaaaauuagcugggcaugguggcgcaugccuguaauucuagcuacucgggaggcugagacaggagaaucgcuugaacccgggaggcaggguuugcagugagccgagauugugccauugcacuccauccugggcaacaagaaugauacuccgucgaaaaaaaaaaaaaaaacaaacaacaaaaaaaaaaccaaaaaaauuaaaagggagagagaggaggaaaaaagagggaaaggaaagagagaaggaaggaagaaggaagggagggaggagggagggggagaaaagaaaagaaaggaaaagaaaaaagagaagaaaagaaaaaagaaaagagugccuuugccaaguuuagcucuaagcaccaaaugggguccuugcccucuaggaacuucuaguccagaacagaggagaggaucagguugcaagugauuauccuucuaccaggcaggggguggagcgcugccaaggaggguguggcuggcacagcugaggggccaggcuggcuagaccggacaggaguacggggaggagaggcagguucacaauccaggcuggggcauccucuccuccccaucucacugccccaugaggucccuuguucguucaagugccaaccagaagagcugggacagaggccucucuugugugccaagacgggggccaccaccacccucugagcucugaccacugcccucucaccucuuauugcuuucccaaguguuuaccuccugauucuaaaacgaugguccaauuuuuguuuuauuuuaaaguuaggaacacacugcauguagcacacuucauggagcacaaguguuuucacaugccuuaucccacuaagugguuuuguuuuguuuuagaaagucuggcacacagagaaccuucuaguucuuuaaaaaaaaaaaucauaaauuuuuaaauuugauaauuauccagaacaaaacaaagcaaacccuaagguuaaaagugagcauccuauaaguuaaguauagaucuuugauguuggggaaaccuuugaauuuuacaaaucgauguccuugagaauuggguuccagccagacccacuguaggcauuguuuucuuuuuuucuuuuuccuuccuuccucccuuccuuccuuucuuccucccauucccccuccccacuuugaaaaacaaguuuuauucucuuggguuauguucauuagagagggaagacaauucuguucagcaaggaaaggugaggggaagagaaaaggggggaauucagccagaggagaacagggacaagguugauugcucugugcuggggugaggguggggggcagagagagaacaucacagccagaugcaaaucacaagagcagaccuucagcuuccuggcauugguggggaaaauauuccgucagcugccuuucuauguccugggcuucauucaucagcucaagagaaaaaaaauaaaaucaaaauuucauccuaauuuguugugguuggaccccauucucccacauuuuggccuucuuguaaagcacaaccacaaaggcagaaguggcuuccugggcugaccugccucucaguucauucucaaggcguuagccucaucccaucaggaggaguucagacucuccccaagcaccaagaguuagaaauguguugcuaauugauuugagcuaaauuuguguugcuuugagacuuagcaaaauggcugauuaggggccaguguuggggaaaauaauugcugaucuaauagcuaugaaaaggaacucauucacaaauauguuuauaaaaugggccuucugugacauuuuggaauugucagggaguuaggggucacggugguucuucaggaagaaagaaauguuguugggaaauguuuaguggaaauuuagcauaaaaugacaugccuaauuuaagaaaacaguuaaauccaucaugguuccaagugaaaacaguugucacaaauuaauuuuucaaauguuugacuauuggcaggucugagguuuacucaucuguagguuauguccaacuuggcaaaagcauggaauccugcccaguccuugguacacagggacuagcacauguacccauuuuuucucacugauaaguuauuuccuaauuuuuugguuaacuugaaggucgaaauagccuuacuccuuuuugucugucuaguagcaucucuaagcuugcaguagcugcucacgugucugccacgccccuuagaaggacgaauccuugccuggucggugaguuugccucaauucgggcauuuucauuuguucauucauucgauauacauguauugagugccaaauaugugcccuuccccguggggaagacaaaaguaugagacacugcuacucccuugauggaaucaaaacaaacccaggaaguuaacaagagugggcagucucugcuaagcgauuacacagggaauaaauaaggaaagauggaaagauugucaaccaaaagacuucaacaaccugcuaagagucuuccagcccaguugagcacaccaaaucagagguuaccuaaaagugucaugagugcugauaauuaaacugcagaaaaccuagaaggaucugcuggggucaaaacaagcaacauuugacaggcacagccauucagauuuucaugccacucugaggcugaaaauuucugcacaaacagcagugacugaaccuuugcuagucacaggauagaccucccuguugauaggguagaccucccuguugauaacuugucagucaugggacugaaugaggccuuucuccaggaggcacagcccagaggguuacuggccaugcugaggaggcagucuugcuuccaggaggggcugcagaggccuggcccaagaguggugcugagaacugccuuuugccaacuucuuucuuucauugugcacucucuggagccaaacuaugccuuccaggaucuuucaagacuaaaauucucuuaggaagaugggcccaauauuucccaccuaaccuuagaaaucuucuaugucuaggauuaguguuuugagaguuagaugggaaaguguaguuugcagccagauccuuauguacuacagagugcuuucaccuuagugcuuucauccuccaucuuagcuccaacccuccaucuuagcucuugggcuggcccccgucuuagcucuagccuuacaucuuagcuccuggccugcccuccaucuuagcuucuggccugccuucuaucuuagcuccuggccugcccuccaucuuagcuccuggccugccuucuaucuuugcuccuggccugcccucuaucuuugcugcuggccugccuuccaucuuaguuccuggccugcccucuaucuuaguuccaguccuccaucuuagauccugagcuuugggucucuuuuguuuuguucccuaaugcagauagagauagucuauauucaaauacuauaauuaauuuccagccauuguggaaugaaaaacacauuuuaauuuccagaauuuaauuuccaacuuuccuuucacaaauacuuuuaaauuaucuauuuauuacccuugaaauaauaugucuuauggauaggucucuguaacuaucacagcauaugauagugaccuuuauguuuuuuugaaaauaucuguguaauacagauugcuagcuauuuuuuauguuaaaaauaagacaagggaagguugucuggaugacugaacugaaagaacucucaggugaacuuugcuccauagugaauaugauugagauuuauagaauuauuaaguuguggcuucuuaaaaauugccaccgaaacaagaaugccugaauuuuguguucugggugaucguggaugagcacauggcacaucugaaaagugauuuggccccaggccuccuuaccucccugcagguggcuguguucucuucaguuaaucccauuagcuggcaaaggcugaugaggcuacucguaagggacaugugcauuuucauaaagagcuuuagaggcccaaaagcccagagagucacauuuuuaauagugggguuccuaagaguagcauucuaacaagaggcauuggggggaacaggggagagcauuugggcagucacccccuccccacuucuaguuccagccccauacccuguuuucccaacccaagucuauggcugccuagcagcccucuaagcaaugaguugacuuucuuccacugugaccccaggacacguggaccccucacaccagaucuccaaguagcagcauagugcuuaguguuauucugccuggcagcggggugccccccccaccccauucaguggcagucagguucagaucguagccuucagggugccugacucauuccggcuccggucgauaaugacaagccccauguuuuucuccagcguccacggcuaugacacauacaacagucaggaaauaaaagaggcuugaguacuauacgguugcuuuacuuucuuuaaaaaagaaauauaaugugaagggcaugggggaaggagcaaggaggcaggaguccaggccagcaaauaagccagcagcaaaacaaccuuguuguuuguauguuacauaaacagcccccccaacuguccugcgguuauauccuuaggaaaaacuggggcuuaguggcgcuuggguugauuucacaccuuagcuuagaguuacucagagguguauuaacagcuaaugauuccauugagggcggcccagauugccaucuugacuugccagauauuagcaauacucuuauagaaacccaaaagccugccaauuaaguuccccaguguaaguuaaaaggggccuuucugagaugcgugaucuuuaggaaaaggaaauuaaacuaauuuugaaagcuccuaacacucgaguuuccuuauaauguaaguaggugacagcugggaugaauauuaugagucccucccauaauguguauuugaauagaugucauggauucuaauggcagaguucaaagucacucagaggggcggguuuuuauuuuuuuaaugucacccaccugaaauuauuuucagaaaguucuguaauggcuaacaggauuagaaugacauugucacaaaaugauaugagguguuaaaaagaccccuacaugaugcgguguccacaacgcacaagaaguacccccccacccaagcaugacucaguaacacucagugaggagaagagcaucgaauuauauaaguuacaguuuuauuucagacacacaagcacguaggccagcagugauaguaaacaugcaggcaugcuuucccucugagcaugagaggcguuuggauuuuacccucccagaugcagaaccucuguacuucuaaacagcuuccuccugacccuuagcuaagucaacggggaaaaucagccuccaaguuuugcuaaauuguguaccaugacagugacuuguauuuaggagaccuugcguggaucuaaagcccagaaguagccaccaccaccguuccuccugaugaaaauggccucaccagcaccucgcugcaaacagacaccagcucaaaacauugauuuucuccccacccucgcaggguuaggauucugcuuagaacucugcuuuaagcuaaaauuuccaucaccaaagggccugauuucaggcagagaaaggaccacuuuagcaaaugagagaagcgaagaggaguggaggaggagggucauuucaacagcagcaaaacucagccaugccauuuucccugacagcacuuuaauuaugaugaaagaacaagauuuuuuuuuuccgguuuuuacagaggaggcucgugguggggggaaaggagggggcucugaaagagaugugagcugccaagguacagagugcaaagcggcugucacugccaaaugacagaugcaguuggagagggggagagaagcccuucccugagccugugcaccaguggccuauucugugggggcccaggacuagucagccaggggcaaauggugaauaggauggcccaaaggagccaccugcuacaugcuagcuucccccuuuccuuccgugagauuuuaaccccagggcugguucuccuaguugugcucugcuccaccagcuuugaaagccuuggagggguuucaaguggucacauaccuuauuguugaaaaggauguuuuucuuuaaagucaggugcuaagucaggugugagguugaaauggacacuuaagggcuucagagcaggauaaagggacagagcccaggaagcccaggacugaugcucugaugggcagaagccagccguguuuuaggaauggggaaagaguuggagcaccagauguuaagaggcuacagucagcucaagcaagaacgagagaacggcgcugucacugacuucccaccucccggccuugccgguaaucccugcucugauuggaggcaugggguccacaggaggcaccuauuguguugccacaaugcccaaaaguggccugagaauucugggcugcuaguguuuagaaagagauauaagugaacccuagacucucacagcuggaaaaagccuuucuuccugggaaugggaaguaacaaaaugaguccagguuagcuguggaguccuuagagaugaagggagcagagagggcggaaaaaaaacaaaaacaaagaaggugcauuauuuuguguuuccuuucaccucccuccuugguuuuagggcccuuuccuggcaugcaacaggaagugcaggcuguguugagagccucuggugcagacuuacgcagagcacaagagaugaugugagccugcuugucugggcugcuuuuguguaacugaauuacacaguaucuauguuagaagugaugucacccaagagagccccauggccuugaacuaaacaccaaggggcaucgggccccggccccaggaggccugcuaugcagcaacuuuucugaacaauuugugauuuucuguucuuauuccccucacuaaauugucaugcugcuagagacacuucuaauuugaugguuauuaaugggcagcugguaaugaaacagcaaggacuuagggcuuugcaguaggugaauuacggacauuuacaaguaaaacaacuuuacuucuuacauuuagcaagagguuuaacaagcaaagugcaacaucugcagaaucuuaugggaggaggcaguggucuugaaauugugaggcaguacugcagggauagagaucgccuuucccuagaacaacugcaaucuccccaucagagccaacuggaaauacaaauuugcuccuaucuccaugcguggugauucugccugcuacagagauggaggaacagugaucuggcugauuuuaaugggcccauuuagggaaaaacacuuaaaaaauaugugaaaaugcauuuucccccuauuccuucuggaaagcaacauuaggguccggcaguucugucuggaaggagggagaugcaggagcagcauccuggcuuaugaccgcguggcugcuuagugguuuuauuuuagaaagaguuuuaaugcagaggcagcggugguggugggggugcgggugggggggggagggagacaaaucagauguagagguuugcagagccuggaggccaaaggaagcccacuucaggagaccacauuuucagcaucagaauaaguaaaguauuugaggauuuuugucuccucuuaaaaauaggcacuuuggaaaaggaaaauaugcaggcuuuugagaaacacagugaggugaucaguuaaugugaggugguggugauuguaacgucggaagaauuggucucauuuuucaugucacaauuaauauuguuugagauuagauagcuucuuaauuuagaccauuuacauuuuacagagcacuaaaaagcaagccuccaagccacuuucuggcagcacaaagccaaauaaaugggaacaauauaaccuuaaaaagauccauucuuucacuuguagcuuugcucuggucaauaucgagucauuuagcacaaucuaaaaaacucacauuuuucacugcuagaaauauguaauucuuccuacuauucauugccugcagauguccuguucuggggaccuuuuugacuuggguuuuugucuucuugacaccaaagcauacaaucaauuuggucaaaaguucaaucgugaaaaagcaucuggauguuuugucuauaaacaaccaguuugccugaauauuugagaggaucagcucagccaaccaccuguccugauguuaccccaacacagcccaaaugcacucagaggggugcggaaggaaggguacacacaaacaaggugugggggucucgcuuucucugcugcagccaucugaaaucggcugcagaggaggggggaaaugaagcagcaggcuaguccuucuaggcagacguggagagagaaccguguggaaagauaucuuuauggcuagacucucagcaacaucacugucagaaucuggugccugcagccaucuuagaauuuagaggaagcugaaggcaccugcccacauuuugucuuagguuacaaccagcucaauccagccagcaaaaaauaagguugagaagcauuucgcuuuuacagaaaaagaaaaaauuuccaugauucuguuccuugaaaaaaaagcugacccuccccaacccaaaccuuuuauuucaaagucaccaaaacugagacuagauaaucucucucucucucuuuuuccucgugugcauagccaguuuagacucucuuggcuggaauuuuuccugaucucucagugcaguaaaaagccaggcagaugggggaagaagggaacauggagaggcagaagaaggggcaauggcuccuuggcacaucucccuuuguaguucagucuuacacaguccauuuuuauuugcaaauagcucagcccaaaagaggguauugauaugacccccagaugcuguuccgaauccaucuuacuuauuuucccucgggggugcaggcagggcagagcccagauaugaucagaccuucaaagcgcagccuugauccuuuauuuuucauguuacagucacagaccuugaaaauguguuuucagcaguuuaccacauaccgagaauuucaggaaacaaaaggucaagaauugaugacuuagauuuauuaguggccccauuaagcagaccucagaauucuaaugaugggucuuugcuagacaaaucaaugucauguuucuaaaaggacaagcgugacagcugggugauuucacagaauuaucagguauugggaggaagguuaagcagggguucaauuacuaucaauuacaaugauguucuuguuuguuucccugggguuuucaugcugcuaguuguguauuuuuucccuugcauuugcauauuugcuguuuugcuuuacauguuuuagaaauuauccaucuauuuuuuuuuuuccucucaaaaucucuucuaccuuuggcaucaauuguagaaacuaaaugucugcuguagaguucuauccuuuagucauaguuuuuuguucuguuuuguuuuguuuuuaaacaaaguucucuucucugccuccccacccaauaaacugaguggauguauaguuaugccaaguuguggaaaacacauuuaacacauuuaagaacgugccagguaugaaauauaaaguauguuauaccuaagauuaaaauauuaauucgauuuggggauuaugccagucaacauuuugguuuuacaugcauucauucaacuaacuuaugguaucuuguugaaaugaugcauuuaaaauaauuacugauuuaauuaaaagaaaacuaaggaacuuuucaggcugagaaugacauuaaauuauccuguucuugagcgccucccagaggcguggguuaaauaacaccagaauaugaauugagggucauuucggcuuuucuagacuuugggaugccuccaaugguuaugaguaaaaggaguggugcuuuaacuuagagauuagaugucucugggucccaauuaaguuuuauauccauuuccuuuguaugguugagcuauuuggcaccaucuuggcagaagacagggauccagggccuuugcuaccaguggaagggauugaggaaagcuuccucugugauaagucuuggcuuggcaaaacauagccuagccuucuuccuucccucuccagaccagggcaccacguggagauagcgccguuugcuugggcuggccuuggacauuucagaguuccccucuuacuacaugcugacaucaucccgcaacuccccaugugccuucccucacuguugccaagugcucuugaaagucaaccaccuuccugggugacugcugcuuucucaccucagguuaaacccauggacccagugaaaguucucccaggggcucccauacccggggguaaucauaccuuccauaugugaagggcuaguuuuccagaguuuuuauuucuugguguuaggucacugcaacccugggauaaaaauagauguaauuagcauguugcagaucagacucugcacuuguagcuuugugccacuuucucuaauaauaccaauuuuggugacacauuuccuagaauccuggacuugcuucaaucccuaaaauccuccaagagcugaauuguaggacaaaccuguuugcuuuagaaccuagaagggcuuugucccaguuagauugucucuuuucccuaccuuucuagacauugcagguccaucuccauuuucuuuuuuguuuguuuguguuuguuuuguuuuguuuugagacggagucuggguuugucgcccaggcuggagugcaguggcgcgaucucggcucacugcaagcuccgccucccggguucacgccauucucccgccucagccucccgaguagcugggacuacaggcgcccgccacugcgcccggcuaauuuuuuuguauuuuuaguagagacgggguuucaccauggucucgaucuccugaccucgugauccgccugccucggccucccaaagugcuggcgugagccaccgcgcccggccucauuuuuuuguuuuuauuaucagggagcaacggcuccauucuccccuaaggcugacauuuuuguugaaggcugagcacgcaugucuuccgugcuuguggcaaaaggcccuuuccuggcuggcuccagaauccucaccaguuaauugggaaaaaauuugaguuaggcaucacaauuucagccgagcugggcaaacaacgaguacaccugucacucgagccaguguccaaaacucagccccauggaucacagcuguagcguuauuucagcaugagcaauucaguauuuaauguuccuuagaaaaaaaguaaaucauuccaagcugcuacuguucaccuauuaacucuuucaggauuucaugguggugggguggagguggggaguaaucuauaauuugcuuggcuagcagagauaauacccccuucccaagucugucuuucuuacauaauggccauuucuuacauaauggagaagaggggcugcaaaacaauauccucuugaucuguggcagccacugccuuccagaaugagaaguuagauuuucuucuuucguuucauuuauauuuuuaccugcgcaguacagguacugcuuccuacgaucagcagcuuccauuucuucccucuuuccacgguagcuuaaauuagcccaucaucaucagcaaaucuuaauuuacaauuaagugcugggaaaaaaaaaaguucgucauuaaucagaccuucucauuuuauguaaauggcccccaaaagcaacacacauuuuuaaucuguccugccgauagcugagcccuucugucauuuggguccuaauaaaugaauuggccaucugcaauuaaucugcauaguacaaaucauuggaaggccgagucugucugccuucugaaagaaacuggcuauauuuaguuuuuuaagcaagucugcuuuguguucuuuguaaagucagcgacauucuuucaauuuuuucgguguaauuagcacaaaaggagccguaaucugagaagguaguagagacuaaggcaaccgaaaaacaggaauguucaagaaagcaggcagaggcagccuucccaguauugggcggcgugacagagacccugggacguggcuguggguagagcugaggucuguagcucauaaaaaaucuccuuuucaucugauccccagacugguugcaaacgcuugccgcuugggcugaauaauuuuccccuucucauaacuuccaguggucagcaaggaccuuagaaagacacagugccaucugggcucugcuguugagugggcuccugacaggccagugagaguucugugcacacugccaagcccucaauaaacugcugagugggagagcagagggcauagcccugagcuccccagcaaaugcugaauuucaaccaacuggaggcuacauggaaaucaagcagaggaaggcugcaguggccuugggaaggagaguuagagccuguacgaaaagagggggcagcccuccucauugggagcugugcagacugugccccgaugguuaguuccccccucaaaauaaaagccagggaaauagguggagcuaagcgguaauuacacauuuuucaauuucaacuaaaacgugugggcaaacacaaaacgaugaaaagguaucuacauuucuagaugaauuaaaugugugacuaauuaugucacguuaauugcuuaauuccugguuuaccaacagcagauggaagugggacuggagaggggguuuuagcucugaaggcgaaugacaccugaggcccagucuaaaucucaguuuucccaaacugaggcuagaccauaacggcagggcuguuugaaaaugaucaccuacauuugguuggcagguagauaaaaucugaagauguaaaacuucuauuuagcagucguuucauuuguauauguccacaaagcagcauuuaacuaaacaaaaugaauugccugauuaauccaguguuuuuaacugucuaaacuccaauucuauggagcuaaauuugaagaagugaauaccaugaaaaaaacccuaaaaucuuuaaaauaagaacaauuauaaagggcuucuuuuaucuaaggaaauuuuauuagaaccucaggccuccugacugggcucaauaucacaucuccaggugcaccaacugccucuuauuuuuuccuguugucacuuguuuaguaagauguuggaucaaagugucauuuaaauaaggcaucuuguaaauaagcaggaaaguaaacugguccaugucuauuuuuaacuagucucccuacauuauucuccauccuggaugaguuuccaucuucaaggccaaguuaaaaguucuaagcaacagguuuucccauuaccuuaguccucaugaaaauuuuuccccaagggaagugaaggauauuucaguuuaggaaaauuagcuuuccugccguagagcggcaaaacucuuaaauauuuuuuucuacucaauuaagagcuccauuaaguggguccauugaucuguuauugauguugauguaccucaaagaaaauggagcuuccucagucuucuccuggauuugacuuucaguuuuggaguuacuuguggaagcugccgccuguguucugcugaugggucugccuuuugguccugcuaguggguuuguuuucugcucccuguugauauccaaguuguguguccaccuagaaucuucaaugaaggguaacaugugcaucauaucauuuaggcuucuaaaaggaacaaaguaauacaugucaucucuuuuuguuagcuucccccuucuugagguagauggugguuuuguuaaaaguccauuccugcccacgcuggggcucauggggauguggugagaaaggcacugauggccuggggaauugggcgucuguccacagagaccaggaagccucucucacagauggugccuccccaucagagagucaggaaagaucaagaagggcugcaaaacguccucuuugcccucauauuaugugccaugcuuuuaaguagauguuugaacagcaucucaaagccacuggcucaagaaauuggguccaaauacacuggccaauguacguccacauucuguuugaauuagaguauguucugaauuaaaaacagaucauuuuaaaaugaguugauggauaauaaauaggaaaaugucauauggccauguaguuaauucuucaguaauugacuucaagucuucugaaaugaaguuuuauaucauguuuaguuuugaauacaaguuuaggguuacuuuaugguuggaguuacuaacuagugaauaugacaagaaaaaaaaauguccuagauaaucacuacauucgauuucuaagaacuuuuauggucuaaaguaauagagccuucuuacaaggauuaacugagacuaggaaaugcuuuuuacaauuccugcuuucaucaucugcaugacauaggcuuugauauucauuugcaauagcaguuucagucauucuagcuaauuaaagugcagaacgugcuuugaagacaggaaacacuguggaagugcuaaauacuauuauuaaaaccuuacagcuaaaguuucuguuucaguggaaaccuauuuauuguuuccuaggcuauuaaaauaauauuauaauuacauuugcucugggcucuuggaagacaacuuaaaaugaccccaacuaaugaaaggccaaggauaacauucuuguccaaaaacugagugacagcauuaagcagaacaguauuuucaagauucuaagcuguagcaaguccacugcuucaaaagguagacaaggcauucuuacucagaaaggaggauacccaggggccaaggaacacaaacugccuuuaucaccacgaagcugacaagaccacagaauucaaacccugaugugggacguuguucauuguugucaaauauggaauguuggaaagaaauguuucgaggccauaucuccauguagugugugacaccaucuguuuaaacaaguuuuuucguuaggugaccuaguguuuuagguuagggauguguuaugaucucaacuggcuggcuugggcaugaagcaagucuccugagccagagaucugugcuuuccuugggcauuuuauacccaagauauucugcccuuugucccucccugaaaucuccauaacucccuucucuuccugagccagacgaggggccccuuccauuggaaagcucucucaucuggacuguuccaagaguuaugccaauagauugccccacuuucaaagcauaaacuagguacuuaaaacaguaaugaucaauuaaauuacuaacucauaugaaaaggucacacaugguagccuccaaaacuaaaagacuugaaaaaaaaaaaucacaacuuuuagggccucaagaggucaaauuugaggccaaaagcucaguaaaaucucuucuuucacuuuguguggagugaaaacagacagccuagcugaccacaaaccagcuuguguuucagcacucugggugucauuugcuuaccuguaaacccaugauuccaccugcugucauuuauuuacaaagugaaugcuuuauuuauccaucaguaguuagucauaauaaaauauaggugaaaccuacacuuaaaaaauuuuuguuuugaagaguggccucauagauugagagcugaaaggaguaaagccugaucuugcguuacccauuucuaggacaauagucccaauugugccuugccuaggacgcauguuaguauaugacauggggcaguuucacuccuuuuaaaguucaggugugauguuuaucuaaaaggggaaggugguaauggagcucagagauuuccaaauaaggaggcucuucauuauauucauuguauaacuuuguagcuccuggcauaaguaucuagguuguauuuguuacuauuuaccuuguaccucuuaaagacaauguaucugugcuuugccacaguagaagcaggaaggaagaugcuuuugaacaaauggagcauaacaaaaaugucuggccuauucuucccucuuacaagucuuuaacaauuuuuaaaaaugacaaucaaucaaauucagccaggaauuuuuaauuuaccaucuaaagauauagaaccugugcugugucaucaagcgguucuaauuuaggugguggaugguagugagccucacuaucacuaguacaggcagccuaggaaucaucgauucugaggccuuacugcugaguucuccuaugagcacauucagguguaucugcacaauauuuuuaugcaucuuugguuaggugaaaagcaucaaccuaggauaguuccuuugagcauuuucaaaauaagguguauuuuuguguggaagagaggccauccaugaucaggagugugacaaaaaccuggccccaacuuuucagccaaguucaagaaagucaggggucugcagcagcccagggcaggacggugucuaggcugcgcuuccuguucuuaauuccaaguguuguuuggugacuuugaaucgcccucuguugucuuuucagauucauaaaaaagaggccuuguacaaugggggcagcaguguaccugaaggggccaagaaaaauaauauguggcaucuucaucugucacaccuuuucuuacucgaaguggagcaaacuggggaaaaggggggaauuucagucauccgguugaauggcuaacagugucuuuuuauuuucaaagcuaacuuaaaaugauacaaguuugcucaaggccucuggugguaucagccgccccauaccccuggggacuguuaaauguguuuccauuuauagguagacuuuucuuuuuucuccuucuccaucaaacaucuuaaguuucaugggcucuguuaagaagucaaagaaaaaguuggaagacaguuuguggacuuugcauaucugggcuuuccgggacguaggccugugucccauccaagacacugcucacgucuuagccugauuaccuggccgccucggcucaccugggcacauggugagccgcggaacuggcaggcaccaaacauuuauugaaugaauaaaccguaucccagcagacaccaugguggcagcagaugaccuaaccaaggucccaggaaaggcgggcuggggucaacugcuugaaaauuuaguaacccugcuccuaaucccgugcacugcuauauccuagugugcggcgggacacuugagaguuuugaaagaacccucaaacaaguucacguuccguaaacuacuuuucccucuguuccagagcccccagggcgcccaggcaaggccgccaccucucccaccugggaggacgccucgagcaccgacuccacagccacggccaccgcuccucggcucccgugacaccggcgcgccugcugcuucgagcaggggaggcuuugcacucccaucgcacuuuucucguccgaagauacgaaacuccguccgggcgucgcaaauaauucgaauucggcucucugacaccuaccucggcgggcgcgcgccgcugggagggcgggguggguggcuggagguaaggaggcgcacagcagggguaagcgccgccgucgcacacuuugcacgccgcccagggcuacaccacucaccgaaaauugggaggcaggucugggaggcgggguugagcgcccaccgccuugggcgcgcccgcgccccccgccaucgcggcccccgcgcccccggcccacgcccgcgcggucccggcaccggccugcacccccagggugcgcggcggcccauuugggugcguccccggugggccgauuuuucgcgcuuccccuucgguuuauaggggccgcugcuaugggucgguccucugaagaggcuggggcgucaucggggccgguuagaagcucugcuccccggcggggacacucagucgcgucggcaccgcggagcgggcugcgucagguggcuggccggcgcggcgcuccccugcucucuggcuccgggcugcggcgcggcggcuggagcgagccccugucccggcgcggggcggcggcgggcggccggcaggcgcugccuugcgugugagugcaccucacucacauguaagucggggagcgccggggccucccgcggaagugcgagucgcccggcgcaggcaagagccgccggguccgggacaaggcaggggcgcccgggcgccgcugccuugccccggggcgccuccgggcaccccccaauucucucucuuuucucuucuccauuggcgugcccaagagccaaaccaaggagcgccugaggguaaacagacuccugccauccgcgccuuugcacuuuucuuuuugaguugacauuucuuggugcuuuuugguuucucgcuguuguugggugcuuuuugguuuguucuugucccuuuuucguuugcucauccuuuuuggcgcuaacucuuaggcagccagcccagcagcccgaagcccgggcagccgcgcuccgcggccccggggcagcgcggcgggaaccgcagccaagccccccgacacggggcgcacgggggccgggcagcccgaggccgggggcaagcagggagcccgggccaggcgcgagccgagcuccccgagguggccgggccaccaugcugaagauggccaugaagcucaaagcccgggcggcggagagcgagaagaagacggccgcggcggcugccgagguggcugccgaagcugcggcggcggcugcggcguuggccgagccgagagagccgcucgcgccgcggaagagcggggaccccgagaagcucgcgaagaaccccaagaacccggcgcgggaggcgcuccccgaaaaguuccuaacagacaaggagcgcaagaagcucgagaagaagcugcuggagcagaggcgaaaggaggagaagaagaaggagaaggagaggaagaagauggagaagaugcugaagaagaagaagaagaaggugccagaagcccaggaggaggcccgaugccccgaggccgccgccgccgcggccgccgccgacgacgacgagggcgccgaggagggcgccgucgggggcgccgaggagggcgccgccgccgggggcacgaguagggccugggcugacugggacacggacucgagcgacgaggacgacgccuacuacgcggcgccgcgcguugggggcaucguguggcggcccgggccgcucaaggcuggcgcgcugagcgcccaccugccccucgugguguuccuggucuucucggugcgcagccccucgugggugcucaacuuccugcugcagaagcgcacggagcagggccgcggcugcggcuucguguucggggcgaccugcugcuuccgaguguuccugggcugcgccuucuucuccuacuugggcggccgcgccaagcgcagaggccgcgggcgcuccggggccagaggcgccuucggcucgggccauggcgcccggcgccgggggcgcgaggagcggcucaucuagucagaccccccaccccgccaccgccaccagacaccaccaucgcuguguaguguggguuuuuauucguguucguguguguguguggacacauuuuccuuuucgguugcucuguccuuugguucgugcucgccucgcuuuuuccacacuccugcucucuggcucucugugucucucgcucuuucgaaaauuuuccuaaguccgggcgcgcgcucccuccccuuccgcccaccccagccccucggcggcgcccgcgggagggggaggaggccucgggggcgccgggcgacgcgguccgggggguggagcguuggcgucgugcgaggggucgucacuggcgcggagacgcccccucuccccccucggcucagccgggcugcugcccgagcccgggggguggggggcgucuccccggcccgucccguccccggccgggcgcgggcggagggacccccuccccgggcucccggggggccgccucccuccgccggcucccgcccucccagccgccgccgccgccgcggccgcuccucggcccuccuccuccuccuccuccuuccaccccccucgccgccgccgccuccuccuccccccgccuccccccgcccgccgcggcgcuuuuggcucggggcggcggcgggggcccggccgaggcaauaagagcggcggcggcggcagcggcggcagcagcucccgcagcuccugcucugguccgccucggcccggcggcggccaucagcccccucggccucggcucgaggggcggggagcugcgcgcgccccucgguccgaccgacacccuccccuucccgcccguccgcgcgccccgcggcccgcggcccgcaguccgccccgcgcgcuccuugccgaggagccgagcccgcgcccggcccgcccgcccggcgcugccccggcccucccggcccgcgugaggccgcccgcgcccgccgccgccgcagcccggccgcgccccgccgccgccgccgccgccaugggcugccucgggaacaguaagaccgaggaccagcgcaacgaggagaaggcgcagcgugaggccaacaaaaagaucgagaagcagcugcagaaggacaagcaggucuaccgggccacgcaccgccugcugcugcuggguaagggcgggcggggggcgccggccccggcccgggggcccucgaagggcgccccgcaggccgcgcgcgccgagcccgccccccgccccgggcgcgcgcucccgagccccccgcccguucgcgggcucugucuguggggggcgaggccggaagggggacccaggggcgcggauucggccgggcgggggcucaaaaacggggcggggggccguggcgacgcgggcgcgggucccccucccccggccugcccgcucagugucucucucuugcucucgcucucgcucucccccucuuucucucuuucucucuuuuuccgcgaggccuacacgacgccagggguuugggugcguguuggggagggggagggggagcccauggggcuccggagacugcgacaaaaagaggguuucggggacaggaaaccggguggcggguagagggagggggacccgccuccguggggugugagauuuguugggagagggaaagaggggaagaaaggggcgaggagaggagggggugacgcuggggggcgccgugguggcggagggggccucgccaaagggaggcuuuggcggggagaaguggccgaggagagugggggggcuggugacaucagccccucggaaaggaucggagcgguaaagguggugcagugggggggagggggcgcaagggagucguggcgccggagucgggaggggggcggcgaggggaggagggagggcgguugccgcugggcgcgacuuggugcguuucgggcaggaccgacugacugugugugcgcggagcagacgugucccgggccaggccgggccguggaaggaggagaaggagagucaaauaaaauaagaccaccccccaacaccaaaaaauggauagaguuaguacgagaagugcccagugaagccaaaugacacgucauuuuacagugugaccuuuuuuuccccuuccagacuugcaggcuuuuucaaaagcagagcggagaauuaauuguagcagcugccccccccacccaccacgagcagcgcccccccaacacuauuuuaauaaaccauuaaaaaaaacacauuuuccugcuggcuggccacauugagagugcuuugugaaaagaaaaaacaaagacauucacaaaucagauaaaacuggagaaugacauuugucuguaaauggcuucuuggucuggaaauggcgugguuucuuuuuuuuuuuuuuuuuuuuuuuguccuccucaaggugggaggggggauugagagugcucuaaggagacuuuuccuccaggugggaagagauaaaaagacauuaauuaguuguuuaucaagugacauuuaguuguuugguuuuggguuuucuuuuuuugauugcgauuuuuccucugauuaaaaaaauaauaauaaaauaaaaaaagguuaacuauaaggagauggccuuuccuccuuuuuuuucuuaaggugcuguuuugggggaaaaaaauguaaugaaaugaccaaaagaauuacacagcauuaauuaaaaauggaaguuuuccacuuccuugauaauuuggcuaucugaauaaauuugugaauuugcuagguuaagaccuaguucguggucacauuucaacaaaacagcuugaguauaaagaaaauaauaaaaggcuguucuuauuuauuuuccuuugguggcuuuugguuugcucuuuuugcauaggucaugacuuuguucuccuggguccagauuuauaaaagcagaaaauuacuaauuaagucaaaauaagugucuuugguguuuaugcauuugcaauuucaguaauuaaaugguacauguguugcugucuugucuaaaacuuuuaaaggcagaauuaugcuguugggauauuaguaugcguauaacuugauuucaaaguauaaaucuggaaaagucuagaaucuuuucugugaaugcuaucucaguacuacuuuaagucaagugugaugcuaaugauaucuuaaaauuuccaacaccuuuugugcagugaucacaaagucuccacuuaauuugagacuguuacucagaacacgccuugcgucacgggggcuaaucuaaguguccuagucuauaugacuacauuacaucaugauguauugauugccucuggccuaggaaucugcagcuuaagccagugacacaauauuuugcauuuuuaaauggugauucucaccaaauaaugccuccccacaaaagaggaaaccuaauaaugccccaaauccucuuuuuacuccaucuuaaugacauaaaaauuaagugaauuagagaacuacaaugaucuuaaaauaauuuuucagccacauuucauaaauguggaaacugaggcacggaucuguuuuugccuaugaaagauagguccuguaacuguuacacaguuuaacacuucugaaauuagaauauuagagauccugcuaaauauuacguauuguuuccuuggccucucuuaauagugccauuuauauuuuuaauuuaccagaguuaggcucauuaagauaguguuugcuuugaaaucaauguuucuguggaaacuaauuuuaacuuuuacagauauugauuacgggcuugugaaaaggcaaguaaaggaggaaugcugugcuaucugggcauuaaaacaaaacaauacaauuaaaaguuaaaaagaaagaaaaagguaauaacagauuuguguggaaggagggcaaaaaaacuucacacguggauuaucuguuggagaaugugcauugcaaaaaagaugcaaaauagcaauccucccucuagcuugauggaaauguguuuuuuccaugaaacauauauguauuuuuacaaaugaaagaugauuuaaaauggaggcauguguuucuacucuuugaguugggaagggcuuggaaucuuucaaauucaguacuucccagggauaguuuuccuuuugauuaaaguuuuguucuuauguuacuuuuuacuguuguuuuugcaguuuaccuaaugcuaauagggucucaggaacuguauuugauguuaaagugugguuuuuccagaagaugacagauaauugauggucuccccuuuuccucagcaacauaguuguacccagagggaauuuaucuuuagaaagauauaguuugugaggaaagaggaggauggauaaguggauaaaauguaaugcaguuuuagggguggauuuuuaaguagcccaagggguaggaaaccugcacagaaagaagcugcguugugaaaauguugaggaggaaagugcugcaucgcuacgugauguggaagagacugcagugucugggcauuguugggaaucccggguauuuuaaccaugaaacaucugacaacaaauuaugugucuagauauguuuaugugugaauguucauguaucagggauucaguuucacaguuuuaacuucaauuuucuuguuuaccccacaaaugacaaaauugcgucauuccuucucuuugccccuuuccaacaccaccccacaauuuuuuaaacaaucaaaagaaaaauuaaaaccagcaaaccuuaaauucuuguuuguuauuuggauggugaaauacugcagguagacacugaauuggacauugauuuccuuuucucugcgucgaaaugucaaggaaaguugcaagucugugauuuuguguuugguuuuuugcauguugcuucuauggaaaaacaaaacaacaacagcagaccucccugcccaaaguguuaaaaugccuccuucauaaccugagacuuacuuucauuuucuaggugcuggagaaucugguaaaagcaccauugugaagcagaugaggauccugcauguuaauggguuuaauggagaguaagugucaaaucugugcaggggggcaccaaguaagaggaacagacuuuauacuaaccuuuaggaaguauaggugggcuuugggggcugggcagccaguuuucacuuaauuuuuccugauuuacauauuagaaaauccugggaagggcucuuuagggucccucaccccccacccccuuggaucuuuggugcaacaaauacuacugaugaaagcaccaguguuugugacaaacaucucccuaucccaagaaaaucgugccugguugcaggggacgcuugacagcacuuggccccgugacagccccucuccgggccaggucccugccacagucuucggacaucacugcagugucuucaacguggcuuuggccgcccccucguccggcccacgcugaucacugcaaauucaccccaccccaccucacgcagauuucaauguaaugaaccaacacaggauguuuuaaacuauuagggaaacauuguuuccauaauauucucaccagaaacagauguggaaguggcagcccguguuuacaguuucucauuuuuuuugucccccuuuaaauuaccauuauggguaaaucauuguuucccuuuaaaacaaaaaacaaaucaguaccccugccuacagaaaagaagagggaacauuuauuuaaaggauggaaagacugggaguuaggcacucccagccucacugaggggcauuuuugccuuugagaaguccucccagguauccugguauagcacaauguggcaauccguagugggaaugaagauuaaacaggagagacuuuguauuagaccugugagacgaguuaggaagcccugccuggcauggggaaugcaaacagggaacauucaauaaaucggggaacuugcuuuucuccccaagaccccagauggggccuacccaucguucucguguaacaaaacguguaaaaaaaaaaaaagaaaaagaaaaaacaaaacaaaaaaacuaaguugaccagucuguuuucacugguaugagagcauuaaccgcacuagauuucaagcaccugaaggcacuaguuuguaauuacuagcugguuggcacaguccuguucccuuucuuaaacuuggauucgauugaaaauuuaaccuugaguugcuucagcuuccauuucaaaaggggaguuggagucaaggugguagcguuuaauuauaccaaccaccccccaaaaaaacaaacaaaacaaacaaaaaaaccuuuacuagucacuaagcauccaggaaacaaaggugaacuuuuucaccuuucagagcaaggcaggcagcuccuuauagagaauucuagaauuuguuagaucaaauaauuguuuagagaaggaugacaucacccauacgaauaguccuguuaguugaggaugcuuuuucuacuuuaacccugaauucagaaggauugguugggaugcacagggggcuucuucacucaucugauuaugacucucaauggguuaucaacaugcacauacgugcuauugaguaagucagcaucacuugucaccaaccaauuccgaaauuaauucuugacacaccccucgauaaagcccugccagcggagacugccauccugacaauaaauaaauaacccugagacagacuuccaaccaugaaucugucauuugaagaaaaaucuugcauaaauuuucccccugcaacuugcaggaguacuuacuuauucaugagaguaguuaagcaaaaauaauuugaccauguauccucuagauaaauauuuugaugaaaacuggacauggcuagcauuuuucaaagaugcagcagccacuguuuaccuuagcuugagucggauggaagcuaagucaccuuugaaauaaauuacugacagcuucauuacagauugcccuaaaauuuaaaaauuuuuauagaaaggauucuccucccuaagcgagccagccuguaacaccaggcaaggguuuuaaaccagaacuucucuuuucuguuuucuuuuuggaaagaggaagcaacauucccaguuugccuucuuugcagacaagggcacagauacguuaaauuuagccugugagaggguuuacagggguauuccucaugggagccuagauaccuuauuuuuaucucauccaacugccuccuuuuuucuuuuuccucacugcgguauugcaacaaaagcuauuuccuucuuaacuaggaauucccuaugagacagugacaucugucccuaaaggguggucugggugguacaggguucuuccucccugaucuugcguuuuguuagggcucggcugagcuauuaaauuugccuuaacucucugcgggcugccaugcugauuacauuuuuaagaguaagauaauacugauuugaccuucagaaauacagagguuggaugcggauuuucuaacucaaaacuaacucuguuucuuacauuuagugccaggaacaaaacaaaaacaaaacauaaacaccauuaacauugguugaacuaagcuaaucaauuaccaaacuguagaaugcugcccuucggccuucaaggaggaauuccuacuguuuaugaagaucggguuuggguuuuugguuuuuuuuuucuuuuucuuuuuuccguggugguggugggugggcuuuuguucuuuuuguuuuuucuguggugguggugggugggcuuuuguucuuugaaauuuuuuuugcuacaucacaguccagacauaguuuaaugacaauuuauggggaacaauuauuuauaaauaaaaccauuuuauagguaguuuccuuccacugcaagaagugaggucauuaguuuugcaggaaauccugggcagaaaucucccccguuuaugccuuuaugccuuaaguuacaaccuugggaagauucugaccugggagaauuaggagccuuaugcgcugccauauucuccaaagaauugugagauaaaucacugcuuuagcucccuaaugcguguacguuuagugaaagcacaagaaaacaauuauccaucccuccugucuccgaccagagucuccagagagcucuguuaauacugcagcaaaggugugggauucuucccccauggccugcagucucaguggauguuccaauuuagccagaaaggcgaccuaagaauugccgggaggauggauggcuggcgcgcgaauuguugcuuuugcucuuggcugaugguugaggaauguagagagacugugugggguuugugugacacugcggugccuugcagauuaggugagcuuucaaucucucuuuaaaaggggcggcgaagaggacccgcaggcugcaaggagcaacagcgauggguaggcacauucaaaaccagaaaaaauuguuaacaaaccaaacaaacaugaagaucauacugggaaacugaggccagagacccgggaagaaaauaaaaaucauuuaaaggaccaucagccauauuggcauacauuugugaauaacacacaauuuccugacauuuuggagcaaguaaagugcguaacauaaauuuuuuuggccaugcuuaaaguagaaugagauccagcugggggaaaguuauagauuucagccuuggaugaucaguuuaggauuuugagaauugauguuuuuccauaugguuucuguuuucccccagcucuccauuugaaccagcugcuuguuuuaaaacuaucuacuaaauuccaucuacccacugguuggucugauuuuaaaauuucagaccucuuugaaacaaaauuuguuuccuuuauuaaaauaugcaaugcugcaccgucuuuaauuuugaaaaacgccuugguaccuugcagcaggucguuaagaaucaucucgaaaagccucuggccuuuuaaaaaugaucaaauuuauuugaaucaaaggcacuuuacguuagcuugguggauaaggaaauucaugauggcaucuuuuauuuuuccauucauuaucaaauuauuuuuucuuugcuuccugcauccccacacccaucacacacacacacacgcacacacaugcacaugcauacacagacacgcacacacaucacacgcacacacagccacacgcgccgcgcacacacacacgcaugccagguaaccacucuagcucugcuguguauuuagcaugcagugguggaguggcuauuucucaugagaccauccagaaccauugacuuaguuuagggcaucucaaagaaacagcuucuguggccggggaggggaggggcaaagauauuggggucuggggacaaaguaacugacacauguuuguucaucuguuucuuuuagaauauaauaucccuagaugauggcuacaguuucucaucuucccggcuauguccuaucacaauuugcaugcuggaauugcucggucuuaggaacuucuaauaagaauacuauucuguuaucugaggggggaggggggauggggccccugcuaccugaccuuaaacgaugauugaaaaaacgaaaaaugaacugaaauccuuaauuggcagaaauguaguaugacaacuauccaaaaaggcaucucuauaagaaaugacuaauugacaaucugcuguaccaaaaguuggcauuugagcaagauaugacaaguccuuagugagcaaccuacuguguacuagauguccugcuaaacccuugaacccuacuaauaccuuggccugcacgucucucucacucuguucugcaagucaauauaaguauuaacauucgugauaaauaaaaauucucugcauguuucagcaaucccuguaucucgcgucugucuucugucuuccuuccuuugucugucuuuucccaccaaagcacaaggauuaagguggagaccugaauagcuucccccaccacuuaguuagcugaagcggggggaggggaggagcucuuaaaaacugaacgcaucccaucugcuguauacauagaagggggaggaggaggaaccaagacccuaaaaguacuuccagccuuagucccaauuuuguagcgaaucagaauucuagcuaauggcauauguuuugccuuuguugaguaguuuaaagacaucuaaggaauuuucucugaauuucacaaucaacguuaaauucauuaagcaauaguaaaagugaugauaaacccgccaacccccaguauaauaucuccaucuacauaguaauugcuucaauggaagaauuuuauguuuuaguauuacacacccgaauuagauuuuagauuucuauuuuagcuguuuuauacuugauauacucccacaccuauucacauacguagaugaauacugaacacguucucaaaauauccguauuuuaagacgggaaguuuuccaauuaucauacuacugcuuagaccaaaauaucaaacugaaugaaagaaacuuguuucuggaaauacuuucucuugcuguaugcagauuuggauauuuaguacccgaauguauuuaauuuuacuauuguggaaccucaaaaccaaagguuaauagcuuucauuaccugugaaguggagccugcuuuuaaugaaugggaauagauuugcccuaggggguuuuggguaaauucugaauucaaaagugaacauuggggaccaucaaacacauguccuuuuaauuuauaacaucuaaauaaucgauguuagacuguaauaccaaggccggggauucuuaauuucagaaaugagcuuugauucugcacauacaaagcagacagucgcacagagcggucaggacucacucccuuucacucuaaggugguugcuuuaagagucugggggccagaaucagauuucagauuuguacacaaggccugaagcucgcucaccucccugucaucuguguuucugagauucuccggaccugcagcacuuuuacuuaaauggcccugaggggauuccuggcaacaucuguccccccuccccaccccagacaccccccaccacuaaugagcguggccccucugaacuuccccagcucuucacccaauguagaagagcaguggugcagugaccugugaaaggggcuucacguaggaagggggcgagaugggauccuucagcaggugaaggcccagaaguacacagacauuuauucagaaagaauaaauuuguaaguauaauucuuugagaaaggaaagaccaaaugauuuguggaaggccugucgacaggcccgcacuugaccccaccguccguccccgccccccaccccugcugcuccacugacugcccugcccugcucgucugcucgucugcucuugcuaauuaaccucccuucgccuuuccucugccuuaacugucguguucuagucuggagagauuauauguuuuaauuucuacuccagucuaugaauuggugaaucagccaagugaaugcuucaaaaacugggacucucaaaagauuaaaaaauauauauauacaaaccgugaaaaagauaaacucuguccccuccaucucccauugguuucugccucggugacucccccccucuuggccucaguuucccugucagagaggcaggaccguagcaccuuuuuuccgcaugacaacgcccucaccucccagggccuaacagguacagcaggugugcugugugugcugguuccauuuuugggcuauagaccugaugagauacauacuccacacaagaggccuuuucuugcccucuaaaaacauaaacucgagaaccuucccuggcugugcuucuaaugaaggcuaguuucugaaaaacauacagcauuuggaucaguguaaugugguacaaaaauuaacauucuguuaugguccccagaagccaaaggguguguccuuuaccugugggaccagugacccugaauauagaucauuccauaaagaccacgcaggccaucccauguggcugaguuaaacucaaggaaaagcuacaaaaccuucaaccucuacuuaccagagggaucugaccuccccucccccuuagauuauaaggccuucuaggggguggaaucuuauuugauuccuauugcacauggaccaacaugcacuaacaucaugaacuagaaguuucauugcugcuagcugcagugccuggagcaucgcacauacgacuuuuuuuuuuuuuuuuuuuuuuuuuuuugacagagucucacucucgcccuggcuggagugcaguggugccaucucagcuuacugcaaccuccgccucccggguucaagcaauucuccugccucagccucccuaguagcugggauuacaggugcaugccaccaugcccagcuaguuuuuuuguguguuuuuaguagagacgggguuucaccauguuggccagacuggucuccaacuccugaccucaggcagucugcccgccucagccucccaaagugcugggauuacaggugugagccaccgcacccgggcuccuguaaugaacuauuauaaacaccaccaccugugcucacugguucucucaguaugcuagcaacugaguuaauuccaagucaaaccaugggacuguuuuguuccaccccaaccucauagugaccuaucacuccagccucaccccuacccagauguugauaggaccaggagaagccuuuaggaaguguuaguauguagugugggggcuucaaacccaugaaagauuaaaugagcugcaugcaacuucugguacagucaugauugcuaaggcaauuugcuaaucugccccgauugggcguguccucagggcacauuugggagguuauaauuugcaacuauguuuauucagcuaccuccaaucuuugcacagauccgaacccacaacucccugaagaacagaauacuaugcuuuuuagucgggaugucuuuaugaaagcaguacuccuaacugacauggugcaauaugauuuucuuuucuuuucaaucccacugcagugagaaggcaaccaaagugcaggacaucaaaaacaaccugaaagaggcgauugaaguacgugcuggcuccuugugcugucugucuuguagcgcccucccagccagugcuguucccugaccgcuuugcuaaaucauuuucagaccauuguggccgccaugagcaaccuggugccccccguggagcuggccaaccccgagaaccaguucagaguggacuacauccugagugugaugaacgugccugacuuugacuucccucccguaagcuacaccccgacuuguguggccuuagccccgcccaccugagcacaguguccauauaggaacaugagugacagcccugcacaugggcaggagcauccaaaccacacuucaggcaaaacuacauuucagugauguccauccuuaggaaaaaguuaauuucauguguaaccuuaauuuaauaauaauaaucauuagggcuuuguucaagauggaugagcaaaauucugucaccccuucuacaucuuagcucaccuguccucacaaauaaacaucacucuugaauacuacaaucucacuuuauuagauuguaaauuuuuaugaggaaaaagguccugagcuauggcaggcuuaauuauucccucauucacaucuuaggacaaaacuguauguuaaauauggcacacaaauacuaauuguccauuuacuccacuggaagugcccuaagguaccuugggaugccucagugaagugccaaauggaagacauucucauuuuaaacaggugaccuuuuuauuaagaguuuucuaaaguccuuggggcaaaugaaaucuuuucucauuauuaaaaaaaaugaaauauaucuaaaucauaacucaaaaaucauaaaauagaacauauggaaaagacuuuccucuggaugcacgacacuguuggcucccuaaagaacuacuuuuagggaacaaaaaacuguucaagcccaagcauauaaguuuaggccccuucguggggagaauggcuuauaagcggggaacgggaaacgagauggaaagauguaugcguuuguaagacccacagggaagagacuugucuacagcuaaaacaaugaguuauuguugccuuuugucaggcuuucgugggaauuuguguuuguauauuuuagauggacuuggcugcaaacuuaaauuggagaaauuuagugguauauaguuaguauggauagcuaaacuuuuuaaauagcauuauuuugaaaaaaaagcaauaaacacaauauguauaauauaacccacugacuuucuugaaauaugauucuauauuuaauaggaaaaggaaacagcagccuauuaaaaauguaucagaacaauaacuuuuuauuaguccuacuaacaucugaacuuuuauguuccuaccuacaagucccccaucaucauuuuuuuugguaagauucacauuuucccaggaggaaaauuuagucccagcacaucuuacaaaugaaguuucuuauuuucacaacauugaaccauuuauuggcauauucuaacacauuuaguguauauucuuccuaaacaauucugugaagaaacuaaauuacucaguagcuuaccccauucccccuacacacgagaaaagaaacuacccaaaaccaguaauucacaauaagacccagcagcuaauugcgugaacuuuugaauauguuuaacguguugaauuaaaguucuuugugagcauuaauucauuaauugggcucaaaauucaaaaucacaccaagugucggucacauagggaacucuggucucaggguuugaaugacaguguuguugauuaguucaagcucuugccuuucucuaaacuuucuuguguucacuuucaggaauucuaugagcaugccaaggcucugugggaggaugaaggagugcgugccugcuacgaacgcuccaacgaguaccagcugauugacugugcccaguaguaaguaaccgccacccaacccaucagcacauaaaacagacaaaaacaagaaaacaugaaaaccugugauccugcuuugaaaguuacuuguugaugauuccuuucuuagaagccaaccaguuaccccacuggcagaaaguucuaaucugauucaauuguuuauuuauaaaguccuuaauugcauuuuuuuucuuuuagugcagcgacauuauuuuacauaaacauuuaaagccuguuagagcaaaaugaugaugaguuucauaguauuccuaauuaguaggaaguaauuaauugaauugacccuaagcauuuagggaaauagggcugugcucacauuuugaauaauguaaaaauacuauauuuuauugcuguaauuuuaaaacauaacaaagaggaauggugaagacauagcuacgccuccucucuccuugguaguuguugauugaucuauuucugcucucagguaagcgacucuaguagcugccuaguguuacuagauccuagugacucuagguagaguuuguuuuuguguugucuugacuuuugaacucuauuucauauccuuauuuauuccuucucaccgggucuugauucaaggaugguaaguggucaauggauuuuaaauccuaaacuguacaccuaagcaguacaauaccguggugggguuauuuucaaauaaaacaaauuacuaccugcgaggaggacagguuaaggccugcaguagcaaugggaaaagcaucuuucuccaaagucacucauaaaggugggcucaccugguugguguguuggcaaaugaagaagggggaacuuaaaacacagacuuuauugcacaacucuaccugaugcccaggcugcuucccuugcugccuaacaccugacuuaccauugccucagggaucgcccucugucccugucacccaccauggucucucccagaggacaucguacccgauagcuagaaaguugccuuugaaauaguuuauggcuucccucaucuugcacaugauauagcaagcaugugguggucaggguuauuuaaaaaauauguaaacauuauuauuauuuuuuugaaacggagucucacucugucacccaggcuggagugcaguggugcgaccuuggcucacugcaaccucugccuccuggguucaagugauucuccugccucagccucccgaguagcugggacuacaggugccugccgccacaaccagcuaauuuuuguauuuuuaguagagaugggguuucaccauauuggccaggcuggucucgaacuccugaccuugugauccaccugccucggccucccaaagugcugggauuacaggcaugagccaccgugcccagccaaaaauguaaagauaucuucuguuuguugaugcugcagaaaugcacaaagcagucucaguuaaugauauucugaaguaggaguguccugugacuuggggcaggggagucuaguagagguuugauguuuuagccauccuuauuacaaguagcugaaacucggaacugauuuugcuauaggaaguauuagcuaaucagaaccaaggugccaggcugacucaccaagggcuaagauugcuuuacuuaguagccucaagcccaaggaacugauugugaaaaccaccugaauaaacaggagggaggaagagguaauacuguucaucuauaaaucauauaagccucuguuagggucugcgcaaucuaucaaccccagcccugccuucccauaggaaauuccuuuauuuucaauugccacauacauagauauuccacgguuuaauauacaagcaaauguguauauuuuuucaaggaacagaaaaaaacaguccaucuuggcuggucccuauggcccccagcccccacuccuucuucaacaaagucccugauuuucucaaaaguucgaaccaaaagcuggaagcgcuaauuauaguaacgcaaaacaaauggaaauccuggaauuguuugcauuuuguauuuuggauccaagucagaaguuaaguacagguacaagauuaagagaguuuaaccaccccaguuuugaaugcugggggggcagggagacccaguuucguuaauuaacaguagcuuagccagauuguugaauuuugucggguuucguuuucucucucaaaucauuuagaaguuuuugggguuuuuuuaagcaacacuuaauuacuccugaaacuuugucugaaaacgcaccauuuguauagaucaugaaaaguuuuaaggaaacucagagaaaaagagaacaacgcagcuuaaaacuuuuaaaauguccucccucacccguggcucaaacagcccugcaucugccguggccggcacguuucugguugaacugccuuuauguuaaaguucagauacugguagugugcccauuucuuaagcugucuauuuuuauuuguugagcugggguuuggcuggcuccacuccagaugucucucucacaagauuuggugcugaugaucuauuuauagaacugugguucuguugccaugguaacaugcuggaggccagggcggcuggggagcuauuucuggacuggugcuguaauguaagauugauugggcaaguuaguauauccucuaagccagacuaacucugaacuaguaaaaaggaagaggggaacagaaaacuuaggcaguuucuuuaaauaaacuuuucucucuuuaugauuuucuuuucucguuagcccgcuuuaaaacaauuccaaucucuacaugccccucccuccaaaaaauaacugguuuuaacauuaauuuuccauauuaauuaccccaaucuuucaaaaguaaauuuuccugugugucuagucaagcaacacaaacaagaugcuuuuuuuaaugaaaagcguaauaucuggaguguucuauuucauggaccaaacagaacggaagagaacuuuguguuuguuuccuguucaggauggcuagggcgagaagggccccuuugugccaaccucuuuuguucucuuuaaucaaugagauucuuaaaaaguaaaaaggaagggauacagauucucaguaacuaaaacaaucucgugugcccuugaggggaaaguccuugauguuuuuaagaaugucacuuuauuguuuuuuaacugaaugauauagagguauacaauuuucaaacuguuugccauuuuaaucaagcaauuugaaaauuaaaauguuuuugucaggcauuaccaaauggcacagaaugugauaggccagccugguuuugggguccuuucucuacugguugauaugcauaaaaccuucuaaaaaucaagaauauugccagagagcaacaggaauaaagaagcuaaguaaagaauaaaaaagaaaaauagaaaaaauaaaaauaaacacgaagaacaaagccccaccaccgugcugugcuguuuguguggccccacugcgucgaggccacaggcuagcugcuagacgcaucuagaguucccugauuccuaaaauuauuuaucuuaaauccuguuugcccuaaccuucuuaaggcaucagcuuugaguuacaaauguaaccaacacacaagcaaaugugccauugacuuagugcugcauaacugugggacggucacuuccguugagccugaccuuguagagagacacaaauaguuggcaaauugaugugagcgcugugaacaccccacgugucuuucuuuuucucccagcuuccuggacaagaucgacgugaucaagcaggcugacuaugugccgagcgaucaggugugcaaaaccccuccccaccagaggacucugagcccucuuuccaaacuacuccagaccuuugcuuuagauuggcaauuauuacuguuucgguuggcuuuggugagauccauugaccucaauuuuguuucaggaccugcuucgcugccguguccugacuucuggaaucuuugagaccaaguuccagguggacaaagucaacuuccaguaagccaacuguuaccuuuuuauauaacagagaucaugguuucuugacauucaccccagucccucuggaauaaccagcuguccuccuccccaccagcauguuugacguggguggccagcgcgaugaacgccgcaaguggauccagugcuucaacgguaggaugcugugggcuuggcuguucguaaagaacgcuuugcuucuguguuguuagggaucagggucgcugcucacgcucuuggcuuugcucucuuugguuaagaugugacugccaucaucuucgugguggccagcagcagcuacaacauggucauccgggaggacaaccagaccaaccgccugcaggaggcucugaaccucuucaagagcaucuggaacaacagguuuguggagugaccgcccacccccugcgcuugcccaggaggcccuggucugcacuguuuauagagaagaaccccgugcaagcauuccagaccccuggccgaaagcgcgcuucucccaagcauucacacggccucccuucuuguagauggcugcgcaccaucucugugauccuguuccucaacaagcaagaucugcucgcugagaaaguccuugcugggaaaucgaagauugaggacuacuuuccagaauuugcucgcuacacuacuccugaggaugguguguauggcuuccacucuugcuggcuguucauugcggugguucuuuuucaaacggucaggcugaaaacccccaucccccucccaccaccaaaccauaaaggaucuauaagagaagcaagaaaaacgcacucccacuaauucucauauggaaaaaucaggguuuugaagacuucaggagcuacagagaugcuagcaccccagcucugcuugaauuuuaaauuacauuaauauguauucccuuuuuauauagcuacucccgagcccggagaggacccacgcgugacccgggccaaguacuucauucgagaugaguuucuggugagucgagccugucuuuaguuuccucucuuguuccuccucuuuuucucauggauguaaauuuacuuaauuccaaauucagggguucagcuacccaguuccaugguuuuaguucacgcacauccaguguggauuugagcucuuugcgccccucuuuuugcuuuuguuuucauaugacaucagaggcuggcugacagccgucccugguagguguccccaucagggauagggugguuccuggcgagggugucacugacaaguccccuuguuugugcccgcagaggaucagcacugccaguggagaugggcgucacuacugcuacccucauuucaccugcgcuguggacacugagaacauccgccguguguucaacgacugccgugacaucauucagcgcaugcaccuucgucaguacgagcugcucuaagaagggaacccccaaauuuaauuaaagccuuaagcacaauuaauuaaaagugaaacguaauuguacaagcaguuaaucacccaccauagggcaugauuaacaaagcaaccuuucccuucccccgagugauuuugcgaaacccccuuuucccuucagcuugcuuagauguuccaaauuuagaaagcuuaaggcggccuacagaaaaaggaaaaaaggccacaaaaguucccucucacuuucaguaaaaauaaauaaaacagcagcagcaaacaaauaaaaugaaauaaaagaaacaaaugaaauaaauauuguguugugcagcauuaaaaaaaaucaaaauaaaaauuaaaugugagcaaagaaugaugggacucccgugaguuauuugugguucugagcaaauucccgucauucaugguuuugacuugguccuuaggucaaaaguugggaggccccaaggugaaguggguauaaaaucucaccacuguauguuuucuggugacccuaaucuguaggugucuugaaacaauuugcagacaauaggaaaaguccacuccuguuccuccuaaauuucaccccauagugaaccacuaugccccagucagucaccucugcauuuugaucauugccauccuauccaaagauucuaccaacaacucacaccguuacgucaucacacaguuugccugcugacccaggcuucccaagaaaaguaguguauguuuugcuauaagauaagauagggacuaaauuauguggaggagaaauagaggagcacaguguuuccaaucaaugggguuauucaagaaaugguguagccauuuggggaaaauugaggcuggaucccuaccucauugcacacaccaaaaugaauuugacauaaguugaucacauacaucuaaauaaaagagguacuuuuuaaaguggcuauuuuauaauuaaaaccuuggguuuuuaaagggccucucugcagcauaaccuaagaccuaaaggccauaacgggguuggggaugacuauaaaaacgaaaaucacacguaaaauuugaaugggggaagggccugggucagguagaaauuuaacaaaggguuuacuucccuaauaagcaaagaguucuuaugaauuaauaagcaaaaccaucagaaaaaugggcacaguauauaagcaugcaacuuaaauacaaauaauaagccucuggggauaugugggacaucacucauaaauauucaccauaauugggaguggggauggggguccacacucacggguugaaguguggcuuauuucugagguccuguggguucccuagacuuucaccccuacgcuuaucccccaagguguagucucauauguggucacuuccuggguggcuuccaggaagggugggaggaagugaucagcaucaacgauggugcccucugaagcuggccaaaugggacuucaaguucauucuguaauccaggucccaaauccacuuccuauucuaguuuccagaucaaauuacucucacccaaauuaaucauauaguguagcucaccagaggugagcgaugagccccacgggggugcagaaaaguagcaaauaccugcaucuccauccaacuuucacguaacauucaguccacauguucuugcuaugcaauuuuuaguacaaagcccucaaaagccccccaaauauaaaauccaaguaaaaaucggggcuugcuaugcaaauacagcugaaagacuagcccacaaguucccauaauccuccaaagcaccccaaauaaacacacauaaaaccuggacaguggcuaucaagugcaaccacaagaccagcgugccacacaaacauucauccagguaaaggcugugcucagugaaaaucaagguugaacuccagccccuagcuccucuuccaagauggcucccuguaugucccuuuuacauagaaauucuggaaccuucuuagcauaauccacaugagauugucacagcucuagccacauauccaucaaaauuagaaaacacaaaauucccaggccagagaugccaaggaaaaugauaccacagaaccccaccuuguuggucauaacugacagagacuucaugguaucuucuagaagaagggucacaaaagucacaguuaucagguaucuacuagugcuagccauuacccaaugggauagguucagcugcuauuuugacaaugaguaaaagaggcccagagagaccccaagagacgucuccagugagcagggaagaugcgcuucaaacucaaguagccaaaggccacugcuuggucccuacaagauacuguuguccuggaagaugcaggagaaaagagaaaaaggucuccugguguucuucccauuaugucaguuaucaggaguccaugaccugugacccccaucgaaaauccugcaggucaccaugggauuccacagccaggugggugaguggggccucuucccacagaccguggcacuggccauacuccugccucccuaccaggucagggcuuuguccccaccagucaccccguugcguuugagacuugcuucccuauguuaggcuucauugcugcuauuuaaaacauuuuuguuucccuuuucccucugacccuggugccaagcaaaacuucuacagagcuauuuucaaaucuaaauuuuaggauauucaaaaaacaaaaaauuauaaagacuuucauuuaaaucuuugauuacaagaagccauuuuaaaaaaaaagauuuuuuuaaucugaaugccuguaaucccagcacuuugggaggccgaggugggcggaucacgaggucaggagauggagaccauccuggccaacagggugaaacccccucucuacuaaaaauacaaaaaauuagccgggugugguggcgggcaccuguagucccagcuacucaggaggcugaggcaggagaauggcgugaacccgggaggcagaguuugcagugagcugagaucgcgccacugcacuccagccugggcaacagagcaagaguccaucucaaaaaaaaaaaaaaaaaauuuaaucugacguuuaaaucucuauuaaagugcaaagcaaccuauuuuucuaaagguagcgauuugcaccacacuuuguagagauguguaaaccaaauauuauaaaugacuauucauugaccuuuuggauugaacaugauaauaauaaaccauuagggcccuucacaguaugagaagggucuagaauuggacagaauuuuuauuuaccuccacuuuuacuuaaaugugcacaaaauuaugccucccaaaauggccacaucugcauagcccuucuauguagaccauggcauccucuuauuauaguacuuucuuggauggcuuuggucaucuuuucacucaauaaauacauagagacuaugggauccaugccagccagugggaauccugaucucaugggguucauguucuagcgagagagacacacacuuacuaaauaaauaauaaaaagaauuacagauggugacaaaaucucugaagcaauaagcaggaugcaggcaguggggaaugggagauauuugaggagggauuucacuuuagauggaacagcuagggagggccucucugauguaguacauuuucuucugagaaugugaaggaugagaagcagccagccaucaaguacuaauagcuaacaucauuauuuaaaauuguuauuaaaacauaauuaauggccaggugcgguggcucacaccuguaaucccagcacuuugggaguccgaggcgggcagaucaccugaggucaggaguucgagaccauccuggccaacaugguaaaacccugucuuuacuaaaaauacaaaaaauuagucaggcgugguggcaggugccuguagucccagcuacucaggaggcugaggcaaggagaaucgggaggcaaggagaaucugccucugggaggcagagguugcagugagcugagaucgugccacugcacuccagccuggugacagagcgagacucugucucaauaauaauaauaauaauaauaauaaacauuuuuggaggacuuuacuaugugccagguacuguucuacacucuguauauggaugaucucauuuaauccuuucaaagcccuauuaaaaaccaucccaucauuuguacaacagguccuaucccauugugcaguaguuagcucaaacaugaaaaagguaaaucauaucuaaagcauugugaauaauuuaagcaaauuaugcuuuuuaauaaagguuacacuaaaaaggucauugcaauaagcacuuaauuuaaguaauuguuacacagguuccuauuucagagcuggaggacuuugcaucucuaggauaauuuucccacauuaaaaaaugcaugcauaugcuacgaacaccaagucuucucauuuugccuauuuuauuuaccguaucaguuaagaaugcauucagcugcaaguaacagaauccugacccagaguggcacggacaaacagaaguuuauauccacuuaucaagaauucuagagguaggugguuccuguuauuucagcagcucaucaauggcaggacuaauguguccacaauucucuuggcuucucucucaugguugcaagacaguaucacagaacagcugaaggcagaagaggaagggagagacaacccaaacuaaucucuuuuguccucuuuuugucaguguuucauagaggccucuucauucaugcuucaccaugugaaauacacauagauacccagcuauauaugcguacuucgaaaaguaaaaguaacagauagaaaaguaucccucccuccuucucuccuuccuccccuccccucccucccucccucccuuccuuuccuuccuuccuucuucugucuuuuuagacagagucucacucuguugcccaggcugaagugcaguggcgugaucuuaguaugcugcaaccucuacuucccagguuuaagcaauucuucugccucagccuccagaguagcugggacgacagaugcccacugccacgcgcagcuaauuuuuuguauuuuuaguagagaugggguuucaccacguuggccaggcuggucucaaacuccugaccucaagugauccacccaccucagccucccaaaggacugcgauuacaggcaugagccacugaaccuggcuguaucuuuucaauaacacuauuaugcauacacacauagauagggauuuuauuuuuuauuuuuauuuuuauuuuugagauggaguuucgcucuuguugcccaggcuggagugcaauggcacaaucuucagucacuggaaccuccgccuccuggguucaagcaauucuucugccucagccucccaaggagcuggaauuacaggcaugcgccaccacgcccagcuaauuuuguaucuuuaguagaguugagguuucacuauauuggucaggcuggucucaaacuccugaccccaggugauccacccaccucggccucccaaagugcugggauuccaggcgugagccacugcgcccgguugagagggauuuauaauuuccuguuguaugcaccuugacggaacaucugaaaaaaacauauccaaugccuguaguuuuaaggcuuagggaagauauuagggggaauaaaacccuuucaagucauaagagaacaauuugcauaauucuacguaaauaaguuagaaagccuagaugaaauagaaaaucauccaaaaaaauacuucuuaccaaaauugaccccagcagagacaucauaaaucuaagcugaccaguuaccauagaaaaacacaaagcacagugagaggccuccaugacaaaaaggcuccagacucucgcugggaugggaagcuaaugacaagaaggaaacaugagggaaacuucuggggugcuagcaaguuucuauucuugaucuaaaugcugguuaaacaaauauaucccauuugagaaaauucauuugacuguacacuuaggauuuggaacuuuuuaguacauguauuauauauauauauuuuuuuuuuuaaugaggaaaaggaaaaaggcaccaggcccaggugguuucacaggggaauuauauuaaaccuuuaaaagucaaauaaucccugugcuacuuauauuauuccagaccauaacauaauaaaaggaaaaccucaaaauuauuuuuauaaaguauaccacugauuccaaaacaugccaaagauugcacccaaaaauaaaauuacagauuaauuucacuuaugaauaucaauauaaauauuuuaaaauauaagcaaacauaauuccauauuacauuaaaaauaauacaucaugccugguaagauuuauucuaggaauucaagguuuguucaauaugaacaaauacaguaauauaugccaaaauuuaauacugauucauauuuuagaaauccaacaaaauaguaaugaauggaugcuuuucuaauauaaagacucucucuauauauaccacauaucuauauauacuuaguacaguauauaucauguauauaaauaaaaucuccaaaagucaacauuuuaauuaaugaggagcuucuaaaagcuuuuccacuaaugucaggaauaagaaacaagaaacacaaggaugccucacaucaucacucucuuuaucauuguaugagaugaauaagccaauucaauuaggcaaaagaaagcaaugagagaccuagaauuggaaggggagaagcaaaacuaucuuuuugacaggugcaguggcucauaccuguaaucccagcacuuugggaggccgaggcggguggaucacgaggucaggagaucaagaccauccuggcuaacacagugaaaccccgucucuacuaaaaacacaaaaaaauuagccgggcgugcuagcgggcgccuguagucccgugaaccccggaggcggagcuugcagugagcugagaucgcgccacugcacuccagccuaggcgccaaagugagacuccgucccaaaaaaaaaaaaaaaaaaaaaaauuaaaaaauuagccagaugugguggcacaugccugcaguuccagcuaccugggaggcugagguggccagacaacuugagcccaggaagccgaggcuucagugagccauguucaugccacuguacuccagccucagugacagagugagacccuguugcaaaaaaaaauaaaaauaacaggugauuauuauuauaacucuccccuccaaaaauccacggaaaaaucauuacuaaaaagugaaaggauuuaguaaaguacaaaguacagauuuauaagauuaacauguaaaaaucaaua

SEQ ID NO: 12607 - RNA, 89571 nt, Homo sapiens
uauugauuuuuacauguuaaucuuauaaaucuguacuuuguacuuuacuaaauccuuucacuuuuuaguaaugauuuuuccguggauuuuuggaggggagaguuauaauaauaaucaccuguuauuuuuauuuuuuuuugcaacagggucucacucugucacugaggcuggaguacaguggcaugaacauggcucacugaagccucggcuuccugggcucaaguugucuggccaccucagccucccagguagcuggaacugcaggcaugugccaccacaucuggcuaauuuuuuaauuuuuuuuuuuuuuuuuuuuuuugggacggagucucacuuuggcgccuaggcuggagugcaguggcgcgaucucagcucacugcaagcuccgccuccgggguucacgggacuacaggcgcccgcuagcacgcccggcuaauuuuuuuguguuuuuaguagagacgggguuucacuguguuagccaggauggucuugaucuccugaccucgugauccacccgccucggccucccaaagugcugggauuacagguaugagccacugcaccugucaaaaagauaguuuugcuucuccccuuccaauucuaggucucucauugcuuucuuuugccuaauugaauuggcuuauucaucucauacaaugauaaagagagugaugaugugaggcauccuuguguuucuuguuucuuauuccugacauuaguggaaaagcuuuuagaagcuccucauuaauuaaaauguugacuuuuggagauuuuauuuauauacaugauauauacuguacuaaguauauauagauaugugguauauauagagagagucuuuauauuagaaaagcauccauucauuacuauuuuguuggauuucuaaaauaugaaucaguauuaaauuuuggcauauauuacuguauuuguucauauugaacaaaccuugaauuccuagaauaaaucuuaccaggcaugauguauuauuuuuaauguaauauggaauuauguuugcuuauauuuuaaaauauuuauauugauauucauaagugaaauuaaucuguaauuuuauuuuugggugcaaucuuuggcauguuuuggaaucagugguauacuuuauaaaaauaauuuugagguuuuccuuuuauuauguuauggucuggaauaauauaaguagcacagggauuauuugacuuuuaaagguuuaauauaauuccccugugaaaccaccugggccuggugccuuuuuccuuuuccucauuaaaaaaaaaaauauauauauauaauacauguacuaaaaaguuccaaauccuaaguguacagucaaaugaauuuucucaaaugggauauauuuguuuaaccagcauuuagaucaagaauagaaacuugcuagcaccccagaaguuucccucauguuuccuucuugucauuagcuucccaucccagcgagagucuggagccuuuuugucauggaggccucucacugugcuuuguguuuuucuaugguaacuggucagcuuagauuuaugaugucucugcuggggucaauuuugguaagaaguauuuuuuuggaugauuuucuauuucaucuaggcuuucuaacuuauuuacguagaauuaugcaaauuguucucuuaugacuugaaaggguuuuauucccccuaauaucuucccuaagccuuaaaacuacaggcauuggauauguuuuuuucagauguuccgucaaggugcauacaacaggaaauuauaaaucccucucaaccgggcgcaguggcucacgccuggaaucccagcacuuugggaggccgagguggguggaucaccuggggucaggaguuugagaccagccugaccaauauagugaaaccucaacucuacuaaagauacaaaauuagcugggcgugguggcgcaugccuguaauuccagcuccuugggaggcugaggcagaagaauugcuugaacccaggaggcggagguuccagugacugaagauugugccauugcacuccagccugggcaacaagagcgaaacuccaucucaaaaauaaaaauaaaaauaaaaaauaaaaucccuaucuauguguguaugcauaauaguguuauugaaaagauacagccagguucaguggcucaugccuguaaucgcaguccuuugggaggcugagguggguggaucacuugaggucaggaguuugagaccagccuggccaacguggugaaaccccaucucuacuaaaaauacaaaaaauuagcugcgcguggcagugggcaucugucgucccagcuacucuggaggcugaggcagaagaauugcuuaaaccugggaaguagagguugcagcauacuaagaucacgccacugcacuucagccugggcaacagagugagacucugucuaaaaagacagaagaaggaaggaaggaaaggaagggagggagggagggaggggaggggaggaaggagagaaggagggagggauacuuuucuaucuguuacuuuuacuuuucgaaguacgcauauauagcuggguaucuauguguauuucacauggugaagcaugaaugaagaggccucuaugaaacacugacaaaaagaggacaaaagagauuaguuuggguugucucucccuuccucuucugccuucagcuguucugugauacugucuugcaaccaugagagagaagccaagagaauuguggacacauuaguccugccauugaugagcugcugaaauaacaggaaccaccuaccucuagaauucuugauaaguggauauaaacuucuguuuguccgugccacucugggucaggauucuguuacuugcagcugaaugcauucuuaacugauacgguaaauaaaauaggcaaaaugagaagacuugguguucguagcauaugcaugcauuuuuuaaugugggaaaauuauccuagagaugcaaaguccuccagcucugaaauaggaaccuguguaacaauuacuuaaauuaagugcuuauugcaaugaccuuuuuaguguaaccuuuauuaaaaagcauaauuugcuuaaauuauucacaaugcuuuagauaugauuuaccuuuuucauguuugagcuaacuacugcacaaugggauaggaccuguuguacaaaugaugggaugguuuuuaauagggcuuugaaaggauuaaaugagaucauccauauacagaguguagaacaguaccuggcacauaguaaaguccuccaaaaauguuuauuauuauuauuauuauuauuauugagacagagucucgcucugucaccaggcuggagugcaguggcacgaucucagcucacugcaaccucugccucccagaggcagauucuccuugccucccgauucuccuugccucagccuccugaguagcugggacuacaggcaccugccaccacgccugacuaauuuuuuguauuuuuaguaaagacaggguuuuaccauguuggccaggauggucucgaacuccugaccucaggugaucugcccgccucggacucccaaagugcugggauuacaggugugagccaccgcaccuggccauuaauuauguuuuaauaacaauuuuaaauaaugauguuagcuauuaguacuugauggcuggcugcuucucauccuucacauucucagaagaaaauguacuacaucagagaggcccucccuagcuguuccaucuaaagugaaaucccuccucaaauaucucccauuccccacugccugcauccugcuuauugcuucagagauuuugucaccaucuguaauucuuuuuauuauuuauuuaguaagugugugucucucucgcuagaacaugaaccccaugagaucaggauucccacuggcuggcauggaucccauagucucuauguauuuauugagugaaaagaugaccaaagccauccaagaaaguacuauaauaagaggaugccauggucuacauagaagggcuaugcagauguggccauuuugggaggcauaauuuugugcacauuuaaguaaaaguggagguaaauaaaaauucuguccaauucuagacccuucucauacugugaagggcccuaaugguuuauuauuaucauguucaauccaaaaggucaaugaauagucauuuauaauauuugguuuacacaucucuacaaaguguggugcaaaucgcuaccuuuagaaaaauagguugcuuugcacuuuaauagagauuuaaacgucagauuaaauuuuuuuuuuuuuuuuuugagauggacucuugcucuguugcccaggcuggagugcaguggcgcgaucucagcucacugcaaacucugccucccggguucacgccauucuccugccucagccuccugaguagcugggacuacaggugcccgccaccacacccggcuaauuuuuuguauuuuuaguagagaggggguuucacccuguuggccaggauggucuccaucuccugaccucgugauccgcccaccucggccucccaaagugcugggauuacaggcauucagauuaaaaaaaucuuuuuuuuuaaaauggcuucuuguaaucaaagauuuaaaugaaagucuuuauaauuuuuuguuuuuugaauauccuaaaauuuagauuugaaaauagcucuguagaaguuuugcuuggcaccagggucagagggaaaagggaaacaaaaauguuuuaaauagcagcaaugaagccuaacauagggaagcaagucucaaacgcaacggggugacugguggggacaaagcccugaccugguagggaggcaggaguauggccagugccacggucugugggaagaggccccacucacccaccuggcuguggaaucccauggugaccugcaggauuuucgaugggggucacaggucauggacuccugauaacugacauaaugggaagaacaccaggagaccuuuuucucuuuucuccugcaucuuccaggacaacaguaucuuguagggaccaagcaguggccuuuggcuacuugaguuugaagcgcaucuucccugcucacuggagacgucucuuggggucucucugggccucuuuuacucauugucaaaauagcagcugaaccuaucccauuggguaauggcuagcacuaguagauaccugauaacugugacuuuugugacccuucuucuagaagauaccaugaagucucugucaguuaugaccaacaaggugggguucugugguaucauuuuccuuggcaucucuggccugggaauuuuguguuuucuaauuuugauggauauguggcuagagcugugacaaucucauguggauuaugcuaagaagguuccagaauuucuauguaaaagggacauacagggagccaucuuggaagaggagcuaggggcuggaguucaaccuugauuuucacugagcacagccuuuaccuggaugaauguuuguguggcacgcuggucuugugguugcacuugauagccacuguccagguuuuauguguguuuauuuggggugcuuuggaggauuaugggaacuugugggcuagucuuucagcuguauuugcauagcaagccccgauuuuuacuuggauuuuauauuuggggggcuuuugagggcuuuguacuaaaaauugcauagcaagaacauguggacugaauguuacgugaaaguuggauggagaugcagguauuugcuacuuuucugcacccccguggggcucaucgcucaccucuggugagcuacacuauaugauuaauuugggugagaguaauuugaucuggaaacuagaauaggaaguggauuugggaccuggauuacagaaugaacuugaagucccauuuggccagcuucagagggcaccaucguugaugcugaucacuuccucccacccuuccuggaagccacccaggaagugaccacauaugagacuacaccuugggggauaagcguaggggugaaagucuagggaacccacaggaccucagaaauaagccacacuucaacccgugaguguggacccccauccccacucccaauuauggugaauauuuaugagugaugucccacauauccccagaggcuuauuauuuguauuuaaguugcaugcuuauauacugugcccauuuuucugaugguuuugcuuauuaauucauaagaacucuuugcuuauuagggaaguaaacccuuuguuaaauuucuaccugacccaggcccuucccccauucaaauuuuacgugugauuuucguuuuuauagucauccccaaccccguuauggccuuuaggucuuagguuaugcugcagagaggcccuuuaaaaacccaagguuuuaauuauaaaauagccacuuuaaaaaguaccucuuuuauuuagauguaugugaucaacuuaugucaaauucauuuuggugugugcaaugagguagggauccagccucaauuuuccccaaauggcuacaccauuucuugaauaaccccauugauuggaaacacugugcuccucuauuucuccuccacauaauuuagucccuaucuuaucuuauagcaaaacauacacuacuuuucuugggaagccugggucagcaggcaaacugugugaugacguaacggugugaguuguugguagaaucuuuggauaggauggcaaugaucaaaaugcagaggugacugacuggggcauagugguucacuauggggugaaauuuaggaggaacaggaguggacuuuuccuauugucugcaaauuguuucaagacaccuacagauuagggucaccagaaaacauacaguggugagauuuuauacccacuucaccuuggggccucccaacuuuugaccuaaggaccaagucaaaaccaugaaugacgggaauuugcucagaaccacaaauaacucacgggagucccaucauucuuugcucacauuuaauuuuuauuuugauuuuuuuuaaugcugcacaacacaauauuuauuucauuuguuucuuuuauuucauuuuauuuguuugcugcugcuguuuuauuuauuuuuacugaaagugagagggaacuuuuguggccuuuuuuccuuuuucuguaggccgccuuaagcuuucuaaauuuggaacaucuaagcaagcugaagggaaaaggggguuucgcaaaaucacucgggggaagggaaagguugcuuuguuaaucaugcccuauggugggugauuaacugcuuguacaauuacguuucacuuuuaauuaauugugcuuaaggcuuuaauuaaauuuggggguucccuucuuagagcagcucguacugacgaaggugcaugcgcugaaugaugucacggcagucguugaacacacggcggauguucucaguguccacagcgcaggugaaaugaggguagcaguagugacgcccaucuccacuggcagugcugauccucugcgggcacaaacaaggggacuugucagugacacccucgccaggaaccacccuaucccugauggggacaccuaccagggacggcugucagccagccucugaugucauaugaaaacaaaagcaaaaagaggggcgcaaagagcucaaauccacacuggaugugcgugaacuaaaaccauggaacuggguagcugaaccccugaauuuggaauuaaguaaauuuacauccaugagaaaaagaggaggaacaagagaggaaacuaaagacaggcucgacucaccagaaacucaucucgaaugaaguacuuggcccgggucacgcguggguccucuccgggcucgggaguagcuauauaaaaagggaauacauauuaauguaauuuaaaauucaagcagagcuggggugcuagcaucucuguagcuccugaagucuucaaaacccugauuuuuccauaugagaauuagugggagugcguuuuucuugcuucucuuauagauccuuuaugguuugguggugggagggggauggggguuuucagccugaccguuugaaaaagaaccaccgcaaugaacagccagcaagaguggaagccauacacaccauccucaggaguaguguagcgagcaaauucuggaaaguaguccucaaucuucgauuucccagcaaggacuuucucagcgagcagaucuugcuuguugaggaacaggaucacagagauggugcgcagccaucuacaagaagggaggccgugugaaugcuugggagaagcgcgcuuucggccaggggucuggaaugcuugcacgggguucuucucuauaaacagugcagaccagggccuccugggcaagcgcagggggugggcggucacuccacaaaccuguuguuccagaugcucuugaagagguucagagccuccugcaggcgguuggucugguuguccucccggaugaccauguuguagcugcugcuggccaccacgaagaugauggcagucacaucuuaaccaaagagagcaaagccaagagcgugagcagcgacccugaucccuaacaacacagaagcaaagcguucuuuacgaacagccaagcccacagcauccuaccguugaagcacuggauccacuugcggcguucaucgcgcuggccacccacgucaaacaugcugguggggaggaggacagcugguuauuccagagggacuggggugaaugucaagaaaccaugaucucuguuauauaaaaagguaacaguuggcuuacuggaaguugacuuuguccaccuggaacuuggucucaaagauuccagaagucaggacacggcagcgaagcagguccugaaacaaaauugaggucaauggaucucaccaaagccaaccgaaacaguaauaauugccaaucuaaagcaaaggucuggaguaguuuggaaagagggcucagaguccucugguggggagggguuuugcacaccugaucgcucggcacauagucagccugcuugaucacgucgaucuuguccaggaagcugggagaaaaagaaagacacgugggguguucacagcgcucacaucaauuugccaacuauuugugucucucuacaaggucaggcucaacggaagugaccgucccacaguuaugcagcacuaagucaauggcacauuugcuuguguguugguuacauuuguaacucaaagcugaugccuuaagaagguuagggcaaacaggauuuaagauaaauaauuuuaggaaucagggaacucuagaugcgucuagcagcuagccuguggccucgacgcaguggggccacacaaacagcacagcacggugguggggcuuuguucuucguguuuauuuuuauuuuuucuauuuuucuuuuuuauucuuuacuuagcuucuuuauuccuguugcucucuggcaauauucuugauuuuuagaagguuuuaugcauaucaaccaguagagaaaggaccccaaaaccaggcuggccuaucacauucugugccauuugguaaugccugacaaaaacauuuuaauuuucaaauugcuugauuaaaauggcaaacaguuugaaaauuguauaccucuauaucauucaguuaaaaaacaauaaagugacauucuuaaaaacaucaaggacuuuccccucaagggcacacgagauuguuuuaguuacugagaaucuguaucccuuccuuuuuacuuuuuaagaaucucauugauuaaagagaacaaaagagguuggcacaaaggggcccuucucgcccuagccauccugaacaggaaacaaacacaaaguucucuuccguucuguuugguccaugaaauagaacacuccagauauuacgcuuuucauuaaaaaaagcaucuuguuuguguugcuugacuagacacacaggaaaauuuacuuuugaaagauugggguaauuaauauggaaaauuaauguuaaaaccaguuauuuuuuggagggaggggcauguagagauuggaauuguuuuaaagcgggcuaacgagaaaagaaaaucauaaagagagaaaaguuuauuuaaagaaacugccuaaguuuucuguuccccucuuccuuuuuacuaguucagaguuagucuggcuuagaggauauacuaacuugcccaaucaaucuuacauuacagcaccaguccagaaauagcuccccagccgcccuggccuccagcauguuaccauggcaacagaaccacaguucuauaaauagaucaucagcaccaaaucuugugagagagacaucuggaguggagccagccaaaccccagcucaacaaauaaaaauagacagcuuaagaaaugggcacacuaccaguaucugaacuuuaacauaaaggcaguucaaccagaaacgugccggccacggcagaugcagggcuguuugagccacgggugagggaggacauuuuaaaaguuuuaagcugcguuguucucuuuuucucugaguuuccuuaaaacuuuucaugaucuauacaaauggugcguuuucagacaaaguuucaggaguaauuaaguguugcuuaaaaaaaccccaaaaacuucuaaaugauuugagagagaaaacgaaacccgacaaaauucaacaaucuggcuaagcuacuguuaauuaacgaaacugggucucccugcccccccagcauucaaaacuggggugguuaaacucucuuaaucuuguaccuguacuuaacuucugacuuggauccaaaauacaaaaugcaaacaauuccaggauuuccauuuguuuugcguuacuauaauuagcgcuuccagcuuuugguucgaacuuuugagaaaaucagggacuuuguugaagaaggagugggggcugggggccauagggaccagccaagauggacuguuuuuuucuguuccuugaaaaaauauacacauuugcuuguauauuaaaccguggaauaucuauguauguggcaauugaaaauaaaggaauuuccuaugggaaggcagggcugggguugauagauugcgcagacccuaacagaggcuuauaugauuuauagaugaacaguauuaccucuuccucccuccuguuuauucaggugguuuucacaaucaguuccuugggcuugaggcuacuaaguaaagcaaucuuagcccuuggugagucagccuggcaccuugguucugauuagcuaauacuuccuauagcaaaaucaguuccgaguuucagcuacuuguaauaaggauggcuaaaacaucaaaccucuacuagacuccccugccccaagucacaggacacuccuacuucagaauaucauuaacugagacugcuuugugcauuucugcagcaucaacaaacagaagauaucuuuacauuuuuggcugggcacgguggcucaugccuguaaucccagcacuuugggaggccgaggcagguggaucacaaggucaggaguucgagaccagccuggccaauauggugaaaccccaucucuacuaaaaauacaaaaauuagcugguuguggcggcaggcaccuguagucccagcuacucgggaggcugaggcaggagaaucacuugaacccaggaggcagagguugcagugagccaaggucgcaccacugcacuccagccugggugacagagugagacuccguuucaaaaaaauaauaauaauguuuacauauuuuuuaaauaacccugaccaccacaugcuugcuauaucaugugcaagaugagggaagccauaaacuauuucaaaggcaacuuucuagcuaucggguacgauguccucugggagagaccauggugggugacagggacagagggcgaucccugaggcaaugguaagucagguguuaggcagcaagggaagcagccugggcaucagguagaguugugcaauaaagucuguguuuuaaguucccccuucuucauuugccaacacaccaaccaggugagcccaccuuuaugagugacuuuggagaaagaugcuuuucccauugcuacugcaggccuuaaccuguccuccucgcagguaguaauuuguuuuauuugaaaauaaccccaccacgguauuguacugcuuagguguacaguuuaggauuuaaaauccauugaccacuuaccauccuugaaucaagacccggugagaaggaauaaauaaggauaugaaauagaguucaaaagucaagacaacacaaaaacaaacucuaccuagagucacuaggaucuaguaacacuaggcagcuacuagagucgcuuaccugagagcagaaauagaucaaucaacaacuaccaaggagagaggaggcguagcuaugucuucaccauuccucuuuguuauguuuuaaaauuacagcaauaaaauauaguauuuuuacauuauucaaaaugugagcacagcccuauuucccuaaaugcuuagggucaauucaauuaauuacuuccuacuaauuaggaauacuaugaaacucaucaucauuuugcucuaacaggcuuuaaauguuuauguaaaauaaugucgcugcacuaaaagaaaaaaaaugcaauuaaggacuuuauaaauaaacaauugaaucagauuagaacuuucugccagugggguaacugguuggcuucuaagaaaggaaucaucaacaaguaacuuucaaagcaggaucacagguuuucauguuuucuuguuuuugucuguuuuaugugcugauggguuggguggcgguuacuuacuacugggcacagucaaucagcugguacucguuggagcguucguagcaggcacgcacuccuucauccucccacagagccuuggcaugcucauagaauuccugaaagugaacacaagaaaguuuagagaaaggcaagagcuugaacuaaucaacaacacugucauucaaacccugagaccagaguucccuaugugaccgacacuuggugugauuuugaauuuugagcccaauuaaugaauuaaugcucacaaagaacuuuaauucaacacguuaaacauauucaaaaguucacgcaauuagcugcugggucuuauugugaauuacugguuuuggguaguuucuuuucucguguguagggggaaugggguaagcuacugaguaauuuaguuucuucacagaauuguuuaggaagaauauacacuaaauguguuagaauaugccaauaaaugguucaauguugugaaaauaagaaacuucauuuguaagaugugcugggacuaaauuuuccuccugggaaaaugugaaucuuaccaaaaaaaaugaugaugggggacuuguagguaggaacauaaaaguucagauguuaguaggacuaauaaaaaguuauuguucugauacauuuuuaauaggcugcuguuuccuuuuccuauuaaauauagaaucauauuucaagaaagucaguggguuauauuauacauauuguguuuauugcuuuuuuuucaaaauaaugcuauuuaaaaaguuuagcuauccauacuaacuauauaccacuaaauuucuccaauuuaaguuugcagccaaguccaucuaaaauauacaaacacaaauucccacgaaagccugacaaaaggcaacaauaacucauuguuuuagcuguagacaagucucuucccugugggucuuacaaacgcauacaucuuuccaucucguuucccguuccccgcuuauaagccauucuccccacgaaggggccuaaacuuauaugcuugggcuugaacaguuuuuuguucccuaaaaguaguucuuuagggagccaacagugucgugcauccagaggaaagucuuuuccauauguucuauuuuaugauuuuugaguuaugauuuagauauauuucauuuuuuuuaauaaugagaaaagauuucauuugccccaaggacuuuagaaaacucuuaauaaaaaggucaccuguuuaaaaugagaaugucuuccauuuggcacuucacugaggcaucccaagguaccuuagggcacuuccaguggaguaaauggacaauuaguauuugugugccauauuuaacauacaguuuuguccuaagaugugaaugagggaauaauuaagccugccauagcucaggaccuuuuuccucauaaaaauuuacaaucuaauaaagugagauuguaguauucaagagugauguuuauuugugaggacaggugagcuaagauguagaaggggugacagaauuuugcucauccaucuugaacaaagcccuaaugauuauuauuauuaaauuaagguuacacaugaaauuaacuuuuuccuaaggauggacaucacugaaauguaguuuugccugaagugugguuuggaugcuccugcccaugugcagggcugucacucauguuccuauauggacacugugcucaggugggcggggcuaaggccacacaagucgggguguagcuuacgggagggaagucaaagucaggcacguucaucacacucaggauguaguccacucugaacugguucucgggguuggccagcuccacggggggcaccagguugcucauggcggccacaauggucugaaaaugauuuagcaaagcggucagggaacagcacuggcugggagggcgcuacaagacagacagcacaaggagccagcacguacuucaaucgccucuuucagguuguuuuugauguccugcacuuugguugccuucucacugcagugggauugaaaagaaaagaaaaucauauugcaccaugucaguuaggaguacugcuuucauaaagacaucccgacuaaaaagcauaguauucuguucuucagggaguuguggguucggaucugugcaaagauuggagguagcugaauaaacauaguugcaaauuauaaccucccaaaugugcccugaggacacgcccaaucggggcagauuagcaaauugccuuagcaaucaugacuguaccagaaguugcaugcagcucauuuaaucuuucauggguuugaagcccccacacuacauacuaacacuuccuaaaggcuucuccugguccuaucaacaucuggguaggggugaggcuggagugauaggucacuaugagguugggguggaacaaaacagucccaugguuugacuuggaauuaacucaguugcuagcauacugagagaaccagugagcacagguggugguguuuauaauaguucauuacaggagcccgggugcgguggcucacaccuguaaucccagcacuuugggaggcugaggcgggcagacugccugaggucaggaguuggagaccagucuggccaacauggugaaaccccgucucuacuaaaaacacacaaaaaaacuagcugggcaugguggcaugcaccuguaaucccagcuacuagggaggcugaggcaggagaauugcuugaacccgggaggcggagguugcaguaagcugagauggcaccacugcacuccagccagggcgagagugagacucugucaaaaaaaaaaaaaaaaaaaaaaaaaaaagucguaugugcgaugcuccaggcacugcagcuagcagcaaugaaacuucuaguucaugauguuagugcauguugguccaugugcaauaggaaucaaauaagauuccacccccuagaaggccuuauaaucuaagggggaggggaggucagaucccucugguaaguagagguugaagguuuuguagcuuuuccuugaguuuaacucagccacaugggauggccugcguggucuuuauggaaugaucuauauucagggucacuggucccacagguaaaggacacacccuuuggcuucuggggaccauaacagaauguuaauuuuuguaccacauuacacugauccaaaugcuguauguuuuucagaaacuagccuucauuagaagcacagccagggaagguucucgaguuuauguuuuuagagggcaagaaaaggccucuuguguggaguauguaucucaucaggucuauagcccaaaaauggaaccagcacacacagcacaccugcuguaccuguuaggcccugggaggugagggcguugucaugcggaaaaaaggugcuacgguccugccucucugacagggaaacugaggccaagagggggggagucaccgaggcagaaaccaaugggagauggaggggacagaguuuaucuuuuucacgguuuguauauauauauuuuuuaaucuuuugagagucccaguuuuugaagcauucacuuggcugauucaccaauucauagacuggaguagaaauuaaaacauauaaucucuccagacuagaacacgacaguuaaggcagaggaaaggcgaagggagguuaauuagcaagagcagacgagcagacgagcagggcagggcagucaguggagcagcagggguggggggcggggacggacgguggggucaagugcgggccugucgacaggccuuccacaaaucauuuggucuuuccuuucucaaagaauuauacuuacaaauuuauucuuucugaauaaaugucuguguacuucugggccuucaccugcugaaggaucccaucucgcccccuuccuacgugaagccccuuucacaggucacugcaccacugcucuucuacauugggugaagagcuggggaaguucagaggggccacgcucauuagugguggggggugucugggguggggaggggggacagauguugccaggaauccccucagggccauuuaaguaaaagugcugcagguccggagaaucucagaaacacagaugacagggaggugagcgagcuucaggccuuguguacaaaucugaaaucugauucuggcccccagacucuuaaagcaaccaccuuagagugaaagggagugaguccugaccgcucugugcgacugucugcuuuguaugugcagaaucaaagcucauuucugaaauuaagaauccccggccuugguauuacagucuaacaucgauuauuuagauguuauaaauuaaaaggacauguguuugaugguccccaauguucacuuuugaauucagaauuuacccaaaacccccuagggcaaaucuauucccauucauuaaaagcaggcuccacuucacagguaaugaaagcuauuaaccuuugguuuugagguuccacaauaguaaaauuaaauacauucggguacuaaauauccaaaucugcauacagcaagagaaaguauuuccagaaacaaguuucuuucauucaguuugauauuuuggucuaagcaguaguaugauaauuggaaaacuucccgucuuaaaauacggauauuuugagaacguguucaguauucaucuacguaugugaauaggugugggaguauaucaaguauaaaacagcuaaaauagaaaucuaaaaucuaauucggguguguaauacuaaaacauaaaauucuuccauugaagcaauuacuauguagauggagauauuauacuggggguuggcggguuuaucaucacuuuuacuauugcuuaaugaauuuaacguugauugugaaauucagagaaaauuccuuagaugucuuuaaacuacucaacaaaggcaaaacauaugccauuagcuagaauucugauucgcuacaaaauugggacuaaggcuggaaguacuuuuagggucuugguuccuccuccucccccuucuauguauacagcagaugggaugcguucaguuuuuaagagcuccuccccuccccccgcuucagcuaacuaaguggugggggaagcuauucaggucuccaccuuaauccuugugcuuuggugggaaaagacagacaaaggaaggaagacagaagacagacgcgagauacagggauugcugaaacaugcagagaauuuuuauuuaucacgaauguuaauacuuauauugacuugcagaacagagugagagagacgugcaggccaagguauuaguaggguucaaggguuuagcaggacaucuaguacacaguagguugcucacuaaggacuugucauaucuugcucaaaugccaacuuuugguacagcagauugucaauuagucauuucuuauagagaugccuuuuuggauaguugucauacuacauuucugccaauuaaggauuucaguucauuuuucguuuuuucaaucaucguuuaaggucagguagcaggggccccauccccccuccccccucagauaacagaauaguauucuuauuagaaguuccuaagaccgagcaauuccagcaugcaaauugugauaggacauagccgggaagaugagaaacuguagccaucaucuagggauauuauauucuaaaagaaacagaugaacaaacaugugucaguuacuuuguccccagaccccaauaucuuugccccuccccuccccggccacagaagcuguuucuuugagaugcccuaaacuaagucaaugguucuggauggucucaugagaaauagccacuccaccacugcaugcuaaauacacagcagagcuagagugguuaccuggcaugcgugugugugugcgcggcgcguguggcugugugugcgugugaugugugugcgugucuguguaugcaugugcaugugugugcgugugugugugugugauggguguggggaugcaggaagcaaagaaaaaauaauuugauaaugaauggaaaaauaaaagaugccaucaugaauuuccuuauccaccaagcuaacguaaagugccuuugauucaaauaaauuugaucauuuuuaaaaggccagaggcuuuucgagaugauucuuaacgaccugcugcaagguaccaaggcguuuuucaaaauuaaagacggugcagcauugcauauuuuaauaaaggaaacaaauuuuguuucaaagaggucugaaauuuuaaaaucagaccaaccaguggguagauggaauuuaguagauaguuuuaaaacaagcagcugguucaaauggagagcugggggaaaacagaaaccauauggaaaaacaucaauucucaaaauccuaaacugaucauccaaggcugaaaucuauaacuuucccccagcuggaucucauucuacuuuaagcauggccaaaaaaauuuauguuacgcacuuuacuugcuccaaaaugucaggaaauuguguguuauucacaaauguaugccaauauggcugaugguccuuuaaaugauuuuuauuuucuucccgggucucuggccucaguuucccaguaugaucuucauguuuguuugguuuguuaacaauuuuuucugguuuugaaugugccuacccaucgcuguugcuccuugcagccugcggguccucuucgccgccccuuuuaaagagagauugaaagcucaccuaaucugcaaggcaccgcagugucacacaaaccccacacagucucucuacauuccucaaccaucagccaagagcaaaagcaacaauucgcgcgccagccauccauccucccggcaauucuuaggucgccuuucuggcuaaauuggaacauccacugagacugcaggccaugggggaagaaucccacaccuuugcugcaguauuaacagagcucucuggagacucuggucggagacaggagggauggauaauuguuuucuugugcuuucacuaaacguacacgcauuagggagcuaaagcagugauuuaucucacaauucuuuggagaauauggcagcgcauaaggcuccuaauucucccaggucagaaucuucccaagguuguaacuuaaggcauaaaggcauaaacgggggagauuucugcccaggauuuccugcaaaacuaaugaccucacuucuugcaguggaaggaaacuaccuauaaaaugguuuuauuuauaaauaauuguuccccauaaauugucauuaaacuaugucuggacugugauguagcaaaaaaaauuucaaagaacaaaagcccacccaccaccaccacagaaaaaacaaaaagaacaaaagcccacccaccaccaccacggaaaaaagaaaaagaaaaaaaaaaccaaaaacccaaacccgaucuucauaaacaguaggaauuccuccuugaaggccgaagggcagcauucuacaguuugguaauugauuagcuuaguucaaccaauguuaaugguguuuauguuuuguuuuuguuuuguuccuggcacuaaauguaagaaacagaguuaguuuugaguuagaaaauccgcauccaaccucuguauuucugaaggucaaaucaguauuaucuuacucuuaaaaauguaaucagcauggcagcccgcagagaguuaaggcaaauuuaauagcucagccgagcccuaacaaaacgcaagaucagggaggaagaacccuguaccacccagaccacccuuuagggacagaugucacugucucauagggaauuccuaguuaagaaggaaauagcuuuuguugcaauaccgcagugaggaaaaagaaaaaaggaggcaguuggaugagauaaaaauaagguaucuaggcucccaugaggaauaccccuguaaacccucucacaggcuaaauuuaacguaucugugcccuugucugcaaagaaggcaaacugggaauguugcuuccucuuuccaaaaagaaaacagaaaagagaaguucugguuuaaaacccuugccugguguuacaggcuggcucgcuuagggaggagaauccuuucuauaaaaauuuuuaaauuuuagggcaaucuguaaugaagcugucaguaauuuauuucaaaggugacuuagcuuccauccgacucaagcuaagguaaacaguggcugcugcaucuuugaaaaaugcuagccauguccaguuuucaucaaaauauuuaucuagaggauacauggucaaauuauuuuugcuuaacuacucucaugaauaaguaaguacuccugcaaguugcagggggaaaauuuaugcaagauuuuucuucaaaugacagauucaugguuggaagucugucucaggguuauuuauuuauugucaggauggcagucuccgcuggcagggcuuuaucgaggggugugucaagaauuaauuucggaauugguuggugacaagugaugcugacuuacucaauagcacguaugugcauguugauaacccauugagagucauaaucagaugagugaagaagcccccugugcaucccaaccaauccuucugaauucaggguuaaaguagaaaaagcauccucaacuaacaggacuauucguaugggugaugucauccuucucuaaacaauuauuugaucuaacaaauucuagaauucucuauaaggagcugccugccuugcucugaaaggugaaaaaguucaccuuuguuuccuggaugcuuagugacuaguaaagguuuuuuuguuuguuuuguuuguuuuuuuggggggugguugguauaauuaaacgcuaccaccuugacuccaacuccccuuuugaaauggaagcugaagcaacucaagguuaaauuuucaaucgaauccaaguuuaagaaagggaacaggacugugccaaccagcuaguaauuacaaacuagugccuucaggugcuugaaaucuagugcgguuaaugcucucauaccagugaaaacagacuggucaacuuaguuuuuuuguuuuguuuuuucuuuuucuuuuuuuuuuuuuacacguuuuguuacacgagaacgauggguaggccccaucuggggucuuggggagaaaagcaaguuccccgauuuauugaauguucccuguuugcauuccccaugccaggcagggcuuccuaacucgucucacaggucuaauacaaagucucuccuguuuaaucuucauucccacuacggauugccacauugugcuauaccaggauaccugggaggacuucucaaaggcaaaaaugccccucagugaggcugggagugccuaacucccagucuuuccauccuuuaaauaaauguucccucuucuuuucuguaggcagggguacugauuuguuuuuuguuuuaaagggaaacaaugauuuacccauaaugguaauuuaaagggggacaaaaaaaaugagaaacuguaaacacgggcugccacuuccacaucuguuucuggugagaauauuauggaaacaauguuucccuaauaguuuaaaacauccuguguugguucauuacauugaaaucugcgugaggugggguggggugaauuugcagugaucagcgugggccggacgagggggcggccaaagccacguugaagacacugcagugauguccgaagacuguggcagggaccuggcccggagaggggcugucacggggccaagugcugucaagcguccccugcaaccaggcacgauuuucuugggauagggagauguuugucacaaacacuggugcuuucaucaguaguauuuguugcaccaaagauccaaggggguggggggugagggacccuaaagagcccuucccaggauuuucuaauauguaaaucaggaaaaauuaagugaaaacuggcugcccagcccccaaagcccaccuauacuuccuaaagguuaguauaaagucuguuccucuuacuuggugccccccugcacagauuugacacuuacucuccauuaaacccauuaacaugcaggauccucaucugcuucacaauggugcuuuuaccagauucuccagcaccuagaaaaugaaaguaagucucagguuaugaaggaggcauuuuaacacuuugggcagggaggucugcuguuguuguuuuguuuuuccauagaagcaacaugcaaaaaaccaaacacaaaaucacagacuugcaacuuuccuugacauuucgacgcagagaaaaggaaaucaauguccaauucagugucuaccugcaguauuucaccauccaaauaacaaacaagaauuuaagguuugcugguuuuaauuuuucuuuugauuguuuaaaaaauuguggggugguguuggaaaggggcaaagagaaggaaugacgcaauuuugucauuugugggguaaacaagaaaauugaaguuaaaacugugaaacugaaucccugauacaugaacauucacacauaaacauaucuagacacauaauuuguugucagauguuucaugguuaaaauacccgggauucccaacaaugcccagacacugcagucucuuccacaucacguagcgaugcagcacuuuccuccucaacauuuucacaacgcagcuucuuucugugcagguuuccuaccccuugggcuacuuaaaaauccaccccuaaaacugcauuacauuuuauccacuuauccauccuccucuuuccucacaaacuauaucuuucuaaagauaaauucccucuggguacaacuauguugcugaggaaaaggggagaccaucaauuaucugucaucuucuggaaaaaccacacuuuaacaucaaauacaguuccugagacccuauuagcauuagguaaacugcaaaaacaacaguaaaaaguaacauaagaacaaaacuuuaaucaaaaggaaaacuaucccugggaaguacugaauuugaaagauuccaagcccuucccaacucaaagaguagaaacacaugccuccauuuuaaaucaucuuucauuuguaaaaauacauauauguuucauggaaaaaacacauuuccaucaagcuagagggaggauugcuauuuugcaucuuuuuugcaaugcacauucuccaacagauaauccacgugugaaguuuuuuugcccuccuuccacacaaaucuguuauuaccuuuuucuuucuuuuuaacuuuuaauuguauuguuuuguuuuaaugcccagauagcacagcauuccuccuuuacuugccuuuucacaagcccguaaucaauaucuguaaaaguuaaaauuaguuuccacagaaacauugauuucaaagcaaacacuaucuuaaugagccuaacucugguaaauuaaaaauauaaauggcacuauuaagagaggccaaggaaacaauacguaauauuuagcaggaucucuaauauucuaauuucagaaguguuaaacuguguaacaguuacaggaccuaucuuucauaggcaaaaacagauccgugccucaguuuccacauuuaugaaauguggcugaaaaauuauuuuaagaucauuguaguucucuaauucacuuaauuuuuaugucauuaagauggaguaaaaagaggauuuggggcauuauuagguuuccucuuuuguggggaggcauuauuuggugagaaucaccauuuaaaaaugcaaaauauugugucacuggcuuaagcugcagauuccuaggccagaggcaaucaauacaucaugauguaauguagucauauagacuaggacacuuagauuagcccccgugacgcaaggcguguucugaguaacagucucaaauuaaguggagacuuugugaucacugcacaaaagguguuggaaauuuuaagauaucauuagcaucacacuugacuuaaaguaguacugagauagcauucacagaaaagauucuagacuuuuccagauuuauacuuugaaaucaaguuauacgcauacuaauaucccaacagcauaauucugccuuuaaaaguuuuagacaagacagcaacacauguaccauuuaauuacugaaauugcaaaugcauaaacaccaaagacacuuauuuugacuuaauuaguaauuuucugcuuuuauaaaucuggacccaggagaacaaagucaugaccuaugcaaaaagagcaaaccaaaagccaccaaaggaaaauaaauaagaacagccuuuuauuauuuucuuuauacucaagcuguuuuguugaaaugugaccacgaacuaggucuuaaccuagcaaauucacaaauuuauucagauagccaaauuaucaaggaaguggaaaacuuccauuuuuaauuaaugcuguguaauucuuuuggucauuucauuacauuuuuuucccccaaaacagcaccuuaagaaaaaaaaggaggaaaggccaucuccuuauaguuaaccuuuuuuuauuuuauuauuauuuuuuuaaucagaggaaaaaucgcaaucaaaaaaagaaaacccaaaaccaaacaacuaaaugucacuugauaaacaacuaauuaaugucuuuuuaucucuucccaccuggaggaaaagucuccuuagagcacucucaauccccccucccaccuugaggaggacaaaaaaaaaaaaaaaaaaaaaaagaaaccacgccauuuccagaccaagaagccauuuacagacaaaugucauucuccaguuuuaucugauuugugaaugucuuuguuuuuucuuuucacaaagcacucucaauguggccagccagcaggaaaauguguuuuuuuuaaugguuuauuaaaauaguguugggggggcgcugcucgugguggguggggggggcagcugcuacaauuaauucuccgcucugcuuuugaaaaagccugcaagucuggaaggggaaaaaaaggucacacuguaaaaugacgugucauuuggcuucacugggcacuucucguacuaacucuauccauuuuuugguguugggggguggucuuauuuuauuugacucuccuucuccuccuuccacggcccggccuggcccgggacacgucugcuccgcgcacacacagucagucgguccugcccgaaacgcaccaagucgcgcccagcggcaaccgcccucccuccuccccucgccgccccccucccgacuccggcgccacgacucccuugcgcccccucccccccacugcaccaccuuuaccgcuccgauccuuuccgaggggcugaugucaccagcccccccacucuccucggccacuucuccccgccaaagccucccuuuggcgaggcccccuccgccaccacggcgccccccagcgucacccccuccucuccucgccccuuucuuccccucuuucccucucccaacaaaucucacaccccacggaggcgggucccccucccucuacccgccacccgguuuccuguccccgaaacccucuuuuugucgcagucuccggagccccaugggcucccccucccccuccccaacacgcacccaaaccccuggcgucguguaggccucgcggaaaaagagagaaagagagaaagagggggagagcgagagcgagagcaagagagagacacugagcgggcaggccgggggagggggacccgcgcccgcgucgccacggccccccgccccguuuuugagcccccgcccggccgaauccgcgccccugggucccccuuccggccucgccccccacagacagagcccgcgaacgggcggggggcucgggagcgcgcgcccggggcggggggcgggcucggcgcgcgcggccugcggggcgcccuucgagggcccccgggccggggccggcgccccccgcccgcccuuacccagcagcagcaggcggugcguggcccgguagaccugcuuguccuucugcagcugcuucucgaucuuuuuguuggccucacgcugcgccuucuccucguugcgcugguccucggucuuacuguucccgaggcagcccauggcggcggcggcggcggcggggcgcggccgggcugcggcggcggcgggcgcgggcggccucacgcgggccgggagggccggggcagcgccgggcgggcgggccgggcgcgggcucggcuccucggcaaggagcgcgcggggcggacugcgggccgcgggccgcggggcgcgcggacgggcgggaaggggagggugucggucggaccgaggggcgcgcgcagcuccccgccccucgagccgaggccgagggggcugauggccgccgccgggccgaggcggaccagagcaggagcugcgggagcugcugccgccgcugccgccgccgccgcucuuauugccucggccgggcccccgccgccgccccgagccaaaagcgccgcggcgggcggggggaggcggggggaggaggaggcggcggcggcgagggggguggaaggaggaggaggaggaggagggccgaggagcggccgcggcggcggcggcggcugggagggcgggagccggcggagggaggcggccccccgggagcccggggagggggucccuccgcccgcgcccggccggggacgggacgggccggggagacgccccccaccccccgggcucgggcagcagcccggcugagccgaggggggagagggggcgucuccgcgccagugacgaccccucgcacgacgccaacgcuccaccccccggaccgcgucgcccggcgcccccgaggccuccucccccucccgcgggcgccgccgaggggcuggggugggcggaaggggagggagcgcgcgcccggacuuaggaaaauuuucgaaagagcgagagacacagagagccagagagcaggaguguggaaaaagcgaggcgagcacgaaccaaaggacagagcaaccgaaaaggaaaauguguccacacacacacacgaacacgaauaaaaacccacacuacacagcgaugguggugucugguggcgguggcgggguggggggucugacuagaugagccgcuccucgcgcccccggcgccgggcgccauggcccgagccgaaggcgccucuggccccggagcgcccgcggccucugcgcuuggcgcggccgcccaaguaggagaagaaggcgcagcccaggaacacucggaagcagcaggucgccccgaacacgaagccgcagccgcggcccugcuccgugcgcuucugcagcaggaaguugagcacccacgaggggcugcgcaccgagaagaccaggaacaccacgaggggcaggugggcgcucagcgcgccagccuugagcggcccgggccgccacacgaugcccccaacgcgcggcgccgcguaguaggcgucguccucgucgcucgaguccgugucccagucagcccaggcccuacucgugcccccggcggcggcgcccuccucggcgcccccgacggcgcccuccucggcgcccucgucgucgucggcggcggccgcggcggcggcggccucggggcaucgggccuccuccugggcuucuggcaccuucuucuucuucuucuucagcaucuucuccaucuucuuccucuccuucuccuucuucuucuccuccuuucgccucugcuccagcagcuucuucucgagcuucuugcgcuccuugucuguuaggaacuuuucggggagcgccucccgcgccggguucuugggguucuucgcgagcuucucgggguccccgcucuuccgcggcgcgagcggcucucucggcucggccaacgccgcagccgccgccgcagcuucggcagccaccucggcagccgccgcggccgucuucuucucgcucuccgccgcccgggcuuugagcuucauggccaucuucagcaugguggcccggccaccucggggagcucggcucgcgccuggcccgggcucccugcuugcccccggccucgggcugcccggcccccgugcgccccgugucggggggcuuggcugcgguucccgccgcgcugccccggggccgcggagcgcggcugcccgggcuucgggcugcugggcuggcugccuaagaguuagcgccaaaaaggaugagcaaacgaaaaagggacaagaacaaaccaaaaagcacccaacaacagcgagaaaccaaaaagcaccaagaaaugucaacucaaaaagaaaagugcaaaggcgcggauggcaggagucuguuuacccucaggcgcuccuugguuuggcucuugggcacgccaauggagaagagaaaagagagagaauuggggggugcccggaggcgccccggggcaaggcagcggcgcccgggcgccccugccuugucccggacccggcggcucuugccugcgccgggcgacucgcacuuccgcgggaggccccggcgcuccccgacuuacaugugagugaggugcacucacacgcaaggcagcgccugccggccgcccgccgccgccccgcgccgggacaggggcucgcuccagccgccgcgccgcagcccggagccagagagcaggggagcgccgcgccggccagccaccugacgcagcccgcuccgcggugccgacgcgacugaguguccccgccggggagcagagcuucuaaccggccccgaugacgccccagccucuucagaggaccgacccauagcagcggccccuauaaaccgaaggggaagcgcgaaaaaucggcccaccggggacgcacccaaaugggccgccgcgcacccugggggugcaggccggugccgggaccgcgcgggcgugggccgggggcgcgggggccgcgauggcggggggcgcgggcgcgcccaaggcggugggcgcucaaccccgccucccagaccugccucccaauuuucggugagugguguagcccugggcggcgugcaaagugugcgacggcggcgcuuaccccugcugugcgccuccuuaccuccagccacccaccccgcccucccagcggcgcgcgcccgccgagguaggugucagagagccgaauucgaauuauuugcgacgcccggacggaguuucguaucuucggacgagaaaagugcgaugggagugcaaagccuccccugcucgaagcagcaggcgcgccggugucacgggagccgaggagcgguggccguggcuguggagucggugcucgaggcguccucccaggugggagagguggcggccuugccugggcgcccugggggcucuggaacagagggaaaaguaguuuacggaacgugaacuuguuugaggguucuuucaaaacucucaagugucccgccgcacacuaggauauagcagugcacgggauuaggagcaggguuacuaaauuuucaagcaguugaccccagcccgccuuuccugggaccuugguuaggucaucugcugccaccauggugucugcugggauacgguuuauucauucaauaaauguuuggugccugccaguuccgcggcucaccaugugcccaggugagccgaggcggccagguaaucaggcuaagacgugagcagugucuuggaugggacacaggccuacgucccggaaagcccagauaugcaaaguccacaaacugucuuccaacuuuuucuuugacuucuuaacagagcccaugaaacuuaagauguuugauggagaaggagaaaaaagaaaagucuaccuauaaauggaaacacauuuaacaguccccagggguauggggcggcugauaccaccagaggccuugagcaaacuuguaucauuuuaaguuagcuuugaaaauaaaaagacacuguuagccauucaaccggaugacugaaauuccccccuuuuccccaguuugcuccacuucgaguaagaaaaggugugacagaugaagaugccacauauuauuuuucuuggccccuucagguacacugcugcccccauuguacaaggccucuuuuuuaugaaucugaaaagacaacagagggcgauucaaagucaccaaacaacacuuggaauuaagaacaggaagcgcagccuagacaccguccugcccugggcugcugcagaccccugacuuucuugaacuuggcugaaaaguuggggccagguuuuugucacacuccugaucauggauggccucucuuccacacaaaaauacaccuuauuuugaaaaugcucaaaggaacuauccuagguugaugcuuuucaccuaaccaaagaugcauaaaaauauugugcagauacaccugaaugugcucauaggagaacucagcaguaaggccucagaaucgaugauuccuaggcugccuguacuagugauagugaggcucacuaccauccaccaccuaaauuagaaccgcuugaugacacagcacagguucuauaucuuuagaugguaaauuaaaaauuccuggcugaauuugauugauugucauuuuuaaaaauuguuaaagacuuguaagagggaagaauaggccagacauuuuuguuaugcuccauuuguucaaaagcaucuuccuuccugcuucuacuguggcaaagcacagauacauugucuuuaagagguacaagguaaauaguaacaaauacaaccuagauacuuaugccaggagcuacaaaguuauacaaugaauauaaugaagagccuccuuauuuggaaaucucugagcuccauuaccaccuuccccuuuuagauaaacaucacaccugaacuuuaaaaggagugaaacugccccaugucauauacuaacaugcguccuaggcaaggcacaauugggacuauuguccuagaaauggguaacgcaagaucaggcuuuacuccuuucagcucucaaucuaugaggccacucuucaaaacaaaaauuuuuuaaguguagguuucaccuauauuuuauuaugacuaacuacugauggauaaauaaagcauucacuuuguaaauaaaugacagcagguggaaucauggguuuacagguaagcaaaugacacccagagugcugaaacacaagcugguuuguggucagcuaggcugucuguuuucacuccacacaaagugaaagaagagauuuuacugagcuuuuggccucaaauuugaccucuugaggcccuaaaaguugugauuuuuuuuuuucaagucuuuuaguuuuggaggcuaccaugugugaccuuuucauaugaguuaguaauuuaauugaucauuacuguuuuaaguaccuaguuuaugcuuugaaaguggggcaaucuauuggcauaacucuuggaacaguccagaugagagagcuuuccaauggaaggggccccucgucuggcucaggaagagaagggaguuauggagauuucagggagggacaaagggcagaauaucuuggguauaaaaugcccaaggaaagcacagaucucuggcucaggagacuugcuucaugcccaagccagccaguugagaucauaacacaucccuaaccuaaaacacuaggucaccuaacgaaaaaacuuguuuaaacagauggugucacacacuacauggagauauggccucgaaacauuucuuuccaacauuccauauuugacaacaaugaacaacgucccacaucaggguuugaauucuguggucuugucagcuucguggugauaaaggcaguuuguguuccuuggccccuggguauccuccuuucugaguaagaaugccuugucuaccuuuugaagcaguggacuugcuacagcuuagaaucuugaaaauacuguucugcuuaaugcugucacucaguuuuuggacaagaauguuauccuuggccuuucauuaguuggggucauuuuaaguugucuuccaagagcccagagcaaauguaauuauaauauuauuuuaauagccuaggaaacaauaaauagguuuccacugaaacagaaacuuuagcuguaagguuuuaauaauaguauuuagcacuuccacaguguuuccugucuucaaagcacguucugcacuuuaauuagcuagaaugacugaaacugcuauugcaaaugaauaucaaagccuaugucaugcagaugaugaaagcaggaauuguaaaaagcauuuccuagucucaguuaauccuuguaagaaggcucuauuacuuuagaccauaaaaguucuuagaaaucgaauguagugauuaucuaggacauuuuuuuuucuugucauauucacuaguuaguaacuccaaccauaaaguaacccuaaacuuguauucaaaacuaaacaugauauaaaacuucauuucagaagacuugaagucaauuacugaagaauuaacuacauggccauaugacauuuuccuauuuauuauccaucaacucauuuuaaaaugaucuguuuuuaauucagaacauacucuaauucaaacagaauguggacguacauuggccaguguauuuggacccaauuucuugagccaguggcuuugagaugcuguucaaacaucuacuuaaaagcauggcacauaauaugagggcaaagaggacguuuugcagcccuucuugaucuuuccugacucucugauggggaggcaccaucugugagagaggcuuccuggucucuguggacagacgcccaauuccccaggccaucagugccuuucucaccacauccccaugagccccagcgugggcaggaauggacuuuuaacaaaaccaccaucuaccucaagaagggggaagcuaacaaaaagagaugacauguauuacuuuguuccuuuuagaagccuaaaugauaugaugcacauguuacccuucauugaagauucuagguggacacacaacuuggauaucaacagggagcagaaaacaaacccacuagcaggaccaaaaggcagacccaucagcagaacacaggcggcagcuuccacaaguaacuccaaaacugaaagucaaauccaggagaagacugaggaagcuccauuuucuuugagguacaucaacaucaauaacagaucaauggacccacuuaauggagcucuuaauugaguagaaaaaaauauuuaagaguuuugccgcucuacggcaggaaagcuaauuuuccuaaacugaaauauccuucacuucccuuggggaaaaauuuucaugaggacuaagguaaugggaaaaccuguugcuuagaacuuuuaacuuggccuugaagauggaaacucauccaggauggagaauaauguagggagacuaguuaaaaauagacauggaccaguuuacuuuccugcuuauuuacaagaugccuuauuuaaaugacacuuugauccaacaucuuacuaaacaagugacaacaggaaaaaauaagaggcaguuggugcaccuggagaugugauauugagcccagucaggaggccugagguucuaauaaaauuuccuuagauaaaagaagcccuuuauaauuguucuuauuuuaaagauuuuaggguuuuuuucaugguauucacuucuucaaauuuagcuccauagaauuggaguuuagacaguuaaaaacacuggauuaaucaggcaauucauuuuguuuaguuaaaugcugcuuuguggacauauacaaaugaaacgacugcuaaauagaaguuuuacaucuucagauuuuaucuaccugccaaccaaauguaggugaucauuuucaaacagcccugccguuauggucuagccucaguuugggaaaacugagauuuagacugggccucaggugucauucgccuucagagcuaaaacccccucuccagucccacuuccaucugcuguugguaaaccaggaauuaagcaauuaacgugacauaauuagucacacauuuaauucaucuagaaauguagauaccuuuucaucguuuuguguuugcccacacguuuuaguugaaauugaaaaauguguaauuaccgcuuagcuccaccuauuucccuggcuuuuauuuugaggggggaacuaaccaucggggcacagucugcacagcucccaaugaggagggcugcccccucuuuucguacaggcucuaacucuccuucccaaggccacugcagccuuccucugcuugauuuccauguagccuccaguugguugaaauucagcauuugcuggggagcucagggcuaugcccucugcucucccacucagcaguuuauugagggcuuggcagugugcacagaacucucacuggccugucaggagcccacucaacagcagagcccagauggcacugugucuuucuaagguccuugcugaccacuggaaguuaugagaaggggaaaauuauucagcccaagcggcaagcguuugcaaccagucuggggaucagaugaaaaggagauuuuuuaugagcuacagaccucagcucuacccacagccacgucccagggucucugucacgccgcccaauacugggaaggcugccucugccugcuuucuugaacauuccuguuuuucgguugccuuagucucuacuaccuucucagauuacggcuccuuuugugcuaauuacaccgaaaaaauugaaagaaugucgcugacuuuacaaagaacacaaagcagacuugcuuaaaaaacuaaauauagccaguuucuuucagaaggcagacagacucggccuuccaaugauuuguacuaugcagauuaauugcagauggccaauucauuuauuaggacccaaaugacagaagggcucagcuaucggcaggacagauuaaaaauguguguugcuuuugggggccauuuacauaaaaugagaaggucugauuaaugacgaacuuuuuuuuuucccagcacuuaauuguaaauuaagauuugcugaugaugaugggcuaauuuaagcuaccguggaaagagggaagaaauggaagcugcugaucguaggaagcaguaccuguacugcgcagguaaaaauauaaaugaaacgaaagaagaaaaucuaacuucucauucuggaaggcaguggcugccacagaucaagaggauauuguuuugcagccccucuucuccauuauguaagaaauggccauuauguaagaaagacagacuugggaaggggguauuaucucugcuagccaagcaaauuauagauuacuccccaccuccaccccaccaccaugaaauccugaaagaguuaauaggugaacaguagcagcuuggaaugauuuacuuuuuuucuaaggaacauuaaauacugaauugcucaugcugaaauaacgcuacagcugugauccauggggcugaguuuuggacacuggcucgagugacagguguacucguuguuugcccagcucggcugaaauugugaugccuaacucaaauuuuuucccaauuaacuggugaggauucuggagccagccaggaaagggccuuuugccacaagcacggaagacaugcgugcucagccuucaacaaaaaugucagccuuaggggagaauggagccguugcucccugauaauaaaaacaaaaaaaugaggccgggcgcgguggcucacgccagcacuuugggaggccgaggcaggcggaucacgaggucaggagaucgagaccauggugaaaccccgucucuacuaaaaauacaaaaaaauuagccgggcgcaguggcgggcgccuguagucccagcuacucgggaggcugaggcgggagaauggcgugaacccgggaggcggagcuugcagugagccgagaucgcgccacugcacuccagccugggcgacaaacccagacuccgucucaaaacaaaacaaaacaaacacaaacaaacaaaaaagaaaauggagauggaccugcaaugucuagaaagguagggaaaagagacaaucuaacugggacaaagcccuucuagguucuaaagcaaacagguuuguccuacaauucagcucuuggaggauuuuagggauugaagcaaguccaggauucuaggaaaugugucaccaaaauugguauuauuagagaaaguggcacaaagcuacaagugcagagucugaucugcaacaugcuaauuacaucuauuuuuaucccaggguugcagugaccuaacaccaagaaauaaaaacucuggaaaacuagcccuucacauauggaagguaugauuacccccggguaugggagccccugggagaacuuucacuggguccauggguuuaaccugaggugagaaagcagcagucacccaggaaggugguugacuuucaagagcacuuggcaacagugagggaaggcacauggggaguugcgggaugaugucagcauguaguaagaggggaacucugaaauguccaaggccagcccaagcaaacggcgcuaucuccacguggugcccuggucuggagagggaaggaagaaggcuaggcuauguuuugccaagccaagacuuaucacagaggaagcuuuccucaaucccuuccacugguagcaaaggcccuggaucccugucuucugccaagauggugccaaauagcucaaccauacaaaggaaauggauauaaaacuuaauugggacccagagacaucuaaucucuaaguuaaagcaccacuccuuuuacucauaaccauuggaggcaucccaaagucuagaaaagccgaaaugacccucaauucauauucugguguuauuuaacccacgccucugggaggcgcucaagaacaggauaauuuaaugucauucucagccugaaaaguuccuuaguuuucuuuuaauuaaaucaguaauuauuuuaaaugcaucauuucaacaagauaccauaaguuaguugaaugaaugcauguaaaaccaaaauguugacuggcauaauccccaaaucgaauuaauauuuuaaucuuagguauaacauacuuuauauuucauaccuggcacguucuuaaauguguuaaauguguuuuccacaacuuggcauaacuauacauccacucaguuuauuggguggggaggcagagaagagaacuuuguuuaaaaacaaaacaaaacagaacaaaaaacuaugacuaaaggauagaacucuacagcagacauuuaguuucuacaauugaugccaaagguagaagagauuuugagaggaaaaaaaaaaauagauggauaauuucuaaaacauguaaagcaaaacagcaaauaugcaaaugcaagggaaaaaauacacaacuagcagcaugaaaaccccagggaaacaaacaagaacaucauuguaauugauaguaauugaaccccugcuuaaccuuccucccaauaccugauaauucugugaaaucacccagcugucacgcuuguccuuuuagaaacaugacauugauuugucuagcaaagacccaucauuagaauucugaggucugcuuaauggggccacuaauaaaucuaagucaucaauucuugaccuuuuguuuccugaaauucucgguaugugguaaacugcugaaaacacauuuucaaggucugugacuguaacaugaaaaauaaaggaucaaggcugcgcuuugaaggucugaucauaucugggcucugcccugccugcacccccgagggaaaauaaguaagauggauucggaacagcaucugggggucauaucaauacccucuuuugggcugagcuauuugcaaauaaaaauggacuguguaagacugaacuacaaagggagaugugccaaggagccauugccccuucuucugccucuccauguucccuucuucccccaucugccuggcuuuuuacugcacugagagaucaggaaaaauuccagccaagagagucuaaacuggcuaugcacacgaggaaaaagagagagagagagauuaucuagucucaguuuuggugacuuugaaauaaaagguuuggguuggggagggucagcuuuuuuuucaaggaacagaaucauggaaauuuuuucuuuuucuguaaaagcgaaaugcuucucaaccuuauuuuuugcuggcuggauugagcugguuguaaccuaagacaaaaugugggcaggugccuucagcuuccucuaaauucuaagauggcugcaggcaccagauucugacagugauguugcugagagucuagccauaaagauaucuuuccacacgguucucucuccacgucugccuagaaggacuagccugcugcuucauuuccccccuccucugcagccgauuucagauggcugcagcagagaaagcgagacccccacaccuuguuuguguguacccuuccuuccgcaccccucugagugcauuugggcuguguugggguaacaucaggacaggugguuggcugagcugauccucucaaauauucaggcaaacugguuguuuauagacaaaacauccagaugcuuuuucacgauugaacuuuugaccaaauugauuguaugcuuuggugucaagaagacaaaaacccaagucaaaaagguccccagaacaggacaucugcaggcaaugaauaguaggaagaauuacauauuucuagcagugaaaaaugugaguuuuuuagauugugcuaaaugacucgauauugaccagagcaaagcuacaagugaaagaauggaucuuuuuaagguuauauuguucccauuuauuuggcuuugugcugccagaaaguggcuuggaggcuugcuuuuuagugcucuguaaaauguaaauggucuaaauuaagaagcuaucuaaucucaaacaauauuaauugugacaugaaaaaugagaccaauucuuccgacguuacaaucaccaccaccucacauuaacugaucaccucacuguguuucucaaaagccugcauauuuuccuuuuccaaagugccuauuuuuaagaggagacaaaaauccucaaauacuuuacuuauucugaugcugaaaauguggucuccugaagugggcuuccuuuggccuccaggcucugcaaaccucuacaucugauuugucucccucccccccccacccgcacccccaccaccaccgcugccucugcauuaaaacucuuucuaaaauaaaaccacuaagcagccacgcggucauaagccaggaugcugcuccugcaucucccuccuuccagacagaacugccggacccuaauguugcuuuccagaaggaauagggggaaaaugcauuuucacauauuuuuuaaguguuuuucccuaaaugggcccauuaaaaucagccagaucacuguuccuccaucucuguagcaggcagaaucaccacgcauggagauaggagcaaauuuguauuuccaguuggcucugauggggagauugcaguuguucuagggaaaggcgaucucuaucccugcaguacugccucacaauuucaagaccacugccuccucccauaagauucugcagauguugcacuuugcuuguuaaaccucuugcuaaauguaagaaguaaaguuguuuuacuuguaaauguccguaauucaccuacugcaaagcccuaaguccuugcuguuucauuaccagcugcccauuaauaaccaucaaauuagaagugucucuagcagcaugacaauuuagugaggggaauaagaacagaaaaucacaaauuguucagaaaaguugcugcauagcaggccuccuggggccggggcccgaugccccuugguguuuaguucaaggccauggggcucucuugggugacaucacuucuaacauagauacuguguaauucaguuacacaaaagcagcccagacaagcaggcucacaucaucucuugugcucugcguaagucugcaccagaggcucucaacacagccugcacuuccuguugcaugccaggaaagggcccuaaaaccaaggagggaggugaaaggaaacacaaaauaaugcaccuucuuuguuuuuguuuuuuuuccgcccucucugcucccuucaucucuaaggacuccacagcuaaccuggacucauuuuguuacuucccauucccaggaagaaaggcuuuuuccagcugugagagucuaggguucacuuauaucucuuucuaaacacuagcagcccagaauucucaggccacuuuugggcauuguggcaacacaauaggugccuccuguggaccccaugccuccaaucagagcagggauuaccggcaaggccgggaggugggaagucagugacagcgccguucucucguucuugcuugagcugacuguagccucuuaacaucuggugcuccaacucuuuccccauuccuaaaacacggcuggcuucugcccaucagagcaucaguccugggcuuccugggcucugucccuuuauccugcucugaagcccuuaaguguccauuucaaccucacaccugacuuagcaccugacuuuaaagaaaaacauccuuuucaacaauaagguaugugaccacuugaaaccccuccaaggcuuucaaagcugguggagcagagcacaacuaggagaaccagcccugggguuaaaaucucacggaaggaaagggggaagcuagcauguagcagguggcuccuuugggccauccuauucaccauuugccccuggcugacuaguccugggcccccacagaauaggccacuggugcacaggcucagggaagggcuucucucccccucuccaacugcaucugucauuuggcagugacagccgcuuugcacucuguaccuuggcagcucacaucucuuucagagcccccuccuuuccccccaccacgagccuccucuguaaaaaccggaaaaaaaaaaucuuguucuuucaucauaauuaaagugcugucagggaaaauggcauggcugaguuuugcugcuguugaaaugacccuccuccuccacuccucuucgcuucucucauuugcuaaagugguccuuucucugccugaaaucaggcccuuuggugauggaaauuuuagcuuaaagcagaguucuaagcagaauccuaacccugcgaggguggggagaaaaucaauguuuugagcuggugucuguuugcagcgaggugcuggugaggccauuuucaucaggaggaacgguggugguggcuacuucugggcuuuagauccacgcaaggucuccuaaauacaagucacugucaugguacacaauuuagcaaaacuuggaggcugauuuuccccguugacuuagcuaagggucaggaggaagcuguuuagaaguacagagguucugcaucugggaggguaaaauccaaacgccucucaugcucagagggaaagcaugccugcauguuuacuaucacugcuggccuacgugcuugugugucugaaauaaaacuguaacuuauauaauucgaugcucuucuccucacugaguguuacugagucaugcuuggguggggggguacuucuugugcguuguggacaccgcaucauguaggggucuuuuuaacaccucauaucauuuugugacaaugucauucuaauccuguuagccauuacagaacuuucugaaaauaauuucaggugggugacauuaaaaaaauaaaaacccgccccucugagugacuuugaacucugccauuagaauccaugacaucuauucaaauacacauuaugggagggacucauaauauucaucccagcugucaccuacuuacauuauaaggaaacucgaguguuaggagcuuucaaaauuaguuuaauuuccuuuuccuaaagaucacgcaucucagaaaggccccuuuuaacuuacacuggggaacuuaauuggcaggcuuuuggguuucuauaagaguauugcuaauaucuggcaagucaagauggcaaucugggccgcccucaauggaaucauuagcuguuaauacaccucugaguaacucuaagcuaaggugugaaaucaacccaagcgccacuaagccccaguuuuuccuaaggauauaaccgcaggacaguugggggggcuguuuauguaacauacaaacaacaagguuguuuugcugcuggcuuauuugcuggccuggacuccugccuccuugcuccuucccccaugcccuucacauuauauuucuuuuuuaaagaaaguaaagcaaccguauaguacucaagccucuuuuauuuccugacuguuguaugugucauagccguggacgcuggagaaaaacauggggcuugucauuaucgaccggagccggaaugagucaggcacccugaaggcuacgaucugaaccugacugccacugaaugggguggggggggcaccccgcugccaggcagaauaacacuaagcacuaugcugcuacuuggagaucuggugugagggguccacguguccuggggucacaguggaagaaagucaacucauugcuuagagggcugcuaggcagccauagacuuggguugggaaaacaggguauggggcuggaacuagaaguggggagggggugacugcccaaaugcucuccccuguuccccccaaugccucuuguuagaaugcuacucuuaggaaccccacuauuaaaaaugugacucucugggcuuuugggccucuaaagcucuuuaugaaaaugcacaugucccuuacgaguagccucaucagccuuugccagcuaaugggauuaacugaagagaacacagccaccugcagggagguaaggaggccuggggccaaaucacuuuucagaugugccaugugcucauccacgaucacccagaacacaaaauucaggcauucuuguuucgguggcaauuuuuaagaagccacaacuuaauaauucuauaaaucucaaucauauucacuauggagcaaaguucaccugagaguucuuucaguucagucauccagacaaccuucccuugucuuauuuuuaacauaaaaaauagcuagcaaucuguauuacacagauauuuucaaaaaaacauaaaggucacuaucauaugcugugauaguuacagagaccuauccauaagacauauuauuucaaggguaauaaauagauaauuuaaaaguauuugugaaaggaaaguuggaaauuaaauucuggaaauuaaaauguguuuuucauuccacaauggcuggaaauuaauuauaguauuugaauauagacuaucucuaucugcauuagggaacaaaacaaaagagacccaaagcucaggaucuaagauggaggacuggaacuaagauagagggcaggccaggaacuaagauggaaggcaggccagcagcaaagauagagggcaggccaggagcaaagauagaaggcaggccaggagcuaagauggagggcaggccaggagcuaagauagaaggcaggccagaagcuaagauggagggcaggccaggagcuaagauguaaggcuagagcuaagacgggggccagcccaagagcuaagauggaggguuggagcuaagauggaggaugaaagcacuaaggugaaagcacucuguaguacauaaggaucuggcugcaaacuacacuuucccaucuaacucucaaaacacuaauccuagacauagaagauuucuaagguuaggugggaaauauugggcccaucuuccuaagagaauuuuagucuugaaagauccuggaaggcauaguuuggcuccagagagugcacaaugaaagaaagaaguuggcaaaaggcaguucucagcaccacucuugggccaggccucugcagccccuccuggaagcaagacugccuccucagcauggccaguaacccucugggcugugccuccuggagaaaggccucauucagucccaugacugacaaguuaucaacagggaggucuacccuaucaacagggaggucuauccugugacuagcaaagguucagucacugcuguuugugcagaaauuuucagccucagaguggcaugaaaaucugaauggcugugccugucaaauguugcuuguuuugaccccagcagauccuucuagguuuucugcaguuuaauuaucagcacucaugacacuuuuagguaaccucugauuuggugugcucaacugggcuggaagacucuuagcagguuguugaagucuuuugguugacaaucuuuccaucuuuccuuauuuauucccuguguaaucgcuuagcagagacugcccacucuuguuaacuuccuggguuuguuuugauuccaucaagggaguagcagugucucauacuuuugucuuccccacggggaagggcacauauuuggcacucaauacauguauaucgaaugaaugaacaaaugaaaaugcccgaauugaggcaaacucaccgaccaggcaaggauucguccuucuaaggggcguggcagacacgugagcagcuacugcaagcuuagagaugcuacuagacagacaaaaaggaguaaggcuauuucgaccuucaaguuaaccaaaaaauuaggaaauaacuuaucagugagaaaaaauggguacaugugcuagucccuguguaccaaggacugggcaggauuccaugcuuuugccaaguuggacauaaccuacagaugaguaaaccucagaccugccaauagucaaacauuugaaaaauuaauuugugacaacuguuuucacuuggaaccaugauggauuuaacuguuuucuuaaauuaggcaugucauuuuaugcuaaauuuccacuaaacauuucccaacaacauuucuuucuuccugaagaaccaccgugaccccuaacucccugacaauuccaaaaugucacagaaggcccauuuuauaaacauauuugugaaugaguuccuuuucauagcuauuagaucagcaauuauuuuccccaacacuggccccuaaucagccauuuugcuaagucucaaagcaacacaaauuuagcucaaaucaauuagcaacacauuucuaacucuuggugcuuggggagagucugaacuccuccugaugggaugaggcuaacgccuugagaaugaacugagaggcaggucagcccaggaagccacuucugccuuugugguugugcuuuacaagaaggccaaaaugugggagaaugggguccaaccacaacaaauuaggaugaaauuuugauuuuauuuuuuuucucuugagcugaugaaugaagcccaggacauagaaaggcagcugacggaauauuuuccccaccaaugccaggaagcugaaggucugcucuugugauuugcaucuggcugugauguucucucucugccccccacccucaccccagcacagagcaaucaaccuugucccuguucuccucuggcugaauuccccccuuuucucuuccccucaccuuuccuugcugaacagaauugucuucccucucuaaugaacauaacccaagagaauaaaacuuguuuuucaaaguggggagggggaaugggaggaagaaaggaaggaagggaggaaggaaggaaaaagaaaaaaagaaaacaaugccuacagugggucuggcuggaacccaauucucaaggacaucgauuuguaaaauucaaagguuuccccaacaucaaagaucuauacuuaacuuauaggaugcucacuuuuaaccuuaggguuugcuuuguuuuguucuggauaauuaucaaauuuaaaaauuuaugauuuuuuuuuuuaaagaacuagaagguucucugugugccagacuuucuaaaacaaaacaaaaccacuuagugggauaaggcaugugaaaacacuugugcuccaugaagugugcuacaugcaguguguuccuaacuuuaaaauaaaacaaaaauuggaccaucguuuuagaaucaggagguaaacacuugggaaagcaauaagaggugagagggcaguggucagagcucagaggguggugguggcccccgucuuggcacacaagagaggccucugucccagcucuucugguuggcacuugaacgaacaagggaccucauggggcagugagauggggaggagaggaugccccagccuggauugugaaccugccucuccuccccguacuccuguccggucuagccagccuggccccucagcugugccagccacacccuccuuggcagcgcuccacccccugccugguagaaggauaaucacuugcaaccugauccucuccucuguucuggacuagaaguuccuagagggcaaggaccccauuuggugcuuagagcuaaacuuggcaaaggcacucuuuucuuuuuucuuuucuucucuuuuuucuuuuccuuucuuuucuuuucucccccucccuccucccucccuuccuucuuccuuccuucucucuuuccuuucccucuuuuuuccuccucucucucccuuuuaauuuuuuugguuuuuuuuuuguuguuuguuuuuuuuuuuuuuuucgacggaguaucauucuuguugcccaggauggagugcaauggcacaaucucggcucacugcaaacccugccucccggguucaagcgauucuccugucucagccucccgaguagcuagaauuacaggcaugcgccaccaugcccagcuaauuuuguauuuuuaguagagaugauguuucuccauguuagucaggcuggucuugaacuccugaccucaggugaucugcccaccucggccucccaaagugcugggauuacaggcgugaaccacugcucccuuucaaauuuuuaaauuuaaucucuauuuacuucuuuccuuccguuugcaccuuaauuucucuuugucucucucuuucaacaauaaacaacuggccaaagggaauugguuuuaauuucugagucguucacaaggaccccgggauuucaaaagaucagagaaggaaaaacaaagggagggaaccucaauucuuucccugcucuuccccgcuagcgaaaggacugaacaagugaaagaacuguggaaggacgauggcgaacauggaagagcucuaaggaaacuguccuguaguguguguuuguggagcagggggauuaauaugaaacugcacaccaugauucaugcccucucaaaacuaugcauacaccugaguaaagaacagggggagauaaugaucaguaaaaucacagcagggugaggguaggcuggggggauuuccuguaauauuaugaugucauuuuaacaauaaauacaacuagaagaaaaggcgcccggccaagugugggauguggguuccaugucaugugggaagcgaaagugggcaguugggccccagaagggagaguucuaagagggugugguucccucuaagggagggauuugugcgucuggcgcagggagaagacugaccaagaaagccaccaaauaaacagaccaaacccccaaccaccccuccccugagaaaagcacagaauggcuguauugguguuaaaaguaagguccccgggacccaagacaggaugagagccccaaccaaaacacccuggaaacauggggcuuuuuuuccauuugggcauccuacauuucaucuagagaauuccaagaucccaauuucugagagcagacccagccauucugagcucucugcugaccucugguggggaggagcucccauggcccaggaaagguuggaaagaggcagccaccugcccuggccuccucuguuccccacggucuacagggucaccugcccucagccaccacucagggcuagaagucagggacugugaggaggagaaagugcaagaaaagcuuuaaagaauccucagaggaauaugggcauaagagaaucauguuguaggaaaguuaucaaguaaaagaaaauuuuuuaaauagaugggugggagggacguuuaccuuaaaucaacccuguguauucaguuucuuuaacuuuacaaucuuaagagagaggggagaaagaauguguauaugaaugggguauggaggguaaauuugaucagaaagaaauaaauucccauuggaggacuuuguagguccuugugugggaggccuguguggcccuucucaaauagaugaccucaucauuuuccagcugcugggugggguggugcagggggcagaaauggaagggaauggcaacgguaccuguucuuggaaccaaggaauuugacccagacaccaucggacccagcuuccccucccguggaaacgaggccuaaagaagccagaaguggccugccccaaggcagugcugagccugagauggacaguaggggucccauccuuagagaggacaccuucgcuagugagaaugccccagugugccgugaagcacugagaaguggagagggguugaggaggggaagaacuuaaaacuagcccugaggucucagagauccugaaaaacacaaugauacuugcaugaauggaaaagcaaugauguaucccuagcaagucccuucucuguaaacaaucauugaccaugcaccucaaauucuacuucaucucuccauauugucuuaaaugcuaacuucuccagguaggccccuuagauuucccugguggaaacuggagcucugcucaccuaugaaccucuuuucuagcccuugauugaggugugaaagaguuuaccaccaaacucugcucccacaaagauucucccggugauugggacccagaaacuauuaauuauuuaccaaaggacaacagagggcccuaccauuugauuuccuauacaaucugccauuuuggaacagacauuuaaaaaaauuuguguuggauaggggguuggcauaccucaucuauugaaacuuuauaagauaauuaaauaaguuuuaaagugagaaagacaucccuccuguuuuuucaauugagaaaaacuagaaccagggauuuguccaagaucucaggaccaguucccaggagaaccggggcaccagggcggugaaucuggagguuaccugaucgugugcuuuccugccuuggcuaagaucuucagauccacucguuaaaaguugccgggauuuguccuuagaugucaauugcucaacugaaaccuuuuaaaaacauuccucagccuuaggggcaggggccguguccuugggaaggaggauuuagggagggggaugcggguucugccuuaggcgccggcgcaagggugaauuuuugaaagccaggcugucaaucguaaaagccgagcgccaucugccagccgguucugaguagccuugcuuucuuucauuguuuccacuucccagcccugaauaauuuguguucucauuuauuucccuccaaaaaaaagguaguuccugcucagaaaguccccccaaaauaagaaccccauuuaaaaauaaaucuuagaagagagugagagagcgagaaaacaaaggaaaagugagaaagaaauucgagaacuccuuaggaggcugcuuuccguucuccccuuucuggauugugaaacuucugagaaaaugagagaugagcccccuuucuucaacuaaggcagcccuaauggucuugcuucuucuuucugaccucucaccuucuuguggcgagcagaugccccacuuugagccugccuuaacaucugaaaucagacccuaacucuggggaaucaagauugcagggccagaaaaaaaaaaaaagcuggcugcggugguucacgccuguaaucccagcacuuugggaggccaaggugggcggaucaucugaagucaggaguuggagaccagccuggcuaacauggugaaaccccaucucuacuaaaaagacaaauauuggcagggcacgguggcucacgccuguaaucccagcacuuugggaggcugaggcagggggaucaccugagaucgggaguuugagaccagccugaccaacauggagaaccccaucacuacuaaaaauacauaauuagcuaugugugguggcgugcgccuguaguaccagcuacucaggaagcugaggcaggagaauugcuugaaccugggagguggagguugcagugagccaagaucaugccacuucacuccagccugggugacagagcaagacuccaucucaaaaaaaaaaaaaaaagaaagaaagaaacaggagagguguccacuaucugcuauauguuagcuuaagucugaggcugagaugccugcaagccuuuuggauucaucccuggcaccugaguuccaagucucaaucucaagccuccuuucucaagcugucccuguccugcccccaucuugugucuugacuuucucauacauaaagcugaacacagagauacccucugcuucuucccugacaacucaucaaauuuaaggugcucuccugaccauggcaggaccccaggaauacuuggcagaaucauuccuaaauggggccuugucaauacuuucaagaaucaaacuuuagccuuuucccgaugucagcuuggcaaauucauggaauccuagaauaaaguucuauaaucaaccaaggucccaggaaugagaacccccaacuucuaacccagugcuguuuguacuauucuaggacccucccaaagagcuggagcuccucugcccacugccucccccaucagaucagaccuaugguagaagacagcaaggaguaaacgcuguaagcucacaaacaccaaacugcccuaggaugaacgauuucguaagagcgcuccagaaugacuggaucccaucaggaacauuuccaaagacucccacucagaaaggggagcccuccugggaguguccauccuaaaacccacacuggccauuuguuuugcaaaacaaaaugaucuaaugugcuuccuuuuagcagcuaaaaaugcuuaauuauaaauagcuagaaguuuucuggcaauccaacuuuuaaaaauuuuccccuaacgucuggcauuuguuuuuggguucugcccugagucuucuaagcauuugcuuggaaagauguugcacuuucgcaggcaaaauuucaaaaucaacauucaagaagcuugccuuugguaauuucuaggauucugcaguaaggagguuuuauaguuaggggacacuuugcuuagcugaacuugugacauaaaaagcuagucuucagacaaguuuugauuucaaaugauacuuuaaauuuuacaugucugauauauaauuuaucaaacuaccaauauauuucuacaccuuccccuaaagaaauccugauaguaaaagcuaaaguguugaaauacaccugcaugucuggaguggagaguggucauugucuaucuauuuauuuauuuuucuggccuuugcaaugaagucagaggucauaaauuugaaacucccuagggaaaaaaaaaaaagaaaaaaaucuccuuuguuugaaaaaauuagaucccuaaugaaucuguuucaguuguuacaaucagauguuucaauuugaaaacuugaugagaugaauucagauguuacaaucugaaaacucuauagaaagaccaaaugggggcaaaaauguaaauguguuaugucaaaauauaacaaagaaguuauaaaguccccuuccauaaugguuacuugagagaggcuggucagaugcaaauuaggggcuuagaccacuguuuaaaauuaagaucacaauuuaguccuauuaugauuauuccaagaaauaaugguuacagagucugcccuaggauggagaaggggguguccacuuuaucagagaccaagcgcaagacucuugaccaggaaauguccuuggauuguuacuucuauuggcuuagcuauguauuauuccugagagaucuuaugcucuuucucaguccagucauucagagccguuccuuccacugccccucucuccugcaaucuaacugucugucuugaaagaucaguugcugaaaguuuauaggucaccuccaugcaguaggcugguucucuaugggccugagacuagggagacccagcaacuggggcccacacacugcuugcugguguguacacauuaucaguuaaaggcucugcuguuguuuuggggaacacauauaaaguggggcuccugccacccuagagcugauacguugucagcagccaucugacagauggguccuucgugucuuggcauccuucucuacaaugcagagugaauuaauugagugugcaccagucagagagagaauuccuagccugcuacaggaaaaggcauccuuaagaaacccuaaguggaagaugugaucauuuaaggguaaaggcuauuuaagcauugauuuagccuagcuaugggacugacuugguuaaucaaagucagcucacuauuuacuucccugaaauaauuuccuuuucuauucuaguuagggucaucugggucacuuucuucucugagauuucuagaaauuacuucugcaggguuggacacgguggcucaugccuguaaucccagcuacuaggaggcugagacaggagagucacuugaacucaggaggcagagguugcagucaucugagaucaugccauugcacuccagccugggcgacaagagugaaacuccaucucaaaaaaaaaaguaacugcaguggacaaacuuuucucuggaaaaaaaaaaguauuuuauauuauagaugauauauauuauauauguauauauuauaugauauaucauauuauauauauuuuguauuauauaugauauauauauaauauaaaauauauguguauauauauauuuuuugagauggaguuuugcucuuguugcccaggcuggagugcaauggugccaucuuggcucacugcaaccucugccucccggguucaagcgauucuccugccucagccuccugaguagcugggauuauaggugcccgccaccacgcccggcuaauuuuuuguauucucaguaaagaugggguuucaccacguggccaggcuggucuggaacucuugaccucaggugaucugcccaccuuggccucccaaagugcuaggauuacaggcgugagccaccgcgcccagccccaauauauauauuuuuaagauacgcaaguuacaguauguaugaucuugaacuguccccagaauuugauacugaugauguuagggcaguaguuaucaaugaggggugacauuuggcaaugacuagaaacaguuuugguugucagagagagagagagagagugugcgugcguguguguuugugugugugugugugugugugugugugucugguagguaggggucagagaugcugcuacacaucccacagugcauaggacaaccaccccaugaaaaaaugucaauaaagccacuuggaggaccccucuguuagacugagccccccaaaaugcuucuaaaauccuggcauauagcuaacuaggagaagucacagcguaaaaguaaaaagcuggucuggcuaaagcuuuggggccuauuugaauccaaggucuguccuggggugggggcuggcauuaaaagucaagggggacccuucuuugccuuugccagcccuggccaucccucucauuuucacagacacgugccaccuguuuucugccuuauacugucucaccaucuaguggucaccugaaauaucaauucaccuucaccaucuuugggcccuucuagagccagucauuuaaaaauucccauguuggggggcagugggcaaaaggaacccccugaaugacgucaaugauuuaauuaauaagugaauucagcaucuugaaggcccuaguagagccacagaaagagcagcuauaaggaauuaggauggacacuuccuaagauuucaaaagcccaugaaggcccccccaaaaaaaucgaggggcugauuauaaauaaggucugucuuuugaaaagagaaacccacagggcuuucugcuuaaaucccucggacacagauguuacauaaccauagauuuuaaaaaagguaucuauuuaaaaggauguguucaaguggucucaguaauguaaguaccuauauacuuccuaaauaacacuaucuauucuugacagguuuccuguuuucauuuuuuucaacuggaccaccagcuacuacaacccuagaaaaauggaggcacagauaugugggucccagagcccugggggagcuggaauggauacucgcuaacacacgggacacgagauucucuuuccuuuggaaggguccuguccauggcccuucuuggguucuggacuguccuacaaugccugacuuuaguuucuguggaucaugauaagcauuauucauuuuuucccccucaaauaucccacagcuucaaacuuaccugaaugcagguucccuguaaaaauaccaucauguaauuugcacauuagcaaucaguuugaugaauggcaaaaucguucaaauggaaaagaggagagagauaguguggucuuuugauggagggggagaggcaagagccagauaaaucagaagagagaggcgaggcucuugcagcccaagucuuaauuuccuuguaagaaucgaugcucacucaguggugacacugagcuugugaaagcucaacugugacacucuuuagaaaguaguacagagauuuuuuuccuucccauuaucaacucauuaaaggaaguuaaaaguacuuacucugucccacacacagugugugugugacaaugucggaaacauugacugacucauaauaaauuugagauuggauaacaauuuauacuaccuuuauaccucucuccucgccccaaauugaaucauuaaaaaacauuuaguaagauccaaugugcaguucugugggcagaacuccacaagucaaaauacuccugaauuuaaauacuccugagguuuaacaaauuacucugcaaugcaauuugggauuuuacucuaaggaaguacaacagaggcacacucccuuaauuuccauugcccugucacagaucaguugccuaacauucuucccauagcauagcucccaguuguugcauguagaaaagcgcuccacugauucuaacuugaaaggugugugacucgugugugcucaaagagcaugugacgaucaacauaaugaaaagucaaacauuguuuuguuguguuguucccuaccucuuucuuggaggucucuucaucuucaauucccaugagcuggccugguucaccaucuggcuguuggaaaggaaacuaaacacauuuucuuucuuucuuuuuuuuuuuuuuuucauguguaauaaccauagaacaauccaagcucagguccuugagcucagccucgguauugaguugauuuauaguuaggagcuaaucaaaacagaagggggagcuggauaggcaggggugacaggugacacuuuuacaggacaagucaaaaaguaaguuaucuccucaucucucucuggcacaucauucaccugagagugacuucacacaauuauaaauguggcaagguggcauucgucuacugcuugaguugaccuuuauuuacaaaauguaaacaaagaauguacucugaaagguggagacagaaagacagaaugagauggcuggcacuuuuagaacuuacauguuaauagucuaaugagaaaugcaaaaaacagaaaaacaaagacacaaacaaaaaaaaaacccagcaacaacagaaaacuaaccaaacccaaaaccucacuuggagcagggagaaaaaaaaaaaucuaggaggaaaauaaauuucuaaaauuaaaagucgaggcuugguaugguggcucacaccuguaaucucagcacuuugggaggccaaggugggcagaucaccugaggucaggaguucaagaccagccuggccaacauggugaaaucccaucucuacuaaaaaauauaaaaguuagcugggcaugcuggcaggcaccuguaaucccagcuacuggggaggcugagacaggagaaucacuugaacccgggaggcagagguugcagugagccgagaucaugccacuguacuccagcuugggcgacagagugagacccugucucaaaaaacaaaaaacaacaaaaagaacccaaaaaacccaaaacauguuuugggguacuuauaugugccaagcacuggguugaacauguuacccuuuaaaaaagacuccagauuucucaaauuguaacugcuucuaguagcuggcccucuuuuugggggaauuaagaaaaaaaggccaggugccauggcucacaccuguaaucccagcacuuuggguggcugaggcgggcagaucaucugaggucaggaguucgagacccgccugaccaacauggugaaaccccgucucuacaaaaaauacaaaauuaguggggcgugguagugcaugccuguaaucccagcuacucgggaggcugaggcaggagaaucgcuugaacccgggaggcggagguugcagugagacaagauugcaccacugcacuccagccugcgcaacaagagcaaaacuccgucucaauaaaaaaaagaauauauccucuuuuugaaauaccucuccucuccuuuguucaggggcuucuuucccccaauuuauauucgugccuuccuuccagucucuaaauugcauaaaggccacuuaggacuugcagacuuuucagcagaacucccaaagagaggcucagguccauucuccucuuccuuccuaaagagaacaugaucuuaugcuuagggugaccacaggccagaacaggaaucugaugggaacaaaagcuccauucagucuaauuuaaugaaaucugugaaggugcguguuagggccagagucuccuagucccuauuccaaggggucagagauggucaauuaggcugcccagugcuuuuaguucccuccguugacuugucuuaauugauggugaggaccuugugacaucaauuggcccugucccuucucucuugaaaauugcuacuccuccugagaaauuugauuuuuaaaugggcaaauggcgugaguggguuugagaggaaccucacauuugcuacuacagcuaaaagaaaccaagaaguguagaaacgaauuguuguucacuacugaugugucuccugagaguuauuuagaggcauuugaagagccacaauuuugcugggguuggggguaaguuuuauuuggaggaaaaacuaacucuaaaaagaagaaggagcauggcugccuuugggaauuucaaaucuagguuaccuucucuaaaaauaaauuuauguuuugcuuaauacuaaccuuccuggcugggcacgguggcucaugccuguaaucccagcacuuugggaggccaaggugggcagaucaccugaggucaggauuuccagaccauccuggccaacauggugaaaccccaucucuacuaaaaauacaaaaaauuauccaggugugguggugcaugucuguaaucccagcuauucgagaggcugaggcaggagaaucccuugaacugggaggcagaaguugcagugagccgagauaguaccacugcacuccagccuaggugacagagcgagacuccaucuuaaaaacaacaacaacaacaacuaaccuuccugcauaaaagucaaaggugauuucuaagaccacgcacugacucuugcuaaauggaaauuagccuggacuagaaguaaggcauacuuuuaaaaaaaaaucacuacaaagacuauggagcagaguuauuuugauaagaucaugagauccagaccaggauucuaaacauucuaacgcuauacuuauaauagagcuaugcagaaaaguaacugcauuuuauuauuauaaugauuaauuauuauuuaguggaaaccuaaacaagaagaaaagcuuuagacccugcaaaaaaacaaaacaaaacaaaacaaaaaaaccaaaaaacuuuuaaaaaaaccugcauuuaaaaaaaaaaaaaggaaaacaguagcccaacaaacuaagacugcaacguugcagugcuggcagaugaguuaaagcaaauguguaaaugaaauauuaccaaagcaaugacagccaucucagaaaugggggagcucauguuucauguauacucaauggacauuuauaaccagggaucugugcguuuugcuauaauucagaaaguagcagacuacucgacacgugucauuuggcaagggauuuuaagagcacauaguauacuuagaauaaucaugcuuuacauuuaaauaaugcuuuauagcuuaucaucacauuucugguaagcauuaucugaauuugaaauuugugauccuuuaccuaccuugcagucuuugaguaaaagugccuuauggccgggcgcgauggcucaugccuguaaucccagaacuuugggaggcugaggcgggcggaucacgaggucaggaguuugagaccagccugaccaacauggugaaaccccaucucuacuaacaauacaaaaauuagccgggcauggugcaugcaccuguaauccuagcuacucaggaggcugaggcaggagaaucgcuugaacccaggaggcagagguuguagugagccaaaaucacaccaucgcacuccagccugggcgauagagcgagacuccuucucaaaaaaaaaaaaaaaagugucugauauuuaaucucugagcuuuugguuuauuugccuaugaaauggggcccuaucacguuuuuauugcccaggacuguuucaagagacaaauaugacuagaugaaaggcuuuaaaaaauguaaaauguggccaggcacaguggcucaugccuguaaucccaguacuuugggaggcuggguagaucacuugaggucaggaguucgagaccagcuugaacaacauggugaaaccccaucucuacuaaaaauacaaacaauuagccaggcaugguggcacacgcuuguaaucccagcuacucuggagacugaggcaggugaauugcuugaaucugggaggcagagguugcagugagcagaaauccugccauugcacuccagccugggugacagagggagacuuuguuucaaaucaaacaaacaaaaaauguaaucagaauguguuauuauuauuacugguuacuaaucauacugagagcagugagauuuuccuuuucaaguuaggaggauacauacaguaaggggaugacccccaauucuuuuugcuuaaaaccaguuuuccauuguaaauaauggggguaaauuuuaaacauuaaucuaccuauaugggaaaauuuuuuuugagagaaaucuguaagaauuaaaaccaagguagaauuucagacuuugagaagcaugaaucuuacuaggagacugaaaagagaaaauaauaaaucuaucuggacuccaaaauuuuguggccugauaagccauguccuuccuaccacaccaaaagcucaguggaggcauuuagaauauaaaaaaauggcuguauguuaaaaaagagagagagagagagagaaaagaaaaauaaaaaggugcuucugcaagauggaauacaaugcauacuguugcacuugguggcauaaauaaucauacaauuaauugugauucacuguauaaauaaagcaucauagcagaauagccauuauuauauauagcauuugccuacacaauuuuaauaaauguggcagauacuaagaaacucugaucuauuagccccauucaguucuuaaggaggaaaucacaccuaaaugaaguuuuaaaaaauguuuaagccaccaaaauuauuuaaaaacguaacagaaacauggaaacagucuauugguggauaguguugaguaagaaaaaggcuucuuuaaaaagaacucuuuagauauuuuagaauuuuaaucauauuacugauuucuaucuaucuuucucucucucucucucucuuugauuucuuaggauucccuguaaugagauuaaauugucccggcaauaaaaacagaaaggauaagcacaugaacauacauuuuuucaagcaacagaugaaucugcaugucacaaauuagcaaccauaucaaaggacagccauuugaucugcauuuucagugguagggauguauggaugucuuguuuuauauguugggacuaaaaaguuaguaaaaagucuuguccuacaugugaguaaguccucauccuuccuccucucccugucccccaucaauaauucagguccagaagagguacgucaccucugcaaaaggaagccuggucaaaaacuguagccugcuuugacaaacugcagugguacaguuucagcuagcagcuaacacuggcuaucauauuucaggcuuauguuagacauggcccaugguuugccagcccaccuucuggacuaugcugcauccaaagguguuuggcuaccagcacccgagaacaaagccaggacaagguacaaggugaccccagcaaauuuccuuuucuuaaaguuaauuuuuacuccuggugacaaaauaaggggagacaaaggaaacuucuaauauucuuaagacuggucccaaacauggacaguuugcugcaggauugauggcugcacaaucuaugguauaagucuccaguccugauguaaguagacugugucuccuccaccccccaccuccaggaagaauagaagacucaaaucauggugcaaaagcauuccuuaguggagaucugcuaggaaagcuucauuucacaaaggaggcaacugaggccccgcauguaaggcacaucaccaauuugacaauuaggggucaggugcacacugucacuugggucuccugucuguaugcauuuauguccucccacccccaaucuacagguuugcuucccagagcugugcuuggaauauugaaaugggucuguuauggcaaaaucaguugucugcagggaaaccagugcauugucauuuaauguuugguagcuuuaguguaguugagacauuugaaauuuaaaacaacgaccauauuauaugucuuuagguaaaugacaaugucaugaucuaccuggaugggcauacacaaaaugauccucacauuuaaaauugugauuugugagagccacaucacaauagcacaguuauaugccaauaaugccauuaauaaaaaaccaucacacauucuaacauauuuaacaaauguagcgcagccuuaaaaacugugaucuugaaaucccuuggaaggucuuagagaaagucuuagagaauaaaauguaaaaauuaagcuugugaaguuuguuuggaaguuuucauuuaaaccacauauucagaccauugcuaauugaugcuuuguuuaaauguggcaaaaauauuuaaugccccagauuugaaguuaagaagucuuggggggcuggggggaggguggggaacugggaauggccagggaaagacugggagauacaggagagggucuugcuguggggugaggagggggauccuggagaggggagggcaccgagagguggggaaaugugagcagaggaggagggggaagguagaaggccaccaaaauacccuccugacaagaauaucaugauuuuuaacuucuguaaucaaaauaccuuuauauauuuuuuguauccagagccaauuugcagaagaccuuaccuuugacaagccucuuugcccccagcuaaagcugccugaaaaaauucacaugcaaacauuuacuuguuuucacaagucauauucacgguuuugccauacuuuguccacacacuucaaauacacucagagcauuuuuugaaaacuuuuauuuuaguugcauuucaaacacaaaggugacauuccacucacaacacauaacccccaucuuuuuaaaccaagccccuccuacuguacucuuuguaaaaaugauuggcuuaccucgggcucuucgcuaggaagaaaaauuauuucauauuuuuuaaacacagccacgcccacccccuuggaaccagcccccaagugguuugggauccggacuugccuacagcagguuguguuuccccuuucccccaucccccgaccaggcgagcugugugugugcagaauaccgaacugaggugugcagccccgggcgccccagauaccugugugucugguuuuucaacuguaaaggcgggaggguuuggcgaacgaaugagaagugaggaaacgcuuagcgcaaaaggaaaaagagagaaagacauacagaaacaagguuacgcggaggccggcgaaaagcgauuccccgcucccccaggccaagggccccgcuuauuucccgggaggccccgccaccuuccccgcguguccuccgcaccgcuugccgcagagcgcccgggcgcagguaccaccagagugugcgaacagcgaaaguuuuuugcccgggccauggcgcaaaccacaacacagcccguucccaaguacaaguacacagucggcggguaauuugggggugccgggauaggaacaggggacacuucagcguaucaugcacaggcgaacacagaauauggacaccaacacacaccaacgacaagcugucugaguccaagcagccgugccaggcgaggcggggcgcgccuuccccaaugaccccagcccaccguggaccccaccagccuagccaggggagucccggggccccggggccccuccccggcaguuccuggcucaccugaagccccugccuguccagcuuacgguugcuggcgcuggccuguccagccggaaacgacccucagugucgcucggcaccacuuuucucccuggagggcauauacuucggccacccgaauccaccaaagauccccucccgcucccagggcaguuagggucccucccuggaacuuucuagcaaguucuucccgccuuuggcuggacccccuccucccacugcggagccccuagccccaccaggcagcccugccacccccuccccgguuccccggcggcccugcugcccgcaggcagaguccgccgcauuaccuagaagcagcaggcggugcguacacauguagcccaucuuuucguccuggaguuguuugucgaugagcuuacugcguuucuucucugcgcgcuucugggcccgcuucuccagggcuucuuugcgcaucugucugcgcuucuccgccagggguaccuucuugaccuugagagagcgcgaggcuuugggcuggggacucucagaucgaccgaagcagcccccgaaggcuugcacgagaaaguugcggaguaaguugcgcuggggcuuucggcggcggcgauuucgccgaugcugaaaccagcggaggcauccggaggucccaucgucggacucgucuccgcuggagucaucgucgcugcuggccaccccuucaucguaguacacgcggcggccgcggcugcucucggacuugccccgccaggcagacgcgcgaguaggccgcggaguaggcggaucggcagccuggaucucggggcuggggggucugagauggaucuugcgucuggccccggaggcaggggcugcagaggccgcccggcggacuugggcugcccggguggcagaagcggcuggggcagugggagccccugcgucuggcgcagcuggggcgacaugggcugcccgggucucagcagccgcaggggcggcgggagccucaggggccgccccggcaucuggaucggcuggggcgucaggggccgccccggagucgggaucggcuggggcgucaggggccgccccggagucgggaucggcuggggcggcaggggcugccccggagucgggaucggcugcgaaugccccggagucaggaucggcuggugcugucccggagucgggaucuucugggguugccccggagucaggaucggcuggggcugcaggggcugcccuggcagcgguauccgcugaggcugccccggcggcaggggauccguaccccggagaggguacuuuuccucccuccgcggcaucagcggcuccuuccaucucugcugcuuccuccucaacugggggucucucugcucgcucucucuuaucuggggcuccggagaccuugaugggcgggccgucaagcgcgauuggggggcuguccauguugacgggagugucgucgaccccagcgggggcgcugccaaucucgaacggggguccggagaucuccauccaggggcugcugcccgugaaguuagaaggaggucugacagccucuugggaugggcugccgauggcgccugggacccagaggggaggcgcguucgcggcgggagugaggcggaccgcacucgaggccgcgacugccgcgaacuggcugcugccgucgacuugugcgauaacucgggaaagccccgggggugggcugucguccccaaauccuucuccaucaagcucaaauggcauagucuccucagggggagggcuguagccuccucuggagccagccuuugcaggccugagggcuuggggcuccucgggaggagcuccggggaccccugcagcaccugggccuccuggagcaaggucugggaccuguaagagaaguugacugcagccucucugggcaggcuggucaaacucaaagggcauagcuucuucugguggagggcuguauccucccaggccuggucuggcaccacugaaggcuccgggcuccaugagugcugggccgaaggccucaaggccugcauggaccccacuggggaauccaggcugcuccaguguaggccagaagccucccaagcugggcuguucagccucgaagggcauugcuuccucaggaggugggcuguagcuuccaugggcuccagcuucccugaaugccggguugaggaccugaaaguugggucuggagaccucuggggguccacaggccucgccaucauucucgacggggaugggcucguugugaggcgguucggucuccaucucuucggcugggcuaggcccagcaccgggggcagcugccccuggggccuccaaaggugguugcucgggcuguuccccgauuucaggggggauaucgcguuguccugacauauuauugccguagaggcaguugcgcacgcccauaacacgguggcggccucucaaaauaaguuuggggcuccguaagauggagcacccaaccgaacuagggugaaaaaauuauuauuauuauuuuaaaaucaaaguaccagcuggaaaguucaccggccucacuuuccaacccuugugagguugggggguucaaggccuggaaggaacccuagacugaggcugaagcaacucaauuguugcugguggagucuuggcuccuuccuggccacuuuucaugcccccaggcugccccccagccccucuuccuuggucuauccuuacgcccuccucucucuuucuuuuugcuccaggccagucccgccugcuuggaucugacgagcgugccgauucgguccgaaaaucgccaguagcgcucucucucugccaccagaggacgccgguuccagugccgagcuggcuccggcuccaggagccugcuccuggcgccaggggcccgggacuuuggguaagggggcuggugagcgcaggccucgcagggacguuuuggcuccuuccacuccucucccugacugauuuggagucuuucuccucgcuucuccgcuggccagagaaagcgcuccugcguugcgggacacgugacgcaagacgugggccucggaacgcuggaguacaggagcugaaacccucccuccccaacccaaccgacuccucgggggaggggggacugaagaaggauuucaucaccccaggauaccccugaaacucugagucauagcccccagccuccaggcagccccggaucucaagccccuaguccggagcgcaaggcuuuuggugccugggaaggggcgcaggcacgcguagggaugcgacagguggucgugagcccaccaaagaagcagagagaggcgagggagaggggaugccgaguaugcaagcacgcaauuuguuuuuuaaaugccuuggguguacuuuuugcugcuuuuguuugucacuugcugagguuggcuccgguaaagcacuuuaacagcccccacccccaucacacucuaggggucuccgcaguggcccacagcggcgcaagcagggugcucucuuguuuauguggauggugacgcaggggaauaagaaggucucgggugcguaccaccaagagcaaagcccccuagggaguagcugcggcggcaccaagagagggguggggggcgugcugcgcagaggaggaccucacaaagcggccucagaguuucgcagguccugcuguucuagggaaggguuaaaggggauuuugguugggguuuaaugccgguuuagggugguuucgagacuggacaacgcugugcgcacugaacccacagauaaauaccaugccgcgcggcaaccggagcugaggugcgcugcucgcugcuucgggcaccggccgcagcgcuggucagucagcuccuuuagccccacuacagccugccuccagcacccuucuagccccucuccucucgcucuggguaucuuaggguagucgcuuuacuuuucuacugcuagagcccacugaggcggcacugagcccgccaaccggccacaaacccggcgguugcccgcgcagcugcgcucccgcuaccaugcugcggugagcucagagcuagccaaagguaaaugcccacaccaccugguggccuugaugugugcacaugcuaugcucuggucuggggucugcagagggauuggaacccgggagaaaagcugcuguaagggggucacauaaaacucggcaggugcgcaucaggucggucucaccagugagacagauuggcgagccacgucuaggcacagagcaacugggcaggaggcagggggucaucugaccugcagaacccugggggaggggaggcuggaugaguuacacagggcgggcugcagcaagcagggcgcacggcacgggcugcuguauaagagcugcaggcgggcgaaccaccgcaaguugcgaucccguuuagucuaaugcaucccucuuagagccaggguaccacaggcaccgugcauccuugcaccccugcauccaccauccauguggccacgcagcacggaaggaggcgaacacaguuggacccugggaaacguuugggaucccccaaagauauaucgcuuuagcucuaugggucuacacacuuccagaugucaacacugaacuuugauucaaacuuuggccaacuacacccacgcaagacggcuuaaccacuugagcauccacugaauggcccaacugggucccaacaccaacucacuccccuccgaccccagcgccgggucagccauugggcaggggucaugccaaucaaggcugccuggcgaaugagcagggggcgucagaccggaaaccggauaugggugggagguccaauagggggcgccgcguuggaacgcccgaagaggugcugcuggggugguuggaagccgguggggggcggguguauggcggcuaggccuggaagaccacgaggaccgcuagcgccguggggucacucuuccucaugccacagguugccgagccucgggggagagguggggucccaggggccaacccuuggguguguugauggcggcaggcuaacccagccaacggggugccacugccgggcaaggugaggagcaagaagauuuccagggcugggagguagagggccaggaccccaaggagagggcuuacugcgaggagcagcccaggauggauaaggaguugaggccccagggaugcugagccugcacaaguggaaggucaguagacauugggguuggagccccagggaggcugccaugggugcuccaaagggguuguuugcuuucgucaggccucgcgcucacccccaaaguaccauuugucgaggaacggguucagggucucuguucgacacccucaugggucugugggaccccuuuguucauucuuucugauaucaugagcuuugccaggggagcacaugcauggaggugacuaaaacaaauuuaacaaguuagacaaauaccaguuccucauccuggagaguagagcagcauacaaauggaagaaaagaacuccaccuggggggaccuugaaagucuugcuggagaaaaugacuuuuuauaugggccuccaaggaaggauagacgccuuggcuaugaauagaaggugguagugggggaugggagacgguuugcccaccacgaacaaaggauuuaaugguaggaaacauggggcguggcuggguaaacacaacuggccaccuuggcuggcucuuggggagcagggggagaaaaguuaggagaaauuagauagaaucucucugaggaugccauggaguaugagggcaagcacuuuugaggcuauuuuggcaggaaacggaaaggauguugaaaguuuuuuguucugcaagugaggauuugagccuacuuuuaggaaaagcagaagcagcauggaggaugauccugaucgagaacaaaggaaagggguuaugcacaaaggagauguuuaaaggagagaccuagcacggugaaggaagcaggaaggcugaaggacggcacucaagaggggucccaaaggauccuccuggagcagcucuuaugcuagaaagacacaaaagauggaggagccaaaguguggcacccagauggauggaacacugggagugggacagggaagucagugggaggggcuggcaagguggcagugcugauuugguuuuagacauggcagauuaaggaacuuugggcaguugggauggagauuuuugcagcccauuuucugggaggaaaggucugaaguucagaaaaagauaaagaucacacauucaaauuggcaaucguacuuacaaagaugaauuuauggagucagagaaaacucuuuaggggagaaauacauuugguaauagaaucuugaacaauuggcgcacuggacaggaaaaagggagacaguccaggagugaguagggaggacucagaagggagagaugggagcacaccagaggaagggguuucagaaccacucagcacaucucaucuagacuugguguuuuagccucugcacuggugguauuuggggccaggcaauucuuuguuguggugacugcccugugcauuguaggauguugagcagcaucccuagccucuacccacuagaugccaguagcauccccuuaguuuuaacaaccaaaaaugucuccagacuuugcuaaauguccucuggggggcaaaaucucccccaguugaaaaucaccacuauaagcugagaaaggacccuuagauuuaaauaggaauugccuuaauuuaaagauaaauuaagacuaggaagaauaaaucccaguauuuaacccugauauucccccuuuuuuccacuccuguuauuucucuguagugacuggcuaccagacucugaaaaaccuaaguccuuuaggugaguggagcuaagagcugaaacaucaguaauggggucagggaccccagaaguguggccaaauguucgaggaguugacccaccuguggcaccugcaaggccacagggaccugaggaauccgguauaguaagagcugggggugaucggcuaguggguuuacugggguccaccuugauuggccugauugguuggcuugucuggugauccuccugaaggcugauaauuuugcuagcucaagacagaaacauggccuugaucuggagggagauggccagugcuggauguuagugggcagcaucgucuggggccuaaccuugccggggcuuuuuuaggaucugccauuauaauuguauaauagcaaaguaccuuaaacauagcuuuccagugcuggauggauugccaucaugggaaaagauaaauaugugauaggacugaggaaggaaagucuauuaauguguuuaugcagcuaaggaagaggaagucaggagaggcuggugccugaaaaaaaaggccgaguugggauggauagacgcugugugccagggucuugaccccugucaugaggggcugugugcuggaguguagggcugcagugagaugaugugucaaguaggggaggacaggauuggcugucgaaacccagggaugguuuacuugaaaauuguguauacuuggcuacuuaaaaauaauagcgucugcacuugauguacuaagaaaggcaugggaagaauuucucaugcuuccauuaaacucugcaugucugaggaaagccaaauggcccaggugccacagguggcaaacaguggcguuuugaaaauauggaacccccaauagaaagaauguguguauuucuuuaccauugacucucugaacagcaccauuacagccccguuccuuggaagccgcacgugaugcccugggccucccaaacagucucaccucucuauugaugcuuucauggcauauguauucaacgaguaauuguguuucuacuuacauucugggauucuuacucauuaccaaaagcauaaggcauaucucaaguuuagguagcuaccugucagcuuucuggguuuaucccuguagccaacaaagagaaggcaaaguagagagagggaagggaggugggugaaagggaagggaacagaaaccacgaaaaacaguauuuuuuugguagucauuuuccuuuuggucugcggcuuugcagggaggagguggguggugaaguuugcagaagugccuucucugcagcccauucaugucauugguugucaguggguuucuuucaauugaggaaaaaguaaaagcagaaagagaagguagaaaagaauuuaggcaacuaugaagcuucucagccucccagugacaaauguuuucugagugcugagugaguaguaauagacuuugaagcuguacaauuaauuacuuuucaaucaagacuugcugcugccauccuuuucccuucagacucuccucugcccgccuuggccgguggaggcagcagcauacugcuaucugcagaggggucugcguggccaggcuguuugaagcaaaugccagcuaaaggaaaaaagccucaaauggaugaggcaagauaccagguuagaggcagaugcaaggcugauauuagagguaguggaaaaagucuuuaugaaaauacuugauaugcucagauuaaaaagcccccaucgugaguucagaccccuucacucagcuaauuagcuguagcucagcaaccuucucaaaaggugccccaaauucuguuucagccaaggcaugccacuguccucugaccaccugugcuugaacaguggguccagacauuuguggauuccuucuccagacuagcugaugaugcagcaaagaauuucaggggaggagaggccauuccagaaaagaugaacagcaccaugggaaagcaacuaagagagaggcaaaaguggggguuggaggggaaagagggaaucucggaagguaaauuuggcuuuaguggaagcucugcuuaaaauuucugcaauucauagugggaauuccagccacccugggggcuucugggcaucauuguuuaaggggaaugguauauuucaccuucuagaacaaccucaauuacccagggcaaauuuuccuaaugaaaucuaauuaagacagcgacauaagccaggacacucagaaaccagcucucacaugggguugaggggagaagaaacguggucuucugcuggcugccggucuuuggccugugccccuuggaccccucaaguuugagaguggggaccuugaagaccaaccuugcugugaaccaaaacccaaagcuuuagccuuggagcuagacagcuagauuucuagguguuaaaucuuucucuuugaguguagcaauugaaguacuuguaugaaaacuccacaccuaugaaauuggaauuuuuggaccaggucuguacgaaacucucagggggacagugauguuaauggugucgaaucugugagccucauugguagcccuccaaugccauauuuggcuuuuaaaaaugcccuuccuaauguugagcugaagucugucccuugaugcaccugguucuaacccccuuagccaccagauacuugaagcugcccucaaccuuucucucuucaagacucucuuuauuccuucaaacgacuuucuuuauaaccgccaaauuuccuggcuuugugacccccuuccccauuucuaaaucuucuuuucugcuccuucccagggguucucuuaucuacccacaucuuccuuuuuuucugugaucccucaaauucuucuuuuccuuuugucuuccuuaaaucucuccccacuuuacugucaccacuuacccucugucccugcugccuggguuuauguuggccuuucucauagccaugugcccugcuaauuuguaacauacuuacccuaaaauaaacacaaaaaauaaacacacaggcuaugcccagugggagcugggaaggcagccuccccauuucuacccgggaauaguugcaggcagaguccugccucugcuggcugagcacugucaacagguaaugguggccccgcauugcaggcucuuggccuugggagaacuaagucacuaggcuguuuauucuggcuucucugcccugugaauuaauggccacuagugcuuggaccagcauagcuauuggaggcguuugaaaaaacucaugagauuuuuaaacaagggaaagaaaacaaauaccaguaaaaaauuuaugccccccaccccccacauauggccuuuugauauguaagaaagaaauuauaaaacaaaaaugggugcuacaucacuuaauuugacagaaccagauuuuuuuguuuuugaaaugcuugcuuuguuuaucccaugcauguaugauggaggcaaaacugguuuugggggaugcggugcgcaaacaagucuuagcugugacaagguccugcagugcauaaacagacaguggggucuagcuguauguccaugguauuaaaaugucauggggaggggcaaguaagaagcauaugucugaagaagcgaagaggggagugaucaugaaaaaaacaaagguugagaaaacugguuuaucucaaauagcuguagcuucuauaccauuuuuuucaggucuagcuuaaccaaaacacuuaaaacuguuaccaaaaaacuuucaacagcacuuguggucacucaaccaauguucccaucagucugccgucccccacagugguuagccucuccaagcugcaguacuaggucaguacuugcaaccuugcugccugcuccugcucugaaaagcuuguucuuagacaccaaggucagggacagaagguggggaacacacacacacacguaaaacacacacuaaauacgacucucaggauggcuaaguguuuccaguuuagggaaaggacacaguggaauucugcauucucuaaacugccuuuugagaccauuuugcaaccaacuguaaagcagauuugacaaaauuuacaugaagccaacacaaaacagauuucuuccuagcuggugcuuuuuuuguuuuucgggguuuuuuguuguuguuguuguuuuguuuuguuuuuuuuuugagauggagucucacacuguaggccgggcuggagugcaauggcgcgauaccuagcuggugcuuuuuauuugagcaacuuucgauguuuuuugggaguuccauuaggguuaaaucacuaguguagagucaaauuggacaaccccaggcuucuuaagcuaaucaaucuagacauuuggagcugaaagggauaaauaggaucaucucauucagcgaucucauuuuagaagaaacugaggcagagggguguugggucugaccuaaggccacuugaccauggcuagaagcaaccugggcugcuagcccugggccuuucgucuuagaucccacugcuccaguuugggacaucaaguuauaggaaauagagucauuagugucaaaaccccacaacagaacaagaaauuccaucucucauucuugaacauggggauuaaagaugucauuugagcaucucaucccucugcugggugauuuuuuagagaagagcagcaguugagccagcacaugacaucacuggccuggaagcuuaauuuuauuuuagugauuugguuuuugugauaggucaccuuccagguaagcaguuaggagacaugcuuuacucacaccaugguuucugcucaguuuccucucaaaagcuucccucuucuugaagagcaguauaauaauaacugauaauugagguaaauccauguagauuauuaaaaaaccaaaaaaccucauucuuaccaacacugaaguuucagcuuucuuccuccuuaaccuuccacacagcugcagaaaaugaaggcugaagaguuaaaggcuguaagcaacuccagggugagaaaggcuugcagugcauuaaagaaacaucucaaaacaaucccaaacuguaacauuucuaauucuugaauucugaugaacauaaaagaguuuuguuugcaaaacuuuaaaccuacaucagguugaccccacacaauauuggaacauugcaacauaaauucccagcucagauaaguucaguuacaagagcaccuuugggucgcccuccccucccccacaaaagcaaauuuccauuaagcaaaugauuaauguacuaaaggaaacaacuucaauauugggggcauaucaucauguuuagcuagcuuuauucuccugcuccuccuccucccucacccuccauuugaaauauuaaaaguggcugguaauucaccuaugugguucaccauaagaucugcuuuuucuugggagccuauccucaccccgcagaccucaccuauguaaaaggggcaagugggccuauucagaugcuaaccccaguugagcaggguggggcaaagggccagcugggagacuagugaguugggaaugcuuggggaaguugcuaaaaauggcucuggaaaaggaaggagcugaguaccagucucucaggcagagagaagguuugcgaagucuauauagcaaaauccugucuucucagggagggccauaggugcuuuccucggggguugguauagcucucaguugcuucauauggucugcacuggcuuuuccacccuugaaucaggguguaaagagggaagcugggggaggggaauugagcgggggaggagaauugagcgggggaggggaauugagcgggggagagugugugccgguagguaacagguuuuuacaauugggcuguaaugcagauggcgaggcaguuuguggaagacugucugaaagacaguguguguuccuagauugccccuccucgcuacaugugaacaugguacauugcuuacaguucaggaaacaucccuauguugggcuucuguuuaaaaaacagcaagaugggugugaggugugggcucgacacggagggcuuuuaaaaaacuuguuuauucauccugcaacaaggcaacaugcucauuucucuaaugaauaauucucugugggaaaacgggucucccggaauacccagucugaagauagcucccacacuugaaaggcacaccaaagaaauucaacacaaucccuaguuuuucuugcuugucccuagagacauuuugcuuggugaacucaggcugagacauuaccagaggaaaaacugaacacuuaaugucacagaaagccaacacaccaucauuguuuacauuaagcaggaauuucgacuuaggggcaagccaaaagcggggcacgccuagcccuuccgcagccuccaaacuucugagacuaacauugcugucgcagaaaaccacuugcaaauaaacuaguuucuccguauuuacuagggaagaccacaaaagcauccaaccacagucugcgcugcagcccggcagaacuaagucuugggcgccgcgacgccuuuccuacggaauagguccuggaaggaagaccauuuaagguauuuuccuucuaucaucauccuuuucuuaggaguuaagaaccugaccgucauucaucucaagcccucaaaacgcuuuacuauuccuccaaaucguugucauccguauaauuaagccggcgcaaaaugagacacgcacaccaggaaaaaaaaaaucaauuuccaagucggaugagauuuuuuaaagacauuucacuuaucagucuuuccccccaggacuggcgaggagagcacgccuucccuuccgaaggugcguuaccagauugcugccguuuuugugcugggucaucagagcagauuccccuccagguuacagauuaaacuuaacucuacccgugcugaaaauggccggagcacgccgccucgccuccccuccccaaggcugccggagccgccggccccugccuccuuuucgacgacugaucguccaaggacuggcgccggauccaacaccuuuccccagcucugcgcguaccgcgcucuuuggaaacgaauuguaaguuauccugauguuagacgcgacccccgucuccagccugucccuuguuccgcuuuaccuuuccacuugcgacgaucucgagggccuccagagguccugcgcaaacagcccaggacgucuccugcuaagccgcaugcagccuggccacccgaccagcugcgccaaaagcuuggcaauaccccgacgugaccaugccugugcguucaacccugguagcccguaggggcauccccaaggguccccuuaccuccucuaccuuucccccagguacuuuccccuaaccgcccgccgccgggagaggucagcuccggcgcgcgcgggcaggugcgcacgcucuuugaggcggucucugucccgcgagcgacgggaggcgggcuguggcggccaaggcuggcgcacggcagcuggaggcacuggcgcggaggucccgcggcuuaauugucagcucugggaccugggcuccggcucugagcugcuuaggcgccgcgcgcgcgugacuucccucccggguggucagucucuagaguucucgcccauucccauucagauuacuuuccgcacauuucaacggugucucuacagcgcggcugcucucacaucgugaaaguuggcgcgcgcaccuccgaaccacauuuuggacaccugagaaggccaacuuauuugagacuagucuuucuaggaggaagaaaagcgcgcaaaacaagugacuuaccaaugccguuugggugugcagcuccaaaucuggggugcguucgggauucagucgcguagccggggcaccagcucggagaccucagguugucuccagcgggacgcacggcgugcgccccgccguccaacaagccuuuggccaccagggcgccccuggcauccugggaaguuugggggagcccucgccgccucacccugacccccgaucccaggcugaccagcugagccuccucucuucccacucgccccugaccugccuuuccuucucaccuccuuuccaccugcgcugcucccacaccgcccucaggcuccccaguuuagcggugggcaacuaaccugaauccaugaaaacaaggagaaucuggacggcguccuccauuagugacgccggauggggaugggucccuuuuuggaaggggacuccggggacgcgucacggcgggugggcuucuuuggcuugcagcgacgccgcugcuucuccuccuugggcuccuucgacucuucggggucccuuggaucuuuguccucgggcuugagcuccuccccuucccuggggcucuggggcuccugagugcugggcggcgcgcgacuuggggaggcgucggggcuucgcaacuugagagcgugcagacgcugggugagggacuggccgaagguggagugcuugggcaccaccgggccgcgaucgucuucaggcucggucucgggcucaguggugggggcggucucaggcucggucucgaagucggucucggacucgauuucggacucggucucgcucucggucucguagucgaacucuuccucguacucuaggcacucggggagggacagcucaaggucugccuccucgugcucguggucagauuccgauucgggggacucagggaauaccugggcgccggagcgguggugggcguuaaggaagcuccggcgcuguugggcagccgcgcgcugcugggcacgggcguuggagguggcaagggcgcggaggagcgcgauggagcaggagagccagaggagcgcgguggcugcccggcggccuaugggcgggcacaggucguuguaauuauggcgagcucggcgccacugcugagcccgggaccuccgauccauccucuuaggcacacaccgagaagccggccugcccucuggcucugcagagaguggcuccgaagcacauuggcugcuggagccgggaaagguacacccuaugaggugagaagcuggcccggaggucccagccucaccuccuugugaggagaaaaagggaagcaccuaccuuccugaccacuuaagaacuuucuaaagcuccgcgccuugcuugccucucugagcaagaagaagggaugggaaaaaaggggaaaguucugucuccucccgggcuccucucgcugagucuuagauuccgcagccuaagacucgagagaggugccuccgccgguccucuugccugggagaggacagaggagacugaggcgaggagggacgggcagugagguucugcgaaguugcgcgcccggacuucugccgggcaugugcaguaaggaggugggggccaccuccccgcgagcugcgugguggcgccgagccuguggcgcagacccuagugggccggcagguggcaggagggaaccuuguuugaaaggauuugggcgaagcgaugggcggggggccuggcggguggcaaggagcaagcggcaagcuagccccagguccaguacuugggcaggugggcgcaggcucccguggggucgugccccuccccaguuuccccaguuauuggggaaauaaacacagccugggagcagcuaaaaacccagaaccccaaauagcaaauauucaggggaaugagggucugucuauacacgaguauuaagccucuagcauuuuccaauggcuuaauaguuugaggaugguaacuucgggcagccauuaaucaugaaacuaccuuuagcagaucuguuauagugacuguaauuagaaaaguuuccaaacaauacgugcucaaacagucugaauuggcuaauuaccucaucuucuucaacaagggcccccacgguugagguaguaguuugcaagucugcaagcccaucugaggacugcccugagcucgauugagcugagaagguggugcuggaaguggacuggagcugagagcauggguaaagggaagucuuuccugcgcucucaguucacacaaccacuucucuccugcggggcaguucagggugacacggaauccucacuggaggccccuuacagccauuuccuagguagguuuuuuuuuuuuuuuuuuuuuuuuugagacagaaucuugcucugucacccaagcuggagugcacugaugugaucuugggucacugcaaccucugccuccuggcuucaagagauucuccuaccuaagccuccugaguagcugggauuacaggcgugcaccacuacgcucggcuaauuuuuguaguuuuaguagagagggguuucgccauauuggccaggcugguuucaaacuccugaccucaagugauccgcccgccucggccucccaaagugcugggauuacaggcgugagccaccgcgcccggcuccuagauagguuuuuaacaaagguaacucagcaauacucauugggugccuugcaugugccaagcuguguuuuaggugcugaagguagaguagugaacaacaacaacaaaaguauuguauuaaggaaaggauauuuuggauuaauuugcugugaaucaggagauugaaucagucagaaucccucuguacccaccaacauuguuuaaucuagcuugaauuccacaugagaaaaugauuggaucagggcuagggggcggucagacaccacuagaucguguuguuguacucugcaaggcugaagauuuggaguaaauagugccgcucuuucuuggcccuagaaaaucaaaugauggccuacaggaggagaucccuacagugggagcuaaccuggcugcugcuuuugaggugugcgugucuucagucuggcccuccaugaugauuauggggugccuuuuuggccauagugacaaguccaaaggcgaaacaacucagagcaaagccaucauccuaaaaucccugggaguaucaagaagguuguuucacuuaggacacaugucauggguugugguccuuuucuccuucuugagucaguauggggaaucuuaaaaaaagaggcucuaccacuggguggcccaccaggcccuccugguacugguacuucugccuggugucugaagagucagucagguacccacagccauucucaccaugauggaacuuaaccucacaccuucaacaccacacccguauuaaaaccacuaagugcagaguucauaccccagugagagaccagcaacugcuuuggauguguugagguuuuccuuucugcaucuuggcugugucuagcuuguaucuugcacucuguguuaguuuguagcauuaaaauagugauugggcugggcaugguggcucucaccuaugaucccagcacuuugggaggccgaggcgggugggucacuugaggccaggaguucaagaccagccugaccaacauggugaaauccugucucuacuaaaaauacaaaaauuagccaggcguguugacgcacgcuuguaguuccagcuacucggguggcugagccacaagaauugcuugaaccugggagguuagucugauaaaguaggauugacuugucaaaccccacaaaaggacaaaugucuauguuccaguugugcccugcucuaccacuuuuccuguggaacagcaaggguuuuauuaucacaggugccugcguggcuguagucacuguguggauauuaucaugggacacugggcaggggcauuuagagcuguauauuucaaauccucaucuccgcuucugagucccaacuaauggggcacguuuccagagagucugccuacacugacccacccacuuuauuucuucuaauuagcacagcuccaucgacagcauauggaacagaaauauauuauucaagcugauuucagggcacguugggggaaaaaucaggaauauaugggugcuaguaaaugcccuuugaauggaaacuaaugucagcugucagcaacgagguagauuaugauucuuuaguguacauaagaaaguacuucauucuucagauggagugcuuuuaugccuauaaaggagauggcagcccagagcugauucacuaauauagauacaccgagauugccugcauuauuaaaaaaugugcauuacauaauacauauauuuggacuagauucugcauuagcaaugcgcuuucuuugcaagaugcauuuuaaucagcaaacacacauuuaacaaaagacugcauuuuugagccccaguccuguguaguuauaaauacaucucaguguacauucaccacaggcucugggaggaaggagugggggacugcacugagaugccauuccaucucacacuuagugccgaggucgagcaaauggagccguacagcagaugcucuuuaaaaugcauuacgugcgugacuuuaaaaagugcucgcugcagagugaauuucaaaaaggagcaagugggugaugaaccaccucuguuguuaccgggcugaggaacaaggggcucucucugucugcugguaaauaaaguaugggcauauaucacuugcgggucucugcuggagggaggcuccuaaaccaguuggacaggaaagcgcaguucccagcucacuacaguaucauacaguaagcuucugauucggauaaauugugaagaauauugucucuagcuccuuaaaggauuuucauguggaagaggccuuaagauuuauuauauauggcucuagagggcaaaauuagaaccuaucggugguaguuguagcagaaagccuucagcgcaacccaaagaagaaucugacauggagugggcugucagaaaguuggcgcuuugucagaagcaaugugaagucaaaggacagguaaccacacacuggagauguuuuucguggugugcgugagcaagugggguuggaacucggugcccaccgcagucuuaucagguuagccucugauuccauugaaggccucuguaggcugugggagaaggguuugggggcucuacugauggacacgauccucccccccgcccccacuuuuuacuauuuuggaagcauugaaagugcaaguggcucagugacaggaaggaguguugggguggcaguuuuaagacagggcaaacagaugugugcaauggacccagcggccuguggagcuuuccucaccaaggcagggcguggaggcucuuugcuccacaacucaucacuuguugaagcaaagaaaugagucaaguccaucuguuaauuacauugguucucuuugccuccucuccuggagcugucucggaaauuacaaaugaaauuggcuauuuagcaaucauaaauugagccacuucuaugaucaagacacuauuccgggcacuguggggagaucgaaguaauugaggaugagcaauuccugccauccaacaucacacacauugaugugaagugcccccaaauauuaaaaccagauugcugacagguguagaguaauacauuccagcccagauagacagggagggaaguugaguaacugguuagaaucagagguacaguucaucuugugauuuucagaaagagaugagucuuuaccuagucugacucugagauuuucuuuugauuuuuaaaagcccaugagaauugcuuucaauccacuuguuucuaaccaugugucuaccgugugcaaagccaugugccaguggcccugggggagacagaugaaucauggguucucagaaggcuugcaggcuauugucagaggucccacagaccucaaugcauuuucuaagaugaaacucaagauaauggauugguucugcccugccuggugagcggguauaaucacucuugaagauauuuuuuggauaaucauuggaaaggacuauuuuuggagaugaagagcuuuuccaacuuuccuuuggacagaaaugaauucagggaguuugcagcacucgcuaccccucacuguggcaaucagccaguaaggcucaaccccaccgagaauuugguauuggccccucccgccuguuccccagagaggaccagguacaaugcagaagcauuuggcucagcucucuagggugcuauuuugcugcuauucagacugcgcugauaucaauuggcucucaccaguagaaauggugaaaaccucgagcuccugauuuugagauuugggggaaugccaucuagagcuaaaagcaaacaauagagggaaauaaucaccuuuuugacauggcugguuucuguccaggccauuuuugggauuacaauacuguauuugugccauucguuuuuaaagggcguaggaucagaaaggagccuucguucugugcguagagauugcucggagcugucuucccaggagcucccuuacuuucucuucacuucgugcucuguugagcuucuccuacugauaagugccuaucucccucucucucccucugccacaggaggagcaauuucuagacucuggauccaacgggaagcaucuagaagcccccuugcucaggcaaagcaucaguacccaagagggguacaggcccucuuggacguggugucucauuucucucccguggcccuggagcuuggcauucuguauucuccgguucagacccuggacucugacacccugccuugcuucaucuugaguuccggcugucugcccagccggaccuacacugagcuugucugguucuuuccugcagccaguugagacaucauugucccaggacacccccagucuacgggguucuggccccagauguccaccucugcccugcccaccagcagccaugccagccagugagcugugggugaaaacacugcugauugcaaaggaccacucaaccgucaggaaagcucucggcucauagcuuugucuuuuguccagcuguccuggacauccuaucuuuccucuagccccuagcccugacagagagccucaaaguuguuuucaucuuaucugcugaggaucugacucaccccaucagacuucugggagggagagagcgagcgcgccucgagcccggaggggagaaacccuuaguguugucacgguuuaggcacacgcucauagaaauccuugcagcucgagcucuucaaaauaugauuagaccaauuuuacaugucuagucacugaggcuccaguagauugggacuauuucuauaugugcaaagugaaguggauaauugaggcaauuaucuucaggcaaaugaaucugggcacuguaaucaguccauccugauaacuggggagaaaucggcgucauucacuguagcauugcuuugcguuaaagagaauucuaagguauuuguuuguuauuuucgcuuggcuucauuuuucuaaaagacaguccagugaagaugagguccugccucgugcugguguuaggauguguggaccccuuaggucucagucaggugugugugggguugaucuggacgaguugauaaucagaucagugcccuagccgggugcauccuuggcuuccuugugguggauacuugguuuccacaucaggguuuucuuuccacuucuucuuuccuuguguaugagaacccugagguguuggauggguuggucuacaaggucaccuccacugcuaggaugauaggauuccuaauagggcccaugagugacauacauugugcaugauaaaauaucauggagccaggagaaugaaagaagggccucucaacgucagaaaugagaaugcacuggaggcuggugauuacuucuggacccccgcuuccccauccauuguuucggcuaaaagucaucauaaauugggaguccuucccuuuacuggucuagaaguucccucaggaagcagccgucacuucucucccugcucuucacugaggagggagggaagaggagcaagagaagacuuuccgguuuuccaaauggcagauuugguuucaggcaugugaggagccacauauaaaaagaaaaggcauugaggcaugugagauuugacuuaaguggaggagauccucgccuuuaagcaauaaucuguguauuuagggagccaauggcccagcaagaaguccagcagugccuccugagugccugggcaccugguggagauggugcagggucccuggcaaaagagccucugggacaggaguuguagccgccagccugugucacacacucacacucacaauuagaggacaacgggaauuuaauuaacuuccaaagugugauuuuugaccauaagcauucuaggaaugaggugcuguguggggauugagaugaaccuuggaaaauacuuaaggagaggcuuguuuuaugcugucaggaaaucuucaucuugucacuucguaaauuuuugaccuugcucaguuaguuagaaaaacaaaaacaaaagcuuccuguccacaacugagauaagagaguuuugcaagacaucucucuguccucggaguguuguggccuucuguggguucuguaguuuuaauugcuagugguuucauuccugcucaguuagugaaauugcgacauuuucccaguaucuuagcgugacugcccuacagccuuaauaaugaugauuuuagacuguaguuuaagaucugcuggggcaaaugccuucucacugcacaguaucucagcauucucugauguuuuguccauuuauuuuucuauaugaauuuaagaaccauuuuuaucaaguuuuauaaaugaccuuggugauauuuugacuggaauggcguucaauuuauaaauuaaguugggaaauauuaucaucuuuucugcauuuagucuuaagccagaaguauggccucucaaucuguucaggucacuauuucucucauuaaggauuuguguuuucuucauguaauuuuaauauauccuaugugaguuugauaugugaauauauaucauauauuucccaaguauuagaugcuuuuguugcauugugagugggcacucuuuuuuuaauuauauuuucaggccucuuauuauguauuuauagaaaugguauugauuuuuguacguuuuucucaucuucugccacuuucagaauugguugguuuuugaggcaaccagcagccuacucaggcaaacacucagagaagguuucuggaggauuugguagaagagacuaccucaucagggaaagaguugaacuaagucagcgguucccaaaugccaguccacagugaaaugagaaaacgaaagauguuguaguggggcuuucaucaagccaaauuuauucaggggagggacuuuugauuuugauucuugauuuugaggcuauauaagcuuccugccuuuuagaauuuugauaucauuucuuucuagaaggauuguagaugauaauuagggguuuuguuuugcuuuaagauuuuagagucuuugaaaauaaauaaaucagaaauccuuauaauaaaugaaugaaugaaugaaugaauaaaacugcuugaauucuacccuccccaaaagauuuuagaucuuuuuuuguuuuuguuuuuuuuuguuuuugagacagagucucgcucuaucgcccagacuggaaugcaguggcucaaucucggcucacugcaagcuccaccuccccgguucaugccauucucccggcuaauuuuguuuuuguauuuuuaguagagacgagguuucaccauguuagccaggauggucuccaucuccugaucucgugaucugcccgccucggccucccaaaguucugggauuacaggcaugagccacugcgcccgcugauguuguuuuuuaaauuuugcuuuuauuuaguuuucagugacuuuaucuagcagauuuuuuuaaaaaaaagcaaaacagcuggcaacccgaugugagugccacacauuucuuuugaaauauuagcguggucuggccgggcacaguggcuuaugccacuguucguagauuuuggucuaaaaucucaaaaucuaggaaccuccaauucgauguccuuuggguuuuacaguugugauauuugguaaaucuggacuucuuuuuauauuuuaaaaucauuuuuaguuuauucuuuuggguucuucuaguuaguagugccaguuagauugauguuuuuguuacuuauuuuggcuuucucugacuucauccuuugucuaugccuugcguuguccucugaaaguguguaggagagagaagggugaaaugggggcacccucguuuuauaucuguuuuuaaagggauuuuucucuaaugucuuuucucugacaguauuuaggugggcuucaaagggaaaauagaugguaucuuaugagagggcucaacagaaaguuuggaggugagaaaccagaagccagauuugggaucacacaggccuggauauaaaucuugccuccuucugcuugcuagcugaccagugacuaugccugguggcggugauggugcugguuaugauggugguguagcauugguggugaugguaguggugguugugaugguaguggugauggugaugguggugguggugauggugguguggugguguggcggugguggugaugguggugugguggugaugguggugguggugauuguggugguggugguguggugguggugauggugguggugaugguggugcugaugguaugaugguggugugguggugaugaugguggugugguggugaugguggugauggugaugauggugguguggugguggugauggugguggugguaaugauggugguguggcggugguggugauggugguguggcagugauggugguggugauuguggugaugguguuguggugguggugaugguggugugguggugauggugguggugaugaugauggugugguggugguggugauggugguggugauggugguguggcggugguggugaugguguggcguugaugguggugguggugauuguggugaugguggugugguggugguggugaugauggugauguggugguggugguuaugauagugguauagcagugguggugguggugguaugguggugguaauggccaagaggugagagagugagggggcaggaguuugaggagcccagccaugcagaaagagccuaaaauaaaguuggaguuggcagucgaguuggauuuuucuuuuuaauuucacuuuccaguucucuuuuaguggauucuuaauggaaagccuuagaagcuguagaguuuggucugcacaacugcacuggaugcccauucuagguccuguacucugcgaggcacugggaauacaauggugaaugcaugcagugagggggaucuggaaauaaugagucaucgcgcuaaggaaggucuccuuauaaccuaagcuaagggcacuggaaaagaaagauguucuuuuguuuuuuucccccugaguauacagcagaagaagccacccuauauuugggcaaggcagggaauacuuuacugaaaaagugauacgugcacacuugagcugagaacugaagggugagcauguggcagcaggggguuggugcaguuccaaguugaggaguagccagaggguggugcaguuccaagcgaggaauaguguauuugccagcucucuggcggaaagaagcuaagccuguuagggaaacucacaggucagcagagcuggagaacagagaugaaucuggagggcugggcagggaucucugggcccaacagguuaaacugcagucuuucuguugucuugaacagccauaaaccaugggaagccuuuguccugauggccaugagggaccaaaaucaaguugucuauuuuaaagaccucucuggccacagaguacggggauggaauuugagaggaagcuagaguugauaguagcugggucuagggaggugguugguuuuagaaauacauaaagcugaggauagugagaguggcuuuuagaguuauuuaggagagugucuuacaaggcuuggugauaacauggauguggggaauuggcugugucaggaugacacccagguagaacuagauggaagcuaguacuuuucacugagguagagaagcagggaaagaggcccaggugugagguagcaggaggccaugaguucugccauguugaguggggugguggggccaagagcucugccauguugaguggggcgguggggccaggagcucugccauguugaguggggcaguggggccaggagcucugccauguugaguggggcgguggggccaggagcucugccauguugaguggggcgguggggccaggagcucugccauguugaguggggcgguggggccaggagcucugccauguugaguggggcgguggggccaggagcucugccauguugaguggggugguggggcuaagaguucugccuuuggucuguugagaacaaggugccuuuaggcugcacgugacaagguaucaagacaagguaucagacagguagaaagauguucuaggucucgggcacaguggaaaggcugucauagaagcagaaaaagucuagugcuaagugggagacaagagaggaacacuccaaauugaguuuccaaccaaagucauuaucaacaggagucauccuggagcuggauggcacuggagagaucgagucucagcccuuuuauuuuacaaguaaggaaacugaggcuuagagaggugggaccagcugguu

SEQ ID NO: 12608 - RNA, 75334 nt, Homo sapiens
gguuuggagaaguuaaacaaacugcccaagagaacacaguuaguggcagaucaugaagggugaacagaucgccuuuuucaucaauauauagcugauucuugcacaaugucuugacucgugguaggcgcccaauaaauauuugucuggcagaugauuagagaguuagaugaccaaccaagacagagccccaaaaucuucacuggcagaccagcuuuuccuucccuuuuuuggcaauacacuaauagccuccauaguuucuuacagagugaaacccacauuuuuuaucauauaauuuauaaaaucaagauauaauccauauaccauaauaguaacccuuuuaaagugaagauuccagugguuuuuaggacauucacaaaguugugcaaacauaaucaguaucuaauucuagaacauuuugauaaauagccauuagcagucacucccauuucucucucacccaccucugcaagcaggaauuaccuacuaucucuaaaauuugccuauucuggacauuucauauaaauggaaucauuuaauauguagccuuuuguguguggcaucuuucacuuagcaugauguuuucaaggugucccaaugacauugcacauaucauuccuuuuaagggccgaauaauauuccauuguaucaaaaccaaauuuauguucugaauuaucugagcacucucuugucuuuuucacuuuucaacaugaucuagcccuugucuccaccucucaagaaaaagcuagugugguuucaguggguuuuccacagguuccggccaccacucuucccuggaggagcaaauagcaaaggaagccaauugccuaagguuuacaagcuauaaucaaacagaaucggaucccugguguuaugugaacagagaugcaguugccauaggcagcagccugcuggccagacuccagagggcuccuuccccaccucaccugccaccuuccaggauuguggggaagccugucuggcucuuuggaacaauagaacaaagaggccucccugaaguuguaagaaccuguuugaccgagauugcugcuguaaugaaucaagcuccagaaacuacuuccaccuccucccugcacaaauaucccugggccugaagcugugccuuuccccaaaagagcccaagcuggggcuuguacugggaagcuguaagcaugcacugaggugagggcagggggauagggaggagcucuagaagcaucuucugugagcaagggccuugccacucaggguugggaaagggaaagacuugucugugaaagucccugacucugaauuugugguuaaucagugauuuaccugcagagcacugauguguaaccuggggcaaugggccugacugcaggacuaggaaugucauuccugcaaaacagucccucugcauuccuuugcucuugcuaacaaguuagacauggccuuucaccccaaccaaacaccuaaccccaccaccccaaggaagaagaucauaccuccaggaaaauaauacaguucuucuuaaagaacuaacaguauugaggaacugugcuaggagcuuuauguagaugaccuuauuuagcaccuaaagccacucuguaauacgugcaugaugauuauuauucuagugucagaugaggaacgugaguuuuagagguuaaauaaguugcccaaaucacucacuauaccuaagccaagauucaaauucaagcaggcuaucuugaccucuaaauacaucaugacuaugaggaagaugaugaugauugucacuuacuguguacuuauauguacacaagaaccccaugaggaaggcauuauuuuuauuacaacugaggaagcugaggcugagagagcuuaccucacugggaagcaugaaguuggaaugacgcugaggaugucuggcuucccagcccacacccuuaaccacaaggcccugccauagaguuauaugaagucgucagguuagcaacucugaguggcauauacgucuguagcagggccuuaugcuaagugaucauucgauccuccuuccugccucucuauugcccuucaccaucuccuccaccuccaacauuugaaagacaagaaagcggagacccagggcaaugcaguggcauguucgggaucacaggguuauaggaauagugggaaaucgagcuuagauuucccaagggccccuccugugcacaguccacccuaucacaccaacuccaaacaaugccccagccagugcaggcucugagcaugugcagugcugccgcauguacuggggaaggggacacgagcaggcagagcaggcggaggugagaagagcacaaaaccaccuggaagcuugagagccuaguuagggaagaaaagucaggcuuccucccacugucuguccagguuugggaucuaagauuacacagcagcaacaaccacaugucccagugauccagcugccccaaccacuuucuucccccagcaguucugacaugauccucauggccaagagcuugaguucacccaggguaggaagcugagggaaggcagcaacccuguacucccaccuccaccugccaggaggcagagucugcucuccuggcccucgagccuaaucgccagaucucuccugcuguacucaucccaugcccuuaggcaggccuggcugggaaggacauuuccuagcccugugcucuugcccauugccugguggugcugccagucuuccuccagcuccugcgcucaaagugcccgccagagccgcucgucugacagguuugaaaaugaaugacugucuuccucaccaccccuagaugugucugugucaggcugacaucuucuuuauaacaugugaugaaagguuugcaaagcagcguuucuacaugagugcaugcuagauggauauccucaaagggcacugggaauauuagcgcuaacaagcuggaaaugcaaggaaaggcugcugucugcacacguggaacagaauuagugacaggcccuggaaggaacgucuccaagcucuguuccauccaagcuuccacugcuucagguucuuguaaaaaucuuuuugagaccaauugucucaaguaggaccacuaacugccuccuugagcuuuugauuuuaaguuugguuuaccaaauuuaacauuugguucuuucuuucuuucuuuuuuuuuuuuuuugaggcagucucccucuauugcucaggcuggagugcaguggcaccaucucugcucacugcaaccuccaccucccggguucaagcgauucuccugccucagccucccgaguagcugggauuagaggcaugggccaccacaccuggcuaaguuuuguauuuucaauagccucccaaagugcugggauuaugggugugagccacugugccuggccugguucuuacuauguguugaauguuauuccaagcacuuaacaaguaucaacauauuuaaccuuugcaacaacccgacguguuaggugcuguuuuuaucaucuuccccgguguacagaugauaaaguacagggacgaagaaguuaaauaauguccccagcucacauggcuaaucagugauagaacugggauucaaacccagcaguccagccccgagucugggcucuguaaccaucagcuuaagcuucucuucaucacaacaccauaucauuugacuuuuucaccaauucugggaucuuagcgccaggagaagacaggcagagaaagagggugugguaaggagugguagcguauucacaugucucaagugccgucucauagcuguggggcccagacaauguccccuguccuacgcggaugucugacucucacgggugacuucuuggcaauuccaucuugugagaggagagcucccagccuugucugucccucugagguuucccaaaggauccaguucagaugcugggcugcuuuuugagaauuccauauuuacugagugagcucuggucuagagaccaacaaggucuuucugagagaggaccuguccuauucacccuugugucucagccucaggcucugggcuuaagauguugugggaacucaaauuauaccugccugcugaaaacaaacaaacaaacaaacaaaacccuuacgccuguaaucccagcacuuugggauuacaggcgggugaaucacaaggucaggaguucgagaccagucuggccaacauagugaaaccccgucucuacuaaaaauacaaaaauuagcugggcaugguagcaugcaccuguagucccagcuacucaggaggcugaugcaggagaaucacuugaacccgggaggcagagguugcagugagccgagaccacaccauugcacuccagccucggugacagagugagacuccaucucaaaaacaaaaacaaagcaaaacaaacaaacaaaaacccuucccaucaacgaaggaucaaaguagugaaaaaaaaaaaaaucuuaaaaugaguaagaguuugauggggguggaggagagaaaggaagaagacagacaaagucuuuaugaggaccuucugcaugugucucccuacacacuuugcccaacccacaugcugauagcaucucguuauaucaacaugccugagaagucauguggcagcuguucucuccacuuucagaggaggagaugaaaggggagcgguuaagcaaccugugcaaggucuuuaaacuccagacccagugcccucuuuagacacaaccucuaagcugugugguuccagccccggccguuuaucuguccaccugccacacaagcaagggcaggaccccacuuuaagagcuuggcccucccaagcucaggccucuccucacaggagcagagacccugaggcccagaacuucccauggcauggagucaggaagggucccuuuccgugccuuuguggagugagcacagccagcucccccaggaguggggccaugaggacagauagcagggcagggcaggcugcaugcuguggaccuguucacuccuggaccacugcuuggucugagacacaugagccucugccgaauguggccuuggcuccugacuuggcugugccuggccugggaccgguccccuagggcuuggugaaggcucauucccaccagucccugccagggaaacagaagaggauaaucaccaguuucuccucccacaaagaugugauucccagaggccagucgcuugccgugggaaaccuccugguucaacgugcaucccuuggcugugggucauggucucucaggacuccaagccugaguggcaggagaggaguugcaguucucacagcuccaggucucuuuauuuacauccaucucugagacgccagucccacucagagccaucccugaguuagccaacccaucauacuacagcugcugggaggcgagggcuuggcagcgugguuugaaggaggggaagggaccccuccaugggaagguagaggccagcccgccagcccugggacugaccccauggacaguuuccucagugucccagccccugcuucccugauguugaagcuuucacacugggcuuaaaaaucucaagcacucgaggaaggaagauggcagcaacauugguaggagugcagagaccucagaggguaggagacaguggaaguggcuccagacgugcagacuuaagaccugaguucaacucccagcucuaccauuugcucccgugugaugcugggcaagucauuugcucuccuugggucuuaauuccauccucuuuaaaauggagaugauaaaaucuuccuaaccuccaucaagacuaguuguaaaaaucaaauguaaaaguacucaguacccaguaaguguucaauagacacucagaaaauaaagguuggagcagcgugauuauagacuuucugcauauggagaacaauguucuguguccuggcugggcaugguggcuuucgccuauaaucccaguacucugggaggcugaggugggaggaucgcuugagcccaggaguucaagaugagccuggacaacacagagagacuucaucuuuacaaauaguaauaaaaaaauuaacugcaugguggugugugccucuggucccagcuacuuaggaggcugaaauaggagaaucacuugagccugggaagucaagacugcagugagccgugauugcaccacugcauuucagccuggggaacagagcaagacuccaucucaaaacaaaacaaaaaagaacaauguccaguguccauaaaggaagaaauuggggaguaaacgucaugugaaaaaaaggagauuucaauuggaugcaaggauaagauucuuggcuguuagaaugaucaacucuguagucagccuuuuagcaaggucaaacggucucaguccuggaaauauucaacagagacaaauguucugagugagggcuauucaucuaccuggaguuuggaaugucuggguugcgggggucucuucugauuuugagaacugaugcuuuucugauaacugcagagaauaguccucuacuugcuuugucuagauaacuauuagccuacacaucucugaauaguacuucccccuuuucucuauacaguuuuuugaaguauaggcuauauuacuucugaaacauacaugaccauagucuugaaagggcuccaagccaugucuaccacugauaaaggaaacauuuacucauuuuaaacucagucauucauccauguaauuuuaacaguggacuaguccuugcuuaacauugaauuacuaaagugaaaugcggcuuccuacaccugccuuccuggucaaaaagggaggauccacagagaacguuucucuuuuccaggggacuugccaguuuuacaaagaaacagaggcucucuuuggaaaaaaauugaacuuguaacuuacaauuuuagcaacugaauacaugugagaccagguuagcugccuuaacucacuuucacagauugacaauccauuuuaacaggucugcacucaaggcuggugucugaagaggggagagccuuggaggcuuuuaagccuuugaucaggaauauccacacaagcuaaugccuuaaaagcaaaggaauuaaaccuuucccugacccaguuaucaaggcacgguucucguggucucaccagcuggcacagccaucccugaagccuuuggucacagaaucggcaacaggagcuggaaggagcugccccacgcuguacacuuuugugauauaguuuucugucagcauguaccacguggauccaagacugccucuaccccacucccagugcccagaucacugaacguaauaccgaugugguaaaugagcagaggaauggccaggcuuagggaguuccagccagcuuccuugccuuugaauauagaaugucagguaauuuaaguaaaauaauggcuaaaccuuacuauaugccaggcacuguccaagugcuucagagauacugauucauuuaacucacaacuacccgacgaaguagaugcuaucauuuucaucaucucuguuuuaaagaugaggagagaaacauuaaauaacuugcucuaagucacacucuaaggguacauccacgaccuuggccaaggucauuuggccccagagucuguguguuuaagggccauucugggcugacucccugaagaaugggcucuguucugucauugaaaguauuuggggucagagacauuguccauuacagaauucaucacccugaacaucagaaaccugcccuuggaucuagaggaaacuuuuucagcuuuaaugucaaccuuauuuauuaauuuauucugggaaugguuuuugggauuucuuugcuucuccauagacacaaagaauauucucuuuacaaaaaccuuuuauuuucuugaaaaugggcauuaagccacacuuuugacuucacucguuuacaaaaaaacuacaacccauuugauuuuucuugcacaguucaguuuuucuuuucaucucuuaaccugcucuagaaugucaaauaggaacguaguagguaaguucuuguauaccacauuccuuuugaugaaucucaauguuaagagaguuuuucccauaagaaaacaacagugcuccguuguguauucagcuuauaguucugggucacagauccugucccuccacaacacuugugccugccuagacucuccuuuccuuuaugugaaucagucucuugcaccacaaguuuacuuucuacuuucauuugagucuguguuuuugcauuucauccucucugugaauuucaguuuugucaugucccuuuuacauuugacucucucucaucuuccaaaguacuggcagugucaccucauugauuaucauuucuuuauuuucugcagcuaaaaacaguaacugaaguuguuuuggaggaauuccuccuuguggucuuuguacuaugauuucuaucucuacagauaaccaagguggcaccauauuucccucuccugugacagacacauggccaaaggacgacccauaguguccacacgucagucagugauacacuggaggggcaggaccuucucaguuccaccuacaggcagcaggaguaaugccccuaccccaccucacccccagcccugcaaugacagauaaaugaagucuaaugcuuagggcccugucagucuccgguguuugucauaaucucauuugcaauaugguuaugagcacggauuaaaagaucaccgagguccacucuguauuucugcaagaaguggccaccggccauaaagaccccuucuaggccugacacagugacucacaucuguaauccugcacuuuggaaagcugaggcaggaucacuugagcccaggaguucaaaaccaaccugggcaacaaugugagaccccugucugcacaaaauaaaacaauaaaauuuaaaagacuagcugggcauaguggcacacaccuguaguuuuagcuacuugugaggcugacacaggaggaucacuggagccugggaggucgaggcugcugugagcuaugaucccaccacgcacuccagccugggcaacagacaaaaaaaaaaaaaggaacuauuucuccacuagaggucgcugugcuucccagguaauaaggccuaagggggcucagccugaaucuucagugugagcuagcaacagugacuacaccaacucaaaaacucaaaguagaguugcuaagaauaguaugcguuuugccuggaaugcauuagagauaaagaaguguagaaaaaaacuuuuaccaagaguccaaaagagccaaacaaaagcuagcauuccuggagagaggagagguuugcuaaacagaggccauagggaggagcucaaguuugcugagacuccagacaaaagaagaaaaacugugcaaagaaagcacaguuaauugaauucccaaguagcuggugaguuacuuguauucaacguauaaauuucaagccacaaauucagcuaugcaagaaauguaacuuuauuauuuagaacugaaccuaaauuucaauuuugaguguauaccacugagugguggaagcuggggcugauaauuaagguccuccaccccaaccccacuaucccaagggauccagggucucucugguucccaggcauaucugaguggggugcacaucugguaugggucaucguuaccuguucaaguuccucagaaugacaagacaacuccauggggccuucugacaggcuuuucugcccuagugcuccuauacuaggggguucucuaagggauucugggaucuuuucauuugccugaguuuaauucugaaacaaaucaugggucuucuauacucugggauucccugaaacaauggagauucuguacguggacacacaugcacacauggcuuguguuucugcacaugcacgcgugcacacacacacgcacacacacauacacacacgcacgcacacacauacacacacgcacgcacacacacacaggcacaguuuauuauucucagggaccuuccagaaucuaaacuauuuuuucuguuucuagcugggggcuggggaguggugcugaggguugagaguaugcuaucucuuacuaaacguucuccuaaaauuuuuguuuauggcaaaaauuguaugcuccuaguccuucaagguuuaggcuuuuaaagcuaacaaguuuguguucuugaagcuuauaaagcuccucucugcuuuucuuaggaaucaucccaccccuggggcaaugacugcugcugacugaacagagggagggcccaguauacaaggaaauagggagggagggagggagggaagccccauuuacuaucucagagcugugaaaccaacuguaaaucagaagcucguuugguuugaagguuuuagcaauuccugguuguagaaaacuaaggguccaggcuuagacauucuugguccuuagagcaaauguuauuggggacucuaggggacagcaaagcaucuguuucaagagaucgcacaggaucaguaaggacaggcaggaauuucucuguuccgugacugacuuucugacccaaggcugggcaguuuucacaaaugaaguuuggcuuccagugaaaaaccagccaguucucugugaacuuuuaauccuuuguucaaauuuuuuauuguuuccuuuguauaaucugcucugugccuggagcucucaucugacucauucuauagaauaauccuauaauugagggugagcaccaaauguccuaagaaguccucguggaaaaaucacacucugcucuccacauuagaagcuguguaugugcagggguuacucaacucucuugaauccuguuucagauggcuacgaauuccuggagauccugaaacagguugcccgggacaauacugacaaccccgaucugagcauccuguggaucgacccggacgacuuuccucuggugaguggcuccagccagcgccccacccucaguugcugucacaaccucaugauugcguucagcaucugaggaggugaaauaggcaggggcacuugaagaaacccaguggcgguccucacccagugugggaggucuuggcccuuggggcaguauugaacuuggggccuggugcugacccugaaaggauucggcuuacucccuggaguccaggaguugaaaacccuugacccucggggucccacccaagugagcaggguaaacuccuucggcagcagcuccagagcugccccucaucacuccauucccaguccccagaacuacuuuuauuuucuggguggggaccaucguucugaggccaccugaauuacuaaguaauaaaaaucagagaugaacauuuuucagcgaguucagaacuuuguggagagaaagcgagcgugccugucauguucaucguguucuccccaggaccuagcauagugucuagccuacgaugaaugugaaagaaacuucaaguccacacuuuugcuagugugcaugaucaauggcccgaaacuuuugauuauacuuaguuuuuaaaaaagaauaaacagcauuuguacacuacauguauugaacccugguacugguucuggugcugauaauaaguacugguacugauaauaagcauagcugauauauucuacuguaugccuggaacuagaguaauacuuuacaugccucaucacagcgaauccucucaacaacccugugaaguagguacuauuauaaucccugucacaagguggagagaaugauagcuggggagguuaaagcuagugagugauagaugugauauuccaaucuaggucuacaugaugcuaaagccuggucuaccgacugcuuuagguaaaugcuuauugaaguaaucaguacaaguuuaguuaucauuagguuaugaaugaugacuuuaucuuccaggaauuaucauuaguugcauaggucaugacugaugauacugugauuaaauagagaaaauugagagggaucucaaggguccugaaaaucagcccuauguagaggagggggugaaucaaaggcagaggcuuccaugacacuugagaccaaugucauagcacuggguaauuauaacaaagucauggccauauaagacugcauacaguacagcuuuguugauauagcuucugccugguuguguuucuaguuuaucugacuauuuuguuauacaagcuugcagaugguuugcaguuuuccuggccaguuuuuuuuuguuuuuuuuuuuugagacagggucucacugugucacccaggcuggagugcaguggcauaaucucaauuuacugcagccuuaagcucccaggcucaagcaauccuccugccucagccuccugagcaguugggacuauagaaaugugccaccacgcccagcuaauuuuuaaaauuucuuguagagacaaggucuuacuauguugcucaggcugguuucaaacuccuggacuccagucccaaagugcugggacuacaagcaugagccaccaugcccagacucucuucuggccaguucuauguguuugccuugguuuuugcaaagaagaaaucuucagacuauucugauuuccagauuccugaauaucccuaguccccacuaggccauauauuugcgugggagauuuccuaccacuggacaucuccauuaaaaaaaaaaauccuguggccccuugcuccuuuauuuuugccccagucagagauuuguccacauggaguccaagccugguugaaugaagaagccuucuucuuacuuggcaacuuaugacccaucauggcuuucccagcuaucucauguagcacaagauaagguauuuuuaaaacugggacauuaaaaagagguggagggaaauggcucuauaaacuauaaaacagccacaaguaauuuggaaagcaacauuagaccaccucuauaauuuucucucuuacagcugcagacacauguuuccauaauuuaugcugugucaucuuuuauuuaaugcuuauuugaagugcuugaaggcuggggccaagucuucaauuugcuaagugcucacagcuguuuugaagaccuuuaaccaauggugaccuaguuacugugaugggacggcggguggguccuuaacagagaaugcccucugccugcugucuaaucuuauuuuuuuguugcugcagcucguugccuacugggagaagacuuucaagauugaccuauucaggccacagauugggguggugaaugucacagaugugaguauccccugugaaggcuugcucaggcacccuuggccugcccugucuucugcuacacagcuuagauugugagagcaucuauaguagcccagccuuuucagaagagggcagggguccugcucaaggaaacuugccaguguguuccacgccuggucuccgagccagucccaaucugugguuccauggcucucuuccaugggcacauuuucuugccuauggggccagccuuuccugaaucacugauuuggaacuuucccuucaaguaaacucuccuguauuuacccccaaagucaaacagcaaacaaaaaggucucuuuacaaaagggaacccacaccaggagccaucacugcacaaugggugauggggccguuguggccuagaaucccaggcaggcaacuacucuacaggcaggagaccaggccugcagaagggaaggaagaaaaucauaugcgaguaaggggcuucuccucagaguucaggcauuguugaaccgagggugggacaggcuagugagguacacuggcagaaugcgaggaaaucuuagaucucaguccauacaucucauacaacuccaccaucauaaaacucaaguggggacagauacaaucaggcaaacaguggacagaaagggaugaucacagaggauuauuagagccauacuuaauuaagauagaaucucuuaagaaugggggccaagccaggcgugguggcucaugccuguaaucccagcacuuugggaggcugagauggguggaucaccugaggucaggaguucaagaccagcuggccaacauggugaaaccccaucucuacuaaaaauacaaaaauuagccaggcauggucaugggugccuguaacaccaguuacuugggaggcugaggcaagagaaucgcuugaacccaggaggcggagguugcagugagccaagaccaugccauugcacuccagccugggcaacaagagcaaaacuccaucucaaaaaaaaaauaaaaaagaaugggggccaguuagcaaugucuuucuccccuguugauagguguucaaucaccuagggaacucuacauucauuuauuuuguaagcuacuuuaaaauuaauaauaauacauuacuuuuaaaacaugcucaagugaaaacauuuuaaaacagaacaguagauuagaaggucaaaguaaaaaguauuuccuacuccccugacccaaccccuagucucauuccuggagggaaccacuggugguuguugcauggguauauuaccagaaaugucauauauauuccacugggcaauggaauacacauuuccuuuuaugcaacacaaacaguauacuacacauaccguuuugccguuuggcauuuccauuuaacaaugugcacguuccuaauaaguguaagagagucggggggcacucagcauagcuauucagcacggcuaucccuggucugguucagcccucaugcauuuacccacucauucauuuugucccucacugcaggcugacagugucuggauggagauuccagaugaugacgaucuuccaacugcugaggagcuggaggacuggauugaggaugugcuuucuggaaagauaaacacugaagaugaugaugaagaugaugaugaugaugauaauucugaugaagaggauaaugaugacagugaugacgaugaugaugaauagcccaacuccaaacaauucugaugaaaacaaaaucacagcacccacuaccauacagacagcacaagguggcagcaagcaauucugccccacacccagccagcuccuuucccuuuuccaucaucucuuuucccacucccuuugcgucaggagcagcaucauucagcaaaugccuuuucaaaugcagcaaucccacuuagcagggacaggagaaaaauuauucccauguugacugucuugacugucacggaacagaucuuguucuuugcuggaccaucaagggucauggcagugccugaacauggcagucuagggugaacaauccccuaacacaaguuuacuugucuuugauuaugacaguaacaaaauugacagcuuucuaacucacaggcauagagugaccuuuuaaucagagcccagggaagacacaugauuaaugauuuagcucccuccauaccucgaacaucaguugggaucccuccuccagccaagaugauccuucuuagagaaggcucagccuuggaagcaaacuuauaaaucauauucucauggcuuuguuaaacuuauuucaagugauggucauucauaucacuaugaacuuggauauucaagccuuuggauggcuauggagagggcuugaaauguguacaggugucaccaucauuucuaguauauuaggaaacugggaugggagguugauuugcucucuaaacuucccucuaguuggcaagucucacauauucaucagcaggaguggagggugggggaaaacuagaaagaugaaaacuuuuacauuuuucugauggguucaugucucugauugggucagcuggcuuccuagccuaagcugggaucugaauaccccuucucuguagcugcuagugagccuucccauuuagauuaaagauugcuuuauccagcagucaauuaacucuccaguuaucaguacucccacaauuggccagggcaacaauaauuggaguucauacugaugcccugaggcacugaaaaaaaaaaaaaucccaaagugccuucugagcugucuaaaaguuacauugugcuugguagauuuaguguuaagugugcaguauaauuuucuaauuuauuuucucaaucuuuuagcacauguguaagacacugugcaaauuuuuugaaaauagagcaauacuuuuuguggaauacuagcuaacuaauucugucauuaaacucauauuuugaaaauauucagacaauguugaaaauccuaucuugauuuuucugacucugcucauucucaucuggcuccaguccuaccuccuuauuucuucucuauuuuccuuucuagccccucuuccucugccugcucuuugaaugaugguguuucacagcaucucaacucuacauacucuuccaaaaugaugucaucgugcccaucaauacuauccaugugcuaauuaccuccaaauaugagucucuaaccuugacuccuugccuuauuuuuagacacauucauucaacugccucuggauaucuugacuuguuguuguacaagcacuucagacucaacacaacaaaaccugaacucauugccuucuccccuaaacaucuucuccucuucauggaguccuaguuugggugggugauagcaccauuuauccaauugucuaggugaccugaaggugccccuuccccccugugauuugugcaucccuggaucaugucacuuaucauuuaagguauaacauauauuugcaugucuguccuuucacuaaauugcaggcuccuuagaggcaaggaauuuaucuuagaaucccuagcacuuagcgcuuugcccaucacaaaguagauacucauuuauugaguugguggaugaauaauugauuaacuagaauaccuauaauuccccagcacuauuggguaacagagcuuacaaggugucuuagucuguuuuuauugauauaaaggaauaacuaagaguggguuauuuaugaagaaaaaauauuuauuucgcucacaauucugcuggcugcaauacugggcaucaggugaaagccuuggcugcuuccauucauggcagaagguaaaggaaaaccagugugugcagagaucacauggugagagaggaagcaugagagagaggaggugccagccucuaacaaccagcucuccagggaacuaacagagcgaguacccacucacaccccacuuccuccagagagggcauucaucuauucaugaaagauccaucccaugacccaaguucucaaguucuuaaaucacucccuuuagacccuaccucucaauacugccgcacuggggauuaaauuucaacaggggauuuggugggaacaaauauccaaaugauagcacaaaguguauuagcaggguuuacuuauguagauauaaauuguguacauuuugcuuaauggcccaaagaaacagcuuaucaauaaucuaaccaaugaauaucuuugagucaauugcuuucucuaauuucuguccaugcaauagcuaagaauuugauugugugcugucaaaauucuaccacugagguuagcggaaaacaggcuucauauuucuuugcaaauaaucaaauuuccuuuaaauagaccuaucuaaaaucaguugauaauuuaacuugaauucccaagccacucaggaaaauaauccaauauucaccucccacaucaacccaaagucuguuacuuuucugucuucuuauuugacucaaauaccuuuccacuugcugguuuacucaaaagaucuguuucaucuccauguuuuagagccugaggauuucauuuuuaguuaucuauucaaaacauuuucuucacuguaaaaugauugacaacuaguaguuuuuguuacaaugguaauucuacuuucccaauccaucacaauugucuugguuuuuauagaaauaugacagguugucuugaaauucugaaggucucaaaauuaugcgagagugaaaaaugucccugaaaaaguaagcaacuuuuuagauugaaauaaucacaugaagaaaagaaacaagacacaauuugauauuucaguuuauuuuccaaguuuacaguauaaaaaaugugauguguaaaacauuuuacaguuaauugggaugagggggggauuauacuggaggacccaaaaaggaacaaaauaacuugggugacagguacacuauuccaucagagacacuaacucuguuacugacaucacaaugagaagaaguuucauagcauaaaccuuaugaauguaaguaaauggaccuguacagaugguugcugguagugucauucauucauuuacaugcuugcaaaugugucaaaagagcccacuacccaguuuaugcaggaacucacucaggccuugucauacacauauggugaccaugagcagaggcugguuggcaaaacugccccuccugguuacaauguacaguauuaacuaaucagaaagaacaaaaaaggucccugaccacauuuuuacacaaaccguuaugacucugucagguaaagacaggugguuucaucucugaacuuucuaaauuggugcuggacuugaaaucaggaaauguaaaguccuucuaaccaaagcaauuaucaaauaaucuccucucaaauaagaccugccuggcccaggccucucugguucucucaguagcauuucuguugaggaaggggucaucuauaaugugaguuaaaucacugagccaguaucugcccccacccucaucuuugcuggcauccugcacucuaugcaauaguuauggccauaaaugacuguuggaaaucaaauuuggcuaaucacgccauaacuuaggggucccagaggaguuugccauuuaauuaaagccuaccguaaacuauuauaaaaauaaauuauugccauaguuuagauuuuuguauguucccuuuuuaaagaaugaugaugaaaaguaagcgaauguuccauuaccucuauaacugagaggugcugguaaaugaaaaacaacuguuucaucuuucuacaaggccccuagaacggcaaugaugugcaacugucuaaauucccuacaacuucaguugaacuaaacuugucaccugcagaucagaugcccaagucccaucacuaacucccugagcaacaagucucugguccccacagaugaagcuuucuuaggcugaaggcuuuuuagaauuaaacacuccuaaaugaugagcaacuucacaacaaaaggccaugucuacaagugaaagcucagauaaagauaagcacauacaaaaccaaacaacuguacauucaaauaaugcuucccaaauaccauuucagugccaaaagaagugccaaagacacuuuuaagauaaaagccugggguuugucaccuuuguccccaaagcuuaaaguaagugucuuucuuccacuaugacaaggacaaaacgcugauguuuguaagcugagagagacauaaaugguagagucuuggugccauauugaaagaaacuuuucacagugcugcaccuggcuuuaggaaucugcucuuuuguuggagagacuaaaacaacccacuaaagaggcuuauuucauagacaaaacaaauuggguuaucuacguagaaacggaacaggaccugggaaaacgggacuuauagagcccugaaauuuaauuuuauucugaaguuuuacauuucuaauccaucgcaucuuaauuccuaaugagaugucacauggagagaugugagcaccaucuucccuuuacugucuuccauugaaagcaaacagcagggcagaaaacuaugguuuaugcacaacugaaucaaaacuuacuacauaugggaacagagaaaaaugguuuucugaguccuguuuuacgucugcucugucaaaagucuugggggcaagugugagaaagacggugggaugcaaacugcuugcugagaacaccuacgucaaggaggccaggccagggacuccggcuugagauccccacaggauggggcuguggacagccccucucacuccaaccagggaagaaguuuggggcauaauguugccauggcaccagagagaggccaggucaagccccugccugccucccugcacccaaggcccaaggcacgcaucuugcccaagccagcagagugggagcagaagguggggccaggcaaaagcaaaggggggcugccagaacaacagcaucccugucuugcagcagguguuaacacugaaaggcuggguuuuccagaagggauucucaaguucuuuccaucaaauauccuaagauauuugcuagcauaguggagaagcuuuccaagggacaagguguaaauccaaagugaaagaagagauccugccucccaaugaacucucaccccagguucuaguucaaggaugugucucuagguccuuccucaacauccagaagugccgaaucauuuagaccauacuucaagguacaguggacugagggguuagaaucaaacaucuaguuugaaauucuguuaaccagacaugagaccuuggacaagccccuuccucucugaccuuccguuuuucacccgaaaaaccaagaugacuccuaucuugaaagaauguggggauaacaaggcuggguggaacacggacugugacauacauuaccugauaaauguguuaguagccuuuccuuucuuugaccaaaacauguuuugucaaaaugugauccaaaacugaauuuucugagcauacacuugguuaaagcucaaugcaguuauuucaacagugucuaaacuaucucauuucgcuacugcacugaauaccaaucaagaacggugggcagaagagcaauucuuauuuuauuuauaaugaaauacgaccacaagguuacauaguaguaaauucacaguagugauuuuuuuguuuuucaguaacaaauccguaaaucacaaacacuacccagaaauacuuaaaucacuuuacaaucgcagggucucugcugcaggacuauuuaaauaaauaugcuaacauuucugugcuacuguaaguaaccuaucacuuuuuaaaaauaaagcccaauuuuuaaguuaccuuaagaaauaucuaguaaggcuuccaggguagugaaguuugagcaguaauuuucuuagagcuugaccuuuguuuguuuguuucuugcuguuuucagaguccuaaagcaagaaagaguuuaauggacuugccugcaggacagcaggcuccccagaagacagugcugugcuaaagccauuuacucuagcgggagaagccagugucagugagggaaaggaauaaagcaggggagggaaaagucacugguuuagagcgaccucucaaaacacaggguuauuaagucaucucucaaacacaggggacugcagaaacacagacacccucacacacucagcuauauacacaaugacacguaucugcugagcuacacaccugcuacagauaacacagauguuaagaugucugacauauaaaugugcuauccgucugguaauacacucagagaaaugcucacauauauggaaauaaaaacgcacaaacaaauaugcauccccacuuagggauacuuacacagcaggacccagauuggaagguaaaccaaggacucacuuuuguugguuucacugaguggcuggagcacucacucaguacguagguuggaguggcaagguaaucaauuucugucaguccaauaugcugguagcaucccacagagcuacagcccuuagguaaauacaugcacucgaaagugauuaugaggcaaaaugagagagaaaucuaccaccaacuacuguagagagggcaggggugagcacuuuaucccuauccaacacacaccugcacagcuagucucuccauuaaaaaaggagucccaagccccaggcaaugaacuacaacacagcaaacacaccaggucaccugccucuuaccauuugcuguaaagaacuugucuuccauguagaugucaaaaggcaagaacagaggcgggggaagggaggugaugauaguugggcaaaaauuugguggucaaguauuuucucuagggcuuacuuuaugaauuuuagccaaaguauuacagauuugacuuaacauuuugauaaugcaaaggauggaugaacuauauagcuuuaaaauccucucugagaaugcauacagaacuuuuuaacauucaguucauggacuauaaaaacuguccuaucuucaaaaguacauauuuaagaacaaauuaucuaccaguuaaaacaucaccagggaagagagcaaucucagauauagacuccucauuaaguucuuuaacacucaaugcucuaauuuuaauaacguaggaugaaaauuauaaaaaaucuauaaacauauaaggcaaaugaaauccugucuacuauaaugugaacauacauucuaccagccuuagggcgaaguuuacccccuuuuaaaaagaauagccuaccaguuccaagaauugaaauaaaaaugcauuguguucaauugugggaugcagcuuucugaaaccuuaaaucuuuuaaaugucauuuacauuguucccacugcaaaaguaacucaagcuauaaagagguugaaagugcaaaggcuuuacaaagauccugcauuuuauuuuguuauucuuucaaaaagaacucaauacaaagucaauauaaaaaaaucaauacucaauuuaaaacagaaacaguaauuucugaaugucuaacauucuccuaugcaaagacugggagaaagaggaagggggagagagaaaauaaauucuuuaauuuaaaccuuucuucacccugcugggaaugcacaugccagagcaaaugaauccagcuuaaccccuucuggacuggucauugaagauaggguuggaagaacaguauuuuagaauggugaugaacagugucauuauuaacuauauguacauacacuuauggcacuuggaacugcacuguauccaugacguagcaaccucugacacagcccgucucacacuugccaucucuuaccccauuucccaaaauauuuccugagaaagauauuguaaggaacuuccaguuugaagggaucuaacggcaaaaacuaagaacaaaagcaccaugguuccaugguauguguuuuuuauaaacagaaacacauaguugaauaguacaucuuggcuccacgccacaccuauggguucccccuuccuucuucuccagcaugucuuuucaagcugaaggcuaguaauugaagaauguuguuuacuuuuucagguacagguguauuacaaagauccaaagccaauuuugauuuuuacaaugacacaaaauacuguaccacuuguggaguguaugaagcaguaagggaguaagggggugugcacacauacaaagagcauucgacaaugucauccuguacuacagcaagauggcugauuaccgaaauacuggaaaaagcaagagugaacacuuuuaaaagguuuguugcagauacaggaaggcaaauggaggcaaaggcagcccagugcaagagguccggauggggcuccugaaggagcuccccugcagcagggcuccgccaggauggcuccucugcccacaacccagucagugucugcucccccagggccaggggaaagcccacugaaaucagcuguguuuaacagacagaccacagaugaaucuuucuggacaagaugggcucccuacucucccuuccccaaacucuguagaguguccauuuuccuucuccccacuuuaucagcaacuaagagugggagcaaaaccagccucuuuccugguccuaaguggcagaggcgaugaguugcacagugacgguggucagaaaacacagggacuggacagcagcaguugccagcgugguuggcaugguuuggucuccuuuggcagggcagcuugcucuaagcuugggaagaacuuacguccccaggaaauuaaguggcuccaaguugcaccugccaaucccagagucacaguguuagucuccccugguugguguagaacaguggggaggaaaacugggcaguguggggcuccugcugcagccuaaagguggcauucccacugcccucucucccugugcuuuaccugcugggcaccccacacuucccuauggaaacaaugcugggacugacuugaggcuucacacagagccggagggcacacauggagagccagggcugccagccaggugggggcaggauggcauggaggccaggugggcagcugcagggcugggaaaggguuaccugcuucaagccagcagaggggugggaucagaaacagggcagguagguuuucucuuugggaaaaaaacaaaaucaaaucacuuaauagcuguaaacgacaguguacauuuuuuguugugaucuuucucugaagaaccuaaggcaacaaagaacaaagaugaaggcagguaucuccugaacugcccacgacuuucaugggugaugugauacuggacauuaacauacacaaauacauauguggacgugucgugacugguuuccugaaacagaauaaagauguguccccuggaagucuacaagugggcugaccagaagcaacgggggacuugguacuggacgaaaggcaggaauuaguuguaaggcgaggcucccaagaagcaccagcuccacuuugguuuacagcuguaacagaagcuccaaggaauggcuucuugagaagucccaucgacaaaagucagaugucaucagucacucuuuuucaggguggacagccccugcuuccuuccaaauaaagugcagauggucaaaggauacuggucaaucaucugccaguuucagucagcaaugaagaagaauuuuuaaaaaagacaccccucuggcauagauauauaucucucuauauauuuuucuuuuuuuuuuaauaaagccacaaauauagaacuuuuaaacggaugucucagacuguaagcgaaggacaaauuugugagauuuggggucuaugaacucuucagagaguaugaugaauggaauuuucuucacauugacuacgaggcugaaguccaagcacuuaaggacgaacacaauuccaucccguaauccauuagucacagccucaucacugacaagccuccacuguguagagagccagcgguccuugucauauugcaggguggggcccgcacugagguaccguucuaggaaggccuggaagcagaggagaaaggccauuagggaagaaacagccuguuuuaagggcaguacugccaggcggcuauccacucucacaucuauaaagaacuuuuuccaaauaaaccagcuuagaccagagcccagcucaucacacucaauucccaucagacccucacaacugagucauuacuggggagggaagacuucuuggacuuccucacuccccuuuaccuacuauccaccaagcgcaagaauagugguacccacagaggggagggaaaaugggguggcuggugucagugucuggcuggaagccgucauggcugcaucacuccauucuuaggguaugguccuacuugauguguuucuccaugucuuccuccuccugaaccaaaaguuucucagggccagggcugugucgggcccaaaggagcagucaggaaauacaagcugcauauacuugcaugaauaagaacgcaugcgcuaccauuuacuggcagugauucugcacaagucauuuacacucucuauuaguggacgcaaugacacuaccuaagucacagggcugccguaaggaugaaaguguuagcucucaaaaagcacucacagcaaugcccgacaugguaagcaagcaaugguuauuccauguugggcuaagugugcacauggccaguccaggggaugcccaggccugaugcccccuucccucuccugaguucucugcuccaguggcaccuggcucgauggaguucugauacaugugcuguuccuccagcuaaacacugucauucagcucauucuucccugcccuucaaaucuucuuaaggcucuucucuugaaccucucaggcagauuaacauguccuccuucaggcuccuguaaucacugacucucgugugacccuuuacuuucaaagugauugcugacuugcaugucugcuccccacacuacacuucacucucuugaagggcaggaaguauguuuuguuucuuuaauuugaauuuccaacgugccuagcacauacuaggaguuugacagcaugcgaauuaaaucaaauaaauacacugauuuagccaugaggggaaggaagaaugaaaugagccaguaauacagauagaaacauacugggauauaucaaucaggucccagacagagucaagaacagauuuuguuuuguugagauagagucucacucuguugcccaggcuggagugccguggcagaaucucggcucacugcaagcuccgccucccggguucaagugauucucuugccucagccuccuaaguagcugggauuagaggcaugugucaccacaccuggcuaauuuuuguguuuuuaguagagaugggguuucaccauguuggccaggcuggucuugaacuccuggccauuagugaucugccugccuggccucccaaaguguugagauuacaggcgugagccacugcaccuggcgaagaacaguuuuuaacuaguauccucuuuuuuuuuuuugaggcagaguuucacucuuguuacccaggcuggagugcaauggcacgaucucagcucacugcaaccuccgccucccguuucaagcaauucuccugccucagucuccugaguagcugggauuacaggcaugcgccaccacgccuggcuaauuuuuuuuuuguauuuuuaguagagacggaguuucaccaugugggccaagcuggucucgaacuccugaccucaggugauugaccugccucagccucucaaagugcugggauuacaggugugagccaccgcgcccggcccgguauccucuuuuauucacacccugcugcuacugccagguauauauuuuuuucaucuguggagcaucuauuguaaggcagaaaaguaaggccuugcauacucccacacuucuaauauaaauacagcuccuaugaaucauaagaaaaagaaaauaacaauuagagaaaugaaacuaaaacaauaauuuuauagaauaaacauuauuggaaaauuaacauauaaaaauuuuucuaucacauuauuaacuaaagaaauauaggcugggcgcaguggcucaugccuguaaucccagaacuuugggagguugaagcaggcagaucacgaggucaggagauugagaccauccuggcuaacacggugaaaccccgucucuacuaaaaauacaaaaaaaauuagcugggcgugguggugggcgccuguagucccaguuacucgggaggcugaggcaggagaauggugugaacccgggagguggaguuugcagugagccgagaucgugccacugcacuccauccugggugacagagugagacuccgucucaaagaaaaaaaaaaaaaagaagaaauauaaauuagaagaauuaaaaacuaacuuccuccuauuagauaggcaaugauuuuaaaaaauaacauccaaugcucccgaguaugugggaaauaaaaaaucucagauguuagaggcaaagcaugcaaaaguacacccccuaggagggcaauuugguaggaucuacaacucugaccuggcuuuuccucuacuugaaacuuaggcuucagaaauacuuguacaaauacauauguaaaaaaguauucaccacaaugcuguuuaaaccagggguuggcaaacuuuuccauagauguaaauauuuucagcguuucaagccauauucugucacaacuacucagcucuguuggugcaaagugaaagcagccauaggugauacauaaauaacagggcauggcucugugccaauaaaaucugauuaacaaauacaacaagccccuggcuuucacuaaugaaaacucuuaauccaaaugugcaucaacagacaaucaguugaauaaaucaugguauuugguagaauaagacguagcuauuaccagaaaugaguuauaucuguaguuauaucuguaugaguaagaucuguauguauugacuuggaaagacagccaacggaugacuuuaagaaaaaaaagcaaaguuuuauauaucuauaucucucuacauauauauagagaaagauaauauacauuguauagagagauguaguauguaaaucucuaucuaugaaugauaauauauaggcuaucuaucuaucuauguauauaucuauguaucuaucuauguaucuaucuaugugucuaucuaucuaucuaucuaucuaucuaucuaucuaucuaucuaucuaucuaccuaaugaaugauauauauaggccggggugguggccuguaauacuagcacuuugcaaggcugaggcagguagauuacuugagcugaggaguucuagaccagccuggccaacauggcgaaacccugucucuaccaaaaaaauacaaaaauacaaaaauugccaggcaugguggcgugugccugugguuuacacacacacacacacacacacacacacacacacacacacacacagagaaagagagagcaaugacccaauuucuguuuuguuuucccauuucagcuuaaaaaacaucuacauauauuugaaagaauauauaccaacuccuuaucgguaaaaacuguuuuggggcaggggcugaaaacuucauuuuccgcaugauacuuuucuuuaauguuuggauuucuauaccaaaaacagcuauuauuuuuaauucagaaaaguauaaaauuuuuaaaugaaacaaaaagcaaccaggaaacuuucuaaaaucuuguaaaaagaaaaacaacuguuuugguucuacaugguacaagccaucauuuuauaccugcagacauauuuuccucauuugcaaccacaguauucacauguuucugcauucuauuucuuguaacuuacuauucuaacagauucuuucaugauucaacaggugauacaccauaauuuauaagccacuguuauguuuuaaauuauuuccauuguggaggauuacagauuguuuugcaaaacaccaccuuuguguauauucauguguauauaugauuguaggaaauaguuuuccuaggagagagauuagugaaucaauacagaaaacuuuuugguuucuuacuauuucuacauugcuuuccuaaggguaguuauugguugacaauguaaccagcaggauacacauauagugcaacauauaaacagaaguccuuauaaaaaaacagcuaccaaauguuacacauguaccacaugccaagcucaucuacucucuaccaugcgauuuacaugccuuguugccauauucaauguaauucuuacacaacaacccugucagagagauauuauuauuauccucauugauacaacaguaaacaaguguagaggaacugaaagaguuaauucacgugaugugcuuaaaacaguaccugucauaugaagaggccagacuaaauugcuauuauuauuauugguaaaaauaaugcuauggcuuugucaggcauuuuggguguuacagagucaguuuuaccaaacggucuuuuagauuacaguauuuagcacacuuuuagggauauuacaagaaacagccauauaucuaauagaggguagaguaauuugugcacagucacaaaacaauuaagugguggagccaggauuugaacccacuucucuguagagaagucauuugcuguaucuuuacucuaguuugccuccuuggccacaacucucuauuagauacauggcuguuucuuguaacacuucuuaaaguguccuaaauaucauaaucuaaaagaccacucaguaaaacuaauucuguaacacccaaaaugccugauggcauuuuuuuuuuuuuuuuuuuuggacggagucucgcucugucgcccaggcuggagugcaguggugcgaucuuggcucacugcaagcucugccuccuggguucacgccauucuauuuuuuaccaauaaauagagcuauuuaguccauccucaucauaugacagguacuguuucaagcacuucacaugaauuaacuguuucaguuccucuacacuuguuugcuguuguaucaaugaggauaauaauaauaucucucugacaggguuguuguguaagaauuacauugaauauggcaacaaggcauguaaaucgcaugguagagaguagaugagcuuggcaugugguacacguguaacauuugguagcuguuuuuuauaaggaccucuguuuauauguugcacuauauguguauccugcucuuucaguucccaaaacauacaaaugagauaguuauuaguauuauccuaaccaauuaacagguuaggaaacugaggcacagagcuauugccaucugcccaagguuaugcaucuaguugguggaggagccagguuagaaugaaucaguucagcuccagaguccacaaugcaccccuaaucacuauuccauacugucuccaaucacuauuccauacuguccuccaagcgaaauucucuccucuguuagaauccagaggccuucgaaaggcacauuuaaaaaaacaauuguacuaacauaacauaaaauaagugagaaucacuaauucuuauuacuugaguuuuagagaugccuuucgauuuuaucacuucuaguaacacgcuauaauucaacuggccaagcucagugacaagccaggaugacgguggcagagcccgcccggagcagcgcaccuugggggucaugccguuggugaugcagaaggccaggugcugcaggaugcucuccaugcugugguaguucugcugccgggugaugcgcagguacuucuggagagcccuggccauggaggggaaaauggccugggcggccucccuaggguccaucaccuccccuggggcuuucugcugcuccucagccuggagacgcugaauguggaugaaggccucuuccacugcaaccaccagccuagaaggugaugcaacacuaaguaaucaggauggugccugccacagggugugagaacagaaugacgcuugucuacccugcugcggcccaaccugccaacauacccaaggcccaaucacgcugcuugcauccuuagcugucccucagagaguggagagggaggaagggagaaagaaaggcaacagcaaaaauaacauguggaacaggggccccagggguugggggaaaggagccccaggacugggagaugaacucuguucugaauucugccaccaaugagcuugggaaaugcacuaguccuuuuuucaucucugcaaugguuagaugaaaagaguucugaggccccuccgacuggcuauaaaaggcucuguacagagagagguggcugguggugcagaagcagcccuacaaagaagcagagcugcgugcucccugguccagccacccacaccagcagccccugggaaacaggaagaggcacagcacacaugauggaaugcaccucuguccccuucagugaauaugaccugacggugaacaccagcaaggguccaggggugcagaacagacccacucaaguaugggcugggggccaggagcaucagcaucacgcaggaaucuguuagaaaugccauuucuugggcccaacuccacaccuauuggguagggucucugcaagcagggcccagaaccugcugccuguauuugaacagcccucccagugauauucauacaggcuucaguuugagaaacacuggagcaaggugcacuccaaaggugucccagcaggucauguuuuuaaacagaaaccucauucuagugguaagaaaggaaagauugaaagucuacaagaggccgggcaugguggcucaugccuguaaucacaguacuuugggaggcugagacaggcacaucacucgaggucaggaguuugagaccagucuggccaacauagcgaaaccccaucucuacuaaaaauaccaaauauuagccgggcgugguggugggcgccugugaucgcagcuauuugggaggcugaggcaugagaaucacuggaaccugggaggcagaggugacagugagccaagaucuugccacugcacuccagccugggcaacagagugagauucugucucuaaauaaauaaauaaauaaauaaauaaaauaaaaauuuaaaagucuguaagaggguacuggcaucaggagggcaguauaccuugcuuuccgcuucuuuacucgccguucauguucggccucuucauaauacaacucguuguggcuugagucccugcgccgagcagcugcagcaaucauggcccgggacuggccaguggcauuguuacuggggccuuuggggaaaggacagugaaagaauaguguuaauaccacgagggugggaaacagagcagaaaacuaguacccaaucugucaguguugucuacccacccccuauggaacacacacacacaaauccuaaaggucacuucccaggagggugaacugugccccggcuccacauucacuauguccaaagcaagggagcagaggaaucucccuaaaccccaaucuggucaguggaaauggaaaaagaacucagaagggcaugaagaacgguggcaauuaaaauguuggccaaaaacaacacauagagugugcugaagauguuaccaucuguuacauaaaguuucaguuuggccauaagggcggcugggacaucaaauuucagcaagacaaugagacagaaugagagggauggggagaccaaggacagacagacagacagacaaaaaagaaagucaaaggacaugagacacugagucuacaauggaaagcaagcuaugcuagaaugucauggcagccacaacuuuucuaggaaauaccaaugcuugagggugugcaacgugacccguuaaugaauacagacucagaaguccuguccuguccccugaccacugaccaccuuaacuuuucagaaacauaggcagauuucaggcuuucuuacggaugaucuacuuggcuggugacuugguuucacuagugggaaucuuuccuaaguuuuuagaucacaggugaaauuuaucaauccuucaggcuucgugagggagcucacaccucauauagccaaaaaaaaaugaacaaacaaauaacugaaaggauauugccaacaaaaacugacacuguauauaaaucacuugacuuguugaaaauauaauccucuccuaggguuugcaaaguucuugcccucacccaacauacccaggaagaaaugacaccgcauccuguuucuugcacuuaaccaugugauacccugaaacauagcuuggacuuacccagccuggccuccagccuccugccacccacucaacuccggcuccuagccacgaguaagaagugcccgcagguaucucaccagaugccuggacuacugagauuucuagucuuaaugauuuagguagcuuucugaguuuguggguaaugugcaccaauuuugaaaagcaacccuuuccuaacagcuuccaauauaagaugauccuggcagaaggcaggaaacacacaccgcugcuguuuucaaucauaaaaucccaaaaugaacaggcuuccaacacagguagaugguaaaucaacauuccucuaaacaugugucugccuacauaaaaaagagaaauuguucugaaacaagaauguaccauaaagguaggcccagagaagaagucgaaccaaacguaccaugaaucuuaaauagucacccaacugugccccugugagcaccacggacacccuuucaaggcacauaccaucuacauuguagacuuucagcccggccauaugcuuggcugcucggaauuuggaggcuguuaggagguuuggguuauagauggugaaaucuuuguaguaauuuucuaggaccaccaaugcugcucgcuggauacugagaaaaaaagaacaaaauuaaugcaaagcuuuuucacugaagaagcagguccuaaacgaaaaauccucuuuuggagucagguaaaggaacacaacaucaaagauaaucucauacagaaguccacuggguuccaccacacuucuggucuccaggaugagaacuuaaagcugaaacuaagccccauggccaggugacuucugugcccucuccuggaccugugauuagccacaucccaucuagcccuuuguugaaagaggaagaaguuguaacucauaacuuacauuuagcuuuaggcacacaagaacuuuuucuauuuuuccucgguuuacaaaagaagaaacugaggaugcccccaaaagggcaagagacuuacuaaugguugcagagcuaaugagugaaagaacaaaguauagauucagguuucucagguccucauucaggguuuuguccccuaggccuugguaucccuggguauaaggaauccuggaacuuagguuuuauacagaccagaacaacugcagccauccagggcagagcguacuuaagagggccuuggccacgcgcgguggcucacgccuguaaucccagcacuuugggaggcugaggugggcagaucaccugaggucaggaguuugagaccagccuaaccaauaugaugaaaccccgucucuacuaaaaauacaaaaauuaccgggguguaguggcaugcaccuguaaucccagcuacucgggaggcugaaacgggagaaucacuugaacccaggaggcggagguugcagugagccgagacugcaccacugcacuccagccugggcaacaagagugaaauucagucucaaaaaaaaaaacaaaaaaaacaacaaaaaaaagagagccuccgcugagaccacuugaucuuucugggucccccugccccuuggagugcuaucucuggccuuuggcagagggguaugaaggugacuaucuauguuccgauauucuaggucuccaacuauccccugcuugguccucagagagcagcaggggaacaaagaacagguaccaucaacaagugggagagaggaugugggaggguacuuauaauuggaaaugaguauagacagcaaaagaauaugcccuuggucuauggugcagaacacuugccacuuugaagaacaccuugcaaugauacagcaaggguuugcacauaccugauucucauuuaacccucacaaucauucgagguaagaaaacugaggcucaaaaaucuaugaccugcacaacaguaugcauuuaauaaacaggagagcuggaacucugauaugauuuacaaaccuccaaguugggcuucccgguaacaugcggacucuguguaacagcguacgugcugacaucuccaaccaccaccauguuaaauaccacagauauauuuuuaucuugcccuuuggauuuuccuuucuaguacucugcuaagcagaucggcuuacaaggauuauuugcaguagccagagcaccaggauggggcucccuuugauuccuggaugaccacacuguguuccaacacucuccagguggcucagggauccucacuucacaccaagacaagggagcuccuaaacuauccacuggaaauucugucuacccacccauuuggcuccccuuggagcucugcuucaagacuugaacagaauugaauauggaagucagucagcuaaccugcuuaagagcagaaucaugguaaaacuuucugaguuauauccccaacagugcccgcauucaguugguacuuaauaucguccuagauaauguacagucaugugaggcuggggaacacuaucaggggaaauccggugagaccaacuuugcauaauggaaguaaaccuaagacuccuaacagcaaaucugcauuuugaaaauucugaccauucaguuacucaguuguucacucgucauuccauauuugagugccugugucugcuaagcccugggaauaugaagauagaccuuagcugguaccuggagcaugaaccccaugacagugaguauguucucaugcuggaacacguggggcugaguaaccacggagaagagcuucuggcugccugggacagggugcagccuuccugaggaggcggacuuccguggagguuugugugucacgagagcucuuccugcagaagucuagucugcuugcccugaaggucucaccuggcaaucuccaagucaauguggcuccaacuccguccuugcccccuguccauggcauucuccagagaggggcaaguguuucuuuauuccuaccccauccagagauucauugcaacccucucccugaucucucucucucucucucucacauacacacacacacacacacacacacacacacacacacacucccuggugugugccuagcucagcucccaccccugugcaugccuuuucuggagugccugggcuuucugaggcucccuccacauggcuguaagacucaguuuauacacacagacccacugggguucaaacucacuucauccccccuccuccacugauaaagaaacaucucuaggccccuggauuccaacagaaaagcauuacccugaucuaaauuuaaaaauuaaaaagcaaucaucagaaguucucagaaccauuuucaacucaaaacuaucuugugguugcuggguuuugcuuuucuguucagcgaggcugcaaggaggggucaagggaaucccauuaauucagcuggggccugugaggggaugggugggucggagccuccuggcugugucucucacccuccacccugugagugugaugcacugcccagagcaguggcuucugucuccagcagggcucccggcccaccgccuuccagcacggggccucagcagaugcucuccaaaugggccagcucuccaaauaagccaaguccacagcccaccugacagccccucagagcaaaguccuggcgucccaggaagugcccagggugggggcggguacugugggaugccagcccugggugucacaggcauggcucucacaguccucccaaagagugagagucuuugcucaaaaauaccaaacaaggggaaagugcaggcguccugcacucccucuggcucugcccucucagagaagcaacaggaugacucagagccugccgugggcuuggccagccccacaggcugagaagccaaugcuggagcugaagagaucucagggugaaguugauaaacgccuccaagagugugcaugcucucaccuacagaggauggucuguuugaugcccagcauaccuggcaguauuagggaaugagaauuuccaaguaacuaaauaaacacaaaacucaagugcacaacuuaaauaaaaugguugugacauuuugggauaaaauccaauaugccuuucuucuuuuuuuuuuuuuuugagacagucucccgcugucacccaggcuggagugcaguggcgcaaucucggcucacugcaaccuccaccuccagguucaagggauucuccugccucaggcucccaaauagcugggacuacagcacgugccaccacgcccagcuaaauuuuguauuuuuaguaaggacggggucucaccauguugcccaggcuggucuugaacuccugagcucaagugauccgccuaccuuggccucccaaaguucuggaacuacaggugugagccacugugccuggccuuucuucaucguuuugaagagaguaagcuaugugauauaugauuuaagucuucuugauuacuccagaugaugauuacgcaucuuaacagugagcugugccacguacauaaggcagugaagacacuggguuccaucaggagguggaggccaucuauccccacucugucccaagcugcagcaagugugaauaggugaggcuguuuuguuuacauuuuuuccacauucucccucacuacugcuaucagucauuccuaauuacuaugccauggccucagucauagccccgggaggccaggaugcagggagcagccauucccuccgccacuguccgugcccagcauuccucuugccuugauuccucuccacccuccaaauauggaaggaaccacaaagccaacacaggacuggcuucuuucaggaaggcuuuucgaauccuccaguccccacugaucugucccuaaacuugcagcaucaacagugaugacacaugacuugugauaucuucgagggagucaaggaagcuggucuugccccuucaacaagcuugcccaugcaaaucccugacacacaggggacacguccuuugguuccuccauggguauauaauacuugcaggcuuaacuucucuguucaugcaaucuuagaauucccacaggccuaagaucagucuugaauauguauuucauaaaaucauggaauuucagaggcaaaaagggccccagagaugaacaaaagcaaauccuucuacaaaccccaaucucuagaccagacaaucuuggggaaaugugggaggcaagaaaaaucaaguugguuagaaacuugcccccucuguuaucaccauuaaauucagagagaaaaggcaguagccugacugaacaggaccccuguauuaccaucagggggagccugaaguauagacuguggacucagcccccucagaaaccuaugacaaggagcauuuucccaagauagaggacucugugcucaacuggugccacaugccaacauaccugccuagucacaacccagggaaagaaauacucucucccagaccacauagauuuguggaaaacagcacaugaagguacgccuaguugugacagaaauucgcuugagaccuaugcauaaaaaccuccucaauaggcuucagucuaggcugguccaaacuugaacuccugggaaggacgggccagcaaugggucuacacaaaggucuaagggaaucugauggcuacauuuuaauuuaaaacccacugcugaccacauugccuacuggccuauuuucuuugcaggacaaagaggguggaaugagaaaugcuguggucuuuugugucuaaucaaccacgaaagcacuuccaguguuguugacaacuguuacaugacugccauggcaacagagaagaggggcuugcccuugggcuacauuucuuaaacagaccuggaaagaagcaccucaaaacguaguucaaauguuaaugcacaaaaaucugaaagacauauuuuuuaaagauaaauucugaagaaaaaaauacaaaccaaauuaaugcccugcauaucuagaccauccacugccuccccaugcucugugcaugucugagucugcacagaggcugugggaggaggcacgcacagugcaacuggugcagacucuggccccagacaacaugacuccaggcucucucacucauucauucaccuugaacaaauuagucacuucuccaaaccucauacucuucaucugcaggaugggaagagcagcacagaaaacccugauuaccaugauaagugggcuccaaaauacucaguggcauaaaacgucuuacugaaaggcuaaugaauugacuggggcaggccugguacaggcagcuacucggaaccuccagcagcagccugcgagauccaaguauaccaggugcuggcugaggucggcaucgcccuaaggcagguuaagucucaugagcuuaaauauccauugggaugauuccaaguucuaugacauuaugagacuucaaagcuaguuggcauuuauaccaggaaaaauacuggagacuugggaguucacccaccacuuuccugcuuccuaaagaggaguagccugccugguuuaggucugugcugaagaugaaauaacacauuuuaaagugguuauucaaaguaaauaauucauaaacgauagccaccacgagcuuauauggccauauauguugaagcggccaacuugaucccaggugcgccuguaccaaccuccuccagaggcccaccaugaggguacugccaugggaaaugagccaagauggguccacucugcacaguuuuccuuagggacuggggccacaaaguuaugcuacucuuuguuuuuaugcaguacuuccugccaacucucagccuccugaaaaucaaaccuaccuauagggaggcauccauuguaggaguacuagauuccagaaggucuagauuccugcuaccuacccuguaauccuguauaagucauuucccccuucuuggccuuuuucuuggcuuuugauaaagagauaacaccaaccacugcaugugguuguugagaagagcaaaugaaauaaugacagugaaggcauuuauaaacuauaaugcauuguacaaacacaaaaaauuaucgcauuacuaauaauaagcaugaacauuuugcagcggugaugggguugguugguggcuagaauauacacacagcuccuagccacaaaagcaugaccccauuucuauuuauacugaaccucaaaauuuuagaaauggaaggaaucuuaguguucacccaagcagagauucaagaaucagagaaaucaagaguccaucaguccaaucucccaauccauauaccaauuguuuuuuuuaauuauuuuauuuauuuagggauggagucucgcucugucgcccaagcuggagugcaguggcguaucucagcucacugcaaccucugucucccagguccgagcaauucuccugccucaaaucccaaguagcugggauuacaggcgcacgccaccaugccuggcugauuuuuaguggagaugggguuucgccauguuggccaggcuggucuugcacuccugaccucagaugauccaccugccuuggccucccaaagugcugggauuacaggugugagucaccaaaccuggccaauuuuuauuuuuauuuuugagacagucuccuuugucguccaggauggagugcagcggugcaaucucagcuaacugcaaccucugcuucccagguucaagcaauucucgugccucggccuaccggaguagcugggacuacaggcacaugccaccacgccuggcucauuuuuuguauuuuaguagagacgggguuucaccauguugcucaggcuggcucaaacuucuggccuuaagggauccauccauuucagccuaccaaagugcuaggauuacaggugugagccauugcgccuggcagccauauaacaauucuuuuuacaagcucccaaaugacauccagccuuugcuugaaaagaaaguucacuuucacacugaaacgaccuuucaguucuaccacugguucacccaaugccuuguucugaacccaagucccccuugcuggugaaagccuuuuagauacuugaaggaaacaaucgugaccauaaaccacccccauuuuaacucccuuauuuuauagcuaaaggaaccaaagccuaaaaaaaugugugcauacaugcacacacacacacagacguacacauggucccuucuacuucccauucauucacccucccuugaacuugauuguggcuucugcaaucaaacuuguauucuuacauguuauuaaaauccgaaauuaacauugagcuuuagagcucauccaggcugaugcccucacacuuuauggccugcaacuucucccugagcagggagaagggaugaagacaucccccauggacaaguccuuuucaaguuuuagccacaucuuuucaaauaugaauuugaucccuucagcuaggucaauaaaaacagcuuucuucacacguggaaaaugucaaaguacuucuuguaugcuaauuccccaaauacaugucacgucauucuucuuauuaccuagguacaugcugacagaaaaaguacuaaaaaguuuucucaucauagaguaaaaucugcaaagaucuccuuuuagagcaugcagucacuauccugaaagccagcuaaggaugcuacauucagaaaaaucuuaauaacuagccucuccaacuccaucaaaagcaguuacgaauuaugagcaccugcuaagucccuaguacugagacccggauguaaaugaaaccuucaaggggcuuaugcuccaauuaguggugaguaccacucaaacaauaaguacagucaagugauccagagaccgugacagaacauguacaccaggagaagagggacgguguuuccgccaggaauccacagugggggcaaagcugggcuguuaagucuuacaagaugaaugauggucacaccagggacaacaggcuguaaagcaaauuccaggcagagaaagcagugugagcagaaacaggcugguguuaauccucccaaacauccacaauagagcaacagggucaguguucagucacaggacagcacaacuuggagaaacccguaguggcaaauagugucucccaaaauuugcaucuacccagaacuucagaaugugaccuuauuuggacacagggucuuugcagauguuauguuuaguuaagguagagucauucugguauccguauaagaaaagagguggccaggccucuuuggcucaugccuguaaucccagcacuuugggaggccgacacaggcagaucauuugaggucaggaguucaagaccagccugaccaacaaagugaaaccccaucucuacuaaaaauacaaaaagcagcugggugugguggcaugcaucuguaaucccagcuacuagggaggcugaggcaggagaauugcuugaaccugggagacagagguugcagagagcugagaucgcacuaaggcacuccagccugggcgaaagaguaagacucugucucaaaaaaaaaaaaaaaaaaaaaaagaggacauacagagacccacagagaggaggucauguaaugaugggggcagaaacuggagugacacagccauaaaggaacacgaaggguugccagcagccaccagaaacuaggaagaggcaaggaaggauucuucccuagaggcuuugcggggagcacagcugugccaacaccuagauuuuguacuuucugagaaggagaacuuuuaagccauccaguuugugcuauacucuauuacuucagccuuaggaaacuaaggggaagcuacuuaggaaacuacucgaacuuagggaaggaaggguggaggcagguaagcggcaaagcuggucaaugguaauggaggcugcagaugaaugcaaacgugagagaacgggaggaaggagggucaguggacagggacaaccaaaggaggccaguacugacggcugcccaggcacuaaggccacucauuaccuacuuuuuaaggugugccugcucugguggcugcauuuuagggcccaaaccuaggucuuugagagaacucuaaaaugcagaauccccaauacaaguugauucagcuuucugugaaaaccugcagcuagggugcaauagcugaugcuuucaguuuuacccaccugcugcuucccagaagaguccguaagagcuaaaucuaccuggacgugugggcuucacugcuccccacacuuggagauaaaugacuucagucugacagucagguacauuuguggcaauauuugugugagucccagagaagagaauauaauuagccccuggacgcugaacgccaccgccuucacugacaaccaggcacaugaguguuuauaucuccuggcccuucugccuuuuaauuaaaauguuugucucacagcugcauuugggaaguuagcuuacacaagucccauagauaacaggcaaugaucaccuuggaacuugagaaggacaaagagggacaaaaacuggaauuagcucauguuuacugacaggucugguuuaaacugcacaacaaaggccuggacuugguuggacuuucaagauagagggggagauccacagguuucugcuugaggucuugagacacaggagacugaccaucccgcaaagggaaacagaucagaggcucuguguggcugcugaggcccaugggaaggcucuuccucgggccaccuggauucacucgugccucgggccugcuggugccucagcuacacaaaagcuucggcagccaaauucuuugaaccaauaucggaaggcuggaaagcguaccuggcuuuugguuugaaauucaagcuguggacaagcccugcaggguauccccacugaaagaugaacaugcagauuggcagccuaggauaucuaaucccagagcgccaaggaaguggaaucagcaggacuugggaaucacagaaugaucuccaaagugcagugugcaggacacccagagcacuucuccaugagucccuaauaauacaaauaaaacuauacccagagcaugcccggaggacaccauucucuaucaacacugggaggaguuugugagaaccagaaguagcuaauagcucaugcaauuaccuggaucuucuggucucagcaacuaagcaauacaagguugucaacauaugcaccccuccugggcuuaacaccacgacccaguggcaguucugagugcagagacacacugcuggucuccuccugaggagcugagccaguuauggaugaagcccucuggcugccuuccccacagcacagcgaugcuggcagaccuccccuacuggggcaccuaggagacacgcuucccuacaagugaggggcuuggcucugccacagucugccuggggagcaugcagcccugcuuguaggccgcggcacaaaccucgccaugcugccauuuccuuacacaguccaaccugcacugcgccuccccugccugggaugggaacuuugcucucuccacgucuuaaauuacagugaugaaucacaccaagauaaacagcagaggcauggggaucaaagacagcagccugcuuagggugcucuaagaaaaagauuuagauauggacucgaaacaccuccacuccacccaggaugcuggacugccucgccuuccuccugaguaagcaggaaggagcgcaccaugaaaagucuggagucugaggcucccggccugcccaaguggaucccggcuccccgaaaccugggcuggagcagaguugaguggcggcuuugcagccagggaaaggaggccgcaggcuguucacccaccugagugcucgcgccccuccacuuucacaccgugucaagucacacccagccacuuguggugaguguggagaauacgggaccuggccugcagcaagaauccuccagggaaaccaacagcacagcauucagggagugugacccaucucccaggggccaggggcccucaggagaccaugaaaaccagcuucaccuuugccagcuccuuuuccugugaguccucugggcuccgggcgcaaggcugugggcagacgccgugcgagggaagccaucccagcuguagccgcuggcaggaggcagcugaauaaacacagggcuucagugugcagcaccuuacacucucauuaaagccacuuuuaacaggcaccacagcaccaaaccacaaacggcagcuccacucccgccuucaaaauucucccacagcaaagcauggccugagcaaaacccuccacgcucuauguuucagcccuuacuuguucuuguccuuugcuuugcuauggaguggagcuaaggacuggcaaaauaucuuuauuaaaaaguaauuacaggaguacaaaaacacacauuucuaaaaaugagaugguauaugaacccacaaucguaggaacaugagccaaaaccacugauggucauuuaagaauuuucccaacguugcagccacuggcucugggcucucagagaccguuggugcucaucgugaacaugggauggagggcguggcccagcaugagagacaugccuaccaguaauguaaucacuggcuuggacauuacuugacccagaauuacaaacauaagauuucaaaaggagcuggaaauauccuggaauuacuggaguaacuuuaacaucccuagaagacucucccuuugucacuuaaaacuagaaaaucaaagugcaauccagagaagcaaggcccccuugcaagcugggaggaugcaugcaugagcuggagagaggacaagaugagcucuauucaacaggucaaaagucuuuggggucacaagucuccaguguauguaauauuccugucucagcucaggcugcuguaucaaaaugcuacagccuagguagcuuaaacaacagaaauuuauuuucuuacaguucuggagguuggggguccaagaucaacguucuagccaaccugguuccuauugagggcucucuucugggcuuacagauggccaccuucuuucuggggccucacacagccuuuucuaagggugugugcagagacagagcaagcucucugguaucuguucuuguaaggaugccaguccuaugggaucagggccccacacuaugacuacauuuaaccucaauuacuuccuuaggggcuccaucuccaaauaugccacacuggagguuagggcuuccacauaugaauuuggggggaccacaaacauucaguccauaacacuuccuugaauauaaucacaauugacaaugugacaaucauaaacuuccauugcuugaaaagcaauccaaggaucauuucuucuaaagcacaggugguucugugauucguuaccacaucuuugauuaaaagaucuguauuaguccauuuuuaugcugcugauaaagacauacccaagacuggguaauuuauauagaaaaagagguuuaauggacucacaguuccauguggcuggggaggccucacaaucauggcagaaggcaaaaggcacaucuuacauggcacaucuuacagacaacgaagaaaaugagagccaccuuuuauaagguuuccucuuauaaaacgaucagaucuugugagacuuacucacuaccacaggaacaguaugggggaaaucgcccccgugauucaaugaacucccacugggucccucccacaacaugugggaauuaugggagcuauaauucaagaugagauuuggguggggacacaaaaucaaggucuauggucagugucaauuuauaagcuacucucucucagucucaaugaaugaagcauuuuuuaccccaaaacuuugacccugaagcuuaaaaacccaaacaguuaaaaccugcuggcugaauuagguacaagggagcuucagcaauauaaauauccuauagaaugggucacuguggaaagcuucccagagugcugagucauaccugcuuuugugguuucucugucucccuccuuguugaugacuaucagcuaucauuuuucauugauguucauauaccuccuuaaagcagcacuuuuuccccucaaaauauauuacuucugggcuuuuuaagauguagaaaucaauaauuaaauuuguuagaacuauaugcaaaaugagaauaaacagacucugagaaagacagcccgaggugguugugggggucugugacauugaacuuaacauccuaguagccucugucuugugucguccucucuccuuaaaugugggauagggcuguggcuugcuuucaccaagagaaugcaguggaaauacuacugggacaguuccaggcccagaccuuaaaaggccugggagcuucugcuuuugugcuccugggagcccugagcugccauuuaagaagucuagcaacccuaaugaggaaacaacaaggagaggccaugagaaggagagaauauacaggaaaagaaggaggagagaauacacaggaaaaaaaagucagccucagcugacucaccaugugaguauaaucacacaggaccaugggcaggaucagcuaaagaaccuccuggcugagcccaauccaugcugcagaauugugagaaauacugaauugguuguuuuaaacuacuaaguggugagguaguuguuacacaacaauagauaaaauauauuuucuuugagacaugugaaguauaggaaguuaaaaaggucugaccaaaggcucaaaccuacugcuaugacuuuaaggaccaggcuuugucaacugagugaauaaaauaaccaguggagcuaaggaauggaccucagagugcaagccaucuugacaauccugcacauucucucuguuccagcccuaagcucuguguuaagugaaacaggauaauguauacaaaaauaucuggcaccgaggcuggcacaugggaaacacucaaaaaaugcuucuggguuuguucauguguuccuaaagcagugacgugaacaugcaacuaucuauucagagguaguauggugaaauggguaagaucauucuggaaccagagagccugggcucaaauccugguucccacaauuacaaaguguggggccuuagacuuaccuaacucucccacgccucgguuugcucaucugaaaaggaggcuaccagaaccuaccucacaugauuguugugaaaacugaguugcacauuaaaagaucagaagguaccuggcucccaguaagacuauguaauuguuuauuguuaagguuuucuuuaucugucucuguuguucuaccauuucacauucaaccagucaauuacacuagugccugugcaccaguauucacacuuauuucccuuuagagguuucaaaacugaaaaaugauuaagauaauugaaugccaauuuuuaggcucuucuauucuucuggguuucuccucaaauaaagucauaucaacagucauuagucucugguaacauccuggaaaaguuagcaacuuauugugagaacggggccaagaaaagugacgagcaagguguguauggaaaaugacaaagcgacugugugagacaccaggacgcuguagaaagugcggugggguaagcggugugaugcacaggaaggugcugauucccugugaccuugagcaggucccuuacccuggggguuggggaccucaacuguaagaggggacaccucuaccccaccugcucugaccucugacagggcagcaaggagggguaaaugaguccaaaccuaugaaaagcuuuucauaacuccuagggcacugggcagagguuaggaaguaucucaaucuauuuaugguaucuuacuuucugcaacaacuuuuuacauuuuugaaaguuuucaaauaagcccaaaacuucauuccugccaacaagcagggccacagcaagcaccuuuuaugaacuaaugagaagccuauuuucuuuaagaaacuaaagaguagacauucuuuagacaacucucaaaaauagcucagucaauucgauaaaaucaucuuugaaaacauaaaaaagaacucaccaucgcuuggcaccuaagcccaauagggugcugccacggugaaggcuuuacauaaagggagagccaacagccugugauucugcugggucuaauggagaccugcuauucugauuuccgaggcuugcuuugucuauucccgcucccucuucccuccugucuguuucuacacuuuacaaaaggccuuagaaguuguauuucuggccuaguaacucuuccagccacugcuggguucagaccagauuuagcccaaggaucggcaggugaccaggcccacacaaugccaggaggaaaggugccaagccugcuccagcucuggcagacuggcugacacuugggcaucuggcucucccugagggcuccauuugucaguaaagaugucccucuuuccccagccauucuuuccaccuccuaacucaggcucuccacgagagggacaaagggggccuuauuaaaggcagggagaggaggaacaccaaugguccuaaaaagaagccgaaaggaugaggcuggggaccaccucaaaacgcucuccccagggcagaugggcacuugccaccuuucaguucucccuggggagcuggggugacugacuugaguuuuuuaaagccuggacaguuguuggucaugguaagagcagacugaaagguuugcagcaagccugggagccaugcagcacaaucagucuggcuucucccauccagcucugcccugaccagcagagcuguguggugggaggcgagggcugcugcuaaucaugcuuucugaacacgccacaggcauacuuuccucgggcuguuugguuuguccccucuccacucccacucagaugcagugugcagcucaaccagucguacagggaggagcgaugugggagcccauggggguaagucggucccaccacccugcaugaccuauggugagaagaugcccugcccuuucccaccuacacagguggaauucacaccaacuagggcuaagggccaaaaaacaaaaccaccauagaccucacuccuggccagugucuuggcuacuuacauauacagaguuccaaauaucacucaucuccacugagaccacagccggauuuuucucuaccacuuuaacugcagcaaaaccuguucugagacagacugucuccugcucggcuuuauugcugccacaaucugaaauucucuguccuccuguguuccuaucaccuauacccccaggccuguuucugcaccuguccaccagacagcggugcacuggucucuuuccaagugacugugagugccacaggugcugagauagagcucugaaggcagccagccugguguguccagggcucugcacacagcagauguuuaacacaaaacugcuggucauucccugaugcaaaacaugggaaaagaaagccuucugagaugaauaugcagcaaagcggugaccuacuugucuucagagcccuacaggcaucugugaaggacucuaaaccccagauuuuuggugcacagacaugugacuuggacaccaguuuccaccaaggaucaguuaggguggcagcaaccuugaacgcuagaucaucccguucucguagcacaagccaagccagaggaauggaggaggguacacaccaacaugaagaugguuuggcagcauggccugacuccaaauacaggcugagccaccuuccuggagcccagccaaaucuaugacaaagccgauuguucugauacccacuaaggugugcccuugcugauucuggcugcucugccagcuacaugaucacagcaguaauagcugcaaugaacuaagugccuacccugccccaagcaggcuacacacaucagcauauacugccuaaggaggcagagagccugggagaggguaaaggcuuugaagucaaaugucccaggcucugcauucacccagagaacaucucagugcaagccaugcuccaugccaggcacugaggauguaaugagguauaaggguggccccuggccucagggaguucauagucuguggaagaaaacagauggaaaaauaggccacuaaccacaaagugagagaugccauuaugggggcauucacucagcccuggccucaugacaucugagugaauccuaaaugaggcuagccauauguuuuugugcaaauuacuuaaauccccuaagcccuaguuucuucaucugugacacagggauuaauaauaccuaggucacgggguucuaugaagacuaaauacacaaucuauauauaaagugcuuaccuugaagcaaauaaaaugaugguaaucacucuuauuuaaccacaaaauaaugagauuuuaugcagagauguaaguaugacaacccaacugacuucuaacuuuuucucacgcauacauuuucacaacacucaaggauuacacauuuggagucucuaaccugcacuugauucuuuauuggagggucccucggaugaccauauaauuuacugcccaaaccaggccucugagagugggaaaaaaggaacaauucauuauuccacugggacaacaugguaaaccagaugucacauuugggacaaaauggagcugcuggucacuuuaucuguuguccauuggccaauuucagagucaaagaaggcagccaucacuaugcaucuccuuucuccaucauuuuugggagcugccaauaacuuugagaacaagcccagcaaaaucucaaccugggugagagccagcaacugccccgcaccaucuagaaguccagaaacucaaugaacauggacacccuccccacccucgcaucuccuccccaaaccagaaaagagucagacucugguccuagcucuuggcaucugucaccaccccucacgugcuacagagcagcugucucccagcaagacaucagccauccuuucugccuccuggauguugccucuuaccucaggugucccaggcuguagaagcgggacucgccaucgguggagcggaccaccugcagcgugaacaugggcugcagcugccugagcuccagcaggacgauggccagguaauggaugaagaggagggcauccacaagggagacugcauauugcacaaugcccugguaauuccggucccgagaguccaaaaugcggaccccguaaaaaagccaauaggaaaccacaaagagaaagaugaggaccaacaaaagggcacgaaacacaaacacccguggcaugucagcucuccgcuugcggaaaaaaagugcccaggucccuaugagcagaaugaggaguuugaaugccauggagauaaagagccccucacaaauugugccacaaggcuccagcucaucccuccacaggaucggagguaaaaggaugaaggcaauaggggugaggaaaacuagaaguccaagaaaagaggcgacggugaggcccagguagcguuugcaauccagccccacgcuguccuccauguccuugcugauccuggcaauguccucuugggauaugcugugcuccgaggugccugugauggccgugguggucucuccccaguugucauccugguggggagaagacagugaggaugacaugacacaggucauuuguaaaagcuacaaagggcagugaacaugcagggcccgcugcaucuacccagcccuauucacaaaggcuuccagaaaaugaaagcuuaacucuuuaaauauuagaacuucuuaacucaaacgauuuucauugaaauuuucaaaauguaugagguauuuaccuuuucaaacagagaaaacauaaugugaucuuucugucuguuuggcugauucauugacauaacauugauuaucauccccuggguugaaaagccuugagcagcucugagggccuggagcuguuugcccugcaaugcgcaacccagguauuagacuaaucuugugagagcucaucuauagagauaaaccuccugcaucuucuuuccaauucacgcuggguuauaaaggcuuacgaaguccaacuuuuggaggugggaguauuacuacacccucuagcagcccagaagagcaaagggcguagcaagggaacuuacaccacuacacaaacccaagcuuaccuguagcuaggacccacauuuuaaaaucucuuuauggacuggggcgcgguggcucacaccuguaauccccguacuuuggaaggccgaggcggacggaucaggaggucaggagaucaagaacauccuggccaacauggugaaaccccgucucuacuaaaaauacaaaaauuagcaaggcgugguggcacaugccuguaaucccagcuacucaggaggcugaggcaggagaaucgcuugaacccgggagucggagguugcagugagcugagaucgugccacuguacuccagccugggcuacagagugagacuccgucucaaaaaaaaaaaaaaaaaaucuccuuaugauguucacaagauccacuuaacaagcaucagugucaagcacucuuuaacaauauuucucauggaccaagcuaagcaaauccaggaauccguguauggccagauuggcuuaaaaauucuuucuaaaacauguuuucacgaggaacuaaacaucaagggcauagaaacaaccaggauuauuaaaauguuaucuuuuacuuucuagcuuccucucuuuuuaaacuucuaggccguugcuaguuaaagcaauuagucuauucacuuagcaaaacccaguugauagaauuuuaaaggauuuuguuguuuaaaaacaacuggcaacaauaaugaagcaauaagagcaaggcgcugaaaagacacaggaggccaaagagguuucugccucugaaauuuguauguauccuuucacucggaaagaaaacagucagaugcaguggcaaagggggugaaauuaggacaccaacuuagaaaaagcuaguuucaguuaguagcuaaaucagcaagacagacaucgcucaucaucaaauaacuccgaaucuaguaaugaccaaaaaaaccaugauuuaugaaauguaugggcuaugguaagaagcggugguggugaaggucucaaucccauaaacuaauaauccuucaacuugcaaagucagaaguaucaccuacagugagagaaauuccuauuucagacgauggccagaagcagccaggacucuccaacacugcugguggaaguggaccgugguacagugccucuggaaaaccacucuggcgguuucauauaaaucuaaauauacacuuagcuauauggcccagcaauuccacucucagguuuuauccaaaaauuaauaaaaauauacauccagccaggcacgguggcucacgccuguaauccuagcacuuugggaggccaaggcaggcaaaucaccugaggucaggaguucgagaccagccuggccaacauggugaaagcccaucucuacugaaaauacaaaaauuagcugggcgugguggugcgugccuguaaucccggcuauucgggaggcugaggcaggagaaucgcuugaacccgggagguagaggcugcagugaggugauaucaugccgcugcacuccagccugggcgacagaacaagacucugccucaaaaaacaaacaaacaacaacaaaaaaaacccaaauguccauccacuaggagaauggauaacaaauugugguagacugauacaauggaauacuacucagcaaaaauaaaaagaauaagcuguugaaacauaccaaaacauggauaaaucucaaaaucauuaugcuaagcagggcgggugggugggggcaggagauggaccauaugauucuaauuauacuaaauucaaaaacaggcaaaauugaucuacagugauagaaaucaacacagugguugccuuggagaggugaggguggggcagagauugacuagaaagggcaugagagaauuuccuggggugcacauguaugccuaaaacauguagauacacaaaggauccuguuaagcuucagguucuuagaagaaaaagcaccuaagaugcuuucaucaaaaccccuagauuuucaauaaagaaauugaggccuacaaaggcugugacugcucaagguaacagagcuacuaaaaaauacagccuccaaacacccaucucaaugcuuuucacaccagaucauccuggggcaacaccaagagcuucucaaaguguucucagcuacgaggugcagaggagaugcagagaaagaagagccuuugcuguaggccacuggcaccucugaacccacauccaggaggaaacugaccccuucaaguacuccagggugauccaauccuaagacuggccccauccgaccaucagccaucccagagccaaggcaggcagcacuaaaggcauuugcucauugcucaaugaaucccacguucaacccacaauuguaguuuugugucccaagaacaccuuguguacucugaggaauuccaguuucaguccaccuauuugauuauaaaugcuuaccuguguguaugcacagguauguacagauguaugcuuaucuauaguccuauaucuaucuuuacagcuguguaucauacaccacuuuguuuaugaggggcaaggcuggacauguguauauauacuucaggaugugcagaggguaugcagacauguuucuguguauagcucagauguuuauuuaaaucaggugggcugccagacaguuggaaccuggagaagaacccacucaaugguucaaaaaaauuaauaaaguaucaguauuucaaaaauacuguaaaguuaggauuccacauaaaauccugauuugcagcuuuucucaaacaaugaaucccugcauuccugagcaacaguaggugucuggagcugcggagcugcuguuuccuuuacagaggaaaugcauucuccaguuagccauaggcuccuucacaccacacuacagcacugacacugaggcacugcacagauugcuguuaacccaaagcuagguuaauauauuuuugcccccucuuuucgacccagggccuccuuaauuaacuuacguuucucuaccaggcaucugagcgugcggccucucaauuccugcauagcucuaguaguaauggucagucugggcugccccauguuuuuuaaacuucuuagguuuucugaguuuccuucucccccuuauacuguuccauuuugaaaugagucgugggagacuucagcuuuucccuucccaacccugucgucaaccuugcuggcuacuuuuccacaccauguaaagcaggccaaccaaucauacuucagaagaauccccacgcuaccaaagggcaggacaggcuguccuuagaccaacaagagaccaugggacauagauaaacuaauuagcaugcuagaaaaauaaagacaaaaauccaagagaaccuaaggaaaacauuuacagacaggagucuuggccaaguggcagugugcuuacagaccaccuuugauccuuaccugaacuuccucuguccgaguagaaucauuucccaacaggggcucuccagugggagguugaauggugacagacuuuucugacccucugccgucuuuauuccggggugacuugugucucucucuaguucuuucccugaaaaacaacaaugagcuagcacauuuaugccauguuaauuaacucucuggguuuaucaaaauguaaguaucauuuugaauuuagggaaauucuacauacacacacacacacacacacacacacacacacacagagcaucaaaacccacccaucuucaccacacuucaagggguacacugaucuuuacucccuacuaaauauuuucuuucugccaucccaagacccaaaacaaagacugucacucuuccucuaucaucagugauauuuucucaaagccuaaaauuguaauuuuaggauuuuuguagcuaguuacacuuuauuguaauaauuagugauuugauuugguuauaauuugccuuaaccaguuuucuagggcuuuuaaaauugggacaacacuguagaauaagcuuuuuucuacaaaaaaauaucuauuuuuuuguagaauauccaaaaaaaucugggacacauugucacccuucaccuuuggacaacagaagaaaggaaauucaaagucaguacaaagaauuguuuacuucucauucuuacagguucaaaacuaagucauucccauagguucuaguugaacuugaagacacccauagaaacaaacaagcuaggaaaaaaggccaaagacaccaagagggguggaggguguguggguggauguguguguguuuguguguguguguguguguacauggggaggguuucagaccuccugaggaaagcaggcugcugcaucauuuuaccccacaggaacuuccuggguggucuuccagcgugauuguaagaacccugccugggggucacucaugaaauuccaaaaugaaccaaucacuggccaagccaaggucacaaccugggcaauaaccacuuaugggaacuggcacucccccuccagcugccaacaggaaacccagaaucccccaccuaaggagucccucaagggucagugaguucccucagccuccugcccccacagccaccuugacaucagcccuccuuccuacaaccacuugccgucauucccaaggucucccaggcaggacagaagcagauuuuggagacaaacagaucuuggaucugcccuaccagaugugugaucuugcacaaguuauucaaucucugaaaaccuugguuucuuuauguaugaaauggugacaaugacaacaccacauaauguaaguagugcucaguacaaggauguggaguaagugcuaaugcacaguggcuaugauugcuauuacuauuagccagugucaaagaauggugucuugacuuagugaugcagaguguguauaaccuuggagaaagagauguaaauagaacuauuaacacacaacauaucuucuguuaaccuacuacuuagcuuaagaaaacguagauuucuugucaaacuucgaccuuaucauuaccucccugggauaagcauuggcugauuccuucauagagccaggaggcucccauggccaagggaaucuuucagugacaacaauucuauuccuacagcauaacuuauaaucacacucuauugcugauacaguucagauaguugucccuacccaaaucucaugcucaauuguaauccccagugcuggagguggggccuggugagaggugucuggaucauggggacagaccccucauggcuuggugcuaucuucacgauagugagugaguucuugggagaucugguuguuuaaaaguguguggcgccuccucucccaacugucucucuugcucccgcuuucaccaugugaugugccugcuacugcuucacuuucugccaugacuguaagcuuccugaggccucucuagaagccaaguagaugucaguaccaugcuuccuguaaagccugcaggaccgugagccaguuaaaccucauuucuuuaugaaggugucagguauuucuuuauggcaaugcaagaagagacuaauacaacugcaaaguuagauucuaaaaacagagguguucuggucaacucagguguuuuguuuuaacaaggcagcuagggaaacagccaaauaagcagaaaauuugguuguuuacccagagacgcaucuaacaaugccaauuaccucacauccuaccccaauuuauagaacacuuugcugaaugccucacuauaauauuucauuuaauccuaauaauaauccuaugaaggcaguaucauugucuucauucuacagacaaggaaacugaggcucacagaguucaaguuacuucucaagcuaguauuauagucaguggcagaccugaauucaggucuguugccaccacuucuauucacaccuacuauggugcaccguguugaagagcaauuggaagauuucauggcauaaauauucuuaaagcucauucucacacccuuauacuugaaaacuauuagagcuaugaaauaugccuugaagcuauugcuaggaaucacaauuggaccgugaccuuagauagcacaaagcugugugcccaacacucugggcugucaaauacaaucacuucaaaaggcacccacugugagaaacuauaaacaauuugggagagacuucccacguuguuaggucaguuucugaacuaaccucagaauagucuagaacugcugcuccaccagcccugccaucggccagauggacaaugccccucuucuaucuuaauccguuuccauuuuccccagcuacucucacauuuaucacucucucggccaccagccaagucacaugcucaccuaacccaucuaucuauucacuagucccaugggucaaaucuugugacagcacaaauuccacuggaaaucaaaauucuuucacugagugccaauucccggagccugaacccuaccagggcagaaagcagguggggagccacccagggguggaaacagccucuguugccagccaggguugccaucaccagcccucccagccuggcucuuaaaaggcccaggagcacccaaaugugaaacaaccaacaauuccccugauaacaucggagggaaaccagagaagaaucuguuaucugauaacccaagcaagguuucucauccuccagagcccaaaacccuaaccagugugucuuaaacuuuaaaaaccucuuaaacuuaaaaaacugcacagaaaaacuauccuagguauggacucaagugcagauuuguuggccccacucucaaauaauuuucuggaagggagacaacagaaaucaaaauuuuucccagcaucccaggugacugcaggugguaaaggaaacuugccccaagauucucuuccccaaaugcuccuaggaggagguugcugagugacugcuuggaaguuugcuucuuugugaaaugcccuguauauagcaggggcuugauaaugggagccaugaguguaaugcucagcugcacaauguuauaauacacagcaccgcuuuauuaaaauaguaugaaguggaugaaguugggagaaaagcucaggacagugugcagucaugacugagggauaccgagccaagaaccuuccacccacugucaagugagagaugaaggugaggcacuuccugucagcucagcacuagcacugcgccagguacuggucaugcuaccaagggagcaggaccugccauauggcuuuuauuagaaaacaauuauuagaaaauuagaauaacuuuaucagaaauccacuggucccgaauuacugcucuaagaaggucucugagccaagucaggacuucauagugacacucugcaaaaauccuggcauucagugccuuccagucugcagaacugcgggucacaguguggccaccucacuguaauauguacucaaaugcucaucccuguaguuccagaugccacaacuccagggaaaaccuauggcugccaagugcugucugggagaggguuccccaaugaugaagacaaucuguucacggcaucuaagaguauggaaaugggagaccaggagaguaaacagacugccaagccacagggagagguguuacaaacacauguauacauguguguuuuuccaacucugccucaguggucuggaucaccucugugccuuugcuggguggcugugucagcuacgagaguuuuucuucguaucuuuaucucugaauuugucuccacgcaacaucugccuguaugaguaaagauaaguauaucugugcguguugugugaggggcaggaagagcaagugguggcaugcaggcagcccgggcaugugucugcaccacacgugugugagcaaaugcaucuguuuaggugguucuagagcuaagcccuuggggguugcugucacccuccucguuccagcuagaaccccuguaauucucacuguucucacuuacagucagcauuuccugggaagauuauuuaguccuguuucuguuguuugccuauuucuauuuggggaaagcuggccccaccgguuacuccucccuuuccuucucucccacaacccacgacccguccuuucucucugcuggcugcuggggcccggcuggcugcuuccucuuggcuauggcugggguaggagcgcugggcgcaggacacacagacucugaagcagccuugaaacaaaagcaccaauuccucacugccccggcggcccucuuuuugugcauuuuagcacaucaaucacaugagucacccuucguuucccuuuccuaaaguagcauuucucuucuaaagaaacaagguuggcccaaaaucugcugagggcaccuacuaacuuuguaauuuuaggcaaauaacacugcccucugugccucgauuucaucacccguaaaauggggcuaugaccucccgccauucuaggacugcugugagaauaggagacaauggcuaugagggaggggccuagcagacacccccaaagcaguuaacauaacuggcagcugcucuguuuaaauuagggaacuugugcuccaaacccaacuucaaauaaggaugagaaacagaaggagcucggggcaggugcugcuggacggggccuguggugacauggcagagcccagcuccugagacagucacaaacccucuggccauaagaauugaaucacacauuucagcugguggguaaacugaucagauuuaguuaugaaauaccagaaacagcuguuuuaaaauaccaauuuuuuuuuuuuuuuuuuuuuuuuagcccuaccaauucccuugucaauaccaggcuucccucauccacaccacaaugacaaaaguuaggcggggucagcaggaguccacaccauucucccagcaaguuaacuggacacccucuggagacugcaggcaucgcaaaaccaggccacugaccucuuuguuagaaaacagucacuugucaucugcuuggaaccuggccagucuucuaagaugaucauggugucaucaggcauaucaaguuuggugcauuucauuauuccucccugaguuggacucugacuaaaauuaccaaagagcauggucccccuccaaccccaacccgccuccuacccuuccauucaaguucccaacaaaccucugagcagggcagccuucacaggaacacuccuuggacaaaauacccuuagcugggccuggggccugcucucaugccuguggggggcaacccuacugcuuaacauccuuuaggccccagcaaaguacaccacagcccgugcucucuagggauggugccucucaccccacaguugcugugcccuaugcugcagucaguuggagaauccaccacccguaggugguagugguguuuuuuaaagaacccauggagugcaccuacaaaucucuaagguucaucuccucucucagagcuuuucucagaguagauauccaggaacauuuuuugaauaauugauuaaaagacucagcuuguauuaacauuugccaaguacuuucuauauggguccaagaaugcauuaaaaauucugcguguuguuuuaauuggaaguuacagucucuuaaaguuacuacaagggcauuggaauaucaauuucuggaggccccaagaggccuaaggaaauagcagagcguagcaaugggccccgaagcgugaaagucagaacucgaguguagacaaaagagcccagagaugguucccacaaaggauacugcaaagccaaccugcuuuguucauccccaagcacccagggaaucccaaauuccuacuucugucauugugguguggaugagggaagccugguauugacaagggaauugguagugcuaaacaaaauugguauuuuaaaacagcuguuucugguauuucauaacuaaaucugguaaguuuacccaccagcugaaaugugugauucaauucuuauggccagaggguuugugacugucucaggagcugggcucugccaugucaccacaggccccguccagcagcaccugccccgagcuccuucuguuucucauccuuauuugaaagccuuaccuggacuccagcacaagcucgcugacauguuuuccccaaauuuugauaagagcaauacauaaaaauuuagaaaacaauuaaaguuaaaaagaaaauacgaccauaauccuacacucagagacaggcauagucacuaugugaauacucaucauaugucuauguaacuaucacagcauacaacauuuugaauccuguuucuuuuaacauggucucaugaacguuuccucaagucaucaaacaucuuugagaaccuauccuuauacuauauuccauucauuucuaaaaauuacaaaauauacacuuguaaaaaaaauugaacaaguacaaaaagauaaaugaaaauuuccaucauucuccagcuucugccgagccucccccuauggaugaccacuccuggcagcuugggaggucacccucccaaaccucuuucuacguuaguaauccagaugggcuuguaaauaauuagauauauguagcucacugcuguuuuacagaacaaaaucucacucugcauucggcugcuuguauggggaagagcgcagucagggaaaaaccacuacaaucacuauucccaagccagugcagagcugggcauuugggcuggggccaguugauaccuuggaacauagugcugaaaugccaaggccauuacagcauuacuuuagccacuguugacugaccuccagccuguacuguguuacaugcuucacaugcauaaucucauuuaauccucucaacagcccuguaggagaggacugcuguacccauuuuacagaugacaaggcuaaguaaacagcagcacugcaauuucaccaaguacaauucuaacugguacagugccaccuaucuguucacugauuucuuuauucauucauuugcucuucuacuuaacaaacauucuacaggucaguaacacagcaggcccuaagaauaccagugcacaccugcuaauuuugcagagaaggggaaguuugaccaauaucacucaggacaguguuuucaaaacccaaacuuguucaccugaagauuagucaaaaagaauaaggugccaggacaauccuaccaguucacuaaauaagccucaugacaaaggcauaauggacaaugagucaacaacuucaggugaaaagcaacaagcaaugaacacuuuuuaaaucuuccauuuacauucuucauaaagcuuucaggagagccgauaccuauaagaaauaccuagaaaccgaggcgggcggaucacaaggucagaucgagaccauccuggccaacaaggugaaaccccgucucuacuaaaaauacaaaaauuagccaggcgugguggugggcgccuguagucucagcuacucgggaggcugaggcaggagaguggcgugaacccacaaggcggagcuugcagugagccgagauggcaccacugcauuccagccugggugacagaacgagacuccgucucaaaaaaaaaaaaagaaauaccuagaaaugaaaaacauuuccacugcaggaagaaacuuuaauuuaaaaccaauugugagaaacuaaagucaucaacucuaaugguggcuauaaaauguaaacuggugacguaguuacucccaagaauguuaaaugcucuuaaagcucagcuucucaugcaccaaccgaccaaauguccagcgcugagucacugaaaagugaguguagagaaccccaccaaccuguagguuuccccaaaaggaaaaguguaauaaugaacaacuuacauacccuugucugugagauuuuuucgaaugacuugaauaguaagaauauccagaauaaguggauucgguauccauagcaauggagggcuugcgcuugaggaaggagcagguacuguuucuccuuagagguagaaaauuucaccuaccagacuccuaaaaccucaaggagucuggaaauuagaagaggagccacucuucaacaggaacaaauucugggaaagagggggaaaaaaaaagacauuaaucuucagagccaaccuuaauggggcugaaagauaaaugacaaagccacaccuccucucuggggucucuaucauggaacaagcgagugagggugaagcaacugaacuguaaaugcuccacccaugcagcaaccaguuuucccaggugucugggagggagacaggauaggcgcugagcaagcugaaccccuaccacagcagcaggaaaaugggaggcacuuguccacguccucaggaugaccugaccccugcucacuggcuuuaggagguggcuuuccacaucugcgacccuccacacaaugcccagccccccacugccaguuugcugguuaaaaaaacaauacccagcgaaguugcuuuuaagggauuuggucauaauuuccaaaagucaauuaaaaaaaaaaaagaucuucaaucuuuuugaucuaggauccgaauuucugggaauuuaucugagggaacugauuucuuuuuuaaagaaaaauuauuguggucucauugucuauaaauaauaaaaugcuagaaacaaucugaaugcccccagaauacaggaauagguaaggaaaacaugguucauccaccagaaaaguaucacauauguuuaaaaugaucauuauaaagaauagaaacucuuauaaugaugaauuuuaaaagcaggauacaguauuguugauacacagugaaccaacauuacaguuacaauuguauaaaauugcuuauguaaggacaaagauuuuuaaaaggagacacagaaaaugaaagcaggcaauuuauuauuugcaggcuccugggucuucucccacauuuucauuagauauugcuuugcaauaaaaauaaauuggaaacauuuccaaguacauuccugagcucccacaugcuaaaauuuuuacuucuagaaaaccgagauccacaaguucugucucuuucugcaccccucaccccagagcuagucucagcucaacaggguuccuucuuccagccgcuggaagcugaaacugcaaacacagccagugagauaagugugaagaaaaaacaaaggagcuguaaaugccauacccuaacccuccugggaggaggccaaguuucccugaccccagcaacaacacauaagucuggagggaaucaggucagcacaaauugccauacaccaccaauacagcccccacagccucuaaucccaguuaggguguauuuacccuuaccauucauucuuccugggagucagguacgaucacuuccaaggucugccacccagggccagccuccuuugucccugaugcccugacuuaccauuucacuucuccucugccaucaggagcccaaggcuagcccuggggaaaccugaguucuagucugagcccagccacuguuuaguacaaccugggauaagccacuugcuuucuuaugccucaguuuccucaucuguuaaacaggguaaaccaaccagccaccgaccucacagguagaucugaaaauauaagcagacacaguuuccaaagguggguuccaaucucggguuuuacucacuuauuagcuaucaggccccagucaaaauuaguaaaccucuuugaacauguaacuguaaaaugcaaauaucaggguugccgugaagaccaaaugagcuaacaacuaugaaggcacccagcgcgagcuccagaugugcuagguaaacgaaagucacugucuaucagcacucucuuugcggguuccgaaaugcuuguuccucugucuuuuuaaugagagaaaugcuuggaaagaagcagagcagagucucugugccggccuuccugccacaaggcucaccugcagucagacagaacggagcacacaucucaguccgcugccuacuaacuagcuguacaccugggcaaagcaguuucuccuuggagccucagagacuucccaauccauaaaaaggaagcaaggcagccuauuaugguggggguuuguggggggagguagcuguaaagauuaaaugugaaaacacagcaggccuuuuuuaaaugcuaaguuuugcuccuggacuuacccuacuuuccuagaagacuucaagggcugagucaucuuuuuuucugccuacugucuccaccauuuucacuagcaauuucaaucagcuuucaacaccucagucucacuuccuuucugcccugggcuuugcuguuuucucaccugcuucauaacaggcagacgucaacauuaggaugugcuucgaagaucuccagcccugagugaacugagauccucccugaaagccccucacccagccucugcugaucugcagauucaaauguccaguucccuggcccagaacaccgauuucccacucucuucuagauucauaauuaacccuucacaacuccuacacucugccuugcaacccauaacucuggauuccccauuccaucccaacuuccagcuacuuuuugcuaaaugcugcuggagugucucagaggcagguggcccaggccccgcagaugugggcagauccagcuuggugcuuccuagcugugacaucagggggcaaauguuugccucucugagcuuauccaacccugccccauaaaaaugaggucauuuaauacucucucuucccaggguucuugugaggauuaaaugaaacugcaaagguaaagucucuggcacaugguaacccaaguuuuauucccuucccccucugccagaggacuucauuccuuguccucauugaaaacuuguggccauucauuaagacaacuccaggcuugucccucaaaggaaaccaugggucccaacugcccuccagggaaaggcuuuaucuaacucuaccaaccacccuagucugguuucccucccaugguuccuuccuguacuuaccaaaggaguggucuauacaugcugucacucccuccuucuccacuuucaguccaaaucuccauccacaacacuccacugaaacaacucaaaguuggccaaggauugcuaugagccaaguaacauccuuguccuccucccccagugcuuuuuauuucauuuauuaguccauccaccuccauauuaaguggcaccuacaagaccaugcuaggcaaugcuagggcacagcaaugacaaaggcaugcugccugcccuagcagaguuucucugcagcuggcuagccuccaauuugaugccgcuuauguuacuacuucuccucuaacacucccucuccucuccccucaucacguuaucccuugacauucaaaacucuucucagucuucuccauccacagauuuccuauggcagaagcuccuugaacacagcaacuacgucuuaccuccacccaggauauuuugaacauagcagguacccaacaaauacuuacugaaagacuaaaucccaagugcacauuuccuacugagauuccucuugcuccccuugggaauaccaucaucccucucauaggugcucuccaguauccuguccuguucuucccaauuccucagcuaaagcaauacccucauccuaaggaucuaacccugugccaccuucaacacccucucugauccucccuucacucuacugauucacagccacccacuuccuccaggcuccaccuacacagggcuagaccacuacaaagccuccagguguccucaccagccuauacacagcucaggccccuucuaagucauaccguuucuaauaguuaccaacucuuauccuauccaagaucugagugaggacuaagaggaugcaauaagaggcaaacuaauaaaauccgaagugaacuuauuuuaaaagagucugagccaagguaagaacuucaacagacuuaauggaaaaggauauccugaagcuuaccacugcaaugauauaucuaugagauaguucccuugcauacacaagaaauuaaccaaacucaugauaaggucagaaggaaucccuuaucagaaaagacaauaaagcaaugaaaaggaaucagguucccaggguaauacacugauaggcugucacagcagcaugaauaggacagucauauaaaggugggaauauggcuccuagaaccuggaacugucuaucauacugaccccugacaugacucauauuguguuuggcccaggcugggcagcagccagagugaccuuuuaaauuacaaugcagacgucacuucccuguuuaaaaccuuuccguggugucccacugcacuuuaaauaaaauacaaaaaucuuucauuugguaugcaauguccugcccgacgcucuagcucccuccuccuucucuagccccagcuccuuuaagguagagucuuagggcuuuggcagagcccaguauaucuguugguacucacccuuuacaugcccuguuuugccaaauuccuacucaucacuccuuaauuuaaauacugcuccuuucaagaggccuuuccugauccuucaaucucagucaggcucuucucuaguacccuguacucuuccuuucuauccaacuuccagugauacauuuguuugugugaucacuuauugucuaguuucuucacaggcuguaagcuccaugagggcagaggcacuuucaugacugccugucuuuccagcuccuaggacauuauggguacccuauaaaugucugcugaaugaaggguuuuguggcagaucuuaggacaugaggccauagauucauuguggaagaaacuuuagaaauuaucuauuuuaaauccuuaguuuuagagguggcaaaaaaaaagaugcagauauuagauagaggcgugauaccagaacuaucaaaaaaaaaaaaaaaaaagcuauacuacuggcucgcauggcagucccacucaggggcagaguucguaugccagacacacugaguaaaaaucagcagcagccucuuucagccacugcccaagagcaucuugccucaccggucacccaccccuuaagaguguauugcuuggcacugcuuggguaggggcuggaggcaaauauuaggacacggccaggcucauugaaccacauugcaugcaggcaaggucaacaaugggagauaggugcacagagugcuucuaaguggcaguguccuaaauucuggacuuccuaggcaaaaaugucagaaagaaccuccuucaccacccuuuaucaaaagcaaaaugaagauaaucagccucaaacagaauucucuccuaaagucauguucacucauauaaaaauccuacuacuuaauaugaaaacacaguguuuagcaaaucguaugaaggaaauaauauguuaugauaaugacagugguaaacauaagcuaaccuucgcaaaaaggaaauuauaaaaacaucaacagcucugccuagagcuauuaaguaauuaagggagcucugguuuggaaaguuacuuuguaaggguuacagagacacgcacugaauuuaaagagagauuuugcuuccuaugcaguaaguagaucuauuuccaaggaaaaguggugucugguacaaccaugcuuauauaugcuguguauauuauucugaauauuugauuuuuacauagaauucugcagagauuaugcuauuaauuauuauuuauauuaugucuugaagcuaacauucuucuuagggguacccauucuuaauuaaauggcacucaaggggaaagugacaauugaaauaauuuuguuuagagucaacuauucuucuagagaguagcaaugagcccaaauugugggugaagagcauucaaauccuggcucuaguacuuagcugugugaccucagaacaaguuacuuaacugcucucugccucaguuucccuaacuguaacaacagauuuuauuuuacuuauauuauagaucugugguagguauuaaaugagauaauucauaaaaauuauuagaacagugccuagcacgugguaggcacucacagcugucaacuacuacuaguauucacuagaguaaaauuccuucaguuaggaagaacugaagggguuguauggcauauaacuucuguaucauuuucacugaacuuauacacauuuuucuggucucugcuaccaccuuuaacugcuacuauuagcuauagcugaguaacaagugauuucuauucuguuucuuacaggccucuauuuaccauccccagguuggaagcaaaugucagagagaccagaggaaaccguguguguuuuaguggguuuauuuggaggggcaugggcuggaaaggagcgggcagagaugcagggcaaaucuauaaaacauuuugaacuuguggccuauaaaccaccaaacaucaugcaggucacugaugugaggaucugcugggcuuauggcauuugugacaaacccaaugauucuuuuauuacaacagcuuauaaaugaaugauucugggucauuauuuacaaggaaagaaaaugucaacuuuguuuuacuuguuucgccaaugauuucaacucaccuugccagaauaacuucucuuggcuccagucauuaauuaccccugaaacaccuccagcagcuggguacagauuucugaagaggugugaaucguuaacaugucuggaguuaugugauguauauuugcuugcaagugacucccuuguucccugccagauauuuaaacuucagaaaaauagaucucaugaguacuaucuccucuguaaaucugaugguacagagucugaucacuguuguccuguaacugggauucagaaggacacugcuagagacaacagcacacacauguauccuugcaucaaacuucaauacugcuaacaucaaaccaauacugcuaacaccaaaccaauauugcuaacagaaacaugguccaaucacaagcccaccuaaucuuuuccaucuuaaggaaaauagaauagcaugaugcccaaaucacaugcccuauacagcgagacccuaaccagcuagcugauuuuacagagaugaugguaauagucuaacaguuucuaguugucaaguguuuacuauguguuagaugcuguuuuaagucacuuacauguaauaucucacuuaauccgcauaacaaguguuuaagaaaaauaagacauuaauaucauguuaguuagggaaaccagacugccacaggagccagggcuuaaacguugagagucuaacuccagaaccuguguucuuagcuacagaaaauugacagcacuguagcaauuacuagaauuguuuguuuauauagaggaguauaagcaacaaucacaaauugucccaaaccacauauaaccccacuaagaauuuugcaauuucaacuucuacucacagguucaguguuccaagcaucguggggcacucaggagaaaagaaauggaucuaaaauaguucuaacucccaaugagcucacagccccaauguggagaccuccaauuaaaacacaaugugacaagggcccaucccaccaaaauagcugauaaggccuaggguagcaagcacaguguguguauauaaguguguuaaggggaugaugaaggggaggaugccuucuucauucaacacauuuauccuucaaacaaagggugacauggaauuguugcuugguaaagaaacuuuaaauuuccuuuaugguuuuguccuguugcuuaauacauaagacaauaaaaauguacugcuuggcaagcaguccuuacaaauauaucacucucaaaauucuucucccauuuuacuuacaaauuaaguugcaagcaagccucacugccaacauuguuaauagugaaauuccacacugaguguuuucacuaauuauacugagagacaucaacguuugggaauguuuaaugcucauggauaggugaagcguguuauuucuuugaacuggaaaaagaaacaguuuccucccacaaaucaaagccccaacuauaucacauugauuuaauucaacccuaaaaacucuauaauuagugguuacagaaaauggcuaauuaccucucccuguauucagacaauuucugccaucucacuugcagagccugggagcuguguacucaacccacccacugacgggagaaugcuaauuagcauuguugacuggugauacaaguuauaauauuuuucagcagccccguaaaauuuauaaacaugucagugaaaaugccagauucuuuuacaguuuguuagcuuuuggacuaagugucuaagaauacauucauuucuaaccaaagccaggucaagaguuuuaacaaaaugcaugggccaucuacacaaucaucaucauaaggcgcucuaacacuuccuaaggagaaucuaagagagcucacaacaccuucgcagcgugggcauuagaccugguuuggagaagugaaaacugagcaacagauuccucagcuccaagucucaucugcucaucacacagcagccaggccgcggcuccgccccacugcugccgccaccacggacgcguuuaaauuuuuauaaagcuucacacuucucuaggcgcgaugcuuggggcaguucaaagacugcagaaggaaaugagguccugccgguggcgaaggcugccccggcgcggugagauuuccuccagcagggacaccuugggcagagacccgccaggcgccucugcuccaccccggcguuuuugaaaguaaacuccuaccugccuguugcgcucuccgaggcgcaaccggacucgccccccaggccuccagggccggcucaauuuuuugugagcgaggugugcacacagaccagcucugucccgguuccuggcgaagggccaggcggcgcccgggucgagccccgccaggggugggaaccccggugcgcgcccggcucccgcccugcacggcugcugcagccgcccggugccuccaacgcucggccacucccugccggccugcccgccgccccggcacgcgcaccgaaggggcgcacuccaaaggccagcccggggagaaagggacguccgaggugugagcagggaaccccgggaccccaaggaguggggugcggcggagaucgcacggcagggccaggaggggcgcaacgcauggggagaagaguggagucagaggaagcacuacccggagcgcuccggaggaggggagggagcccccggcccgaggcgggagccggccacccggggucgaaguccggcggggcgaaugcgggaggagggcgcaggggcacgcgggguccgaggugggggcgucucccagccaacggucugccccggggaccgccgccgcgcagcgcucggccucucgcgggacucaccuccgcgccggccgcccgagcuccgcggcccgcggucucggcucacagcggccccggcucugcggccugcgcugggcuccuggagaggcagagccccgccgccgccgccgcugcacugcugcuuuccgcuuccugucccggcgccgccccgcagcccgagcccagcccugcgagcccggcgcggccgcgagccaagaacagcuagcgcugccggccccgccgcggggccggcccaccugcagcggagggcggggcucggccggcgucccccucaccucgucaccgccccgaccccacacacccgggacacacacgaaggcgugcgcggucacacucuuacacacggaccagggaaugacaccucccacacucauucacccucauacacacacucacccuacacagacgugcacagcccaguaacccacucucuucugggcagacacacacacuauaaacacauggcccagggauugaucuccgacaccgcccccucccucccccacauacuuggaaucucaagcucacacacacacacacacacacacaaucaugcacaaaauccgagcccauuugcccucacgagugcccccauccacauauucacacggcucagggacuaaccccccaaccccacucaacacacacucauauacacacuuuccaagaacugaccgacaaauauccauauacaccauaucucaacccauauacacacacuuaaacucacauguagcccuggaaaugaccccacaaauagacacacacacacacacacacacacacacacacacacccccuacaagccaccacagcaagccucuccccuccuccucccuuaucagagcaggcacugccgccagccuagucuccuagaaacugcuagaugagcacaucucugcaggcagguagcugaagcuucagugcugauuccaaccagguacuguuuccuuucugagccuuuguuuaccugucugaaaaguggugaggaugcugcuguccaccuugcaggauuguggugaggauuacaaaacaguuggcaacgauuuucaugaauauuugcacuuuucuuaguugucuuguguugguagcauuaggguuccuuacugaucaucuccaaucuagcugggacccaaagcugcuuacguggcaggauuuuccaguggaagcaguguauaaugaagugcugaauuuccuaagaguugucuacaggaguauugcgggcauuugggguggggaaaugcaggcccacccugacuagccuuaaucagggaaccuuggcuccaagaaccccucacucccuugaucaccucuuccucaucccuucuagacuccauuuucucucgcauaugucacauuuccuugagaagacacccauauguucaauguggcugauuuucaccacuccuaguccc

SEQ ID NO: 12609 - RNA, 75334 nt, Homo sapiens
gggacuaggaguggugaaaaucagccacauugaacauaugggugucuucucaaggaaaugugacauaugcgagagaaaauggagucuagaagggaugaggaagaggugaucaagggagugagggguucuuggagccaagguucccugauuaaggcuagucagggugggccugcauuuccccaccccaaaugcccgcaauacuccuguagacaacucuuaggaaauucagcacuucauuauacacugcuuccacuggaaaauccugccacguaagcagcuuugggucccagcuagauuggagaugaucaguaaggaacccuaaugcuaccaacacaagacaacuaagaaaagugcaaauauucaugaaaaucguugccaacuguuuuguaauccucaccacaauccugcaagguggacagcagcauccucaccacuuuucagacagguaaacaaaggcucagaaaggaaacaguaccugguuggaaucagcacugaagcuucagcuaccugccugcagagaugugcucaucuagcaguuucuaggagacuaggcuggcggcagugccugcucugauaagggaggaggaggggagaggcuugcugugguggcuuguagggggugugugugugugugugugugugugugugugugugucuauuuguggggucauuuccagggcuacaugugaguuuaaguguguguauauggguugagauaugguguauauggauauuugucggucaguucuuggaaaguguguauaugaguguguguugagugggguugggggguuagucccugagccgugugaauauguggaugggggcacucgugagggcaaaugggcucggauuuugugcaugauugugugugugugugugugugugugagcuugagauuccaaguaugugggggagggagggggcggugucggagaucaaucccugggccauguguuuauagugugugugucugcccagaagagaguggguuacugggcugugcacgucuguguagggugaguguguguaugagggugaaugagugugggaggugucauucccugguccguguguaagagugugaccgcgcacgccuucgugugugucccggguguguggggucggggcggugacgaggugagggggacgccggccgagccccgcccuccgcugcaggugggccggccccgcggcggggccggcagcgcuagcuguucuuggcucgcggccgcgccgggcucgcagggcugggcucgggcugcggggcggcgccgggacaggaagcggaaagcagcagugcagcggcggcggcggcggggcucugccucuccaggagcccagcgcaggccgcagagccggggccgcugugagccgagaccgcgggccgcggagcucgggcggccggcgcggaggugagucccgcgagaggccgagcgcugcgcggcggcgguccccggggcagaccguuggcugggagacgcccccaccucggaccccgcgugccccugcgcccuccucccgcauucgccccgccggacuucgaccccggguggccggcucccgccucgggccgggggcucccuccccuccuccggagcgcuccggguagugcuuccucugacuccacucuucuccccaugcguugcgccccuccuggcccugccgugcgaucuccgccgcaccccacuccuuggggucccgggguucccugcucacaccucggacgucccuuucuccccgggcuggccuuuggagugcgccccuucggugcgcgugccggggcggcgggcaggccggcagggaguggccgagcguuggaggcaccgggcggcugcagcagccgugcagggcgggagccgggcgcgcaccgggguucccaccccuggcggggcucgacccgggcgccgccuggcccuucgccaggaaccgggacagagcuggucugugugcacaccucgcucacaaaaaauugagccggcccuggaggccuggggggcgaguccgguugcgccucggagagcgcaacaggcagguaggaguuuacuuucaaaaacgccgggguggagcagaggcgccuggcgggucucugcccaaggugucccugcuggaggaaaucucaccgcgccggggcagccuucgccaccggcaggaccucauuuccuucugcagucuuugaacugccccaagcaucgcgccuagagaagugugaagcuuuauaaaaauuuaaacgcguccgugguggcggcagcaguggggcggagccgcggccuggcugcugugugaugagcagaugagacuuggagcugaggaaucuguugcucaguuuucacuucuccaaaccaggucuaaugcccacgcugcgaagguguugugagcucucuuagauucuccuuaggaaguguuagagcgccuuaugaugaugauuguguagauggcccaugcauuuuguuaaaacucuugaccuggcuuugguuagaaaugaauguauucuuagacacuuaguccaaaagcuaacaaacuguaaaagaaucuggcauuuucacugacauguuuauaaauuuuacggggcugcugaaaaauauuauaacuuguaucaccagucaacaaugcuaauuagcauucucccgucaguggguggguugaguacacagcucccaggcucugcaagugagauggcagaaauugucugaauacagggagagguaauuagccauuuucuguaaccacuaauuauagaguuuuuaggguugaauuaaaucaaugugauauaguuggggcuuugauuugugggaggaaacuguuucuuuuuccaguucaaagaaauaacacgcuucaccuauccaugagcauuaaacauucccaaacguugaugucucucaguauaauuagugaaaacacucaguguggaauuucacuauuaacaauguuggcagugaggcuugcuugcaacuuaauuuguaaguaaaaugggagaagaauuuugagagugauauauuuguaaggacugcuugccaagcaguacauuuuuauugucuuauguauuaagcaacaggacaaaaccauaaaggaaauuuaaaguuucuuuaccaagcaacaauuccaugucacccuuuguuugaaggauaaauguguugaaugaagaaggcauccuccccuucaucauccccuuaacacacuuauauacacacacugugcuugcuacccuaggccuuaucagcuauuuuggugggaugggcccuugucacauuguguuuuaauuggaggucuccacauuggggcugugagcucauugggaguuagaacuauuuuagauccauuucuuuucuccugagugccccacgaugcuuggaacacugaaccugugaguagaaguugaaauugcaaaauucuuagugggguuauaugugguuugggacaauuugugauuguugcuuauacuccucuauauaaacaaacaauucuaguaauugcuacagugcugucaauuuucuguagcuaagaacacagguucuggaguuagacucucaacguuuaagcccuggcuccuguggcagucugguuucccuaacuaacaugauauuaaugucuuauuuuucuuaaacacuuguuaugcggauuaagugagauauuacauguaagugacuuaaaacagcaucuaacacauaguaaacacuugacaacuagaaacuguuagacuauuaccaucaucucuguaaaaucagcuagcugguuagggucucgcuguauagggcaugugauuugggcaucaugcuauucuauuuuccuuaagauggaaaagauuaggugggcuugugauuggaccauguuucuguuagcaauauugguuugguguuagcaguauugguuugauguuagcaguauugaaguuugaugcaaggauacaugugugugcuguugucucuagcaguguccuucugaaucccaguuacaggacaacagugaucagacucuguaccaucagauuuacagaggagauaguacucaugagaucuauuuuucugaaguuuaaauaucuggcagggaacaagggagucacuugcaagcaaauauacaucacauaacuccagacauguuaacgauucacaccucuucagaaaucuguacccagcugcuggagguguuucagggguaauuaaugacuggagccaagagaaguuauucuggcaaggugaguugaaaucauuggcgaaacaaguaaaacaaaguugacauuuucuuuccuuguaaauaaugacccagaaucauucauuuauaagcuguuguaauaaaagaaucauuggguuugucacaaaugccauaagcccagcagauccucacaucagugaccugcaugauguuuggugguuuauaggccacaaguucaaaauguuuuauagauuugcccugcaucucugcccgcuccuuuccagcccaugccccuccaaauaaacccacuaaaacacacacgguuuccucuggucucucugacauuugcuuccaaccuggggaugguaaauagaggccuguaagaaacagaauagaaaucacuuguuacucagcuauagcuaauaguagcaguuaaaggugguagcagagaccagaaaaauguguauaaguucagugaaaaugauacagaaguuauaugccauacaaccccuucaguucuuccuaacugaaggaauuuuacucuagugaauacuaguaguaguugacagcugugagugccuaccacgugcuaggcacuguucuaauaauuuuuaugaauuaucucauuuaauaccuaccacagaucuauaauauaaguaaaauaaaaucuguuguuacaguuagggaaacugaggcagagagcaguuaaguaacuuguucugaggucacacagcuaaguacuagagccaggauuugaaugcucuucacccacaauuugggcucauugcuacucucuagaagaauaguugacucuaaacaaaauuauuucaauugucacuuuccccuugagugccauuuaauuaagaauggguaccccuaagaagaauguuagcuucaagacauaauauaaauaauaauuaauagcauaaucucugcagaauucuauguaaaaaucaaauauucagaauaauauacacagcauauauaagcaugguuguaccagacaccacuuuuccuuggaaauagaucuacuuacugcauaggaagcaaaaucucucuuuaaauucagugcgugucucuguaacccuuacaaaguaacuuuccaaaccagagcucccuuaauuacuuaauagcucuaggcagagcuguugauguuuuuauaauuuccuuuuugcgaagguuagcuuauguuuaccacugucauuaucauaacauauuauuuccuucauacgauuugcuaaacacuguguuuucauauuaaguaguaggauuuuuauaugagugaacaugacuuuaggagagaauucuguuugaggcugauuaucuucauuuugcuuuugauaaaggguggugaaggagguucuuucugacauuuuugccuaggaaguccagaauuuaggacacugccacuuagaagcacucugugcaccuaucucccauuguugaccuugccugcaugcaaugugguucaaugagccuggccguguccuaauauuugccuccagccccuacccaagcagugccaagcaauacacucuuaaggggugggugaccggugaggcaagaugcucuugggcaguggcugaaagaggcugcugcugauuuuuacucagugugucuggcauacgaacucugccccugagugggacugccaugcgagccaguaguauagcuuuuuuuuuuuuuuuuuugauaguucugguaucacgccucuaucuaauaucugcaucuuuuuuuuugccaccucuaaaacuaaggauuuaaaauagauaauuucuaaaguuucuuccacaaugaaucuauggccucauguccuaagaucugccacaaaacccuucauucagcagacauuuauaggguacccauaauguccuaggagcuggaaagacaggcagucaugaaagugccucugcccucauggagcuuacagccugugaagaaacuagacaauaagugaucacacaaacaaauguaucacuggaaguuggauagaaaggaagaguacaggguacuagagaagagccugacugagauugaaggaucaggaaaggccucuugaaaggagcaguauuuaaauuaaggagugaugaguaggaauuuggcaaaacagggcauguaaagggugaguaccaacagauauacugggcucugccaaagcccuaagacucuaccuuaaaggagcuggggcuagagaaggaggagggagcuagagcgucgggcaggacauugcauaccaaaugaaagauuuuuguauuuuauuuaaagugcagugggacaccacggaaagguuuuaaacagggaagugacgucugcauuguaauuuaaaaggucacucuggcugcugcccagccugggccaaacacaauaugagucaugucaggggucaguaugauagacaguuccagguucuaggagccauauucccaccuuuauaugacuguccuauucaugcugcugugacagccuaucaguguauuacccugggaaccugauuccuuuucauugcuuuauugucuuuucugauaagggauuccuucugaccuuaucaugaguuugguuaauuucuuguguaugcaagggaacuaucucauagauauaucauugcagugguaagcuucaggauauccuuuuccauuaagucuguugaaguucuuaccuuggcucagacucuuuuaaaauaaguucacuucggauuuuauuaguuugccucuuauugcauccucuuaguccucacucagaucuuggauaggauaagaguugguaacuauuagaaacgguaugacuuagaaggggccugagcuguguauaggcuggugaggacaccuggaggcuuuguaguggucuagcccuguguagguggagccuggaggaaguggguggcugugaaucaguagagugaagggaggaucagagaggguguugaagguggcacaggguuagauccuuaggaugaggguauugcuuuagcugaggaauugggaagaacaggacaggauacuggagagcaccuaugagagggaugaugguauucccaaggggagcaagaggaaucucaguaggaaaugugcacuugggauuuagucuuucaguaaguauuuguuggguaccugcuauguucaaaauauccuggguggagguaagacguaguugcuguguucaaggagcuucugccauaggaaaucuguggauggagaagacugagaagaguuuugaaugucaagggauaacgugaugaggggagaggagagggaguguuagaggagaaguaguaacauaagcggcaucaaauuggaggcuagccagcugcagagaaacucugcuagggcaggcagcaugccuuugucauugcugugcccuagcauugccuagcauggucuuguaggugccacuuaauauggagguggauggacuaauaaaugaaauaaaaagcacugggggaggaggacaaggauguuacuuggcucauagcaauccuuggccaacuuugaguuguuucaguggaguguuguggauggagauuuggacugaaaguggagaaggagggagugacagcauguauagaccacuccuuugguaaguacaggaaggaaccaugggagggaaaccagacuagggugguugguagaguuagauaaagccuuucccuggagggcaguugggacccaugguuuccuuugagggacaagccuggaguugucuuaaugaauggccacaaguuuucaaugaggacaaggaaugaaguccucuggcagagggggaagggaauaaaacuuggguuaccaugugccagagacuuuaccuuugcaguuucauuuaauccucacaagaacccugggaagagagaguauuaaaugaccucauuuuuauggggcaggguuggauaagcucagagaggcaaacauuugcccccugaugucacagcuaggaagcaccaagcuggaucugcccacaucugcggggccugggccaccugccucugagacacuccagcagcauuuagcaaaaaguagcuggaaguugggauggaauggggaauccagaguuauggguugcaaggcagaguguaggaguugugaaggguuaauuaugaaucuagaagagagugggaaaucgguguucugggccagggaacuggacauuugaaucugcagaucagcagaggcugggugaggggcuuucagggaggaucucaguucacucagggcuggagaucuucgaagcacauccuaauguugacgucugccuguuaugaagcaggugagaaaacagcaaagcccagggcagaaaggaagugagacugagguguugaaagcugauugaaauugcuagugaaaaugguggagacaguaggcagaaaaaaagaugacucagcccuugaagucuucuaggaaaguaggguaaguccaggagcaaaacuuagcauuuaaaaaaggccugcuguguuuucacauuuaaucuuuacagcuaccuccccccacaaacccccaccauaauaggcugccuugcuuccuuuuuauggauugggaagucucugaggcuccaaggagaaacugcuuugcccagguguacagcuaguuaguaggcagcggacugagaugugugcuccguucugucugacugcaggugagccuuguggcaggaaggccggcacagagacucugcucugcuucuuuccaagcauuucucucauuaaaaagacagaggaacaagcauuucggaacccgcaaagagagugcugauagacagugacuuucguuuaccuagcacaucuggagcucgcgcugggugccuucauaguuguuagcucauuuggucuucacggcaacccugauauuugcauuuuacaguuacauguucaaagagguuuacuaauuuugacuggggccugauagcuaauaagugaguaaaacccgagauuggaacccaccuuuggaaacugugucugcuuauauuuucagaucuaccugugaggucgguggcugguugguuuacccuguuuaacagaugaggaaacugaggcauaagaaagcaaguggcuuaucccagguuguacuaaacaguggcugggcucagacuagaacucagguuuccccagggcuagccuugggcuccugauggcagaggagaagugaaaugguaagucagggcaucagggacaaaggaggcuggcccuggguggcagaccuuggaagugaucguaccugacucccaggaagaaugaaugguaaggguaaauacacccuaacugggauuagaggcugugggggcuguauuggugguguauggcaauuugugcugaccugauucccuccagacuuauguguuguugcuggggucagggaaacuuggccuccucccaggaggguuaggguauggcauuuacagcuccuuuguuuuuucuucacacuuaucucacuggcuguguuugcaguuucagcuuccagcggcuggaagaaggaacccuguugagcugagacuagcucuggggugaggggugcagaaagagacagaacuuguggaucucgguuuucuagaaguaaaaauuuuagcaugugggagcucaggaauguacuuggaaauguuuccaauuuauuuuuauugcaaagcaauaucuaaugaaaaugugggagaagacccaggagccugcaaauaauaaauugccugcuuucauuuucugugucuccuuuuaaaaaucuuuguccuuacauaagcaauuuuauacaauuguaacuguaauguugguucacuguguaucaacaauacuguauccugcuuuuaaaauucaucauuauaagaguuucuauucuuuauaaugaucauuuuaaacauaugugauacuuuucugguggaugaaccauguuuuccuuaccuauuccuguauucugggggcauucagauuguuucuagcauuuuauuauuuauagacaaugagaccacaauaauuuuucuuuaaaaaagaaaucaguucccucagauaaauucccagaaauucggauccuagaucaaaaagauugaagaucuuuuuuuuuuuuaauugacuuuuggaaauuaugaccaaaucccuuaaaagcaacuucgcuggguauuguuuuuuuaaccagcaaacuggcaguggggggcugggcauuguguggagggucgcagauguggaaagccaccuccuaaagccagugagcaggggucaggucauccugaggacguggacaagugccucccauuuuccugcugcugugguagggguucagcuugcucagcgccuauccugucucccucccagacaccugggaaaacugguugcugcauggguggagcauuuacaguucaguugcuucacccucacucgcuuguuccaugauagagaccccagagaggagguguggcuuugucauuuaucuuucagccccauuaagguuggcucugaagauuaaugucuuuuuuuuucccccucuuucccagaauuuguuccuguugaagaguggcuccucuucuaauuuccagacuccuugagguuuuaggagucugguaggugaaauuuucuaccucuaaggagaaacaguaccugcuccuuccucaagcgcaagcccuccauugcuauggauaccgaauccacuuauucuggauauucuuacuauucaagucauucgaaaaaaucucacagacaaggguauguaaguuguucauuauuacacuuuuccuuuuggggaaaccuacagguuggugggguucucuacacucacuuuucagugacucagcgcuggacauuuggucgguuggugcaugagaagcugagcuuuaagagcauuuaacauucuugggaguaacuacgucaccaguuuacauuuuauagccaccauuagaguugaugacuuuaguuucucacaauugguuuuaaauuaaaguuucuuccugcaguggaaauguuuuucauuucuagguauuucuuuuuuuuuuuuugagacggagucucguucugucacccaggcuggaaugcaguggugccaucucggcucacugcaagcuccgccuuguggguucacgccacucuccugccucagccucccgaguagcugagacuacaggcgcccaccaccacgccuggcuaauuuuuguauuuuuaguagagacgggguuucaccuuguuggccaggauggucucgaucugaccuugugauccgcccgccucgguuucuagguauuucuuauagguaucggcucuccugaaagcuuuaugaagaauguaaauggaagauuuaaaaaguguucauugcuuguugcuuuucaccugaaguuguugacucauuguccauuaugccuuugucaugaggcuuauuuagugaacugguaggauuguccuggcaccuuauucuuuuugacuaaucuucaggugaacaaguuuggguuuugaaaacacuguccugagugauauuggucaaacuuccccuucucugcaaaauuagcaggugugcacugguauucuuagggccugcuguguuacugaccuguagaauguuuguuaaguagaagagcaaaugaaugaauaaagaaaucagugaacagauagguggcacuguaccaguuagaauuguacuuggugaaauugcagugcugcuguuuacuuagccuugucaucuguaaaauggguacagcaguccucuccuacagggcuguugagaggauuaaaugagauuaugcaugugaagcauguaacacaguacaggcuggaggucagucaacaguggcuaaaguaaugcuguaauggccuuggcauuucagcacuauguuccaagguaucaacuggccccagcccaaaugcccagcucugcacuggcuugggaauagugauuguagugguuuuucccugacugcgcucuuccccauacaagcagccgaaugcagagugagauuuuguucuguaaaacagcagugagcuacauauaucuaauuauuuacaagcccaucuggauuacuaacguagaaagagguuugggagggugaccucccaagcugccaggaguggucauccauagggggaggcucggcagaagcuggagaaugauggaaauuuucauuuaucuuuuuguacuuguucaauuuuuuuuacaaguguauauuuuguaauuuuuagaaaugaauggaauauaguauaaggauagguucucaaagauguuugaugacuugaggaaacguucaugagaccauguuaaaagaaacaggauucaaaauguuguaugcugugauaguuacauagacauaugaugaguauucacauagugacuaugccugucucugaguguaggauuauggucguauuuucuuuuuaacuuuaauuguuuucuaaauuuuuauguauugcucuuaucaaaauuuggggaaaacaugucagcgagcuugugcuggaguccagguaaggcuuucaaauaaggaugagaaacagaaggagcucggggcaggugcugcuggacggggccuguggugacauggcagagcccagcuccugagacagucacaaacccucuggccauaagaauugaaucacacauuucagcugguggguaaacuuaccagauuuaguuaugaaauaccagaaacagcuguuuuaaaauaccaauuuuguuuagcacuaccaauucccuugucaauaccaggcuucccucauccacaccacaaugacagaaguaggaauuugggauucccugggugcuuggggaugaacaaagcagguuggcuuugcaguauccuuugugggaaccaucucugggcucuuuugucuacacucgaguucugacuuucacgcuucggggcccauugcuacgcucugcuauuuccuuaggccucuuggggccuccagaaauugauauuccaaugcccuuguaguaacuuuaagagacuguaacuuccaauuaaaacaacacgcagaauuuuuaaugcauucuuggacccauauagaaaguacuuggcaaauguuaauacaagcugagucuuuuaaucaauuauucaaaaaauguuccuggauaucuacucugagaaaagcucugagagaggagaugaaccuuagagauuuguaggugcacuccauggguucuuuaaaaaacaccacuaccaccuacgggugguggauucuccaacugacugcagcauagggcacagcaacuguggggugagaggcaccaucccuagagagcacgggcugugguguacuuugcuggggccuaaaggauguuaagcaguaggguugccccccacaggcaugagagcaggccccaggcccagcuaaggguauuuuguccaaggaguguuccugugaaggcugcccugcucagagguuuguugggaacuugaauggaaggguaggaggcggguugggguuggagggggaccaugcucuuugguaauuuuagucagaguccaacucagggaggaauaaugaaaugcaccaaacuugauaugccugaugacaccaugaucaucuuagaagacuggccagguuccaagcagaugacaagugacuguuuucuaacaaagaggucaguggccugguuuugcgaugccugcagucuccagaggguguccaguuaacuugcugggagaaugguguggacuccugcugaccccgccuaacuuuugucauugugguguggaugagggaagccugguauugacaagggaauugguagggcuaaaaaaaaaaaaaaaaaaaaaaaauugguauuuuaaaacagcuguuucugguauuucauaacuaaaucugaucaguuuacccaccagcugaaaugugugauucaauucuuauggccagaggguuugugacugucucaggagcugggcucugccaugucaccacaggccccguccagcagcaccugccccgagcuccuucuguuucucauccuuauuugaaguuggguuuggagcacaaguucccuaauuuaaacagagcagcugccaguuauguuaacugcuuugggggugucugcuaggccccucccucauagccauugucuccuauucucacagcaguccuagaauggcgggaggucauagccccauuuuacgggugaugaaaucgaggcacagagggcaguguuauuugccuaaaauuacaaaguuaguaggugcccucagcagauuuugggccaaccuuguuucuuuagaagagaaaugcuacuuuaggaaagggaaacgaagggugacucaugugauugaugugcuaaaaugcacaaaaagagggccgccggggcagugaggaauuggugcuuuuguuucaaggcugcuucagagucuguguguccugcgcccagcgcuccuaccccagccauagccaagaggaagcagccagccgggccccagcagccagcagagagaaaggacgggucguggguugugggagagaaggaaagggaggaguaaccgguggggccagcuuuccccaaauagaaauaggcaaacaacagaaacaggacuaaauaaucuucccaggaaaugcugacuguaagugagaacagugagaauuacagggguucuagcuggaacgaggagggugacagcaacccccaagggcuuagcucuagaaccaccuaaacagaugcauuugcucacacacguguggugcagacacaugcccgggcugccugcaugccaccacuugcucuuccugccccucacacaacacgcacagauauacuuaucuuuacucauacaggcagauguugcguggagacaaauucagagauaaagauacgaagaaaaacucucguagcugacacagccacccagcaaaggcacagaggugauccagaccacugaggcagaguuggaaaaacacacauguauacauguguuuguaacaccucucccuguggcuuggcagucuguuuacucuccuggucucccauuuccauacucuuagaugccgugaacagauugucuucaucauuggggaacccucucccagacagcacuuggcagccauagguuuucccuggaguuguggcaucuggaacuacagggaugagcauuugaguacauauuacagugagguggccacacugugacccgcaguucugcagacuggaaggcacugaaugccaggauuuuugcagagugucacuaugaaguccugacuuggcucagagaccuucuuagagcaguaauucgggaccaguggauuucugauaaaguuauucuaauuuucuaauaauuguuuucuaauaaaagccauauggcagguccugcucccuugguagcaugaccaguaccuggcgcagugcuagugcugagcugacaggaagugccucaccuucaucucucacuugacaguggguggaagguucuuggcucgguaucccucagucaugacugcacacuguccugagcuuuucucccaacuucauccacuucauacuauuuuaauaaagcggugcuguguauuauaacauugugcagcugagcauuacacucauggcucccauuaucaagccccugcuauauacagggcauuucacaaagaagcaaacuuccaagcagucacucagcaaccuccuccuaggagcauuuggggaagagaaucuuggggcaaguuuccuuuaccaccugcagucaccugggaugcugggaaaaauuuugauuucuguugucucccuuccagaaaauuauuugagaguggggccaacaaaucugcacuugaguccauaccuaggauaguuuuucugugcaguuuuuuaaguuuaagagguuuuuaaaguuuaagacacacugguuaggguuuugggcucuggaggaugagaaaccuugcuuggguuaucagauaacagauucuucucugguuucccuccgauguuaucaggggaauuguugguuguuucacauuugggugcuccugggccuuuuaagagccaggcugggagggcuggugauggcaacccuggcuggcaacagaggcuguuuccaccccuggguggcuccccaccugcuuucugcccugguaggguucaggcuccgggaauuggcacucagugaaagaauuuugauuuccaguggaauuugugcugucacaagauuugacccaugggacuagugaauagauagauggguuaggugagcaugugacuuggcugguggccgagagagugauaaaugugagaguagcuggggaaaauggaaacggauuaagauagaagaggggcauuguccaucuggccgauggcagggcugguggagcagcaguucuagacuauucugagguuaguucagaaacugaccuaacaacgugggaagucucucccaaauuguuuauaguuucucacagugggugccuuuugaagugauuguauuugacagcccagaguguugggcacacagcuuugugcuaucuaaggucacgguccaauugugauuccuagcaauagcuucaaggcauauuucauagcucuaauaguuuucaaguauaagggugugagaaugagcuuuaagaauauuuaugccaugaaaucuuccaauugcucuucaacacggugcaccauaguaggugugaauagaagugguggcaacagaccugaauucaggucugccacugacuauaauacuagcuugagaaguaacuugaacucugugagccucaguuuccuugucuguagaaugaagacaaugauacugccuucauaggauuauuauuaggauuaaaugaaauauuauagugaggcauucagcaaaguguucuauaaauugggguaggaugugagguaauuggcauuguuagaugcgucucuggguaaacaaccaaauuuucugcuuauuuggcuguuucccuagcugccuuguuaaaacaaaacaccugaguugaccagaacaccucuguuuuuagaaucuaacuuugcaguuguauuagucucuucuugcauugccauaaagaaauaccugacaccuucauaaagaaaugagguuuaacuggcucacgguccugcaggcuuuacaggaagcaugguacugacaucuacuuggcuucuagagaggccucaggaagcuuacagucauggcagaaagugaagcaguagcaggcacaucacauggugaaagcgggagcaagagagacaguugggagaggaggcgccacacacuuuuaaacaaccagaucucccaagaacucacucacuaucgugaagauagcaccaagccaugaggggucuguccccaugauccagacaccucucaccaggccccaccuccagcacuggggauuacaauugagcaugagauuuggguagggacaacuaucugaacuguaucagcaauagagugugauuauaaguuaugcuguaggaauagaauuguugucacugaaagauucccuuggccaugggagccuccuggcucuaugaaggaaucagccaaugcuuaucccagggagguaaugauaaggucgaaguuugacaagaaaucuacguuuucuuaagcuaaguaguagguuaacagaagauauguuguguguuaauaguucuauuuacaucucuuucuccaagguuauacacacucugcaucacuaagucaagacaccauucuuugacacuggcuaauaguaauagcaaucauagccacugugcauuagcacuuacuccacauccuuguacugagcacuacuuacauuaugugguguugucauugucaccauuucauacauaaagaaaccaagguuuucagagauugaauaacuugugcaagaucacacaucugguagggcagauccaagaucuguuugucuccaaaaucugcuucuguccugccugggagaccuugggaaugacggcaagugguuguaggaaggagggcugaugucaagguggcugugggggcaggaggcugagggaacucacugacccuugagggacuccuuaggugggggauucuggguuuccuguuggcagcuggagggggagugccaguucccauaagugguuauugcccagguugugaccuuggcuuggccagugauugguucauuuuggaauuucaugagugacccccaggcaggguucuuacaaucacgcuggaagaccacccaggaaguuccugugggguaaaaugaugcagcagccugcuuuccucaggaggucugaaacccuccccauguacacacacacacacacacaaacacacacacauccacccacacacccuccaccccucuuggugucuuuggccuuuuuuccuagcuuguuuguuucuaugggugucuucaaguucaacuagaaccuaugggaaugacuuaguuuugaaccuguaagaaugagaaguaaacaauucuuuguacugacuuugaauuuccuuucuucuguuguccaaaggugaagggugacaaugugucccagauuuuuuuggauauucuacaaaaaaauagauauuuuuuuguagaaaaaagcuuauucuacaguguugucccaauuuuaaaagcccuagaaaacugguuaaggcaaauuauaaccaaaucaaaucacuaauuauuacaauaaaguguaacuagcuacaaaaauccuaaaauuacaauuuuaggcuuugagaaaauaucacugaugauagaggaagagugacagucuuuguuuugggucuugggauggcagaaagaaaauauuuaguagggaguaaagaucaguguaccccuugaaguguggugaagauggguggguuuugaugcucuguguguguguguguguguguguguguguguguguauguagaauuucccuaaauucaaaaugauacuuacauuuugauaaacccagagaguuaauuaacauggcauaaaugugcuagcucauuguuguuuuucagggaaagaacuagagagagacacaagucaccccggaauaaagacggcagagggucagaaaagucugucaccauucaaccucccacuggagagccccuguugggaaaugauucuacucggacagaggaaguucagguaaggaucaaagguggucuguaagcacacugccacuuggccaagacuccugucuguaaauguuuuccuuagguucucuuggauuuuugucuuuauuuuucuagcaugcuaauuaguuuaucuaugucccauggucucuuguuggucuaaggacagccuguccugcccuuugguagcguggggauucuucugaaguaugauugguuggccugcuuuacaugguguggaaaaguagccagcaagguugacgacaggguugggaagggaaaagcugaagucucccacgacucauuucaaaauggaacaguauaagggggagaaggaaacucagaaaaccuaagaaguuuaaaaaacauggggcagcccagacugaccauuacuacuagagcuaugcaggaauugagaggccgcacgcucagaugccugguagagaaacguaaguuaauuaaggaggcccugggucgaaaagagggggcaaaaauauauuaaccuagcuuuggguuaacagcaaucugugcagugccucagugucagugcuguaguguggugugaaggagccuauggcuaacuggagaaugcauuuccucuguaaaggaaacagcagcuccgcagcuccagacaccuacuguugcucaggaaugcagggauucauuguuugagaaaagcugcaaaucaggauuuuauguggaauccuaacuuuacaguauuuuugaaauacugauacuuuauuaauuuuuuugaaccauugaguggguucuucuccagguuccaacugucuggcagcccaccugauuuaaauaaacaucugagcuauacacagaaacaugucugcauacccucugcacauccugaaguauauauacacauguccagccuugccccucauaaacaaagugguguaugauacacagcuguaaagauagauauaggacuauagauaagcauacaucuguacauaccugugcauacacacagguaagcauuuauaaucaaauagguggacugaaacuggaauuccucagaguacacaagguguucuugggacacaaaacuacaauuguggguugaacgugggauucauugagcaaugagcaaaugccuuuagugcugccugccuuggcucugggauggcugauggucggauggggccagucuuaggauuggaucacccuggaguacuugaaggggucaguuuccuccuggauguggguucagaggugccaguggccuacagcaaaggcucuucuuucucugcaucuccucugcaccucguagcugagaacacuuugagaagcucuugguguugccccaggaugaucuggugugaaaagcauugagauggguguuuggaggcuguauuuuuuaguagcucuguuaccuugagcagucacagccuuuguaggccucaauuucuuuauugaaaaucuagggguuuugaugaaagcaucuuaggugcuuuuucuucuaagaaccugaagcuuaacaggauccuuuguguaucuacauguuuuaggcauacaugugcaccccaggaaauucucucaugcccuuucuagucaaucucugccccacccucaccucuccaaggcaaccacuguguugauuucuaucacuguagaucaauuuugccuguuuuugaauuuaguauaauuagaaucauaugguccaucuccugcccccacccacccgcccugcuuagcauaaugauuuugagauuuauccauguuuugguauguuucaacagcuuauucuuuuuauuuuugcugaguaguauuccauuguaucagucuaccacaauuuguuauccauucuccuaguggauggacauuuggguuuuuuuuguuguuguuuguuuguuuuuugaggcagagucuuguucugucgcccaggcuggagugcagcggcaugauaucaccucacugcagccucuaccucccggguucaagcgauucuccugccucagccucccgaauagccgggauuacaggcacgcaccaccacgcccagcuaauuuuuguauuuucaguagagaugggcuuucaccauguuggccaggcuggucucgaacuccugaccucaggugauuugccugccuuggccucccaaagugcuaggauuacaggcgugagccaccgugccuggcuggauguauauuuuuauuaauuuuuggauaaaaccugagaguggaauugcugggccauauagcuaaguguauauuuagauuuauaugaaaccgccagagugguuuuccagaggcacuguaccacgguccacuuccaccagcaguguuggagaguccuggcugcuucuggccaucgucugaaauaggaauuucucucacuguaggugauacuucugacuuugcaaguugaaggauuauuaguuuaugggauugagaccuucaccaccaccgcuucuuaccauagcccauacauuucauaaaucaugguuuuuuuggucauuacuagauucggaguuauuugaugaugagcgaugucugucuugcugauuuagcuacuaacugaaacuagcuuuuucuaaguugguguccuaauuucacccccuuugccacugcaucugacuguuuucuuuccgagugaaaggauacauacaaauuucagaggcagaaaccucuuuggccuccugugucuuuucagcgccuugcucuuauugcuucauuauuguugccaguuguuuuuaaacaacaaaauccuuuaaaauucuaucaacuggguuuugcuaagugaauagacuaauugcuuuaacuagcaacggccuagaaguuuaaaaagagaggaagcuagaaaguaaaagauaacauuuuaauaauccugguuguuucuaugcccuugauguuuaguuccucgugaaaacauguuuuagaaagaauuuuuaagccaaucuggccauacacggauuccuggauuugcuuagcuugguccaugagaaauauuguuaaagagugcuugacacugaugcuuguuaaguggaucuugugaacaucauaaggagauuuuuuuuuuuuuuuuuugagacggagucucacucuguagcccaggcuggaguacaguggcacgaucucagcucacugcaaccuccgacucccggguucaagcgauucuccugccucagccuccugaguagcugggauuacaggcaugugccaccacgccuugcuaauuuuuguauuuuuaguagagacgggguuucaccauguuggccaggauguucuugaucuccugaccuccugauccguccgccucggccuuccaaaguacggggauuacaggugugagccaccgcgccccaguccauaaagagauuuuaaaauguggguccuagcuacagguaagcuuggguuuguguagugguguaaguucccuugcuacgcccuuugcucuucugggcugcuagaggguguaguaauacucccaccuccaaaaguuggacuucguaagccuuuauaacccagcgugaauuggaaagaagaugcaggagguuuaucucuauagaugagcucucacaagauuagucuaauaccuggguugcgcauugcagggcaaacagcuccaggcccucagagcugcucaaggcuuuucaacccaggggaugauaaucaauguuaugucaaugaaucagccaaacagacagaaagaucacauuauguuuucucuguuugaaaagguaaauaccucauacauuuugaaaauuucaaugaaaaucguuugaguuaagaaguucuaauauuuaaagaguuaagcuuucauuuucuggaagccuuugugaauagggcuggguagaugcagcgggcccugcauguucacugcccuuuguagcuuuuacaaaugaccugugucaugucauccucacugucuucuccccaccaggaugacaacuggggagagaccaccacggccaucacaggcaccucggagcacagcauaucccaagaggacauugccaggaucagcaaggacauggaggacagcguggggcuggauugcaaacgcuaccugggccucaccgucgccucuuuucuuggacuucuaguuuuccucaccccuauugccuucauccuuuuaccuccgauccuguggagggaugagcuggagccuuguggcacaauuugugaggggcucuuuaucuccauggcauucaaacuccucauucugcucauagggaccugggcacuuuuuuuccgcaagcggagagcugacaugccacggguguuuguguuucgugcccuuuuguugguccucaucuuucucuuugugguuuccuauuggcuuuuuuacgggguccgcauuuuggacucucgggaccggaauuaccagggcauugugcaauaugcagucucccuuguggaugcccuccucuucauccauuaccuggccaucguccugcuggagcucaggcagcugcagcccauguucacgcugcaggugguccgcuccaccgauggcgagucccgcuucuacagccugggacaccugagguaagaggcaacauccaggaggcagaaaggauggcugaugucuugcugggagacagcugcucuguagcacgugagggguggugacagaugccaagagcuaggaccagagucugacucuuuucugguuuggggaggagaugcgaggguggggaggguguccauguucauugaguuucuggacuucuagauggugcggggcaguugcuggcucucacccagguugagauuuugcugggcuuguucucaaaguuauuggcagcucccaaaaaugauggagaaaggagaugcauagugauggcugccuucuuugacucugaaauuggccaauggacaacagauaaagugaccagcagcuccauuuugucccaaaugugacaucugguuuaccauguugucccaguggaauaaugaauuguuccuuuuuucccacucucagaggccugguuugggcaguaaauuauauggucauccgagggacccuccaauaaagaaucaagugcagguuagagacuccaaauguguaauccuugaguguugugaaaauguaugcgugagaaaaaguuagaagucaguuggguugucauacuuacaucucugcauaaaaucucauuauuuugugguuaaauaagagugauuaccaucauuuuauuugcuucaagguaagcacuuuauauauagauuguguauuuagucuucauagaaccccgugaccuagguauuauuaaucccugugucacagaugaagaaacuagggcuuaggggauuuaaguaauuugcacaaaaacauauggcuagccucauuuaggauucacucagaugucaugaggccagggcugagugaaugcccccauaauggcaucucucacuuugugguuaguggccuauuuuuccaucuguuuucuuccacagacuaugaacucccugaggccaggggccacccuuauaccucauuacauccucagugccuggcauggagcauggcuugcacugagauguucucugggugaaugcagagccugggacauuugacuucaaagccuuuacccucucccaggcucucugccuccuuaggcaguauaugcugauguguguagccugcuuggggcaggguaggcacuuaguucauugcagcuauuacugcugugaucauguagcuggcagagcagccagaaucagcaagggcacaccuuaguggguaucagaacaaucggcuuugucauagauuuggcugggcuccaggaagguggcucagccuguauuuggagucaggccaugcugccaaaccaucuucauguugguguguacccuccuccauuccucuggcuuggcuugugcuacgagaacgggaugaucuagcguucaagguugcugccacccuaacugauccuugguggaaacugguguccaagucacaugucugugcaccaaaaaucugggguuuagaguccuucacagaugccuguagggcucugaagacaaguaggucaccgcuuugcugcauauucaucucagaaggcuuucuuuucccauguuuugcaucagggaaugaccagcaguuuuguguuaaacaucugcugugugcagagcccuggacacaccaggcuggcugccuucagagcucuaucucagcaccuguggcacucacagucacuuggaaagagaccagugcaccgcugucugguggacaggugcagaaacaggccuggggguauaggugauaggaacacaggaggacagagaauuucagauuguggcagcaauaaagccgagcaggagacagucugucucagaacagguuuugcugcaguuaaagugguagagaaaaauccggcuguggucucaguggagaugagugauauuuggaacucuguauauguaaguagccaagacacuggccaggagugaggucuauggugguuuuguuuuuuggcccuuagcccuaguuggugugaauuccaccuguguaggugggaaagggcagggcaucuucucaccauaggucaugcaggguggugggaccgacuuacccccaugggcucccacaucgcuccucccuguacgacugguugagcugcacacugcaucugagugggaguggagaggggacaaaccaaacagcccgaggaaaguaugccuguggcguguucagaaagcaugauuagcagcagcccucgccucccaccacacagcucugcuggucagggcagagcuggaugggagaagccagacugauugugcugcauggcucccaggcuugcugcaaaccuuucagucugcucuuaccaugaccaacaacuguccaggcuuuaaaaaacucaagucagucaccccagcuccccagggagaacugaaagguggcaagugcccaucugcccuggggagagcguuuugaggugguccccagccucauccuuucggcuucuuuuuaggaccauugguguuccuccucucccugccuuuaauaaggcccccuuugucccucucguggagagccugaguuaggagguggaaagaauggcuggggaaagagggacaucuuuacugacaaauggagcccucagggagagccagaugcccaagugucagccagucugccagagcuggagcaggcuuggcaccuuuccuccuggcauugugugggccuggucaccugccgauccuugggcuaaaucuggucugaacccagcaguggcuggaagaguuacuaggccagaaauacaacuucuaaggccuuuuguaaaguguagaaacagacaggagggaagagggagcgggaauagacaaagcaagccucggaaaucagaauagcaggucuccauuagacccagcagaaucacaggcuguuggcucucccuuuauguaaagccuucaccguggcagcacccuauugggcuuaggugccaagcgauggugaguucuuuuuuauguuuucaaagaugauuuuaucgaauugacugagcuauuuuugagaguugucuaaagaaugucuacucuuuaguuucuuaaagaaaauaggcuucucauuaguucauaaaaggugcuugcuguggcccugcuuguuggcaggaaugaaguuuugggcuuauuugaaaacuuucaaaaauguaaaaaguuguugcagaaaguaagauaccauaaauagauugagauacuuccuaaccucugcccagugcccuaggaguuaugaaaagcuuuucauagguuuggacucauuuaccccuccuugcugcccugucagaggucagagcaggugggguagagguguccccucuuacaguugagguccccaacccccaggguaagggaccugcucaaggucacagggaaucagcaccuuccugugcaucacaccgcuuaccccaccgcacuuucuacagcguccuggugucucacacagucgcuuugucauuuuccauacacaccuugcucgucacuuuucuuggccccguucucacaauaaguugcuaacuuuuccaggauguuaccagagacuaaugacuguugauaugacuuuauuugaggagaaacccagaagaauagaagagccuaaaaauuggcauucaauuaucuuaaucauuuuucaguuuugaaaccucuaaagggaaauaagugugaauacuggugcacaggcacuaguguaauugacugguugaaugugaaaugguagaacaacagagacagauaaagaaaaccuuaacaauaaacaauuacauagucuuacugggagccagguaccuucugaucuuuuaaugugcaacucaguuuucacaacaaucaugugagguagguucugguagccuccuuuucagaugagcaaaccgaggcgugggagaguuagguaagucuaaggccccacacuuuguaauugugggaaccaggauuugagcccaggcucucugguuccagaaugaucuuacccauuucaccauacuaccucugaauagauaguugcauguucacgucacugcuuuaggaacacaugaacaaacccagaagcauuuuuugaguguuucccaugugccagccucggugccagauauuuuuguauacauuauccuguuucacuuaacacagagcuuagggcuggaacagagagaaugugcaggauugucaagauggcuugcacucugagguccauuccuuagcuccacugguuauuuuauucacucaguugacaaagccugguccuuaaagucauagcaguagguuugagccuuuggucagaccuuuuuaacuuccuauacuucacaugucucaaagaaaauauauuuuaucuauuguuguguaacaacuaccucaccacuuaguaguuuaaaacaaccaauucaguauuucucacaauucugcagcauggauugggcucagccaggagguucuuuagcugauccugcccaugguccugugugauuauacucacauggugagucagcugaggcugacuuuuuuuuccuguguauucucuccuccuucuuuuccuguauauucucuccuucucauggccucuccuuguuguuuccucauuaggguugcuagacuucuuaaauggcagcucagggcucccaggagcacaaaagcagaagcucccaggccuuuuaaggucugggccuggaacugucccaguaguauuuccacugcauucucuuggugaaagcaagccacagcccuaucccacauuuaaggagagaggacgacacaagacagaggcuacuaggauguuaaguucaaugucacagacccccacaaccaccucgggcugucuuucucagagucuguuuauucucauuuugcauauaguucuaacaaauuuaauuauugauuucuacaucuuaaaaagcccagaaguaauauauuuugaggggaaaaagugcugcuuuaaggagguauaugaacaucaaugaaaaaugauagcugauagucaucaacaaggagggagacagagaaaccacaaaagcagguaugacucagcacucugggaagcuuuccacagugacccauucuauaggauauuuauauugcugaagcucccuuguaccuaauucagccagcagguuuuaacuguuuggguuuuuaagcuucagggucaaaguuuugggguaaaaaaugcuucauucauugagacugagagagaguagcuuauaaauugacacugaccauagaccuugauuuuguguccccacccaaaucucaucuugaauuauagcucccauaauucccacauguugugggagggacccagugggaguucauugaaucacgggggcgauuucccccauacuguuccugugguagugaguaagucucacaagaucugaucguuuuauaagaggaaaccuuauaaaagguggcucucauuuucuucguugucuguaagaugugccauguaagaugugccuuuugccuucugccaugauugugaggccuccccagccacauggaacugugaguccauuaaaccucuuuuucuauauaaauuacccagucuuggguaugucuuuaucagcagcauaaaaauggacuaauacagaucuuuuaaucaaagaugugguaacgaaucacagaaccaccugugcuuuagaagaaaugauccuuggauugcuuuucaagcaauggaaguuuaugauugucacauugucaauugugauuauauucaaggaaguguuauggacugaauguuugugguccccccaaauucauauguggaagcccuaaccuccaguguggcauauuuggagauggagccccuaaggaaguaauugagguuaaauguagucauaguguggggcccugaucccauaggacuggcauccuuacaagaacagauaccagagagcuugcucugucucugcacacacccuuagaaaaggcugugugaggccccagaaagaagguggccaucuguaagcccagaagagagcccucaauaggaaccagguuggcuagaacguugaucuuggacccccaaccuccagaacuguaagaaaauaaauuucuguuguuuaagcuaccuaggcuguagcauuuugauacagcagccugagcugagacaggaauauuacauacacuggagacuugugaccccaaagacuuuugaccuguugaauagagcucaucuuguccucucuccagcucaugcaugcauccucccagcuugcaagggggccuugcuucucuggauugcacuuugauuuucuaguuuuaagugacaaagggagagucuucuagggauguuaaaguuacuccaguaauuccaggauauuuccagcuccuuuugaaaucuuauguuuguaauucugggucaaguaauguccaagccagugauuacauuacugguaggcaugucucucaugcugggccacgcccuccaucccauguucacgaugagcaccaacggucucugagagcccagagccaguggcugcaacguugggaaaauucuuaaaugaccaucagugguuuuggcucauguuccuacgauuguggguucauauaccaucucauuuuuagaaauguguguuuuuguacuccuguaauuacuuuuuaauaaagauauuuugccaguccuuagcuccacuccauagcaaagcaaaggacaagaacaaguaagggcugaaacauagagcguggaggguuuugcucaggccaugcuuugcugugggagaauuuugaaggcgggaguggagcugccguuugugguuuggugcuguggugccuguuaaaaguggcuuuaaugagaguguaaggugcugcacacugaagcccuguguuuauucagcugccuccugccagcggcuacagcugggauggcuucccucgcacggcgucugcccacagccuugcgcccggagcccagaggacucacaggaaaaggagcuggcaaaggugaagcugguuuucauggucuccugagggccccuggccccugggagaugggucacacucccugaaugcugugcuguugguuucccuggaggauucuugcugcaggccaggucccguauucuccacacucaccacaaguggcugggugugacuugacacggugugaaaguggaggggcgcgagcacucaggugggugaacagccugcggccuccuuucccuggcugcaaagccgccacucaacucugcuccagcccagguuucggggagccgggauccacuugggcaggccgggagccucagacuccagacuuuucauggugcgcuccuuccugcuuacucaggaggaaggcgaggcaguccagcauccuggguggaguggagguguuucgaguccauaucuaaaucuuuuucuuagagcacccuaagcaggcugcugucuuugauccccaugccucugcuguuuaucuuggugugauucaucacuguaauuuaagacguggagagagcaaaguucccaucccaggcaggggaggcgcagugcagguuggacuguguaaggaaauggcagcauggcgagguuugugccgcggccuacaagcagggcugcaugcuccccaggcagacuguggcagagccaagccccucacuuguagggaagcgugucuccuaggugccccaguaggggaggucugccagcaucgcugugcuguggggaaggcagccagagggcuucauccauaacuggcucagcuccucaggaggagaccagcagugugucucugcacucagaacugccacugggucgugguguuaagcccaggaggggugcauauguugacaaccuuguauugcuuaguugcugagaccagaagauccagguaauugcaugagcuauuagcuacuucugguucucacaaacuccucccaguguugauagagaaugguguccuccgggcaugcucuggguauaguuuuauuuguauuauuagggacucauggagaagugcucuggguguccugcacacugcacuuuggagaucauucugugauucccaaguccugcugauuccacuuccuuggcgcucugggauuagauauccuaggcugccaaucugcauguucaucuuucaguggggauacccugcagggcuuguccacagcuugaauuucaaaccaaaagccagguacgcuuuccagccuuccgauauugguucaaagaauuuggcugccgaagcuuuuguguagcugaggcaccagcaggcccgaggcacgagugaauccagguggcccgaggaagagccuucccaugggccucagcagccacacagagccucugaucuguuucccuuugcgggauggucagucuccugugucucaagaccucaagcagaaaccuguggaucucccccucuaucuugaaaguccaaccaaguccaggccuuuguugugcaguuuaaaccagaccugucaguaaacaugagcuaauuccaguuuuugucccucuuuguccuucucaaguuccaaggugaucauugccuguuaucuaugggacuuguguaagcuaacuucccaaaugcagcugugagacaaacauuuuaauuaaaaggcagaagggccaggagauauaaacacucaugugccugguugucagugaaggcgguggcguucagcguccaggggcuaauuauauucucuucucugggacucacacaaauauugccacaaauguaccugacugucagacugaagucauuuaucuccaaguguggggagcagugaagcccacacguccagguagauuuagcucuuacggacucuucugggaagcagcagguggguaaaacugaaagcaucagcuauugcacccuagcugcagguuuucacagaaagcugaaucaacuuguauuggggauucugcauuuuagaguucucucaaagaccuagguuugggcccuaaaaugcagccaccagagcaggcacaccuuaaaaaguagguaaugaguggccuuagugccugggcagccgucaguacuggccuccuuugguugucccuguccacugacccuccuuccucccguucucucacguuugcauucaucugcagccuccauuaccauugaccagcuuugccgcuuaccugccuccacccuuccuucccuaaguucgaguaguuuccuaaguagcuuccccuuaguuuccuaaggcugaaguaauagaguauagcacaaacuggauggcuuaaaaguucuccuucucagaaaguacaaaaucuagguguuggcacagcugugcuccccgcaaagccucuagggaagaauccuuccuugccucuuccuaguuucugguggcugcuggcaacccuucguguuccuuuauggcugugucacuccaguuucugcccccaucauuacaugaccuccucucugugggucucuguauguccucuuuuuuuuuuuuuuuuuuuuuuugagacagagucuuacucuuucgcccaggcuggagugccuuagugcgaucucagcucucugcaaccucugucucccagguucaagcaauucuccugccucagccucccuaguagcugggauuacagaugcaugccaccacacccagcugcuuuuuguauuuuuaguagagaugggguuucacuuuguuggucaggcuggucuugaacuccugaccucaaaugaucugccugugucggccucccaaagugcugggauuacaggcaugagccaaagaggccuggccaccucuuuucuuauacggauaccagaaugacucuaccuuaacuaaacauaacaucugcaaagacccuguguccaaauaaggucacauucugaaguucuggguagaugcaaauuuugggagacacuauuugccacuacggguuucuccaaguugugcuguccugugacugaacacugacccuguugcucuauuguggauguuugggaggauuaacaccagccuguuucugcucacacugcuuucucugccuggaauuugcuuuacagccuguugucccuggugugaccaucauucaucuuguaagacuuaacagcccagcuuugcccccacuguggauuccuggcggaaacaccgucccucuucuccugguguacauguucugucacggucucuggaucacuugacuguacuuauuguuugagugguacucaccacuaauuggagcauaagccccuugaagguuucauuuacauccgggucucaguacuagggacuuagcaggugcucauaauucguaacugcuuuugauggaguuggagaggcuaguuauuaagauuuuucugaauguagcauccuuagcuggcuuucaggauagugacugcaugcucuaaaaggagaucuuugcagauuuuacucuaugaugagaaaacuuuuuaguacuuuuucugucagcauguaccuagguaauaagaagaaugacgugacauguauuuggggaauuagcauacaagaaguacuuugacauuuuccacgugugaagaaagcuguuuuuauugaccuagcugaagggaucaaauucauauuugaaaagauguggcuaaaacuugaaaaggacuuguccaugggggaugucuucaucccuucucccugcucagggagaaguugcaggccauaaagugugagggcaucagccuggaugagcucuaaagcucaauguuaauuucggauuuuaauaacauguaagaauacaaguuugauugcagaagccacaaucaaguucaagggagggugaaugaaugggaaguagaagggaccauguguacgucugugugugugugugcauguaugcacacauuuuuuuaggcuuugguuccuuuagcuauaaaauaagggaguuaaaaugggggugguuuauggucacgauuguuuccuucaaguaucuaaaaggcuuucaccagcaagggggacuuggguucagaacaaggcauugggugaaccagugguagaacugaaaggucguuucagugugaaagugaacuuucuuuucaagcaaaggcuggaugucauuugggagcuuguaaaaagaauuguuauauggcugccaggcgcaauggcucacaccuguaauccuagcacuuugguaggcugaaauggauggaucccuuaaggccagaaguuugagccagccugagcaacauggugaaaccccgucucuacuaaaauacaaaaaaugagccaggcgugguggcaugugccuguagucccagcuacuccgguaggccgaggcacgagaauugcuugaaccugggaagcagagguugcaguuagcugagauugcaccgcugcacuccauccuggacgacaaaggagacugucucaaaaauaaaaauaaaaauuggccagguuuggugacucacaccuguaaucccagcacuuugggaggccaaggcagguggaucaucugaggucaggagugcaagaccagccuggccaacauggcgaaaccccaucuccacuaaaaaucagccaggcaugguggcgugcgccuguaaucccagcuacuugggauuugaggcaggagaauugcucggaccugggagacagagguugcagugagcugagauacgccacugcacuccagcuugggcgacagagcgagacuccaucccuaaauaaauaaaauaauuaaaaaaaacaauugguauauggauugggagauuggacugauggacucuugauuucucugauucuugaaucucugcuugggugaacacuaagauuccuuccauuucuaaaauuuugagguucaguauaaauagaaauggggucaugcuuuuguggcuaggagcuguguguauauucuagccaccaaccaaccccaucaccgcugcaaaauguucaugcuuauuauuaguaaugcgauaauuuuuuguguuuguacaaugcauuauaguuuauaaaugccuucacugucauuauuucauuugcucuucucaacaaccacaugcagugguugguguuaucucuuuaucaaaagccaagaaaaaggccaagaagggggaaaugacuuauacaggauuacaggguagguagcaggaaucuagaccuucuggaaucuaguacuccuacaauggaugccucccuauagguagguuugauuuucaggaggcugagaguuggcaggaaguacugcauaaaaacaaagaguagcauaacuuuguggccccagucccuaaggaaaacugugcagaguggacccaucuuggcucauuucccauggcaguacccucauggugggccucuggaggagguugguacaggcgcaccugggaucaaguuggccgcuucaacauauauggccauauaagcucgugguggcuaucguuuaugaauuauuuacuuugaauaaccacuuuaaaauguguuauuucaucuucagcacagaccuaaaccaggcaggcuacuccucuuuaggaagcaggaaaguggugggugaacucccaagucuccaguauuuuuccugguauaaaugccaacuagcuuugaagucucauaaugucauagaacuuggaaucaucccaauggauauuuaagcucaugagacuuaaccugccuuagggcgaugccgaccucagccagcaccugguauacuuggaucucgcaggcugcugcuggagguuccgaguagcugccuguaccaggccugccccagucaauucauuagccuuucaguaagacguuuuaugccacugaguauuuuggagcccacuuaucaugguaaucaggguuuucugugcugcucuucccauccugcagaugaagaguaugagguuuggagaagugacuaauuuguucaaggugaaugaaugagugagagagccuggagucauguugucuggggccagagucugcaccaguugcacugugcgugccuccucccacagccucugugcagacucagacaugcacagagcauggggaggcaguggauggucuagauaugcagggcauuaauuugguuuguauuuuuuucuucagaauuuaucuuuaaaaaauaugucuuucagauuuuugugcauuaacauuugaacuacguuuugaggugcuucuuuccaggucuguuuaagaaauguagcccaagggcaagccccucuucucuguugccauggcagucauguaacaguugucaacaacacuggaagugcuuucgugguugauuagacacaaaagaccacagcauuucucauuccacccucuuuguccugcaaagaaaauaggccaguaggcaauguggucagcaguggguuuuaaauuaaaauguagccaucagauucccuuagaccuuuguguagacccauugcuggcccguccuucccaggaguucaaguuuggaccagccuagacugaagccuauugaggagguuuuuaugcauaggucucaagcgaauuucugucacaacuaggcguaccuucaugugcuguuuuccacaaaucuauguggucugggagagaguauuucuuucccuggguugugacuaggcagguauguuggcauguggcaccaguugagcacagaguccucuaucuugggaaaaugcuccuugucauagguuucugagggggcugaguccacagucuauacuucaggcucccccugaugguaauacagggguccuguucagucaggcuacugccuuuucucucugaauuuaauggugauaacagagggggcaaguuucuaaccaacuugauuuuucuugccucccacauuuccccaagauugucuggucuagagauugggguuuguagaaggauuugcuuuuguucaucucuggggcccuuuuugccucugaaauuccaugauuuuaugaaauacauauucaagacugaucuuaggccugugggaauucuaagauugcaugaacagagaaguuaagccugcaaguauuauauacccauggaggaaccaaaggacguguccccugugugucagggauuugcaugggcaagcuuguugaaggggcaagaccagcuuccuugacucccucgaagauaucacaagucaugugucaucacuguugaugcugcaaguuuagggacagaucaguggggacuggaggauucgaaaagccuuccugaaagaagccaguccuguguuggcuuugugguuccuuccauauuuggaggguggagaggaaucaaggcaagaggaaugcugggcacggacaguggcggagggaauggcugcucccugcauccuggccucccggggcuaugacugaggccauggcauaguaauuaggaaugacugauagcaguagugagggagaauguggaaaaaauguaaacaaaacagccucaccuauucacacuugcugcagcuugggacagaguggggauagauggccuccaccuccugauggaacccagugucuucacugccuuauguacguggcacagcucacuguuaagaugcguaaucaucaucuggaguaaucaagaagacuuaaaucauauaucacauagcuuacucucuucaaaacgaugaagaaaggccaggcacaguggcucacaccuguaguuccagaacuuugggaggccaagguaggcggaucacuugagcucaggaguucaagaccagccugggcaacauggugagaccccguccuuacuaaaaauacaaaauuuagcugggcgugguggcacgugcuguagucccagcuauuugggagccugaggcaggagaaucccuugaaccuggagguggagguugcagugagccgagauugcgccacugcacuccagccugggugacagcgggagacugucucaaaaaaaaaaaaaaagaagaaaggcauauuggauuuuaucccaaaaugucacaaccauuuuauuuaaguugugcacuugaguuuuguguuuauuuaguuacuuggaaauucucauucccuaauacugccagguaugcugggcaucaaacagaccauccucuguaggugagagcaugcacacucuuggaggcguuuaucaacuucacccugagaucucuucagcuccagcauuggcuucucagccuguggggcuggccaagcccacggcaggcucugagucauccuguugcuucucugagagggcagagccagagggagugcaggacgccugcacuuuccccuuguuugguauuuuugagcaaagacucucacucuuugggaggacugugagagccaugccugugacacccagggcuggcaucccacaguacccgcccccacccugggcacuuccugggacgccaggacuuugcucugaggggcugucaggugggcuguggacuuggcuuauuuggagagcuggcccauuuggagagcaucugcugaggccccgugcuggaaggcggugggccgggagcccugcuggagacagaagccacugcucugggcagugcaucacacucacaggguggagggugagagacacagccaggaggcuccgacccacccauccccucacaggccccagcugaauuaaugggauucccuugaccccuccuugcagccucgcugaacagaaaagcaaaacccagcaaccacaagauaguuuugaguugaaaaugguucugagaacuucugaugauugcuuuuuaauuuuuaaauuuagaucaggguaaugcuuuucuguuggaauccaggggccuagagauguuucuuuaucaguggaggaggggggaugaagugaguuugaaccccagugggucuguguguauaaacugagucuuacagccauguggagggagccucagaaagcccaggcacuccagaaaaggcaugcacaggggugggagcugagcuaggcacacaccagggaguguguguguguguguguguguguguguguguguguguaugugagagagagagagagagagaucagggagaggguugcaaugaaucucuggaugggguaggaauaaagaaacacuugccccucucuggagaaugccauggacagggggcaaggacggaguuggagccacauugacuuggagauugccaggugagaccuucagggcaagcagacuagacuucugcaggaagagcucucgugacacacaaaccuccacggaaguccgccuccucaggaaggcugcacccugucccaggcagccagaagcucuucuccgugguuacucagccccacguguuccagcaugagaacauacucacugucaugggguucaugcuccagguaccagcuaaggucuaucuucauauucccagggcuuagcagacacaggcacucaaauauggaaugacgagugaacaacugaguaacugaauggucagaauuuucaaaaugcagauuugcuguuaggagucuuagguuuacuuccauuaugcaaaguuggucucaccggauuuccccugauaguguuccccagccucacaugacuguacauuaucuaggacgauauuaaguaccaacugaaugcgggcacuguuggggauauaacucagaaaguuuuaccaugauucugcucuuaagcagguuagcugacugacuuccauauucaauucuguucaagucuugaagcagagcuccaaggggagccaaauggguggguagacagaauuuccaguggauaguuuaggagcucccuugucuuggugugaagugaggaucccugagccaccuggagaguguuggaacacaguguggucauccaggaaucaaagggagccccauccuggugcucuggcuacugcaaauaauccuuguaagccgaucugcuuagcagaguacuagaaaggaaaauccaaagggcaagauaaaaauauaucugugguauuuaacaugguggugguuggagaugucagcacguacgcuguuacacagaguccgcauguuaccgggaagcccaacuuggagguuuguaaaucauaucagaguuccagcucuccuguuuauuaaaugcauacuguugugcaggucauagauuuuugagccucaguuuucuuaccucgaaugauugugaggguuaaaugagaaucagguaugugcaaacccuugcuguaucauugcaagguguucuucaaaguggcaaguguucugcaccauagaccaagggcauauucuuuugcugucuauacucauuuccaauuauaaguacccucccacauccucucucccacuuguugaugguaccuguucuuuguuccccugcugcucucugaggaccaagcaggggauaguuggagaccuagaauaucggaacauagauagucaccuucauaccccucugccaaaggccagagauagcacuccaaggggcagggggacccagaaagaucaaguggucucagcggaggcucucuuuuuuuuguuguuuuuuuuguuuuuuuuuuugagacugaauuucacucuuguugcccaggcuggagugcaguggugcagucucggcucacugcaaccuccgccuccuggguucaagugauucucccguuucagccucccgaguagcugggauuacaggugcaugccacuacaccccgguaauuuuuguauuuuuaguagagacgggguuucaucauauugguuaggcuggucucaaacuccugaccucaggugaucugcccaccucagccucccaaagugcugggauuacaggcgugagccaccgcgcguggccaaggcccucuuaaguacgcucugcccuggauggcugcaguuguucuggucuguauaaaaccuaaguuccaggauuccuuauacccagggauaccaaggccuaggggacaaaacccugaaugaggaccugagaaaccugaaucuauacuuuguucuuucacucauuagcucugcaaccauuaguaagucucuugcccuuuugggggcauccucaguuucuucuuuuguaaaccgaggaaaaauagaaaaaguucuugugugccuaaagcuaaauguaaguuaugaguuacaacuucuuccucuuucaacaaagggcuagaugggauguggcuaaucacagguccaggagagggcacagaagucaccuggccauggggcuuaguuucagcuuuaaguucucauccuggagaccagaagugugguggaacccaguggacuucuguaugagauuaucuuugauguuguguuccuuuaccugacuccaaaagaggauuuuucguuuaggaccugcuucuucagugaaaaagcuuugcauuaauuuuguucuuuuuuucucaguauccagcgagcagcauuggugguccuagaaaauuacuacaaagauuucaccaucuauaacccaaaccuccuaacagccuccaaauuccgagcagccaagcauauggccgggcugaaagucuacaauguagaugguaugugccuugaaaggguguccguggugcucacaggggcacaguugggugacuauuuaagauucaugguacguuugguucgacuucuucucugggccuaccuuuaugguacauucuuguuucagaacaauuucucuuuuuuauguaggcagacacauguuuagaggaauguugauuuaccaucuaccuguguuggaagccuguucauuuugggauuuuaugauugaaaacagcagcgguguguguuuccugccuucugccaggaucaucuuauauuggaagcuguuaggaaaggguugcuuuucaaaauuggugcacauuacccacaaacucagaaagcuaccuaaaucauuaagacuagaaaucucaguaguccaggcaucuggugagauaccugcgggcacuucuuacucguggcuaggagccggaguugaguggguggcaggaggcuggaggccaggcuggguaaguccaagcuauguuucaggguaucacaugguuaagugcaagaaacaggaugcggugucauuucuuccuggguauguugggugagggcaagaacuuugcaaacccuaggagaggauuauauuuucaacaagucaagugauuuauauacagugucaguuuuuguuggcaauauccuuucaguuauuuguuuguucauuuuuuuuuggcuauaugaggugugagcucccucacgaagccugaaggauugauaaauuucaccugugaucuaaaaacuuaggaaagauucccacuagugaaaccaagucaccagccaaguagaucauccguaagaaagccugaaaucugccuauguuucugaaaaguuaagguggucaguggucaggggacaggacaggacuucugagucuguauucauuaacgggucacguugcacacccucaagcauugguauuuccuagaaaaguuguggcugccaugacauucuagcauagcuugcuuuccauuguagacucagugucucauguccuuugacuuucuuuuuugucugucugucugucuguccuuggucuccccaucccucucauucugucucauugucuugcugaaauuugaugucccagccgcccuuauggccaaacugaaacuuuauguaacagaugguaacaucuucagcacacucuauguguuguuuuuggccaacauuuuaauugccaccguucuucaugcccuucugaguucuuuuuccauuuccacugaccagauugggguuuagggagauuccucugcucccuugcuuuggacauagugaauguggagccggggcacaguucacccuccugggaagugaccuuuaggauuuguguguguguguuccauaggggguggguagacaacacugacagauuggguacuaguuuucugcucuguuucccacccucgugguauuaacacuauucuuucacuguccuuuccccaaaggccccaguaacaaugccacuggccagucccgggccaugauugcugcagcugcucggcgcagggacucaagccacaacgaguuguauuaugaagaggccgaacaugaacggcgaguaaagaagcggaaagcaagguauacugcccuccugaugccaguacccucuuacagacuuuuaaauuuuuauuuuauuuauuuauuuauuuauuuauuuagagacagaaucucacucuguugcccaggcuggagugcaguggcaagaucuuggcucacugucaccucugccucccagguuccagugauucucaugccucagccucccaaauagcugcgaucacaggcgcccaccaccacgcccggcuaauauuugguauuuuuaguagagaugggguuucgcuauguuggccagacuggucucaaacuccugaccucgagugaugugccugucucagccucccaaaguacugugauuacaggcaugagccaccaugcccggccucuuguagacuuucaaucuuuccuuucuuaccacuagaaugagguuucuguuuaaaaacaugaccugcugggacaccuuuggagugcaccuugcuccaguguuucucaaacugaagccuguaugaauaucacugggagggcuguucaaauacaggcagcagguucugggcccugcuugcagagacccuacccaauagguguggaguugggcccaagaaauggcauuucuaacagauuccugcgugaugcugaugcuccuggcccccagcccauacuugagugggucuguucugcaccccuggacccuugcugguguucaccgucaggucauauucacugaaggggacagaggugcauuccaucaugugugcugugccucuuccuguuucccaggggcugcugguguggguggcuggaccagggagcacgcagcucugcuucuuuguagggcugcuucugcaccaccagccaccucucucuguacagagccuuuuauagccagucggaggggccucagaacucuuuucaucuaaccauugcagagaugaaaaaaggacuagugcauuucccaagcucauugguggcagaauucagaacagaguucaucucccaguccuggggcuccuuucccccaaccccuggggccccuguuccacauguuauuuuugcuguugccuuucuuucucccuuccucccucuccacucucugagggacagcuaaggaugcaagcagcgugauugggccuuggguauguuggcagguugggccgcagcaggguagacaagcgucauucuguucucacacccuguggcaggcaccauccugauuacuuaguguugcaucaccuucuaggcuggugguugcaguggaagaggccuucauccacauucagcgucuccaggcugaggagcagcagaaagccccaggggaggugauggacccuagggaggccgcccaggccauuuuccccuccauggccagggcucuccagaaguaccugcgcaucacccggcagcagaacuaccacagcauggagagcauccugcagcaccuggccuucugcaucaccaacggcaugacccccaaggugcgcugcuccgggcgggcucugccaccgucauccuggcuugucacugagcuuggccaguugaauuauagcguguuacuagaagugauaaaaucgaaaggcaucucuaaaacucaaguaauaagaauuagugauucucacuuauuuuauguuauguuaguacaauuguuuuuuuaaaugugccuuucgaaggccucuggauucuaacagaggagagaauuucgcuuggaggacaguauggaauagugauuggagacaguauggaauagugauuaggggugcauuguggacucuggagcugaacugauucauucuaaccuggcuccuccaccaacuagaugcauaaccuugggcagauggcaauagcucugugccucaguuuccuaaccuguuaauugguuaggauaauacuaauaacuaucucauuuguauguuuugggaacugaaagagcaggauacacauauagugcaacauauaaacagagguccuuauaaaaaacagcuaccaaauguuacacguguaccacaugccaagcucaucuacucucuaccaugcgauuuacaugccuuguugccauauucaauguaauucuuacacaacaacccugucagagagauauuauuauuauccucauugauacaacagcaaacaaguguagaggaacugaaacaguuaauucaugugaagugcuugaaacaguaccugucauaugaugaggauggacuaaauagcucuauuuauugguaaaaaauagaauggcgugaacccaggaggcagagcuugcagugagccaagaucgcaccacugcacuccagccugggcgacagagcgagacuccguccaaaaaaaaaaaaaaaaaaaaugccaucaggcauuuuggguguuacagaauuaguuuuacugaguggucuuuuagauuaugauauuuaggacacuuuaagaaguguuacaagaaacagccauguaucuaauagagaguuguggccaaggaggcaaacuagaguaaagauacagcaaaugacuucucuacagagaaguggguucaaauccuggcuccaccacuuaauuguuuugugacugugcacaaauuacucuacccucuauuagauauauggcuguuucuuguaauaucccuaaaagugugcuaaauacuguaaucuaaaagaccguuugguaaaacugacucuguaacacccaaaaugccugacaaagccauagcauuauuuuuaccaauaauaauaauagcaauuuagucuggccucuucauaugacagguacuguuuuaagcacaucacgugaauuaacucuuucaguuccucuacacuuguuuacuguuguaucaaugaggauaauaauaauaucucucugacaggguuguuguguaagaauuacauugaauauggcaacaaggcauguaaaucgcaugguagagaguagaugagcuuggcaugugguacauguguaacauuugguagcuguuuuuuuauaaggacuucuguuuauauguugcacuauauguguauccugcugguuacauugucaaccaauaacuacccuuaggaaagcaauguagaaauaguaagaaaccaaaaaguuuucuguauugauucacuaaucucucuccuaggaaaacuauuuccuacaaucauauauacacaugaauauacacaaaggugguguuuugcaaaacaaucuguaauccuccacaauggaaauaauuuaaaacauaacaguggcuuauaaauuaugguguaucaccuguugaaucaugaaagaaucuguuagaauaguaaguuacaagaaauagaaugcagaaacaugugaauacugugguugcaaaugaggaaaauaugucugcagguauaaaaugauggcuuguaccauguagaaccaaaacaguuguuuuucuuuuuacaagauuuuagaaaguuuccugguugcuuuuuguuucauuuaaaaauuuuauacuuuucugaauuaaaaauaauagcuguuuuugguauagaaauccaaacauuaaagaaaaguaucaugcggaaaaugaaguuuucagccccugccccaaaacaguuuuuaccgauaaggaguugguauauauucuuucaaauauauguagauguuuuuuaagcugaaaugggaaaacaaaacagaaauugggucauugcucucucuuucucuguguguguguguguguguguguguguguguguguguguguguguaaaccacaggcacacgccaccaugccuggcaauuuuuguauuuuuguauuuuuuugguagagacaggguuucgccauguuggccaggcuggucuagaacuccucagcucaaguaaucuaccugccucagccuugcaaagugcuaguauuacaggccaccaccccggccuauauauaucauucauuagguagauagauagauagauagauagauagauagauagauagauagauagauagacacauagauagauacauagauagauacauagauauauacauagauagauagauagccuauauauuaucauucauagauagagauuuacauacuacaucucucuauacaauguauauuaucuuucucuauauauauguagagagauauagauauauaaaacuuugcuuuuuuuucuuaaagucauccguuggcugucuuuccaagucaauacauacagaucuuacucauacagauauaacuacagauauaacucauuucugguaauagcuacgucuuauucuaccaaauaccaugauuuauucaacugauugucuguugaugcacauuuggauuaagaguuuucauuagugaaagccaggggcuuguuguauuuguuaaucagauuuuauuggcacagagccaugcccuguuauuuauguaucaccuauggcugcuuucacuuugcaccaacagagcugaguaguugugacagaauauggcuugaaacgcugaaaauauuuacaucuauggaaaaguuugccaaccccugguuuaaacagcauuguggugaauacuuuuuuacauauguauuuguacaaguauuucugaagccuaaguuucaaguagaggaaaagccaggucagaguuguagauccuaccaaauugcccuccuaggggguguacuuuugcaugcuuugccucuaacaucugagauuuuuuauuucccacauacucgggagcauuggauguuauuuuuuaaaaucauugccuaucuaauaggaggaaguuaguuuuuaauucuucuaauuuauauuucuucuuuuuuuuuuuuuucuuugagacggagucucacucugucacccaggauggagugcaguggcacgaucucggcucacugcaaacuccaccucccggguucacaccauucuccugccucagccucccgaguaacugggacuacaggcgcccaccaccacgcccagcuaauuuuuuuuguauuuuuaguagagacgggguuucaccguguuagccaggauggucucaaucuccugaccucgugaucugccugcuucaaccucccaaaguucugggauuacaggcaugagccacugcgcccagccuauauuucuuuaguuaauaaugugauagaaaaauuuuuauauguuaauuuuccaauaauguuuauucuauaaaauuauuguuuuaguuucauuucucuaauuguuauuuucuuuuucuuaugauucauaggagcuguauuuauauuagaagugugggaguaugcaaggccuuacuuuucugccuuacaauagaugcuccacagaugaaaaaaauauauaccuggcaguagcagcagggugugaauaaaagaggauaccgggccgggcgcgguggcucacaccuguaaucccagcacuuugagaggcugaggcaggucaaucaccugaggucaggaguucgagaccagcuuggcccacauggugaaacuccgucucuacuaaaaauacaaaaaaaaaauuagccaggcgugguggcgcaugccuguaaucccagcuacucaggagacugaggcaggagaauugcuugaaacgggaggcggagguugcagugagcugagaucgugccauugcacuccagccuggguaacaagagugaaacucugccucaaaaaaaaaaaagaggauacuaguuaaaaacuguucuucgccaggugcaguggcucacgccuguaaucucaacacuuugggaggccaggcaggcagaucacuaauggccaggaguucaagaccagccuggccaacauggugaaaccccaucucuacuaaaaacacaaaaauuagccagguguggugacacaugccucuaaucccagcuacuuaggaggcugaggcaagagaaucacuugaacccgggaggcggagcuugcagugagccgagauucugccacggcacuccagccugggcaacagagugagacucuaucucaacaaaacaaaaucuguucuugacucugucugggaccugauugauauaucccaguauguuucuaucuguauuacuggcucauuucauucuuccuuccccucauggcuaaaucaguguauuuauuugauuuaauucgcaugcugucaaacuccuaguaugugcuaggcacguuggaaauucaaauuaaagaaacaaaacauacuuccugcccuucaagagagugaaguguaguguggggagcagacaugcaagucagcaaucacuuugaaaguaaagggucacacgagagucagugauuacaggagccugaaggaggacauguuaaucugccugagagguucaagagaagagccuuaagaagauuugaagggcagggaagaaugagcugaaugacaguguuuagcuggaggaacagcacauguaucagaacuccaucgagccaggugccacuggagcagagaacucaggagagggaagggggcaucaggccugggcauccccuggacuggccaugugcacacuuagcccaacauggaauaaccauugcuugcuuaccaugucgggcauugcugugagugcuuuuugagagcuaacacuuucauccuuacggcagcccugugacuuagguagugucauugcguccacuaauagagaguguaaaugacuugugcagaaucacugccaguaaaugguagcgcaugcguucuuauucaugcaaguauaugcagcuuguauuuccugacugcuccuuugggcccgacacagcccuggcccugagaaacuuuugguucaggaggaggaagacauggagaaacacaucaaguaggaccauacccuaagaauggagugaugcagccaugacggcuuccagccagacacugacaccagccaccccauuuucccuccccucuguggguaccacuauucuugcgcuugguggauaguagguaaaggggagugaggaaguccaagaagucuucccuccccaguaaugacucaguugugagggucugaugggaauugagugugaugagcugggcucuggucuaagcugguuuauuuggaaaaaguucuuuauagaugugagaguggauagccgccuggcaguacugcccuuaaaacaggcuguuucuucccuaauggccuuucuccucugcuuccaggccuuccuagaacgguaccucagugcgggccccacccugcaauaugacaaggaccgcuggcucucuacacaguggaggcuugucagugaugaggcugugacuaauggauuacgggauggaauuguguucguccuuaagugcuuggacuucagccucguagucaaugugaagaaaauuccauucaucauacucucugaagaguucauagaccccaaaucucacaaauuuguccuucgcuuacagucugagacauccguuuaaaaguucuauauuuguggcuuuauuaaaaaaaaaagaaaaauauauagagagauauauaucuaugccagaggggugucuuuuuuaaaaauucuucuucauugcugacugaaacuggcagaugauugaccaguauccuuugaccaucugcacuuuauuuggaaggaagcaggggcuguccacccugaaaaagagugacugaugacaucugacuuuugucgaugggacuucucaagaagccauuccuuggagcuucuguuacagcuguaaaccaaaguggagcuggugcuucuugggagccucgccuuacaacuaauuccugccuuucguccaguaccaagucccccguugcuucuggucagcccacuuguagacuuccaggggacacaucuuuauucuguuucaggaaaccagucacgacacguccacauauguauuuguguauguuaauguccaguaucacaucacccaugaaagucgugggcaguucaggagauaccugccuucaucuuuguucuuuguugccuuagguucuucagagaaagaucacaacaaaaaauguacacugucguuuacagcuauuaagugauuugauuuuguuuuuuucccaaagagaaaaccuaccugcccuguuucugaucccaccccucugcuggcuugaagcagguaacccuuucccagcccugcagcugcccaccuggccuccaugccauccugcccccaccuggcuggcagcccuggcucuccaugugugcccuccggcucugugugaagccucaagucagucccagcauuguuuccauagggaaguguggggugcccagcagguaaagcacagggagagagggcagugggaaugccaccuuuaggcugcagcaggagccccacacugcccaguuuuccuccccacuguucuacaccaaccaggggagacuaacacugugacucugggauuggcaggugcaacuuggagccacuuaauuuccuggggacguaaguucuucccaagcuuagagcaagcugcccugccaaaggagaccaaaccaugccaaccacgcuggcaacugcugcuguccagucccuguguuuucugaccaccgucacugugcaacucaucgccucugccacuuaggaccaggaaagaggcugguuuugcucccacucuuaguugcugauaaaguggggagaaggaaaauggacacucuacagaguuuggggaagggagaguagggagcccaucuuguccagaaagauucaucuguggucugucuguuaaacacagcugauuucagugggcuuuccccuggcccugggggagcagacacugacuggguugugggcagaggagccauccuggcggagcccugcugcaggggagcuccuucaggagccccauccggaccucuugcacugggcugccuuugccuccauuugccuuccuguaucugcaacaaaccuuuuaaaaguguucacucuugcuuuuuccaguauuucgguaaucagccaucuugcuguaguacaggaugacauugucgaaugcucuuuguaugugugcacacccccuuacucccuuacugcuucauacacuccacaagugguacaguauuuugugucauuguaaaaaucaaaauuggcuuuggaucuuuguaauacaccuguaccugaaaaaguaaacaacauucuucaauuacuagccuucagcuugaaaagacaugcuggagaagaaggaagggggaacccauagguguggcguggagccaagauguacuauucaacuauguguuucuguuuauaaaaaacacauaccauggaaccauggugcuuuuguucuuaguuuuugccguuagaucccuucaaacuggaaguuccuuacaauaucuuucucaggaaauauuuugggaaaugggguaagagauggcaagugugagacgggcugugucagagguugcuacgucauggauacagugcaguuccaagugccauaaguguauguacauauaguuaauaaugacacuguucaucaccauucuaaaauacuguucuuccaacccuaucuucaaugaccaguccagaagggguuaagcuggauucauuugcucuggcaugugcauucccagcagggugaagaaagguuuaaauuaaagaauuuauuuucucucucccccuuccucuuucucccagucuuugcauaggagaauguuagacauucagaaauuacuguuucuguuuuaaauugaguauugauuuuuuuauauugacuuuguauugaguucuuuuugaaagaauaacaaaauaaaaugcaggaucuuuguaaagccuuugcacuuucaaccucuuuauagcuugaguuacuuuugcagugggaacaauguaaaugacauuuaaaagauuuaagguuucagaaagcugcaucccacaauugaacacaaugcauuuuuauuucaauucuuggaacugguaggcuauucuuuuuaaaaggggguaaacuucgcccuaaggcugguagaauguauguucacauuauaguagacaggauuucauuugccuuauauguuuauagauuuuuuauaauuuucauccuacguuauuaaaauuagagcauugaguguuaaagaacuuaaugaggagucuauaucugagauugcucucuucccuggugauguuuuaacugguagauaauuuguucuuaaauauguacuuuugaagauaggacaguuuuuauaguccaugaacugaauguuaaaaaguucuguaugcauucucagagaggauuuuaaagcuauauaguucauccauccuuugcauuaucaaaauguuaagucaaaucuguaauacuuuggcuaaaauucauaaaguaagcccuagagaaaauacuugaccaccaaauuuuugcccaacuaucaucaccucccuucccccgccucuguucuugccuuuugacaucuacauggaagacaaguucuuuacagcaaaugguaagaggcaggugaccugguguguuugcuguguuguaguucauugccuggggcuugggacuccuuuuuuaauggagagacuagcugugcagguguguguuggauagggauaaagugcucaccccugcccucucuacaguaguuggugguagauuucucucucauuuugccucauaaucacuuucgagugcauguauuuaccuaagggcuguagcucugugggaugcuaccagcauauuggacugacagaaauugauuaccuugccacuccaaccuacguacugagugagugcuccagccacucagugaaaccaacaaaagugaguccuugguuuaccuuccaaucuggguccugcuguguaaguaucccuaaguggggaugcauauuuguuugugcguuuuuauuuccauauaugugagcauuucucugaguguauuaccagacggauagcacauuuauaugucagacaucuuaacaucuguguuaucuguagcagguguguagcucagcagauacgugucauuguguauauagcugagugugugagggugucuguguuucugcaguccccuguguuugagagaugacuuaauaacccuguguuuugagaggucgcucuaaaccagugacuuuucccuccccugcuuuauuccuuucccucacugacacuggcuucucccgcuagaguaaauggcuuuagcacagcacugucuucuggggagccugcuguccugcaggcaaguccauuaaacucuuucuugcuuuaggacucugaaaacagcaagaaacaaacaaacaaaggucaagcucuaagaaaauuacugcucaaacuucacuacccuggaagccuuacuagauauuucuuaagguaacuuaaaaauugggcuuuauuuuuaaaaagugauagguuacuuacaguagcacagaaauguuagcauauuuauuuaaauaguccugcagcagagacccugcgauuguaaagugauuuaaguauuucuggguaguguuugugauuuacggauuuguuacugaaaaacaaaaaaaucacuacugugaauuuacuacuauguaaccuuguggucguauuucauuauaaauaaaauaagaauugcucuucugcccaccguucuugauugguauucagugcaguagcgaaaugagauaguuuagacacuguugaaauaacugcauugagcuuuaaccaaguguaugcucagaaaauucaguuuuggaucacauuuugacaaaacauguuuuggucaaagaaaggaaaggcuacuaacacauuuaucagguaauguaugucacaguccguguuccacccagccuuguuauccccacauucuuucaagauaggagucaucuugguuuuucgggugaaaaacggaaggucagagaggaaggggcuuguccaaggucucaugucugguuaacagaauuucaaacuagauguuugauucuaaccccucaguccacuguaccuugaaguauggucuaaaugauucggcacuucuggauguugaggaaggaccuagagacacauccuugaacuagaaccuggggugagaguucauugggaggcaggaucucuucuuucacuuuggauuuacaccuugucccuuggaaagcuucuccacuaugcuagcaaauaucuuaggauauuugauggaaagaacuugagaaucccuucuggaaaacccagccuuucaguguuaacaccugcugcaagacagggaugcuguuguucuggcagccccccuuugcuuuugccuggccccaccuucugcucccacucugcuggcuugggcaagaugcgugccuugggccuugggugcagggaggcaggcaggggcuugaccuggccucucucuggugccauggcaacauuaugccccaaacuucuucccugguuggagugagaggggcuguccacagccccauccuguggggaucucaagccggagucccuggccuggccuccuugacguagguguucucagcaagcaguuugcaucccaccgucuuucucacacuugcccccaagacuuuugacagagcagacguaaaacaggacucagaaaaccauuuuucucuguucccauauguaguaaguuuugauucaguugugcauaaaccauaguuuucugcccugcuguuugcuuucaauggaagacaguaaagggaagauggugcucacaucucuccaugugacaucucauuaggaauuaagaugcgauggauuagaaauguaaaacuucagaauaaaauuaaauuucagggcucuauaagucccguuuucccagguccuguuccguuucuacguagauaacccaauuuguuuugucuaugaaauaagccucuuuaguggguuguuuuagucucuccaacaaaagagcagauuccuaaagccaggugcagcacugugaaaaguuucuuucaauauggcaccaagacucuaccauuuaugucucucucagcuuacaaacaucagcguuuuguccuugucauaguggaagaaagacacuuacuuuaagcuuuggggacaaaggugacaaaccccaggcuuuuaucuuaaaagugucuuuggcacuucuuuuggcacugaaaugguauuugggaagcauuauuugaauguacaguuguuugguuuuguaugugcuuaucuuuaucugagcuuucacuuguagacauggccuuuuguugugaaguugcucaucauuuaggaguguuuaauucuaaaaagccuucagccuaagaaagcuucaucuguggggaccagagacuuguugcucagggaguuagugaugggacuugggcaucugaucugcaggugacaaguuuaguucaacugaaguuguagggaauuuagacaguugcacaucauugccguucuaggggccuuguagaaagaugaaacaguuguuuuucauuuaccagcaccucucaguuauagagguaauggaacauucgcuuacuuuucaucaucauucuuuaaaaagggaacauacaaaaaucuaaacuauggcaauaauuuauuuuuauaauaguuuacgguaggcuuuaauuaaauggcaaacuccucugggaccccuaaguuauggcgugauuagccaaauuugauuuccaacagucauuuauggccauaacuauugcauagagugcaggaugccagcaaagaugagggugggggcagauacuggcucagugauuuaacucacauuauagaugaccccuuccucaacagaaaugcuacugagagaaccagagaggccugggccaggcaggucuuauuugagaggagauuauuugauaauugcuuugguuagaaggacuuuacauuuccugauuucaaguccagcaccaauuuagaaaguucagagaugaaaccaccugucuuuaccugacagagucauaacgguuuguguaaaaauguggucagggaccuuuuuuguucuuucugauuaguuaauacuguacauuguaaccaggaggggcaguuuugccaaccagccucugcucauggucaccauauguguaugacaaggccugagugaguuccugcauaaacuggguagugggcucuuuugacacauuugcaagcauguaaaugaaugaaugacacuaccagcaaccaucuguacagguccauuuacuuacauucauaagguuuaugcuaugaaacuucuucucauugugaugucaguaacagaguuagugucucugauggaauaguguaccugucacccaaguuauuuuguuccuuuuuggguccuccaguauaaucccccccucaucccaauuaacuguaaaauguuuuacacaucacauuuuuuauacuguaaacuuggaaaauaaacugaaauaucaaauugugucuuguuucuuuucuucaugugauuauuucaaucuaaaaaguugcuuacuuuuucagggacauuuuucacucucgcauaauuuugagaccuucagaauuucaagacaaccugucauauuucuauaaaaaccaagacaauugugauggauugggaaaguagaauuaccauuguaacaaaaacuacuaguugucaaucauuuuacagugaagaaaauguuuugaauagauaacuaaaaaugaaauccucaggcucuaaaacauggagaugaaacagaucuuuugaguaaaccagcaaguggaaagguauuugagucaaauaagaagacagaaaaguaacagacuuuggguugaugugggaggugaauauuggauuauuuuccugaguggcuugggaauucaaguuaaauuaucaacugauuuuagauaggucuauuuaaaggaaauuugauuauuugcaaagaaauaugaagccuguuuuccgcuaaccucagugguagaauuuugacagcacacaaucaaauucuuagcuauugcauggacagaaauuagagaaagcaauugacucaaagauauucauugguuagauuauugauaagcuguuucuuugggccauuaagcaaaauguacacaauuuauaucuacauaaguaaacccugcuaauacacuuugugcuaucauuuggauauuuguucccaccaaauccccuguugaaauuuaauccccagugcggcaguauugagagguagggucuaaagggagugauuuaagaacuugagaacuugggucaugggauggaucuuucaugaauagaugaaugcccucucuggaggaaguggggugugaguggguacucgcucuguuaguucccuggagagcugguuguuagaggcuggcaccuccucucucucaugcuuccucucucaccaugugaucucugcacacacugguuuuccuuuaccuucugccaugaauggaagcagccaaggcuuucaccugaugcccaguauugcagccagcagaauugugagcgaaauaaauauuuuuucuucauaaauaacccacucuuaguuauuccuuuauaucaauaaaaacagacuaagacaccuuguaagcucuguuacccaauagugcuggggaauuauagguauucuaguuaaucaauuauucauccaccaacucaauaaaugaguaucuacuuugugaugggcaaagcgcuaagugcuagggauucuaagauaaauuccuugccucuaaggagccugcaauuuagugaaaggacagacaugcaaauauauguuauaccuuaaaugauaagugacaugauccagggaugcacaaaucacaggggggaaggggcaccuucaggucaccuagacaauuggauaaauggugcuaucacccacccaaacuaggacuccaugaagaggagaagauguuuaggggagaaggcaaugaguucagguuuuguuguguugagucugaagugcuuguacaacaacaagucaagauauccagaggcaguugaaugaaugugucuaaaaauaaggcaaggagucaagguuagagacucauauuuggagguaauuagcacauggauaguauugaugggcacgaugacaucauuuuggaagaguauguagaguugagaugcugugaaacaccaucauucaaagagcaggcagaggaagaggggcuagaaaggaaaauagagaagaaauaaggagguaggacuggagccagaugagaaugagcagagucagaaaaaucaagauaggauuuucaacauugucugaauauuuucaaaauaugaguuuaaugacagaauuaguuagcuaguauuccacaaaaaguauugcucuauuuucaaaaaauuugcacagugucuuacacaugugcuaaaagauugagaaaauaaauuagaaaauuauacugcacacuuaacacuaaaucuaccaagcacaauguaacuuuuagacagcucagaaggcacuuugggauuuuuuuuuuuuucagugccucagggcaucaguaugaacuccaauuauuguugcccuggccaauugugggaguacugauaacuggagaguuaauugacugcuggauaaagcaaucuuuaaucuaaaugggaaggcucacuagcagcuacagagaagggguauucagaucccagcuuaggcuaggaagccagcugacccaaucagagacaugaacccaucagaaaaauguaaaaguuuucaucuuucuaguuuucccccacccuccacuccugcugaugaauaugugagacuugccaacuagagggaaguuuagagagcaaaucaaccucccaucccaguuuccuaauauacuagaaaugauggugacaccuguacacauuucaagcccucuccauagccauccaaaggcuugaauauccaaguucauagugauaugaaugaccaucacuugaaauaaguuuaacaaagccaugagaauaugauuuauaaguuugcuuccaaggcugagccuucucuaagaaggaucaucuuggcuggaggagggaucccaacugauguucgagguauggagggagcuaaaucauuaaucaugugucuucccugggcucugauuaaaaggucacucuaugccugugaguuagaaagcugucaauuuuguuacugucauaaucaaagacaaguaaacuuguguuaggggauuguucacccuagacugccauguucaggcacugccaugacccuugaugguccagcaaagaacaagaucuguuccgugacagucaagacagucaacaugggaauaauuuuucuccugucccugcuaagugggauugcugcauuugaaaaggcauuugcugaaugaugcugcuccugacgcaaagggagugggaaaagagaugauggaaaagggaaaggagcuggcuggguguggggcagaauugcuugcugccaccuugugcugucuguaugguagugggugcugugauuuuguuuucaucagaauuguuuggaguugggcuauucaucaucaucgucaucacugucaucauuauccucuucaucagaauuaucaucaucaucaucaucuucaucaucaucuucaguguuuaucuuuccagaaagcacauccucaauccaguccuccagcuccucagcaguuggaagaucgucaucaucuggaaucuccauccagacacugucagccugcagugagggacaaaaugaaugaguggguaaaugcaugagggcugaaccagaccagggauagccgugcugaauagcuaugcugagugccccccgacucucuuacacuuauuaggaacgugcacauuguuaaauggaaaugccaaacggcaaaacgguauguguaguauacuguuuguguugcauaaaaggaaauguguauuccauugcccaguggaauauauaugacauuucugguaauauacccaugcaacaaccaccagugguucccuccaggaaugagacuagggguugggucaggggaguaggaaauacuuuuuacuuugaccuucuaaucuacuguucuguuuuaaaauguuuucacuugagcauguuuuaaaaguaauguauuauuauuaauuuuaaaguagcuuacaaaauaaaugaauguagaguucccuaggugauugaacaccuaucaacaggggagaaagacauugcuaacuggcccccauucuuuuuuauuuuuuuuuugagauggaguuuugcucuuguugcccaggcuggagugcaauggcauggucuuggcucacugcaaccuccgccuccuggguucaagcgauucucuugccucagccucccaaguaacugguguuacaggcacccaugaccaugccuggcuaauuuuuguauuuuuaguagagaugggguuucaccauguuggccagcuggucuugaacuccugaccucaggugauccacccaucucagccucccaaagugcugggauuacaggcaugagccaccacgccuggcuuggcccccauucuuaagagauucuaucuuaauuaaguauggcucuaauaauccucugugaucaucccuuucuguccacuguuugccugauuguaucuguccccacuugaguuuuaugaugguggaguuguaugagauguauggacugagaucuaagauuuccucgcauucugccaguguaccucacuagccugucccacccucgguucaacaaugccugaacucugaggagaagccccuuacucgcauaugauuuucuuccuucccuucugcaggccuggucuccugccuguagaguaguugccugccugggauucuaggccacaacggccccaucacccauugugcagugauggcuccugguguggguucccuuuuguaaagagaccuuuuuguuugcuguuugacuuuggggguaaauacaggagaguuuacuugaagggaaaguuccaaaucagugauucaggaaaggcuggccccauaggcaagaaaaugugcccauggaagagagccauggaaccacagauugggacuggcucggagaccaggcguggaacacacuggcaaguuuccuugagcaggaccccugcccucuucugaaaaggcugggcuacuauagaugcucucacaaucuaagcuguguagcagaagacagggcaggccaagggugccugagcaagccuucacaggggauacucacaucugugacauucaccaccccaaucuguggccugaauaggucaaucuugaaagucuucucccaguaggcaacgagcugcagcaacaaaaaaauaagauuagacagcaggcagagggcauucucuguuaaggacccacccgccgucccaucacaguaacuaggucaccauugguuaaaggucuucaaaacagcugugagcacuuagcaaauugaagacuuggccccagccuucaagcacuucaaauaagcauuaaauaaaagaugacacagcauaaauuauggaaacaugugucugcagcuguaagagagaaaauuauagagguggucuaauguugcuuuccaaauuacuuguggcuguuuuauaguuuauagagccauuucccuccaccucuuuuuaaugucccaguuuuaaaaauaccuuaucuugugcuacaugagauagcugggaaagccaugaugggucauaaguugccaaguaagaagaaggcuucuucauucaaccaggcuuggacuccauguggacaaaucucugacuggggcaaaaauaaaggagcaaggggccacaggauuuuuuuuuuuaauggagauguccagugguaggaaaucucccacgcaaauauauggccuaguggggacuagggauauucaggaaucuggaaaucagaauagucugaagauuucuucuuugcaaaaaccaaggcaaacacauagaacuggccagaagagagucugggcaugguggcucaugcuuguagucccagcacuuugggacuggaguccaggaguuugaaaccagccugagcaacauaguaagaccuugucucuacaagaaauuuuaaaaauuagcugggcgugguggcacauuucuauagucccaacugcucaggaggcugaggcaggaggauugcuugagccugggagcuuaaggcugcaguaaauugagauuaugccacugcacuccagccugggugacacagugagacccugucucaaaaaaaaaaaacaaaaaaaaacuggccaggaaaacugcaaaccaucugcaagcuuguauaacaaaauagucagauaaacuagaaacacaaccaggcagaagcuauaucaacaaagcuguacuguaugcagucuuauauggccaugacuuuguuauaauuacccagugcuaugacauuggucucaagugucauggaagccucugccuuugauucacccccuccucuacauagggcugauuuucaggacccuugagaucccucucaauuuucucuauuuaaucacaguaucaucagucaugaccuaugcaacuaaugauaauuccuggaagauaaagucaucauucauaaccuaaugauaacuaaacuuguacugauuacuucaauaagcauuuaccuaaagcagucgguagaccaggcuuuagcaucauguagaccuagauuggaauaucacaucuaucacucacuagcuuuaaccuccccagcuaucauucucuccaccuugugacagggauuauaauaguaccuacuucacaggguuguugagaggauucgcugugaugaggcauguaaaguauuacucuaguuccaggcauacaguagaauauaucagcuaugcuuauuaucaguaccaguacuuauuaucagcaccagaaccaguaccaggguucaauacauguaguguacaaaugcuguuuauucuuuuuuaaaaacuaaguauaaucaaaaguuucgggccauugaucaugcacacuagcaaaaguguggacuugaaguuucuuucacauucaucguaggcuagacacuaugcuagguccuggggagaacacgaugaacaugacaggcacgcucgcuuucucuccacaaaguucugaacucgcugaaaaauguucaucucugauuuuuauuacuuaguaauucagguggccucagaacgaugguccccacccagaaaauaaaaguaguucuggggacugggaauggagugaugaggggcagcucuggagcugcugccgaaggaguuuacccugcucacuugggugggaccccgagggucaaggguuuucaacuccuggacuccagggaguaagccgaauccuuucagggucagcaccaggccccaaguucaauacugccccaagggccaagaccucccacacugggugaggaccgccacuggguuucuucaagugccccugccuauuucaccuccucagaugcugaacgcaaucaugagguugugacagcaacugaggguggggcgcuggcuggagccacucaccagaggaaagucguccgggucgauccacaggaugcucagaucgggguugucaguauugucccgggcaaccuguuucaggaucuccaggaauucguagccaucugaaacaggauucaagagaguugaguaaccccugcacauacacagcuucuaauguggagagcagagugugauuuuuccacgaggacuucuuaggacauuuggugcucacccucaauuauaggauuauucuauagaaugagucagaugagagcuccaggcacagagcagauuauacaaaggaaacaauaaaaaauuugaacaaaggauuaaaaguucacagagaacuggcugguuuuucacuggaagccaaacuucauuugugaaaacugcccagccuugggucagaaagucagucacggaacagagaaauuccugccuguccuuacugauccugugcgaucucuugaaacagaugcuuugcuguccccuagaguccccaauaacauuugcucuaaggaccaagaaugucuaagccuggacccuuaguuuucuacaaccaggaauugcuaaaaccuucaaaccaaacgagcuucugauuuacaguugguuucacagcucugagauaguaaauggggcuucccucccucccucccucccuauuuccuuguauacugggcccucccucuguucagucagcagcagucauugccccaggggugggaugauuccuaagaaaagcagagaggagcuuuauaagcuucaagaacacaaacuuguuagcuuuaaaagccuaaaccuugaaggacuaggagcauacaauuuuugccauaaacaaaaauuuuaggagaacguuuaguaagagauagcauacucucaacccucagcaccacuccccagcccccagcuagaaacagaaaaaauaguuuagauucuggaaggucccugagaauaauaaacugugccugugugugugugcgugcguguguguaugugugugcgugcguguguguaugugugugugcgugugugugugcacgcgugcaugugcagaaacacaagccaugugugcauguguguccacguacagaaucuccauuguuucagggaaucccagaguauagaagacccaugauuuguuucagaauuaaacucaggcaaaugaaaagaucccagaaucccuuagagaacccccuaguauaggagcacuagggcagaaaagccugucagaaggccccauggaguugucuugucauucugaggaacuugaacagguaacgaugacccauaccagaugugcaccccacucagauaugccugggaaccagagagacccuggaucccuugggauagugggguugggguggaggaccuuaauuaucagccccagcuuccaccacucagugguauacacucaaaauugaaauuuagguucaguucuaaauaauaaaguuacauuucuugcauagcugaauuuguggcuugaaauuuauacguugaauacaaguaacucaccagcuacuugggaauucaauuaacugugcuuucuuugcacaguuuuucuucuuuugucuggagucucagcaaacuugagcuccucccuauggccucuguuuagcaaaccucuccucucuccaggaaugcuagcuuuuguuuggcucuuuuggacucuugguaaaaguuuuuuucuacacuucuuuaucucuaaugcauuccaggcaaaacgcauacuauucuuagcaacucuacuuugaguuuuugaguugguguagucacuguugcuagcucacacugaagauucaggcugagcccccuuaggccuuauuaccugggaagcacagcgaccucuaguggagaaauaguuccuuuuuuuuuuuuugucuguugcccaggcuggagugcguggugggaucauagcucacagcagccucgaccucccaggcuccagugauccuccugugucagccucacaaguagcuaaaacuacaggugugugccacuaugcccagcuagucuuuuaaauuuuauuguuuuauuuugugcagacaggggucucacauuguugcccagguugguuuugaacuccugggcucaagugauccugccucagcuuuccaaagugcaggauuacagaugugagucacugugucaggccuagaaggggucuuuauggccgguggccacuucuugcagaaauacagaguggaccucggugaucuuuuaauccgugcucauaaccauauugcaaaugagauuaugacaaacaccggagacugacagggcccuaagcauuagacuucauuuaucugucauugcagggcugggggugaggugggguaggggcauuacuccugcugccuguagguggaacugagaagguccugccccuccaguguaucacugacugacguguggacacuaugggucguccuuuggccaugugucugucacaggagagggaaauauggugccaccuugguuaucuguagagauagaaaucauaguacaaagaccacaaggaggaauuccuccaaaacaacuucaguuacuguuuuuagcugcagaaaauaaagaaaugauaaucaaugaggugacacugccaguacuuuggaagaugagagagagucaaauguaaaagggacaugacaaaacugaaauucacagagaggaugaaaugcaaaaacacagacucaaaugaaaguagaaaguaaacuuguggugcaagagacugauucacauaaaggaaaggagagucuaggcaggcacaaguguuguggagggacaggaucugugacccagaacuauaagcugaauacacaacggagcacuguuguuuucuuaugggaaaaacucucuuaacauugagauucaucaaaaggaaugugguauacaagaacuuaccuacuacguuccuauuugacauucuagagcagguuaagagaugaaaagaaaaacugaacugugcaagaaaaaucaaauggguuguaguuuuuuuguaaacgagugaagucaaaaguguggcuuaaugcccauuuucaagaaaauaaaagguuuuuguaaagagaauauucuuugugucuauggagaagcaaagaaaucccaaaaaccauucccagaauaaauuaauaaauaagguugacauuaaagcugaaaaaguuuccucuagauccaagggcagguuucugauguucagggugaugaauucuguaauggacaaugucucugaccccaaauacuuucaaugacagaacagagcccauucuucagggagucagcccagaauggcccuuaaacacacagacucuggggccaaaugaccuuggccaaggucguggauguacccuuagagugugacuuagagcaaguuauuuaauguuucucuccucaucuuuaaaacagagaugaugaaaaugauagcaucuacuucgucggguaguugugaguuaaaugaaucaguaucucugaagcacuuggacagugccuggcauauaguaagguuuagccauuauuuuacuuaaauuaccugacauucuauauucaaaggcaaggaagcuggcuggaacucccuaagccuggccauuccucugcucauuuaccacaucgguauuacguucagugaucugggcacugggagugggguagaggcagucuuggauccacgugguacaugcugacagaaaacuauaucacaaaaguguacagcguggggcagcuccuuccagcuccuguugccgauucugugaccaaaggcuucagggauggcugugccagcuggugagaccacgagaaccgugccuugauaacugggucagggaaagguuuaauuccuuugcuuuuaaggcauuagcuuguguggauauuccugaucaaaggcuuaaaagccuccaaggcucuccccucuucagacaccagccuugagugcagaccuguuaaaauggauugucaaucugugaaagugaguuaaggcagcuaaccuggucucacauguauucaguugcuaaaauuguaaguuacaaguucaauuuuuuuccaaagagagccucuguuucuuuguaaaacuggcaaguccccuggaaaagagaaacguucucuguggauccucccuuuuugaccaggaaggcagguguaggaagccgcauuucacuuuaguaauucaauguuaagcaaggacuaguccacuguuaaaauuacauggaugaaugacugaguuuaaaaugaguaaauguuuccuuuaucagugguagacauggcuuggagcccuuucaagacuauggucauguauguuucagaaguaauauagccuauacuucaaaaaacuguauagagaaaagggggaaguacuauucagagauguguaggcuaauaguuaucuagacaaagcaaguagaggacuauucucugcaguuaucagaaaagcaucaguucucaaaaucagaagagacccccgcaacccagacauuccaaacuccagguagaugaauagcccucacucagaacauuugucucuguugaauauuuccaggacugagaccguuugaccuugcuaaaaggcugacuacagaguugaucauucuaacagccaagaaucuuauccuugcauccaauugaaaucuccuuuuuuucacaugacguuuacuccccaauuucuuccuuuauggacacuggacauuguucuuuuuuguuuuguuuugagauggagucuugcucuguuccccaggcugaaaugcaguggugcaaucacggcucacugcagucuugacuucccaggcucaagugauucuccuauuucagccuccuaaguagcugggaccagaggcacacaccaccaugcaguuaauuuuuuuauuacuauuuguaaagaugaagucucucuguguuguccaggcucaucuugaacuccugggcucaagcgauccucccaccucagccucccagaguacugggauuauaggcgaaagccaccaugcccagccaggacacagaacauuguucuccauaugcagaaagucuauaaucacgcugcuccaaccuuuauuuucugagugucuauugaacacuuacuggguacugaguacuuuuacauuugauuuuuacaacuagucuugauggagguuaggaagauuuuaucaucuccauuuuaaagaggauggaauuaagacccaaggagagcaaaugacuugcccagcaucacacgggagcaaaugguagagcugggaguugaacucaggucuuaagucugcacgucuggagccacuuccacugucuccuacccucugaggucucugcacuccuaccaauguugcugccaucuuccuuccucgagugcuugagauuuuuaagcccagugugaaagcuucaacaucagggaagcaggggcugggacacugaggaaacuguccauggggucagucccagggcuggcgggcuggccucuaccuucccauggaggggucccuuccccuccuucaaaccacgcugccaagcccucgccucccagcagcuguaguaugauggguuggcuaacucagggauggcucugagugggacuggcgucucagagauggauguaaauaaagagaccuggagcugugagaacugcaacuccucuccugccacucaggcuuggaguccugagagaccaugacccacagccaagggaugcacguugaaccaggagguuucccacggcaagcgacuggccucugggaaucacaucuuugugggaggagaaacuggugauuauccucuucuguuucccuggcagggacuggugggaaugagccuucaccaagcccuaggggaccggucccaggccaggcacagccaagucaggagccaaggccacauucggcagaggcucaugugucucagaccaagcagugguccaggagugaacagguccacagcaugcagccugcccugcccugcuaucuguccucauggccccacuccugggggagcuggcugugcucacuccacaaaggcacggaaagggacccuuccugacuccaugccaugggaaguucugggccucagggucucugcuccugugaggagaggccugagcuugggagggccaagcucuuaaagugggguccugcccuugcuuguguggcagguggacagauaaacggccggggcuggaaccacacagcuuagagguugugucuaaagagggcacugggucuggaguuuaaagaccuugcacagguugcuuaaccgcuccccuuucaucuccuccucugaaaguggagagaacagcugccacaugacuucucaggcauguugauauaacgagaugcuaucagcauguggguugggcaaaguguguagggagacacaugcagaagguccucauaaagacuuugucugucuucuuccuuucucuccuccacccccaucaaacucuuacucauuuuaagauuuuuuuuuuuuucacuacuuugauccuucguugaugggaaggguuuuuguuuguuuguuuugcuuuguuuuuguuuuugagauggagucucacucugucaccgaggcuggagugcaaugguguggucucggcucacugcaaccucugccucccggguucaagugauucuccugcaucagccuccugaguagcugggacuacaggugcaugcuaccaugcccagcuaauuuuuguauuuuuaguagagacgggguuucacuauguuggccagacuggucucgaacuccugaccuugugauucacccgccuguaaucccaaagugcugggauuacaggcguaaggguuuuguuuguuuguuuguuuguuuucagcaggcagguauaauuugaguucccacaacaucuuaagcccagagccugaggcugagacacaagggugaauaggacagguccucucucagaaagaccuuguuggucucuagaccagagcucacucaguaaauauggaauucucaaaaagcagcccagcaucugaacuggauccuuugggaaaccucagagggacagacaaggcugggagcucuccucucacaagauggaauugccaagaagucacccgugagagucagacauccgcguaggacaggggacauugucugggccccacagcuaugagacggcacuugagacaugugaauacgcuaccacuccuuaccacacccucuuucucugccugucuucuccuggcgcuaagaucccagaauuggugaaaaagucaaaugauaugguguugugaugaagagaagcuuaagcugaugguuacagagcccagacucggggcuggacugcuggguuugaaucccaguucuaucacugauuagccaugugagcuggggacauuauuuaacuucuucgucccuguacuuuaucaucuguacaccggggaagaugauaaaaacagcaccuaacacgucggguuguugcaaagguuaaauauguugauacuuguuaagugcuuggaauaacauucaacacauaguaagaaccaggccaggcacaguggcucacacccauaaucccagcacuuugggaggcuauugaaaauacaaaacuuagccaggugugguggcccaugccucuaaucccagcuacucgggaggcugaggcaggagaaucgcuugaacccgggagguggagguugcagugagcagagauggugccacugcacuccagccugagcaauagagggagacugccucaaaaaaaaaaaaaaagaaagaaagaaagaaccaaauguuaaauuugguaaaccaaacuuaaaaucaaaagcucaaggaggcaguuagugguccuacuugagacaauuggucucaaaaagauuuuuacaagaaccugaagcaguggaagcuuggauggaacagagcuuggagacguuccuuccagggccugucacuaauucuguuccacgugugcagacagcagccuuuccuugcauuuccagcuuguuagcgcuaauauucccagugcccuuugaggauauccaucuagcaugcacucauguagaaacgcugcuuugcaaaccuuucaucacauguuauaaagaagaugucagccugacacagacacaucuagggguggugaggaagacagucauucauuuucaaaccugucagacgagcggcucuggcgggcacuuugagcgcaggagcuggaggaagacuggcagcaccaccaggcaaugggcaagagcacagggcuaggaaauguccuucccagccaggccugccuaagggcaugggaugaguacagcaggagagaucuggcgauuaggcucgagggccaggagagcagacucugccuccuggcagguggaggugggaguacaggguugcugccuucccucagcuuccuacccugggugaacucaagcucuuggccaugaggaucaugucagaacugcugggggaagaaagugguuggggcagcuggaucacugggacaugugguuguugcugcuguguaaucuuagaucccaaaccuggacagacagugggaggaagccugacuuuucuucccuaacuaggcucucaagcuuccaggugguuuugugcucuucucaccuccgccugcucugccugcucguguccccuuccccaguacaugcggcagcacugcacaugcucagagccugcacuggcuggggcauuguuuggaguuggugugauaggguggacugugcacaggaggggcccuugggaaaucuaagcucgauuucccacuauuccuauaacccugugaucccgaacaugccacugcauugcccugggucuccgcuuucuugucuuucaaauguuggagguggaggagauggugaagggcaauagagaggcaggaaggaggaucgaaugaucacuuagcauaaggcccugcuacagacguauaugccacucagaguugcuaaccugacgacuucauauaacucuauggcagggccuugugguuaagggugugggcugggaagccagacauccucagcgucauuccaacuucaugcuucccagugagguaagcucucucagccucagcuuccucaguuguaauaaaaauaaugccuuccucaugggguucuuguguacauauaaguacacaguaagugacaaucaucaucaucuuccucauagucaugauguauuuagaggucaagauagccugcuugaauuugaaucuuggcuuagguauagugagugauuugggcaacuuauuuaaccucuaaaacucacguuccucaucugacacuagaauaauaaucaucaugcacguauuacagaguggcuuuaggugcuaaauaaggucaucuacauaaagcuccuagcacaguuccucaauacuguuaguucuuuaagaagaacuguauuauuuuccuggagguaugaucuucuuccuugggguggugggguuagguguuugguuggggugaaaggccaugucuaacuuguuagcaagagcaaaggaaugcagagggacuguuuugcaggaaugacauuccuaguccugcagucaggcccauugccccagguuacacaucagugcucugcagguaaaucacugauuaaccacaaauucagagucagggacuuucacagacaagucuuucccuuucccaacccugaguggcaaggcccuugcucacagaagaugcuucuagagcuccucccuaucccccugcccucaccucagugcaugcuuacagcuucccaguacaagccccagcuugggcucuuuuggggaaaggcacagcuucaggcccagggauauuugugcagggaggagguggaaguaguuucuggagcuugauucauuacagcagcaaucucggucaaacagguucuuacaacuucagggaggccucuuuguucuauuguuccaaagagccagacaggcuuccccacaauccuggaagguggcaggugagguggggaaggagcccucuggagucuggccagcaggcugcugccuauggcaacugcaucucuguucacauaacaccagggauccgauucuguuugauuauagcuuguaaaccuuaggcaauuggcuuccuuugcuauuugcuccuccagggaagagugguggccggaaccuguggaaaacccacugaaaccacacuagcuuuuucuugagagguggagacaagggcuagaucauguugaaaagugaaaaagacaagagagugcucagauaauucagaacauaaauuugguuuugauacaauggaauauuauucggcccuuaaaaggaaugauaugugcaaugucauugggacaccuugaaaacaucaugcuaagugaaagaugccacacacaaaaggcuacauauuaaaugauuccauuuauaugaaauguccagaauaggcaaauuuuagagauaguagguaauuccugcuugcagaggugggugagagagaaaugggagugacugcuaauggcuauuuaucaaaauguucuagaauuagauacugauuauguuugcacaacuuugugaauguccuaaaaaccacuggaaucuucacuuuaaaaggguuacuauuaugguauauggauuauaucuugauuuuauaaauuauaugauaaaaaauguggguuucacucuguaagaaacuauggaggcuauuaguguauugccaaaaaagggaaggaaaagcuggucugccagugaagauuuuggggcucugucuugguuggucaucuaacucucuaaucaucugccagacaaauauuuauugggcgccuaccacgagucaagacauugugcaagaaucagcuauauauugaugaaaaaggcgaucuguucacccuucaugaucugccacuaacuguguucucuugggcaguuuguuuaacuucuccaaacc

SEQ ID NO: 12610 - RNA, 82887 nt, Homo sapiens
cuuuagggaagcuucucugaccuugcugacuaggugaaguccugcugugauaaacuuuuauagcaucaauuacuuucccuuauagcauuuaucacuauuacagguugacauuuauuuguaugacgacuuaauaucugucuuuuccaguagaauguaaacuccuugagaacaagccuaugucuaauuuggcucaccauugcauccuuagaacacucucugacuuauaguaacauauuaggcauucaguaaggaagcaaaugguagagguguuucauaggaaauucugaaaugcaaauuuuugaggcugcccuauuuuuggauggcuugcuuaaaggcuuuuauucauccuuaauugguauggucaagauaugagaacagcucagaucuuggaccauugaucccaagugucacucaccucacuuauuugcuauguauguacuuggaggcacugaccuugauguuauuuucuauuuaauuuucuucuaaguauucucuuagccucaaauuuagccuuaauagcuuuacuuagugcucuuuucugucaucaguguagacuuacagaugugaauuuuuaaugcauacuuugaccuaaauaaauguuuaggggcuuucaauuucauuacugccauuggcacuucugucuaaagaucaacaauuccuuguugcucacugcccaguaccauuacugauguagccuccaaguaaguacugaagggggauagaaauaaacacacaagcuuggugggagaaggccuuacuaaggucaauguuuaaaagaaucauggucccuuagucaauucuaaagaaccaauuuauagacauggaaccuguggaaccuggaaccugggaaaucuuguaaccuuagguacacaccauguggaaauugaaccuagaccuuccucaaagagaggcugucauguguauggguaaauauacccuggaggauggaaaagccacaaacuuuuaggggauauuuggaaucuaaaucugaguuuacuggaauugcugaaaauguacagaaccacuacagucaguauuuuagaucaagggauuaugcuggcuaacugaaaagguguuuuaaguuuaccaucaggacccaaaacuuaccauauagucauuugcccacuaggagaguacaguugggauagcaguccucagcauguggcagaauccucacuuuguuaaaacaaaacaaaacaaaacaaaaaaacccuuaauaguccuuaaggacuauuaggguagcaucaaccaaggggaaauuaucuggacucuuuuccccaucaaaauguuaagucagaaacaagaucacuuuuucacggggaacugcagcgauuaaagcuauuauuaaagauuuguaagaugcuggccaaugauuucucuccccauucaauaccucaauauggucagugcaaaaaccaaugcuaauuccaacugcacuuugcaaucuccaaauggcuucuuuacuagaauagaugaauaaaguuccugauuucucaucuguuguccaugauaugucgauugugcauuacuuuauuccugcucacuuggacuauuaggagcaguuugauuucaccugguaagagcaacaguuuguuuacucugugucugugccaaaaucugguccucuggagccuugacaacauugcauuccuccuaggccaugacacugaugcaauacauuuacaaucucaagcugauuacuccuggagaacagcaaguggcaaugcccuaguuaacuuaggaagaaauuagagauacaucuuuaagaaauaagagaaccuacauccucuguccuagaaagaagagggagguucuaaugucaaugauaugacagaguauucucccuaaguggaaaacaaguuacgguaccuaacauuaacagggaaucuuucuggauuuuggaauuuuugugaccucugggcaccuaauaggugacacaaaaauuugcccaaaguagauuaagagaagguuuuccagcuaguccagucugcaaggaaagcuguccugccaggugacaugauagccacacugauccaguaguauccaagaugcaugagagccuugaacauaaaagaguuacugcaagguacucugggguuuuggagcuaacugaugucacauuagcaguaacuauucucuuuuuguguaacagcuccugucuugcuucuagauccaaauguccucccauuccaguagguguagcuguagaaaaaaaaacccaccaaauaucugauuaugaagucaaguaaguacgcagcgugggcugcccugcaugaauugggugucaucaguuucacaauccauaaaacuagguuuauucgaaaacacucccaagugguauauaaaacaacaggauuuacaggccacaagaguuaaaguauuauuuaaauggguugcucaacuggaacacggaggcacaggcauuuuauauauucauaggaagcacuaaagucuuguggaaugagaaugaacacauaaaccuguuucuagcgauuaaaagauuucuacuaaauaggaagcaaauaguuuacugaaguaaauuucaccagucauuaggcuucauuaauaauauuuauuuuaaagaucaacuuuuauuguaacaaauauaaagucaucaauguuuuacaaauugucaaaaaugcuuuaaguacaaaaaaauacauuaguaaaaugaaaguuauguuguauuauuugguauacacuuaauacugccaacaugcauaacauaugccagaaaagcucaugcauuauuggaagagaaaagaaaugugauguaacugcuauauugucugauuauaaauucauugcuucagucaguuuucuuucuucagggauaccauuuaccugcaauguguaagaaugaauaugggcaggaguuagucagggcauggauacuuuuagauuuugagcaaagcaaauuauggcaaggagaaaguuuccaucuucuuaauacaauguaaaauaauuacauugcauuauuucucuguauuugguuuuuuuaaaaaacagaaaacaaaagaaaaaauucuaaauuagucuucuccuucuuggaccaaagcuauaauauuuuguauuucccaagagguacagucugaaaauuccucccacaauaaacaaaaagaauggagguuaacugcaggauguauaacuguaccuuuuaaucguggcuuuuaaaaaaauaucaugugggcugguagggcagagaaaaugagaaaaccugaaggggcaucaaaccuaaugguuugggccuaguccaaaaguuagugcaauugucagcuuuuaacugcucuauuaucccagcuagugcucaaguccaggaacacaacaccagcagcuaguucauuucuuaaagcuuugauaggaauuuaaaagaaaacaaggaacuaaaugaaaaaaaaaaaaaaaaaaaaaaaaaacaacaacuucaagauauacuuuccccugauaaauuccauauagguagcuacaaauaaaauuacuugguauccaagacgcaaacucuugugccuaaauuaccuucauaaagaaaacugacaugugcauaauguucugugguacuuggaaaacuccaguuacuguuugaugauaaucaugcauaaauguagcugccucuaugcaguauuaggauaaucaggguaaaagaaaagaaaagcugccguacucacaaaaauauauaaacagcacuaaauccaugcauuuucagauagaagaauuuagaaauugagaaauaaacuuuuucauuuaaaugaacagaauggaaauaaggaauguaaacugcccaucagcccuucucuccaggaggcaugccuccauuuagguuuucuuuuuucuuuuuuuucuuuuuuugauucagagucucacucuguugcccaggcuggaguacaauggcgugaucuuggcucacugcaaccuccaccucccagguucaagugauuuuucugccucagccucccaaguagcugggauuacagguguaugccaccaugcccagcuaauuuuuguauuuuuuuaguagagacagggcuucgccaugucgggcaggcuggucuugaacuccugaccucaggugauccgccugccuuggccucccaaagugcugggauuacaggugugagccaccgcacccagccuccauuuaguuuuaaauguaccagaggcacaaacacaccaaucuugcauaauuauaaaaaaaaaugcuaggguggucucucucccuuuggcacuuaagauauuuuggggacucacuaaauaaaacaauaacaacaaaacaaccaagaggagauacuguacuuuagucuauaauaugauccaaauugcagaaaaauguaagaaaacaagaagguaauaggcucuaguguuaacuaaaaaggagagcaaagcuuucuugacucaagcaaaauaccugcucccuaaaaucuguuucagaaaaauaauuuuauaaauuagguuaaacaaccuuaaaauccccuaggaaaacucuuuggcucuuauauuuguuuaggcauaaauuguccuuguauuuggaagugcucuguauuacuaaaauguagcaaguuaacaagaguacuugcuaaaaaaucuaugugacuacuaaacaaauugcccuaauaucaucuacucaaguuuccuaauuccccuaguggguaaguaaguaaaaucuggauuuuuaaauacucaaaauaaauauuuacuguuuuucuagaaauugccugcuuccuacucacuccaugccugaaauaauuaagaaucagaagauagaaaucuuaggcgagauggaagcuacaagguuaauaacgaagaaguucuaucauuucuaucguagaaguauucuuuuagaaauuuuccuuuuaaaaaauagcugugaaauuagugguaguagggauucauuuaucuuuuuucucucuuuaggugacucauuuuuauaacaaaguuuguuccuucaucaaucuccugaaugcuuacaaaguagcaccaacacaucaauauauugaacagucuuguugaaacauguuagcauuuaauuaaagcaaguaaucaaaauuguagggaaaaauucugauaaacaucuuguaauugaaaucugaugaacaauuucauuauacuugccucaaaucuuugaaaaguugucaaacgaaaaucuccuuaaauucacgaaagcaguaauagagaagauaauuucugaaugaaaacauccaacacauuucugaaugugccugaaguuuuuaagagacuuacuuaauaguuucccuaccacaaugccgcuauucauacucagaauuccacacccaacuuacauuuuuaaaacuucucuugcuuuuccaaaagagcuacaaaggcauuaaugguucccuggcaauuagaacuaggaaucaaccacuaauuagaagacaaucaugaauaaguuaucuacucaguauagagaugaaugaaauaauuggcuguggaaaauuuuuagggacacuugaaagaaauaaagaaagcaagucuuagggaaauagaauaauccaaggagaauuguccgccaucuuguugucauuggucauguuauaacagcuuuuuaaagcggcuuuaaaaccaggccagccauuucucauuuaucccccugaagccucagugauuagucacaaugguuuccuuuuguaagagagcuugaaacuucaagcugcucacuuacugagacaaauccuggaugcauccaagcuaagaaucuuucauaccaaggggaagaauagggaacuucacugaaggaaagggguuucauucagucuuccuuaauuagacaggaccuccauggaugcuuuugcucuaagaucauuuacccuguguuuaucauucugaugccaaucuauguaauaaucuaagcuauuauucugagguuuuaagucugauuaaggaaugacacaaguguuuugccuuauuuggugaagauaaagcuucauaaauuauauagugccauaauuaucuuuuaaucuauuagauucauucauaaacauuaauuuauuauucuuagcacucaccuguagucugcuguuggggaaucugagucugauguggcaaguuccuagaaaugaugaacauuuuugaguaaaacuguuuguuuacacacuuguaaacagagagcagacauacuagaaugaaaaacuuuacggguaaacuaugaccccagucauguaauccagcacaauuccccuccccuuucaugagcuuacagaugaggaaacugaggucugaggagaauaaaaauuaacaauauuugauaacaugcaugaaauuuucacugcgggcuauacucuaaaguaccucacaacaacccuaagagguagguguuaauauuuuucccauuuuaugggugaagaaauagccuuggagauccagggccacauagcuaggacaugguagguaaagaugugaacacaguggcuugugcucuuaaccuauacacuuucagauccagaucacacauuuucauggaacaacauauauaaccaccuucauucacuaucccaaacaucugugcucuuuuaucuucgugucaggaaugacacuggccaugcauccagaugcauuggcggaaugcagaagucauccuuguuccuucccucuccuucaguccccacauucaaucacuuagggacuuuugacauuucuuuuugucucauuuggaucugccccauuccuccccaucuccauugcuaacuugguugaagccaucaucauuucucacuuggauccuuguaaggggauugacuuguuuccucauuuacauucuuguccccuuauaauccacucugcacauugcugucagaauaaucuucuaagacagggguccccaaccccugggacacggaacugggcugcccagcaggaggugaguggcagguaagccaucgaagccucaucuguauuuacaggugcuccccaucacuugcauuaccaccuggguucugccuccugucagaccagcggcagcaguagacggucauaggagcaugaacccuacugugaacugcguaugcgagggaucuagguugugcacuccuuaugagaaucuaaugccugaugaucugucacugucccccaucacccccugaugguacugucuaguugcaggaaaacaagcugagggcucccacugauucuacauuauggugaguuauauaauauuucauuauauauuacaauguaauaauagaaauaaagugcauaauaaaugcaaugcacuuggaccaccccaaaccaucccccacuccuggucugacaugaaaccaguuccuggugccaaaaagcuuggggaccacuguucuaagacacaaaucugauuaugucauuuaaauaacacacauuucaauauuuccuuguaucuaucugcagauuaaauuucagauuucuuaauguggccuggaaagccacaauauaucucacuccuacauggagugccccaugucugcuugaagccaacaaccaacuaccauguccuguacacaaucagcucccauuuguucuugcuaacucaacucagaacuuguuacagcauacagguauuacucuuauaguuuaaaaauucccaugagaaauguuauuaaaauuuuuaacauauuauuuuuaauuaaaaaaaucucaagaaccaccuuccuaugcauccucacucucuaagcaacccacaaauuagguuaccauuuagcaugcuuucauucacaugcugauugucauuguauucucuguauauaauauuuaauugccccaaaguauauuaagaauaagaaccaucauauuuuguuuaguauccucagcaguaagcauuauaaaguauauacauuuauuaacuuacagauuuaguuucacauauugauacuaaaauuaguuuaugaaaauguacaauuuagguucuguauggaagaaacuccaggagucaguccuuuguaauaaaguuugauccaagcuggggauuuucaguuuuuuguuuucucuuuagcacugggauuccucuuaauugaaacccuaagcagaacugugauguacaaaagagauaaaugugagguugccuggguugaaacaagggaguuaggaauccugucagcuuuguuuucuuugucccucaugcuggccccuacagcaauucuaagaaaucuguaaaaaacaguuugaaaaccauugauaugaauuauuucagccaggcaaauauuauguuccaaauacaacaaucuaaaguggaaaacagugcgugcuaguuaaaugcuguuuaaacucuuaaucuauagguaacaccuuugagaguuuuuuuuaauguuucaguuccacuuuaaagauauuacuagggaaauaauaaacucaacucuaacacaauuugaggaaguuacuuaauaauucaucccgacgauuauauucguuuuuauuguuacuuaucagccuuauccuuguguaggcuagaggaguauuucuuuuuuagcuuguuuguucuuucagaauuucacacaauguauuuauauugguuuuggucacaaaaguaaaaagaucaauuuauaaacuacaaagagggaauaaguucuacauuuaaagauggcaaggcaaauaucuuuacuacagaagucaaaaugcaauuagaugggcaucucacacagggugggaggauguguuuuauuuuaccuacucagguauaacugaucugggucuauucuacacucaaaacgaacacagugcaccuucuacacauaggcgcacaccacacacaagcacuuccucauuccuuaccaucucuagcucuaccuagccugucagcagauugaaucaacacauucugacaaaauacaaaaaucaaacaggauaaagaaaauauagaauguagguguucuaacauagguagugguuaguaaacaaagacacauguuuuccaaaagcacuagauuaaggauccuccaaauucaaaaucagcauuuggaugagguaguuggaugccccccacuucucuuguuggcccucccaacugaccuuucuguggaauuuagcuuggaaaccacugaucaaagucaaccuaugcccugucguuucuuuucuagccuccguuuuuuccucuuuugcuacauugcuaaacuuucuaaaucacaaugggcugggcuaggugaaaagacauggcugguugagaaaaaugccacacacaaacuagcaagaaauucggagaagaugcauaagaaagcaacugugugucuuauauugauuuagagacugaaaaguauccauaguggguguucuaagugguuguguuugaacaaugcucaugcacuccuugcaguuucaaaggaaacuuagaugaguuauauuaaaaaugcuugugugcgcaaaaaggugcucaaccaaaaaaauacugagauucaacauccccugauuggguacaaccuaucuccuguuuugaaggagacccuugagucuccaagaugugugcacauagcucuguuuuuguggcuucccaaacuuguaacuaaaugugaaccuguaaguauuaaagugugaauguaucuaugaugggcauauuuaaaacuguguauuucauuuaagaguugaagggacauacuuuauaacagcacugcuucaggcauacuggaaaaaaugccuucaaucccaacucugcuaguuaagaugcagagaaugcaggaagaaaguggcaaauucucaucuuuggugagagcaggcugcuaaaggcaauuauacaggagcggggggucgacuucaaauagaggcccuauaauccuuccaaggagggaccuuaaugaagucauaaaacaauuuaaugauuauuagacuaagugaaaaguuauuauguguaaacugcauuauguagaaauuuaagaaaacuguaacuaaauuauuagcauuaauuauuuucucauuuuauguucauuaauuucaugcauuuaaauagaaaauuguguaaauuagucauugcacaaacuucauucuuuaagaaugcaagaguaauaacuugcaaauuaauaaauaagugaguuggggggaguacacaauuauuucuuauguguacaaccauuuuaaaguaauuugacauucuuggauacccuauaccguaauucugugaguaagguugaugauuaucaacugauuauauugcuacuuguuucaaacuaaaaagcaaaaugaugauuugcauaaagccacagaauccaugccagaguucaaagaaaaugacacuaguugugugaaauacaaaacauuucacuuuucaguuaguauggugacaucauuuaacaauaagaaauaguuauauauuuuuggaaaacaauggcucugaaauauucuuggcugccugauacuucucaacaggacaccauaaucuuaguccccugaaacacugucuucaacugauauuaacuuuuauuaaaacuuaauuuuuauuuauggaauuuuaccauaaaguuaguugucauugugaccaaaagcaggacaaauggaaaaauauuuaaauaaaagcuaaaaugauuagauacugucuucaauuagaagacuuaauucuacuuuuauacuuguuaauuuucaaaagauuaaguacaaccuaucuccuguuuugagagagacccaauuauccuggauuaggaauuauguuuagaauaaugaauaaggaaaauuuuuguguagcaaauuaauaucuuccugaaaaauguguggaguacuauuccccaauuauucauuaccuaaggggccucaugaagaugccuaccacuccaaaaaaaucaauugguauugauguuggcauaagaaaagaguagugaagaggcagaucuuuccccaaaagacagcauaccucacuacaaauuuaauauaauaauaaauuauuuuuuagaaaaucaaauauuugggauccuccagucaaugucccuuuccccaagcauaagacuacaaaauaacauuuuuucaauggcuuuuagcuguuccaggcacuguuuucugauuagcucucaucucucaaccucuccacaccauuuuccucaggcaguuuaaggagguauggaagagucuagaggcugagaaguauaaacucccaaacagcuccaaccuccuagacaaugugcauggacugcuauucuuucaguuucacaugggggaauuuaggaaaaacuguuccccuuuuaaaacuccauguagaggaaugugaauaacaacccuucuuacucagagcucuggauuuuccaauccugaaacuuaagucuuuugauuauuaagccaggaauucucaaucuuuguugagaagcucucugcaggagcucuaccauaacauacacuuccaccagacuccaaauucccauacucagagccccagaauguguacuguaaaagcucuauggugauucugacacaacgugguuugggaacaaggcuagacucucucuugacguuccuuugaugaccuaaaauguuauuacuuggaauuaaauuuuuuucauuuaaauaauuagaaagggcaaucauugagguacaccggucaaauacguaauagauuuuugaugugaagucuuuggucacaaacauaacaccagucacaacaaugauucuuugggcaaagucaauuuacuuuuaagaauuacuuuacaaugugauuuccaggaaugaauuuuaauaacuaagacaaaugucuauaggggaaaaaauuauuacugcuauuaauggcaacacuuauucacuaggcuacaaagauaacuaaguacagaugcagaaaaacuuacuauaugagggcaugagggacauacuacacaauaccuggcuauagcuccucaugacugucgaggucaugggacacaagaaaggucuaagaaaaugcccagaccugaggagacuaaggagacauagugauuauuguguccuagauggaauccuagaacagaaaaaggacauuaguggaaaaacgaaugacaucugaaaaaagucugaagucuagguaacaguaaaguaccgaaacuggguuccucauugugacaaauguaccaugguacuguaagauguuaacaacgggagaaacuggcugaggcguaucugggaacucucuauuaucuuuguaacuuuccuguaccucuacaaucauuccaaaauaaaaaguuuauuaaagaauaaacacauuagccaagaucaaauuaaguuggccuuacauuucuagacuaugugauaguuuuaacagccuauuuauauugucucuguaauuugaaaagcaaaagaaacacaguacaaaaugaaacaccucauuucuaggcaugugcuacaucuccagguucugcuccagcuucccuguccacugccucuuuauucauuuugcuuauaaccugaaucagagauccuucugaggucaaugaccgacacuaucuaucccugccuagauaucaggauagguaaauaaucuaaucucaguucugaccuaauuuaacuuugucucuuaucagugucucaaauuuaucaucugcaaaugauuaaacauuuuuucuuacugacuaauuuauggugccagucuggagcucugugaaacauucuaccaaaaagaaaauauuacuauguaauugauaaugguggcagccauucauuacauaacauugugaguucucuauaacuuugauguaaauugacuuguuuaaaggaacaaacuaguuuuaugcaguuuugaaagaaagcuuugaauauucuugagucuugcuuagaagccaauauaaaccuuuagccauauccaugucugaauauuuccgguaucaaucugaagaauaaacaugaaauccuuuggcuagcuaaaaauuguuuaugaaugauaaauucaguacacuuaguaugaaugugaagaugaaaugcaugcccuuauaggaaggguaaauuaauaaguacaagacagcauuauccaagcauauaccugguuauugaguacuguaaugccucccaaaauauaauaucacauuuuaaucuugagaauucaauucaauccaaaugaccaaaauauuugugugugucuacucagugcugaaguaaaacuuuuaaaacauagcuguuuuucugguaaaaaguaaaaguugaauuugcauaaaggacagcuaugaugaaccccauacaauaaauucccuauuaucuggcauggcuggaaaaugagguuaaucacauauucuggcuuauagggaguuaccauagagacugugcacauauuauccauuucuaagaauaaaagaaagauaauauacacucaacacugaaacgacaccgaauguaauuuaauuuuccucugaugagucagacgcacuugaugauccugcagugccucagaauaaucauugugaacaucaucaauuaucuguguacccuauuuauauagaagugcuaguuaauggagcuuuuccauuagcagaaaucugaauaaugugaagguuuucuggacuuaaaaauacguauguguuuaaauuguugcaaguucaauauaauagccuauugcauuugcaaauagagagaucugaucaaccuaaugacagucuugaugggguuauggaaggaccagaaagauccauuugguguaaacuagauagaaaauuuuauuuugcuuguauauuaguagcaacauugcaaaauucuaaccacagggaaucaaaauacuuuuuaaggagcuauucuuauuuucaauauaugugguuagaaaggguuaucuuaaaaugacagcaaccuuuuuccgcucuuaaauuucacuagcaauagaguuuuauugauuuacaaacauauucaaguuccccuacucauuauaacuaguuuucuacucuaaaauucuacagcacuguuuguuacauuaucaacagaagcauuucucaaacuguguucuuugaagaguuaccuauucugaccuuuuccuauggauucacaaaguguaucaacacacuaagggacugaagacuguuguagcuuaaaaaacagagaaauaaaaccuuuacguuacaguacucgauaaccagguauaugcuuggauaaugcugccuuguacuuauuaauuaacccuucuuaaaagggcaugcauuucaucuucacauucauacuaaguauacugaauucaucauucauaaacaauuugguuagcuacaggauuuguuucauguuagaauucugcaguguugcuacuacuuuuuuccaaguguauuugaucauuccauuuuuuugaaggauaucugucaacauuucacuggcacgcuaggguaaacaauaucagaaauaauaaccuuaaagaauaaguacaaauucuuuucauuuugaaaaugaaugauaaagccauuucauaauuuucaucuaaaaagggauaagagguuguuaaauucugaauuauuacaauauucuugaaauuuuaccaauuuuucucaucaguaucuaaucccgguaaacuggguuuuaugaugacccauaauaggugggcuacugaccaccagagagcauagaaacccauccguugcauucaguacaacuaaauuuuguagacuuuaauauuuauaucccugauauauuaauguuucaaaaauucaaaauuguaaacauaugcaauuucacccauuucuuaaauuacccacuacccauuacuuacacucucauacacacaugcacauaaacaggcaccuuagucuguaugacccuaagugauguuagagaacuuuagaaaaauauucauaauacuuuuggguuucugaaguauucuggauaaacuuaucuagucuaucuauacuacuuauauuaauuauuauuuaaucuucaaauuaccacaugcauucuaccugguuacagaauaagcacucaaugggaaaaauguacccagcagaguucccagguaaauguguucacuuuaauauuauauccuaagggguguguaugugucuguguguaugagagagagagaaagagagacugagagagugagaaagagagauuuuucugcauagccauuccaucuauaaaaguaaagugaaaaagaggaggaccucaaaagccaacuucaugacuucuagugcuuagggcaauugaauucaacucauuuuaacauuugguuaaaaagaaaaaaggccgggcaugguggcucacaccuguaaucccaguacuuuggaggcugaggcaggcagaucaccuaggccaggauuucaagaccagccuggccaacauggugaaaccccaucccuacuaaaaauacaaaaauuagcugggcaugggggcaggugcguauaauccgagcuacuugggaggcugaggcaggagaaucacuugaaccugggaggcggaggcugcagugagccaagaucgcuccauugcacuccagccugggcaacaggagcgaaacuccaucuuaaaaaaaaaaaagaaaaaaagagacauauucuuauaaauaacaguuuuacccaccauucccuuauauaaaaauguggccacuaggcuacauuauaucagcaauauaugauguagcauaaugcugcauuacagcauuauauagcauggucucccaaaugcaacuguacaguuuccucaccccucacccuugucuacuccuuacaaaguccuucuagccuuucuaacccugaucccuauagcacuagacaagguuugcacuaauaaaauagguguuuauaguccaaauuggagcugcuugcucugacauacaagcagaucauaaaaaacaacccaaacacccuuaauucugaggcaaaaauuuagauuacaaaggucuaugguaauaacauuuuaauagguuuaaaccaaauaauucuaauaucucuaaaaauaaucaauuugaaaugcuuaggauaugguucuuuuuuuuauaauuaacucaucuuugagcaaacauguaauguugaguuuaauaucagugucaauuucuuaaauauuaagguauauguagucuuguuuggaucagugggggaaaaaaagugcauuuccuaaaaguaauuguauuguauauuucaggagaguaggggugagauuuacacaauguccuuuuguuauuuucucuuccaguuauaaacaaacaaacacaacaacagaaagcucuguucuuuacagauauuaguaaaaauauacaugcauauuaauaauuauggcucuaaguggacacuuacugcugcguuugcaucaauggcauguuugugcuaucauaguugucuguguguaaaggagguaugauuuccccagucacaggguggaacacaggaagcguugacaggggccaugcuaucucucuauucuuggacaugucucgaagcuccuugguagauuucugaauagcacugugauggaccaguuggaugcuaggucaaaaagaaauaaaacaacauauauuuaaaaucauauauuagccugaugggucaucaauuugaaaaacuuaugaaguauuuuuaucuuuuaaaauaauaagacauuauggcacuuugggcauucaauaaacuauuucagaaaggcauacaucucacauacuuuuaauauaacaaaacugaaaauuauaaacugauuuuaaaauacauagguguuuuauuaaacuaagcuaugaagcauuguauuaauauuacuguccuaaguaaccaacuaguuuucuauuuauuuucuaugauuuaagauaaaacuaccauagcuuuuauauuuuugcuucugguggggcauuuauaaauacucacagaaguuucauuuuaugguagguuauuacuguagauucuggaaaacuuguaugaaaggucuuuucaucuguucucugguuuauagaaaugcagauuggaaaucacauaauauaaaugguaaguuaauauucugaaucugaaauauuuuagguuuaauuuuuaucuguguaaucuuaguuuucaaacccuuuuuaguuuuaguuucuaccccuccuaaauaucucuauuuagaaagcagcuuucacauuuaugaaauaaacuaugaaagaugacaaaugaaaaaaagcuugacacacauguauggagcaugaugggcaacugagaggugggaaaaaaugaugaagaaaauaacaggaaagaagacacuuacucugguguuugcauguuucucuuuucccuagaaacaaaacaaaauuuaugaauuaaauaauagcauugauauuuggaacauuaagacuauaugcucaugggaucuugcaugauguggaaaugcugacauugucacuauuaaaugcaaccaggcagcauuugccaccagguuuaugacauugcuuggaugaguacacauacagcgauggaauacugaugagaaacacauagaaaaaugaaaaaaauggagauuaagaaucaaggccuugauugaaauaaauucuaugacauaaugaaaucaagcuacauguaaaaaugaaagaauuuguuacuugcugcuuuauuaauuuuuuauccuuugcuuuguugcccugacuuccagauaaucuugggagauuaccuuaauugacauagauguccugaagguacuaacuauucaugaagugaagacuuguuacucaaauuauaccuuauuuucauuaauuuacuccuaaguuggguuuuaaaaauauauuuuaaacauuaaauuguguuacccuguuugacagcagaaugauuucaagaguuuugaccaucacuucugaucaaacuaacacaauuuuuuuaagugcaauuaccaugucaguagauucugcagucucugcucaugcaagauggcuuguauaaccaaaauaucuagccucaauuauucuugggacuguuuugccagugugaauuuacaucuagccuuaauaauuuuugaauaaaguaauuauauccccuaauuugauuuacuagacucaaaacuauuuuaauucauuuuaaaggaauaaaguauugcaguuuggacacaauuucaauucauuuacaaaguguuuuaugaaccaaaugaaacuuugcuuuuaauggaaucuucuauguuguuaucuuagcaggaucucuaauuaucuuauuaguuuuaaaguacucacacgccuucccgucggcagcacaugauauaagcaaguauuagaaaaaggaccagugccacugccgagggcacagccaguguaauuaggaaauccguguaauagucucugcuuuucaaagaaucagaaggggguuuguauucuccaccaucagguaaaauccccucuccacgaaucacuuccugauagguggacacuugcuuuguuuuaucaaccugauauaaaagaagacaauuacacaacaaauuaaucguugcaaacauuaugagauuuuaagaucuggauacacuaaagcauucuuugacaaauuaucuaaaaagccaucuuuuccaauuacuuuaucaccucuugaauuugcaaguauuuauuggagguagggaauguaacaaaugaaaguaauaaaggcuuuacuuuggucuacuuucuauguucuuccuaaaacauauauacauauacauuuacauguguacauauuuaacgugugugccuauacguguaguuguucuuuuucaguuuccuuccucuaaagcaguaguccuuuacacuaccauguaaaugucuuauuuccuaguggcaaagcucaagugcagauuuuaccaaaccuaaaacuggcugaaaaccagguaugcacguaugguuucuaaguuuagcaaaagaaaaaaggaaaaaaaaaagagggacaauuuccaaacgugucguccuugaucuuucugccuuccagcugacagaaguaacuuuuauggaagauagucuagggaauauggaaccuaucccagucuuacuuaauucuaucccaguaucaaaaaaaaaaaaaaaaaaaaaaaaaaaaaaaaacuacaacaguugcacuauguuaauuuaccuccacauuaauugagcugcuuucacugaguugcauuuaauuaugcuaagguuuuuauugaaggacacuaaaaauauagccaugugaaauuugcuacuacauuugcuacuaaaauaaaaugcuggggagaauuaguugcagcauuauucaguaucuucucccaaaaaacuccacuugaaaaauuuuguuaauaauacaguguuaguaaaaacuuuuguuuucugccaaggaauugaugugccuccuuuuuaaaaaugagaacuaaauaugaauuucauuuauuuuuguccugcacauuggcggcuuguuguccaacacagccuugugcuuauuuuuggggggugaaauuuagguccugauuuuccauuucuuuuauauuuuauuuauuauguuuacuguaugaaucuuauuuaaccuucugaaaucuuuuguggcaagauguggcauaaaaauaaauacauguaaaauaaaaaauaaaaauucccaaccuuuccacuuauaaagccuuaacagauaaacaaaaaucuucaaggaguauaucauuuuuuaacuuuuagagacuggguaauaguccuaaacauaaacucauuuuccagaacaaccacaaguaaaauggcauuguuagggucuguuggccacugaugaugcugggagaggaaccuaaguuaugguugcagcugcucagucuccugcacccuuguaucguuagcaccaugauugaacaaauuuuccuauaauaauugagcaaauuugccuauaauaauaauuuuacuugauuuaggaaggcaaagaaggccauuuuucuaaaggccaugagacaagaggcaugagaaggagaguucaaggcaaaaggccacaaggagugcuaaguguugcaaugugaguaauauguucuccaggaugcagcuggcucucuaagacaugaagugauaauuguguuuaugugucaauaacuuuguucaaaugucaacuuuaaacuuagaucuaauucacucaccaccaaucauaaagaauugacagaaguuauaucuaaaagaucacuaaauaauuaaaacaucaguuggauacauuaauaugaaaagaaaaaaaaaacaaagaauugaaacaacucuccugcuuuucagauaacaggaucaaaauauuauauacagacauauaauauaaaauaugcaaacauauguaaaauauuacacauaucuuacauauauuugaaaccuuacauuuuccuaaaucuguuaacaugcaaauuaaaaugugauuuggaaagaaauauuauguuuaugaauuauggguaagauucuaacuuucuucacuuggaauugucucuuguuucuuggacuuucccuauaauuugaguugucagaacauuaaaucauagcacaauacugcuuuauuuucagauuuauuauuguacuccauccuuuccuuccaaaguggguuaguggcagaauauuuaagaagaaucuuucugcacauaucauacuaacuccacuaucugugcucauuagcagcuauauggaugcccaagggguucauuuggaccaccugccaagcuaauccagccccagcaauuaaucaaggauagaauaaguacaaaaguggauauauucuuuccuaaacggaugcacugucaacgagcuuaccagauccuuaaucucaagggaagucaacugcaguuaaaguaaaccuaggauuuauuccuaaaagcaguucagguuuuagucaaacguuaacuccagccacauuauuuuuaacuaaacuugcaaaaacaaaauaaaaacuuaccaaugaaauuuugcaccagucaauguaaaauugaguacgaaauuuuuuaucacauguuauuacaggcuccauuucuugacuacaucucaauugauucuguggauuuucaacuucucguaaacaagaagaaaacgggacaucugcaccaaccaugacauaaacgcuguaaaaaugugaaacucucagguuauccuuuaagaaaauugaaaacacuaaaaaacaauccaccuuaaaagcaggauuuagccuuuugaauugagagauuaacuagacucaucccugagguaggggccucggcucuaaaaacaaugauucauguaggggcuuccuuucauucauuccuuuauucaaccaauauuuacugagugcuuugguauaccagauacucucuccauucuauguuaauuucuaaaaacuuuauuucaucccauuuauuuucauucaauauaaacaugcaucauauucugauuacuauauuuaguaauuacuauauuuaguagauauuuacauuaaaacauuauccuuaagguaaauuaggaaauaaccccacuacuacaauaauaaauaacuaaguaauacauuucacuuaauuuucuuguaauaaaacuuuuaaauuacaucccuggagguauggagcuuuggguagacauuacuauuuuaccuaucaguucuguuaguuuuucuacuacacaaaccccuauaugcuuggucucucauuagaaggccuugcaaucuuuuaucuaagacauuaauauaaggguaaaacuauuguuugguaaacacaaagaggcaaacaaaauauuuuguugguuugggggaauuauggggaaagaucucuacuuaacuggcuaaaaagauuucacaacaggaaauagugacaacaguauuuaaauaaucuuggagcagcuugagaagauaggaaucucauuggccuuucaaaagaaaagagaaaaccaggaaaauacuacaaguaaauacuguuccuuuucauaaugacaaugcuaggaaaaaaaugacaauguaaaaugaaguaaaaccaucaaaauucuagcugccuucuuugcagaaguugacuaacugauccuaaaauuccuaaggaaguucauagcacccagaauagccauacacacacacacacacacacaaauuuggauaaggaaaaacaaauuuggaaaacucacaauucccaauuugaaaacuuacucagagcuacaguaagcaagucaucugguacgggcauaggaacagacagacagaucaauggaauagaacugagaauccagaaauaaacucucacauuuaauaaacugauuaucaucacagguaccaagacaauucaaaaaggaaagaauaguuguuauaacuaauggugcuggaaaaacuggauauccacauauccuguccuaccuaagaaggcaaaugagaagcauaugugaaauuuauggucuugaggcauaggcucacuaaaagauugaaaacuaaucauagaauuauuuuuuauaacuaauggugcuggaauauauauauauauauauauauauauauauauauauauauauauauauauauaauaguuguuauaacuaauggugcuggaaaaacuggauauccacauaucccguccuaccuaagaaggcaaaugagaagcauaugugaaauucaugguccugaggcauagguucacuaaaagauugaaaacuaaucauagaauuacagaauucuuccccucccacaacaccugaccaccauauuacuaaagaucuacuuauauucauucuuuuuacuccauacauuaguccagcuagcaagaaaaaaauuauaaaacauacuauacagcaaaaagcacaguuugaaaagacugaacaagcaucacaccggaaucagauauggcagagauguugaaauuaucagaccagaaauuuaaaacaacuaugacuaauaugcagagggcucuaaugaauaaagugaaacuacuuugcaagaaauguuaaaauaacuucuuuugagagauggaaaaugauauaagucagaaacucagaucuacauaaagaaaaguagagcaucagagaaggaauaagugaagauaaaaccuuuuauuuuucuuaauugaucuaacagauaacuuguuuaaaauaauagcaacaaucuauucaccauauauccauaaauguauauaucuacauauauguuuauauacacuuauagauaagcaaaauaaaugacagcaaugauacaagagagaugagggaaagacagggauuauuuuaucauaagauaccugcaauaccuaggaaguaguguaguguuauuugaaagugaauuuggauugguuauauauguauauuacaaacucuaagacaaucaguaaaagacaguuuaaaaaauacaacugauguguuaaaagaggagagaaaacaaucauaaaaaaugcucaaugaaaacuauaaaaagugggaaaagaguggaagacaaaaauagaaacaaaaaacaaaggcaacaaacagaaaacaguaacaaauauaguagauuuauauuuuauuuuauuuuauuuuuauuuuauuuuugagacacagucucgcccugucacccaggcuggagugcagaucucagcucacugcaaccucugccuccuggguucaagcaauucuccugccucagccucccaaguagcugagacuacaggugcccgccaccacacccagcuaauuuuuguauuuucgguagagauggguuuucaccauguuggcuaggcuggucucgaacuccugaccucaggugaucugccugccucugccucccaaagugcugggauuacaggcgugagcuaccauggcuggccucaauaaucacuuuaaacaucaauggucuaaauaccccauugaaaagacagagacugucagaguggauugaaaaacaagauccaacuauacucuuuauaaaaaauaucuacuuuaaauaggaagacacauauacauuaaaaguaaauggguggagaaagauauacuaugcuaacaauaacuaaaaagcaggaggagcuauauuaauuucagacagagccaaccucacagcaaggaaacuuaucagagacaaagaaaggcauuacauaaugauaaagaggucaauucuuuaagaacauaaaucacuccuuaauguguauaugccucauaacagugcaucaaauuacaugaggcaagagcugauagaagugcaaagagaaauagaugaauccacuauuauagcuggacauuucaacaucucucuaucagaaauggacacaaccagcaggcagaaaauugguaaagacauagugaaacucaguaucaucaucagucgacagguuuuaauagacacuuagagacuacuucauccaaaaauagaauacacauucuucuuaaguacacaugaaacauuuagcaacauuccagaccauaaaaaauuaacaaauuuaaaggaauggaaaucauacacugucuguucucagaccccgguagaauuaaacuggaacucaguaucaaaagauaacugaaaaaucccaaacuacuaggaaacuaagcaacagacuucaaaaauugcacauggauuaaaggagaaaucuuggaugaaacuugaaaauauucugaauuaaauaaaaaugaaaccauaacuuaucaaaauguuuacaauuuggcaaaagcaauacuuagaaggaaauucauagcauugaaugcauacauuagaaaagaagagagaucuaaaaucaauaauugaaaccucccccucaggaaacuagaaaaagaagaacaaaugaaauccaaaguaagcagaagaaaaaaaaaaucagauaaucugcacaggccuauauguaguaaggaaauugaaucaauaauuaauaaucuucuaaagcagaaagcaucagguccagauggguucacuguugaauucuacuagacauuuaagggagaaauuaugccaacucucuacaauauuucucagaagacaaaagccaaaagaauacuuccuaucucauucuaugaaacccaaauuaccuuaauaccaaaaccagaaaacaacauuacaugaaaagaaacuacacaccacaccagcaucucucauaaacacaggugcaaaaauccucaacaaaauauuagcaaaucagauucaacaauguauaaaaggaauuauacacaaugaucaacugggacuuuccccaguuaugcaaggcuaguucaacauccaaaaaucaguuaauaucacaucaacaggcuaaagaagaaaaaucacaugacagcaucaucagaugcaggaaaugcauuugacaaaauccaauggcaauuugugaaaaaaaaaauucuuaguaaacuaggaauagaggggaauuuccucaauuugauaccuacagcuaacauuacucuaaaugagaaacuugaaguuuuccuacuaguaucaggaaaaaguuaagaauguugccucucaucacuguuuuuuaacaucauacuggaaguccuaacuaauguaauaaaagacaaaaagaaaauaaaaaguauacagauuugaaaggauuaaauacugucuuucuuugcagaugauaugauucaaaagaauugauuaaaaacuccuaaaacuagugagugauuacagcaacguugcaggaaucaguaauaaccuuccaaaacagaaagcaucaaaauacaugaggcaagagcugauagagcugauacuaagauuaauauaauaaaguccaucacuuuccuauauaccagcaugaacagguagaacuugaaauuaaaaacagaggccgggugugauggcucacaccuguaaucccagcaguuuugcaggccgaggcaggugggucaccugaggucagaaguuugagaccagccuggccaacaugacaaaaccaucucuacuaaaaauacaaaaauuagcugggcaugguggcacacgccuguagucccagcuucucaggaggcugagccagggguugaacccaggaggcagagguugcagugagccgagauugugccacugcacuccagccugggcgacagaguacccuccaaaauaaaauacuuaaauauaaauauaagucuaauaaaauagguacaagaucuguaugaggaagacuacaaaacugaugaaagaaaucaaagaagaccuaaauaaauggagagauauuccauguuuaauggauaggaagacuaaauauuguccauaugccaguucuucccaaauuaauuauagauucaauguaaucucaaucauauucucagcaaguuaauuugcagauauuaacaaacuuauucuaaaguuuauauggagaaacagaagacccagaauagccaaaacaauauugaaggagaagaacaaauuuugaggacugacacuacccaacaucaagauuuacuauaaagcuacagcaaucaagacaguguaguauugggaaauaauugacaaaauagaucaaugaaacagaauacacauuuagaaauagacccacauaaaucuauucaacuaaucuguggcaaaggagcaaaggcaauacaauggaggaaagacagucuuuugaacaaaugguguugaaaaaacuagacuuauacauguaaaaaaugaaucuagauacauaugcccuucacaaaaauuaacucaaaaugcaucacaggucuacaugcaaaaugcaaaacuaugaaacuucuagaagauaauagaggagaaaaucgagaugaccuuggauuugaugaugauuuuuuaguuacaacaccaaaggcacaauccaugaaagaaagaauugacaagauggacuuaauuaaaauuaaaaauuucucuucugcaaaagacacugccaguaguacaaaaagccacagacuacaaggaaauauuugcaaaaugcauaucugauaaaggacuguuauccaaaauauacaaaaaacacuuaaaacauaaaacaacaaacaauccaauuaaaaaugggccagaggccagaugcaguggcucaagccuguaaucucagcacuuuuggaggccaaggugggcagaucacuugaggccaggaguuugagaccagccucgccaaaauggcgaaaccccaucucuacugaaaauacaaaaauuaucuguguaagauggcaugcuucuauagucccagcuacuugacuugggaggcugaggcaugagaaucacuugaacccaggaggcagaggcugcagugagccaagauugcaccacugcacuccagccugggugacacaguaagacucugucuaaaaaacaacaacaacaaaaagccagagaccuuaacagacaccucaccauagaaguuauacucgugguaaauaugcacaugaaaagaugcuccacuuuacauaucaucauggaaagacaaaugaaaacagugagauacgcaacacacagauuggccaaaauccagaacaguggcaauaucaaaugcuggcaaggaugugaagcaacagcaacuuuuauucauugcuggugggaaugcaagaugguguagccaauuuggaagacagcuuggcaguuucuuacaaaauaacauacuuuuaccauaugauccagcuaucacucucccuauauuuacccaaaggaguuaaaacuuauuuccacacaaaagccugcacauggauaucuauagcagcuuuguucaugacugccaaaauaugggggcaaccaagauguccuccaguaggugaaugauaauuaaaccgugguacauccagaaaauggaauauuauucagugcuaaaauggaauaagcuaucgagccaugaaacgauauggaagaaacuucaaagcauauuacuaagugaaauaagcaaauauggaaaggcuacagacuacaugauuccaauuauaugacauucuggaagaaaaaccacuauggagacaguaaaaacaucaaugauugccagaaguuggggggaaggagggaugaacaggugggacauagaugacuuuuaaagcagugaaacuacucuguaugauacuauaaugauggaaacaugucauuauacauuuguccaaacccacagaauauaaaccgccaagaguaacaccuaauguaagguagggacuuugggugauagugaguugucaguguagguucaucauuuguaacaaauauaccacucuggugggggauguugauaaugggggaggcgaugcaaaagcaaucucugcaccuuaugcuuaauuuuucuauaaaccuaaaaauucucuuaaaaauaguauacgcacaaaaaaaucaaagacuuuaagagcuaaaacuauuaaacucugagaagaaaacagguguaaauaugaccuuggauuaggcaaugauucuuaaaauaugacacuaaaagcuccagcaguaacagaaaaaaaauaaauugaacucuaucaaaauaaaaaaguucugugcuucaaagaacaccauuaagaaaagugaagacaauccauggaauaggagaaaauaacugcaaaucauauauuuaauaaaggacuuguauauagaacauauaaaaacucuuacaacuuaaucaaaaaaugaauaauucaauuaaaaauggcaaaggauaugaauagaccuauuuccaaauaugauauacagauaucuaauaugcauaugaagagaugcucaacaucaccggccaucagcaaaauagaaaucaaaaccacaaugagauaccacuucacuuucacuaggauggcuauaaucaaaaaggcagauaauagcuagugcuggugaagauauggaaaaguuggaacucuccuauuuugcugguggaaauguaaaaugcaucugcuuuggaaaacagucuggcaauuccucaaaauguuaaauacagaguuaccauaugacccagcaacucgauuccuagggauauacuucagaaaaaugaaaauauaugucuacacaaagacuuguacaugaauguucacaaugacaucauucauggucaacaagugaaaacaacccaaaugcucaucaacuuauaaauggauaaacaaaagauggcauauccauaaaauagaauauuauuccaugauuaaaaaugaaauacugauuuauucuacaacauagaugaaacuugaaaauguuauacaaagugaaagaagccagucacagaagaccacauauuauauaauuccauuuauacaaaauguccagaauaggcacauuuauagagacagcaaguuccuuaguggcugccuagggguaggggugggggugggggugacuucuaauggguacaagggugggugugugguguugggauaauaacaacuuucuaaaauugguuauaauaaugauugcaugacugugaauuuacuaaaagucacgauuuaaaauuguacauuuuagauaggugcauuguaugauaugugaauuauaucucaauaaagcuguuauuuuuuuaaaaugaaaugaaauaaaaguacagcacaaaaguucaaagcuauguaaauguaaauaugaagucaugaccaagccagagaugacaacuguguucgagaauauguucacacaaauucauuugcucuacacaucaaauuuauauuaggauuuaagacucauuugaaagauuaucuuuuaaaaaaccuauuguaccuuugggaaacaaauaguaaauaaugggcaaaauuaaagaucaaauuaaaaauucagaacaaaaguagagaugagaaaccauugguauuuagaugaucagaggauauaaacauauucgauuuaaaacaaguuauuacuuuuaagccuugcauacauucaguuucuauccuuuuaguaacuaccaaggcaacaccauauuuuuccuugguaauugugaaauauauuuguaaggaccgagauuaaaugaauguuucuuacaacuguuaauggcccucuugcuuagacaagacauugauuuguauuugcaauuaguaagauuuuuaauuaauuccucucaagguaacauaaaugggcauaagagauuuucaugcuuugaaauguuuuuuuucuuaaauuauaaaaccaguauaaaaacauuacagaaaaccugagguauaaaaacaaaacucauuuauauugccaaaagaacuauuuucauuuuccaauguaccuugcagaauauuuuucaaaugcauauauuuuaaucuaauugcaauaaucucuaaaauauaauuuuguauccugcuuuuucacuuauugcaucauaagcauauuccacauuguaaucuuuguaauuauaguuuuauggcaguauaauuucuuuuuaaguacacaugauuuauuccgcaauuauuucagaguuggacaacuaaguugcuuccaauuuuuugaaguuauaaauaauauuacaaagacuaucucugcauauucuuuaaugugacuauccuaaaagagaggucuagaaguggaaacauuuuuaugacaguugacacauacugccaaacuacuuucaucucuacuuggaugauccauaagcuuuucaacuuaauauguuccaaacugagcucaucauuaccccaccccaccuccaccuguuccuccuucuaucuucuucucucuuggugauugacauccccaaaugcucaagucaugaacucaagcaccaucucuuugacuccucuccuucucuccacauauucaauccaucaucagucucugacauuuacccugaaauaacucucauacacaccuguccacuuuguuuugucccacugcuacaacuguaguucuagucaccaucaccuuccacagggagugaaggaacagccccuuaauggugcuccuugaacccagucuuugccacuguccucagguagccuacuggcuaaaugaaugcaugaaugaaaagcauuauaccaguuuaaaaacaaacggaacacagaugucaugcucagaagcaggagauauuggauuugucucauuaaguuuuuuuaaaaaguauauuuauggcuucuuuuguagaaucacuaaguuugaacacacuggcuuuuaaaaauauguaauuuugucugaguccauguguaauaauaauaacuaugcuacacaugcuaaaauuauguuuuucauaauguuguuuuccuuucagcuaguuguugucaaaauuuaaaauuuguaugaagugaaaaugagaaugaucuuuaccuuuaugacccuagcacauguuuucaaauuucaaauguguauaaacagaugagacaggaggcuauuaucaaguauaaggcucucaaugaaugcuaacaaaaccugguacuucaaaagacuagagacuggagugcacuagauagaguuguuucuugugaagaauuuuuuuuaucccaacaauucaauuucucuucuuugagguaaaaugcauuuauugaggccuuuacauuuauaaugugaagaaacaaguaaugguaaacaauuuaaguagaaacuccacuguuuccagcaauagccaaauauauggauccaaugauuguauuuuuuccuaauugcccaauuaaugaauauacuuuguuauuuuauguauauagaagauaaaagacaguuuagagaagaauauguccauauauguuacauguugccugggaaauguugagcacucaaaagcagcagcacaaaacuuccugccuuuuccuccacccaacuucuuucuaauguacauaccugcaauuaaucaaucaaaaaguaagauacaaaauaaagaaugaaagauguaugggauuauagcaaaacacauauaauaaaauaaacaagugaaaaagucaccagaaauuaggaaaacauugaaaacuugacaggacuaauaauucucuugcaagccagagcacugcauuuggcacuuaauuuucuuguacccaaauugaaaucaaaaaaaaaaaaaaaaaaaaaaacacaguaaaugucauaguucucaucauuagagaggggaaagcaugacuauuccuuagagaccuaaauguuuuauuggcacuaaauucuaaaagaauuuuuucauguguucauguuccucuuguucauguauccucuggcaggggaaaauggaugcuauuggguccccuaaaaucccagcaccuauauccacacagcauuuccuccauucagucuucccuauucuacaagugugaucucucuaaaacaaaaauuuuaguaucaaccauuuccugcacaggucccuaaugcuucaggaugaaauccaaauaacuuuucccagaagacaacgucuuacauggucuggucuuugccccuucuggaucucuuucuccauuuccacacuaaguagaguucugaauccacuaugcucucuccuaccuucgguacucgcccaagcccuuuccccugcauagcguucccauuucucauuuucucagcaggcuaauuuguacuuauauuuucaacucagucagccuucagcuccucuauaaaccuuuuucagguguagaaauguagugagagaggagcccucucugugaugccucaauugugguacuuaaaacacugauuuuaauuaucugauuauuugccugcucccuaguagacugcaagccuagauuguguuuuuaaaaucacuguacuccaaagacuaauaaaauauucucccauuaaaaaaauacugaauaaacauuaaacuaugaaagaaaaaaugauagaacucagaagaguagauauuaaacauauaguugcauugacuucauuuguuuuuuuguuauaaaaauugauacagguuuccaauuuuauuaaaggcauuugcaaauauuucuauaucaccacuauuccauaaaauaaaggauauuuguaccaaaauuauaggagggacaucauuuaagaauaaagggcaauucagccaggcacaguagcucacgccuguaagcccagcacucugggaggccaaggcggguggaucauguggucaggaguuccagaccagccuggccaacauggugaaaccccaucucuacugaaaauacaaaaauuagccaggcacaguggcaggugccuguaaucucagcuaaucaggagguugaggcaggagaaucgcuugaacccaggaggcagagguugcugugagucgagaucccaccacugcacucuagccugggugacagagcaagacucugucucaaaauaaauagauagauagauagauagauagauagauagauagauagauagauagauagauagauaaagggcaauucuguaaguuaccauagauagagacaauuucagaacucuacugaaauuggcccaggaucaugacuuuccaucagaccaauauugggcagccauugacuuccauucuuuuccucaaguauaacuucucacugaggccuuugacauacagcaaaaagcagacaaucagugggaguacuuugugagauggucuagagaauaaaauaggauucucuguuguugauugaaacuggauccacaugcuuugguaaccagaggaaauagugguaaguuugacaaucucuuaggaaaagugaguauauucuuuaauccucacaccccaucauucccuucauagccaccauuuacacuacaucacucgccugugguuggcagccaugacaugccuggaaugaaauaugaaccugcucuucuucccaccagcuuuaucccaggcuaaauacauccacaaggccuuagccucuggcucagcaucaggaggaaaaguagcaccaagaccaugcccagaaacagcacaguugccuugggguuaucagucuggcaagugaaaaugaaucuuuucagagggcucagccuuccuuugcaggagcuuauucacuuugaaguaaaucuucauaaucacuuucuguuugauuuaggagaaguuugaaagcugucagugaguucugcagagauuaaaaaaaaugcucaucaagaaggaugaggagcucagaugcugcagguugggcucauggggacugacacuuaaugacacuucaggcaguagaacgguaguagauuuacucugagguucuacuacugagggcuacucuuggucaucugcuguuuaacugacuauacauaugaaauaugaaaaauuuugcacuuauuacuuguggcugacauguguaauaaauaggaaauaauuucauggagaucuuuuucuuaaaucugggacuaagacuuaugcuaaguauuacacaaagcacauuuauuaggugccuaguuaauacuucugaaguguaugaauauauuuuuaaacaaaaauuuuuacaagggauauaauuccuuugcuagcucugaaccuauuucuugaucuuuuuaauauuucauuuuuaaaggauuuauagccccugauauuuucaaaagaauauacaaaggcagaaagcauauuaagugaauuaaaaaucauaauauacacagguaaaaaggaaauaaaguauuaguuaagcauuggauuuuuuuucuaaauuuaaggcaacagggcuaaaaaauuguuucuauuaccaugauuuuauauaacaacuaaagaaaacaugcaaaaucauuugcagcgacaaacuuuuuuuucgaauuauaacucaaguaagauuuuauuuuaugaguguuuguauacagacacacuggaguaauagagcuggcauugcguacaauuuauagaaaugcuauuuuaaaagacuccauaugaauauuuuguaaagguuaaggcuuaacauuaaauuaaaacucauggaaagcguuucaaguugggaagggaucugagacaagaguccaaauaaaugccacgggacugauucucucaaauaucugacggcaugugccacccucuagcagguguuggguguugggggucagucaguuagugauugaauucucaaacaaguacuuguaggacaaaaauucuguucuuaauauagagucacaugcucaggcccagcccuaggcucaaagaaucagucucuagggggaacaaaggccaggaaccuaucuauauuuuuaguaauguucuauuggcaauuuucaggcuagacauaguuggaaagcagugcuuuaggucacaguuugguuuauggaguugcuugguucaauuuaguuuaguucagguucuaaaaguaccucgacgggugggaccugcacuacuaacgagaaaaagugagaccagaauaaagcacaacaaugaaaaacucuaccaaugccuuguuuuugugcuguuuccuccaacauuauuuggucauuguuuuaacaauuguggaacacauuaccuuaagaaaacuguuuuaaaaaccccauauuuggagaaugccuucagggaagauacccccauucaucucauuccacgguucugcuuuaauuacuuuauaggaaagagaaccauguuguaacuguaacuaugaaguaaaaauuuaagcucuagaauuauguuuucauauagaaagccaacuagguacauagacaagagauaaagcaaccauuuuccucaaaggacuucuauguaugcuugacugauuucaaaauccauugcuauaaaacagaagauaaaauuuaauucugaaauuuuuaaguuggacuuuacagcucacuguuuuuccccaucugccuuuuaccuacccacagacugcauccauguguacauaguucuccuuuaaagcuauccuuaaauuuaauucuuacuaauccagguauucuagcuaauucuagauaucaccuguauaaaaguguuuccaggauuaugggcgaagaaguugaaaggggaauaugcuaugcaaaaugugauuuauuccacagacuauacuuuuauaggauugagguaggaaaagcaaaucugccucaaccuacagauuaaaaauuaaagaucaaaguuugucuugauaauaacuuuacccaggcaggauucuuucuugaccuccacaaggucagaagucaugcuuucuaucugcacagcuucagaacugacaaauaccuuucaaaugcauuaucucacuuaaucauuauaacaacucugagggagaacauauccccacaggaacagaugaggaaguugaggcacugaggaguucaggguuugcccagugucacccagcuugugagugacaaggucaggcuuuaggccuuugugucacaggaauggguuucaaauccaccccagccaucagucacugacacaugguggaaagaauguuaaagaugaagaaauaguuuccuagaauaaaguuacagcagucugugcauccuucugcagcuaauaacuggggcgucaauuuccuuugaaauucauggcccuaaauaaucagcuucuuaauggaagguacaaaagacuuagugcuauaauuuaugaugcugauccucaucuacaauuagauuucacagaccaggaacuugagauauaaaaaaccacuaacacaacaucuuugccaauauagaaaauuacuaguauguucauaucuuuacaauaucuauuucuuauuaaaacgaaaaaugcaauaggccaucuuccaucuauaauaaguuugauaagaucaccguauuuaaaaaucuauauuuaaggcaaugagauaaagaucugcuuaccccuccuucaggucauuaaugggaaguggcacccugccaccccugucuagggccgaugugauguuuauggcguucaggcgcucuggcugccacacauuuuucacugcgccaagaaagucuccaagaaccucacuggccaacauuucuucuacauucauauucuuaaugaagaauucugcuugauauggcaacgggaagucuaauuuuggugaaaaagggcaugcauaucuuuaaugaaguagucuuuuaaaaaggaaacaaaagaacaauuugcgauuuguugaguucugucauaauccuggcagcaggaagcaauauuaauacugacuuuaaaggcuuucuguuuaacagaggauguaucuaaaaacauaacugacauuagaaacagaacuuuaucuacaauauaauaaaauccaaggcucaucagaggcucaucagggcaauuuauaguuauagaauuuggcaaaacaacuaagaaaagcuaaaucuacauuuuaaauuuauaauauuacugaucuuuuggggagcaugcuaaaauauuacuuuuucugaaauaaaaaucaauuauauguccaaaaggaauucuaaaaaccagaacaauuccacaguuuuuaaucacacuauaauuaaauauucuagaaaaauuauaaaguucucauggaauuccacuucacauuguuggagauuuaguguuuuuuccuccucaaugugucaucaaaauuucccucuaaauauuucaugauuaacaucuuaaaacaaccccaugucaaauucagccuuucaauaugagaaacuguaaguaaauauaauuuguuacucaaaugcuacucuucaauuacaaaucaucacucucuauauucuaauuguucucuuacgauaaauaauagcuuucuguuuauuuaauaauauuucuguaagaauaaagguuaauuuuuuaaauguauguacugugaggcaggccaagcuaggggacuuaggugaauuagaacauuuaauucucacaacaagaggguguguagcugcuuguguuuuucauuguacuuucauacgugaaagcuuaucuuuagagagguccagaagcuuaucucauaaugugaacuuaccuuguacgacuuuuaucuaugcuaaaagagacugcauauauaaggugcucagcagagcucccaaaacauaguaggagccuauaaaauauuaaauguuagcucuaauuauaauaauaugaaaagguugauuaucugaauuuuuacuuuaaaaagacaagaaaauguuucuaggugcuacacagauuuaaaguccccaguaguaauuacacuauguauauccucucauuuauuucaauaaaauucauguaucuguaagauauuccacuuuuauuuaaugaacaaaaaauaaaaauuacauuaaguaccuaaaaucuugguuaacuuauuucuuaugaagcauccuauuaaaggacauuugaugccugagaugaagucaaagaagaaacuaacgcuucagaauuuucaacagaguuuucuagaguguggucaucacuuuuuaaagauuuaguuuuucaaagcccuaaucauagaaaguucuuugcuuaucuccuauauugucacuuguucugcuuacaauuuuguuagauuuccuuaauguauagcccaucugcaauuuaaaauauauuuauucucauauaugcaaauaaauuucguuuuauagacauauuuccuguuuuauacagauaaauagcuuaaucaugcuacauuuaucugcauaccuagaaauagucaugcagaaauguguuaugagaaaguuucuuggcaauaaauaauaaaauauuuauaaauaauacaaauacagcuuuugaauaugccagaagucuaaaaucuauucauuucauucaauguuuuuacauccaguuuucuuaaaaaguaucuaaaacuuuuuucuuaugaucagugcuacuuuuuggagaauuauuaucuggcuuuuccuguuccacgugacccagcuucauggcuccuuuucugagaccugcugcaaagccugugguugccaccacaccccucagaggcuuugagcugggcagcugccugcuaucuacccauccaagagcugcugccaggccucccagagaugagucacagcagcuuucuaacucuggggaaaucccaugccugcuauauuuggaaaucacagaggccaagagaacaguaggccaacagauugguggcaggccucugaggcacuaaacccaauuuagagaaucacuuuauguacucuccuugagcuucaugcggugugagucuacaugacuaauuucccauuagaucucucagaacaggagacagcugggcagggaguuggacagagcaugauuacccugauauauaacuuuuguuauuucuuuuccuaaaucuaaucugggauaaauaacaugaguguaggccaugcucaaacauguacauccuacugcacauauacauuucugucuagaccagcaaggacaaaugcauggacuuuagugcagugguucaaauagguuugggccacuaacccuacacaaaaagcagaggaacaagcacugccuggaguaaagguggaggcuucuaaaaccugucuacuacuccuucucacuagcacaccuuccaaacccguuauuuagacaaagagcccugcugccaauuuucaauccuacaguugucuagcagucuuccauuaguaucuacuugaccacagguccucauacgucaacaacaacaucuauugagaugccuugaguaaucuguaucuacagcacugagacuagauuugagaaggaagaaguucaaacuauagaacaagcuuucaauuuguagggacucucacaccugacagaguuucgagucccuuugagagcauaauggugaggugagaugguccaaggccacuguaguauaacuuuauaacuguaaugaugaauuccuaaggaggaaggaaacuuuucaauuauucugcucauuaaguguauuccaauucuacagggccagcuuagacagcauguaagcauccaaucaccacuguagucaagaacaaaaaucucccugauccaaacauaaauaccuaccaaaagccuuuggggaguggcagaguggacagggagucuucaguccaggcccacagaacuggcacuuggacuugcuuuucauauaugaaggucauuuuaaauuuuaaacuugcacauuuguugucuacaauugauaccgguaaacaccugggggaaaacauucacuuaaggggguuuaaguguucaagcaaucucuccauacacguuuaauuuuacagaaauuccuucuuucauaucguguaaaaguaauuuuuaacccagccuugacugcauuaucauuaaugcuaaauuaguagguucugauaaaauguuugguguuugcucauuuguuuuuaguugcacuaguaaauagaagcaaaaauuccccuaucaagaaugcacaauuguuuucuuguuuuuagagggaaaaaauucuggaucaguuucccuccugucauucucauaaaugauaucuaacauagggaggaucauuccaugauuuauacaauucaacuacaggccagguguggugguucgugccuguaaucccagcacuuuggaaggccaaggcagguggaucacaugaaguccggaguuugagaccagccuggccaacauggugaaaccccaucucuacuaaaaauacaaaaaauuagccgggugugguggcaggugccuauaaucccaccuacucgggaggcugaggcaggagaaucaccugaacccaggaggcggagguugcaguuagccgagauggugccauugcacuccagccugggugacgagagcaagacuccaucucaaaaaaaaaaaaaaagaaaauuaacuacaaaguauuuggugauauuuucccaauugauuaaaauauuugagaguguaauucugagaauacuuccuuaucccuaaccuucaaaauucuuaggaaaucacuuacaauuugagcauaugaaacuuuaaauugcugaaagacucuacaaauuacuaauacacuauaaacuauuuaggaaggaaauuguacccuaaguuaugguuuauuuguuuuccagaaacccuauauuaucacauauacuuagacuauuaccuacaguaaauuuuuaaauaaaauaauaaaacuaguuaguaauuauuuuuuuugagacaggcucucacccuaucagcuaggcuggagugcagugcuccagccuuaacuugugaauccuuaccccacacuuauaagagaaaugcuacuguuagucccauuuuaagguaaugaaaaaggcuuagagaaauaagaggacuaucuguuuggcuuccuaucugaguuuucaccaucauaacacaccauaauauuucauaauaaauuacauauugcuuaguuuucuuuucuauaucuuauuauuucaucaguuauauuagguauguggcauuuuaaaauucuugacuauauuuuauguaguuauaaaacauaaugaaauacuucuuauaaauaagaaaugaucaacauauuuucauaccuaccuucugcagacauuauauuaauuaucaaauuaugccuugcagucucaaaggugcgccuguuguaggcaguuaucuauuauaaaaggaaaaccauauuaaagaagugaaauguucuuuguaaaaugaaauucauuaaggauuaaaaugaaaacaaauugucauucuuuccauuuucauuauuuguugauauacuuacaaaauauuccuucucugggcaaugagaacucagagcuuuuagcaauauuaugggaaaauaaauaauuagucaggucuauuuaauauacugaaacaaaaaguuaaaaucagaaagacucuuucauagaaggccauuaagcacugguagcaaugcagaugcaucauuaguaaauggauuaaccauuaugaauuacuuaccagugauguucuaagauuucaaaaaaaaaacaauaauuuuuguacuuuuaaauggaguuuaagaauuauaaugaaaaguacacuuuaaaacaagcauaucuuuguguuuuuuugcauuuaguacuaaacugcaccccaaucagucaaaaaaugucauaaauaacccuuuggaaaucauaucucacuuacgaugggaguaaaguaguaaggaucauaguccaugaagcuuauggaacaugcucaaaaacacaaaucaaucccuucauacgggcaaauauuaguaaacauuugcagagccaauagacuuacaucaaagucaauucagaaacagccagugcaaacaacacacaaagcaaaggccaacaacaggauauggcuucaaaacuuaaggccuauuuaacuuuauaacagauauuaaaucauucggacacaucugcaguaccucaaaaaaaaaaaaaaaaacaaaugauugugucaaaaucuuagaaucccagcacuaaccuucuggcaaugauugcagcuggaggugacacugagacaaaagaguaggauaaaacugacuucaacuaaaaauaaauaucuugugcauuuuaaaacaaauaucaaagauuuuuauacauuacaugugucaaaaaauaaguugcagucauugaaaauacugaguuagaacaguaagaauuuugaaauaaauaauuuuaaacuuuuaacaauguuuaaaagguauauauuuugaaaggcauauuacuccauaaaguuaaaagaaccucucucuccaggauuugccaaauuuccaucauauuuaauuauuuccuugcuguuaucuguugggacacaugaucaauuaauuucacaccggacauuaaaauuaagacuagccauuaaacaaacuaggaacuuuugcucaaaugaaacauacaaaaaaugcaaaauagauuuuguuugagaaacuuaaucauuugaaaaguuuacccugcaaaaaauuuaaucacauuuucaauaaaaaguaugauccucuacuauuuguuacaauaucaugaagcuucagcuuagaaaaaaaauagauuuuuucaaauuaauagcaauauuuuuauggguagccuucccuuaaucaucacaaauuucauuauuauaaguuucauaaauuccaauaaaugucuuuauuuuuaaauaaugcagacuauugaagggagugaagaauauuucauaucaggaggaagaauuuuauuaccugauuuuauaguugaugcuuaauuuuaacagcuauaacagaauguaguccuucuaucacuuccaaugagacauuuaacugcuguaauauccucagauuuuacuuauuaugaugaugugaagaccgucaaagcagaagaaaaugugagugucuacgugugcauacuuuauuuuugauuccccaauuucuaaaacagagcugaucuauuuuagauacuuaaaaucuaaauauuucagauaaaaaucuacugaaugaauuaguagacuuauaugauuaaauauuauauauuuaagauacaaaaauucuugacuaaauagaauauuuuaaaauacuauaccuguuacuauaaaugaaugugaaaaugagcuauuuacagauaagucacuauauuauaugaaagauaugguaaacuuucuuuuuuuuaucuuuuuacuauauuuuuauacauauucauaacacaguauguuagucauaaaguauauaaugaaugcacucacaaugaacucuuaugaaaccaucccaguacauguguuucucuccuagccuaagcccuuaccucuccccaaccagaaguagucauucuggauuugguguuuaacgauccauucauuuaaaauacaguuuuauuauaauugcaugaaugcuuaaagcauaugguuuaguuugccuguuuuugagcucuaccaaaauggcaaacuauuacagguggucuucuaguacuuuuuuuuaauugaacauuguguuuaaaacacuuauccauauugcugggcaagcuuaaguucacuauugcucugaacauucacugugugaauacaccaagauuaauauauucucuugcugauagacuuuugggucucuauuguuuuguggcuuuccaguguugugcuauacaaauguugcuugaugagcaugauuguaccugccuccaggagggcauuugcaaguacuucuuuggggcauauugcuagaaguaggacugccagauaauaagguacagggauacucaacuguaugagauauucaguacugcuuuccaaaguagugaugccaacucccacauccaccugcaaugcauuuuacugauggcaaaauuuucauugugaucuccaucugaauauuccucauuacccauaagagcaagcuacuuaaguuuauuggcguuugugucuccucuuuagugaaauaucuguuucuuauuaaauugcaggauuucguuuuuauuuuagauacucuuagucagcuauauguguugaaaauaucuucucccaguuuguggguugucuuuuuaaaucaugcucugguuuaaugguugauaaacagacauucacaaauuucauauagugaaauugauaaauuuuuucucuuaaaaauauuuaggucuuacuuaacaaauccuucccuauccauaggucaaagagauuuuucuacauuuuaauauaauuguuuaaaaauuugcauuuuacauguaaucccuaaucuaccuagacuugagaccuggcauauauucuguuagauuuauuccuaguaccucaacauuuuuguugcuauuaacaaugguauuuuuaaaaacguguauuuucucaauacaugcuauucauguguagaaauauaacaguaauuuauaaugaucucacaguucacugcuagccuuucuuaagauucuuaauagucuacagaccauuuauaucauugaugguuuccauuucuucuuuuuaaauccuuagggauuuaauuucuuuuucuuucuuuacuguacuggcugggaccuccaauacauucuguaauagauuuaucagacagagucauucuuguuuuguuccugaauuuaaaugaaauuucucuaacauuuuacuaugaagaaugauguuugcuauuacuuuugguaaaaacuggcaaauuaaggaacuucacuucuauuccuaguuugccaagagcuauuuuuucuuaucaagaauagguaguaaauuuuaauaaacacuuuuuccauaacuaucaugacaauuaugcuguuuuuccuucuuuaaucuaauaauguggugaauugcauuuauauauuucuuuuauaacuuuuacugaauauuuaaaaaaauuaauuugacaauagcucaaacuaacaugcuucuucuaaguaccugucuaucuuauaguuacacugccuuaaggaauaugauuuauagauagaaaucacugaacaguuaauacaaacuucaauuccaacugaauuggccaauguggaagcucacauccacaguacacagcugacuaaaacuuuggagaaaaauucauaguauguaauccucugaaaggcuguauucuuuuaguuuauacauccauucauuuuuuuaaaguauuguauuaauuccuacuaaagauucaauguaacaguuguuuuguuguuguuaauuucuaguaucucccagcuacaaugcuaggugcuggugaggaccugaugaaugguaacaucaccaucacuucuagaauaaaggcuaaacguaccaggauggcuuacagagcccucaaagaucugccccuaccagcaucaacgccucccauucccaucauuuaccuacuaggguacauccuauuccagccacacuuauaguucucugagaccaugugacuuuucuuauaccucuaagauuuugauguguuguuuccuccgcccaagauggccuuccuucuacuuugucaaguaaauucuuuaccuucuuacaacucugcaucaaacagcaccuucuuacuauagcaguuauuacaguguuggcuaaguauuuguuuacaucccaguccuccaaccccugaauuguaagaagacugggcaagauucaccuauuauuuaucauucuaucccuaagcaccuaucacaaugcuuggcaaguagcagggguauaugucuguugauggcuauauuucaaugaacauaaaacuugaauucaaaauacagagcaaauaagucuaucaagucuacaauuauuuucucaaauagaauucauauuauaauaaucucuuuuaaggucauauuuuuuucacaaauuuagacugucauuuuuaauauaaaagcugaaacaaaaacuuuauaaacagagaagaauggcacauuuccaaauguuaucuacuguguuuccaugcacaaaauauuaaaaaccaccaucagguaacuuuaguuucaacacuuaaaacucaaauuacaauacacacacacacacacacacacacacauauauguauaguuuugcucuuucuagguguaaauuaccucaaugauuguuggcuuccccacauuuucagcuguuggggacccauauaggacuccaucacuauaugguguccuuuggauauaucgaagccauccaggucggucuggguaacccauuaaauuuguauuaaauguuaugggaucauuacuaaucucgccuagauaagaaacagagaauuaagacauaagacaguuauuuucacacauguugcuuugguaguuucaaucaaaacauucugucuaaaauuuuuuucuuacauuuguagccaacuaaauacacacauacaaaacccaucugggaauuuaaauuagggcaccacguuaaaaaaaauccuuuugguuguuuaauuuguuucaaaaucugaugcaacaaagaaagcagauucauacaauuuucuuggaaauauauuuuuggucaccuaacagugauauaguucugccagugagacaacuaucuuucaggagaauucccuaaucaugcuaauguacucauucuuuugcgaaauauuccguucaugaaacucuggacacuaucauaugaguaugaaagauauuccaaaauuauaaaagucucaucaaaacaaaaauaauguaauuuuaaaacacuggaggauaggaugaaaaagacguuacaaauccauaacaacuguacuaacgacagcauuuauuaaucacaagcaauaauaacagcaucauuuauuagcacauccuggcccuguguuaaaugcuuuacaagccguauuucaucuucuugaauacuauuaggaacauggcuaacuauauuguggaagaguuuucagguacaguauucaucauauaaucuucaaaaagaauaguuauaucaauucuaaugcuaaaaacauucuuauacaauauaauuuucagaaaauucacuuuuauuugcugcuuaaggaagagcuguaaugauauguuuucucuugcuauucuuuguauaucuucauuaacuugauggcauuuaugaucacucaaaauaacauauuuaaaccaauagugaauuaaguaagacuucauaauugguaucacuuaaaaggaaaaauuaaucuccauaauauuauuauggaguuauauaaaauuaucuccuauuguaaaagcuuuuuaaaagcucuuaccuaaugccauuuuucauucuccucuacaacauauguauaguuuuccaaaaaucaauguacuaugugagaaucuaggucuuaauauagaaaaucauaaguuuacagcuauaauuauuuccaugugaauauagguagaucacuugucagagacauaaaacucaagacugagaauccagaaauaugcuuuccuuaacauucaaaaauaaauuauuuuugucuguaauuaaauuucuaaucuguaaaugagaaauauccuacaacaauuuaucacauauuuagaccauuugaaauaauguuaaugauauuuuaucauauaugucuauauuaugcaaauuaaacaaaaaauuuaguacguuaacugcuuuuuuuuccucacaaagaacauaccagguuuuggguaagguggaaauucccccuuaaaauauucucuuuccaaaacaugaacaaagaggacaccugcugauggguauacauuccgaucggaguguaccuuggagaaaauacuguacacugaaaacaaagaggaaagauaagugacagaaagacaaauaaugagauacgcccuugauaauucagcuuacgcuguuuauaaagaggggucucacuauguagacauuucuggaaaaacugaagcaacaugcaaggaaacuguuaauaacaauuuguuuuaaauggaagugauuucaggacaaaaugggaaaaaauucuuuugauuuguguuuacagccuuuucaaacacuacauagacaaaauuaugcacauuuaauauuuuagacuguuaucaaauaaugaagcuauccauaauaucuuuuugguaauuucuuuuuacuugaaguuauuaccaacaaaauacaucaugagaacugaccagcuacauaauugcuacagauuuuuuucuucuuuccuuuuuuuuaaagcaaaguacagaguaauuuuuaagugguaagaauccauacuauacuaauuguuuucuagacaaagcaugucagacuauauaacacuaucaauacauguaaugcgguuuuuacguauacuuauaaaaaugcauuggauacuuuuucuggguauucauuccucgcaucucuuguagaaaugauuuauucaauuuucucugaucuugauauuuaauaauucaaacaauauaaucuauuauauuaugcugcauccuaaauaagcaauaacaauuacauaauaaaauucaggcaaaauaauuuaagugaaauaagcaaauuucaugauuuaccaguuacuuaagacauaugauaugaguacauuaaaaugaccaauuguuuugauuaguuuccacuuauuguuuuugcucugauagcaucuucuccacuaacacauuauugccguuacucuugucacuucuacgaucucuuuuggguuucuauauuccugauuggcuaguggcugcaauuuuuagagagauaaacccuaucaggccaguucuuucuuuuaagucauuaauggauuuguaaauaugguaauuaaccuuaugaaccacaaggcugcucacuccaagcucacaacuuacuaaaagccuuggauagcaagaucacugaacuacauuuuucagcacaaaaauaaaaacucccacaaaauguuucuuuaucugugaaaacuugucccugcaguucgguggauggcugccagaaaagggggaacugagcuaaaauauuugacuuguagcuucacguaucuacagauuuacuacuaaaaacauaacuucaaaggcuguguaacagagggaaggaagcuacaaguuauguuuaaacuagguaugcagagagaucuauucuuuccugauuuguuuuguacuaguauucauaagugaucuuccccuguggcauuuacaguacccaacuucuacucaagaacaauguacuuaccagcaggaauaaucccauuccgcgaaacaagaaugaaugaaucacagaaaaauaguaaagaugagaauuuuauacuuuuuuuuuuuuaccaguuugauaccacaauguacccugaaugugaggugcuauggggaauaugaagaugaaagagacccugccacugcuuuccaggaguucaccaucugguaugggagaccaacauccaccuaacuagguauuaucccagagguaaaacugcuuuggcaacaccuggaaauaugggaggagcaauuaagguuggacagauucagaaaagauuuauggaagaaguggaauucaauauggcucuuaaaauacuacaguaguaggauucugaaacucagagauguggaauuucagcauuucacagugaacauaugugcaagauacaauacuggauacugugggggccuuucggggaagggaauuaagucaguaaugcuggauccugggguaaauuuaagguagggggaggcaaaacugggaagaaaagaagaguuaaaauagggaguuuugaacuccugcuaaaaagucauuucacucuguauaucaaaguauuuaaauucaggaucacaacccuacauccaaagcagagaacauuacaaauaaucuaaaggaaucucuuuguaguuuaucuaauuaucuaauucauucuuucuagagauuaaaaauaccuugaaguacagcacuaaguuuuauuuaccuugcuauuuucucggcagcuagaagagagucugguauauuugaauaauuguaucaaugccuauggaauggaugaguacauucuaauacaaaguacggcagagguaaacacaaguuuccuauuagugaacuaaauauauauaauacuuagagggauagcauucuguagauuaucauccuucauugacauuauaaacuaauagucucccuuaguauuugcugcuauaaggugguaaaagcuagcuaacaaagcaaaaugaaagguuguucauauuaaauaauacugaaaugauuccauuuucuacauugcccuccacagguccugaaguggaaccauuaaagaaaggguaccugccacuccauaucaucucacuucaagaacuugcauagaacaucucaguuucugcuuuuauaaaaaacauuucugcguucuacagagccaagacacaaucuaccauggcccuccuggguuugaagaugacaagcacauuucuuuauucauguguacucaauugccuuucagcaaucugcugaacugcauacuugcuggucaguuaccuuggcaacuccacaguaaaggcugcuucacuuuaaguauaguaugccauucacuuugagaaaaacaugauacagauguaugacacauucaucaucuagaaauggaaaaugacuaagccacuauguuuuguuuguaaaaauaauacuuccuuucuguagcaucaguuuaaauuacaggcacccacacaacauuuuagaggagugcccuuugccuuucccuuucgcauuuguuacuugcaaaacaaauagcucugcaacggaggcaauuuaggcaguauuuacaccuaugcuuccuuucaaaaacaacaaaugacacagagaauucgaagcuauagguucuuguucuaaacgugagcuauauaaauaaagcugaugggguccacuccaacaccuacagaggcuauuacuaacaguuaacacauguugcagucacauaugcccaggcagcacucacaaaccauaagcuuaaagcauguuguuuuccuuaagagcaagucuugaaaaucaaauuuaaacacucuaagaauccacaacacuaagaucuaauaaucucugaaauauacauguguacagugccaugcuaaucaagccaagguaacagggucuggccucucuguguaucgcaugguuuugcaaucuucuacggcugcaaauccauuaccucugcaaacauacgccacuagauauaaaugaaacuggaaaacuaugggugguuaaauccaugcaauucuaucacuauuaaugggaaaaacaaugagaccaaaaguccaacccgcaagaggucaaaaauaucaucuccaaauagcaagcauagcuagauuuacaaagauuaaaaacuucugaagacagguagucauaaggaacagaauuuuuuaaguaauaauuacauaucugaguagagagagccaaaggguuauguaagcaaguagcugggaucauuaucucgcucucccuaaacauagauccaauuuaucucaucaccauguuaccaaaaccuuguucacaaaacuguuaucuguauguuucauucacaggguauagaaucugcagccauuucaacaacucuauauuaugugacagcauagagcccagaaucaaauaacagaccacgaaagcaguagcaaaaaaaaagggagcucaugcuagcuaaacaaugucuuguuuuccuuuacuaauaguccaguggaaacucucucuccauaaugaaaauauaugggugugcacgugugcuuauuacaauuaccuucaaagcaaguuugaauguauuuaguaaacauuaaauuuugaaaguacuauggugguacgcugccaaugaauccacagcauauaacuucacaauucucacaaugauuauucuuaauggcaugugcauaagcacaggcacacacacagccccuucacuacaaaaauguccagagaacacuugccaguucuuuuucugcaucaccaagaacaauuacauggcuauaaagauaaaauaacaacugaguauaagacccugcaaguuugagcuaguuuuaaaucuuaaagccaucugucuucugaaaucuuugagaagaaagucauaaaguauugucaauauuuauguccgggugacuuugauuagguacccaguauguuuaggucucucuuauagaugcuuuauuaauaaacuaaucacuuuaaaauguccauuuauaucaucauuuucuaauuuuuaagguuuacaaggaucuaauaaaaucucaguuuaccagaaccacaugaaaugaauuguuccacagagcugauguuucugaaguacucugcaguugauucuuuuucaugaugguauaagaucaucauuuuguacaucaauuguugcacucugcucuauuauacggugauacccguauggacuguuugguugccuugucauuuaccgaucacacugugggucccagucugcuaaugcuuuuuaagguuguguguuuuacagauuuuguuuucucuuuuguagacaaguugucagcugucauuucucauugcuaucaguauguuucccauagcagcuucucuauccccucuaauuugcuguuauuaaucggcugcagguuuagaaaccagacuaccaaaugaggcaggguugcacauugaaguaaaaacaaaugcgugcuguuuaacacacauagggcucugcuagauguaaaagacaggagccugcauucgcagcaucuauuuuggcugccgaaagacucuuuuguggcguauuuccuaguucuuaguugacgcaguacacuucugaauagaugaucuuacuauacuugagagagagccauuacuuaaggugauggcagcagaaacucuguuauaaaauacauucacaaauaaauagguguacaauugaaagucuuaauucaacccauauauuacauaacugugaacugucaaauaaaaaauggauugaaugcauuguauaaaacacuuacauauucgauaugugggaaauacacugcacaauuuaaacgaagagaucuauggauuaaaugauauguugcccuuaguuauagcuaaaucagccuaagauacuauaacacaauauaauuaauaaguaacuuauuaauaagcaauuaaagucuauuucuaaaagcauuucaauuuuaucaauuuguuucucacaugaagaguuugaagauggaagcuguucauugggaagcaucgcaaagguguuuuaacuaaguucaaauuauuuaaauaugauaguauauauuucacagcuaggaaauuaguuguucaaguaauuugaacuuaguuuaaguauugccuuaacaguaaguauuaucuaaaaaaauguuuuggauaagaaugauuaagaagguuuuaagguauguugaggauacaaagagaguacuaaacagccaccuaucugcuguaucuuuuaaaauaaauuguugccuaagcaacuagguaucaucaucccugauaauuaaaaauguuaaguacugacaaaaaauaauacuucucgucucauauuuuauaguuuuaacaucuaaaaacucuuuaugagauucagagucccuguauacauaggaauugaacaagaggcaaaucucacuugcugucucugcaucaaaagaacucauuucaaaguuugcauagccugauacauuuauggauuccuuucuaauuuauuuuuuuaacauguuguuacuacagucaaauugaaauuuaauuauuaagccagguaauugcuguagagaaauauuuuaagagagaucaauauccagccaguuagacaaccuguuuuuguuuuuguuuuucucacuaagauuuaccuuguguuuuaucaauacaacuuuaugaaucuuggcuuugaaucaaaagcuuuucucagcagucugcccuucaccuuuaauucacucaacaucaaaguacugcaggccauucaucuggcauuggccagcuauuguuuuuuuuucagucacagauaguccaugccuuggcuguggaauccaucacuaagaaggcauuacagugucuuuguaaacuucauuucucuaggagauauggccacuuuucuuuacaugaaguaggagaggaaaccauuacuugaaucuucuacaaaaaagcagaagaguuucuucaugauauuuuccccaacuaaaaccacuuacuuucaguuuuuccaaaguggaacuaaacaucuugauuauugugugauuucauguguguguuuuuuaaaugucaaucggaaaaagguugcaaaccauugcuaauuggugaucaauaagcuuagugucauagcaugcuacauugaaaagagcuuuauaugucauccugucugggcaugccaaauauauuucuuuauuaagagacagaucauaacauuauuuccuaccugcauauggccucugccuccuacuuaacccaggauuccugacaguuacuaacaaucagaguuugcaugcauuugcucucuuggagaguucaguccauuuuauagauaacaaaauugaacguagagggacuaagugacugcuucaagccuauaggacccauaacuagaaaauagaaaaaaggaagagugggugugucaaagaagcugauggcccucagcuugcucaaguagguccccuacucccauuccagggaaaaaaagaagagauuccauaguccauaucuggaguauuccuuauugcuuuuguaaccacuuacugggugcugagguagaaugucaaaaguuaaggcauucaaauuccuuagaauccuauuuacagaagaaguaccauccuaccgcuuuagcuaagaauuggaauauucuuugcugggccuggcagcucacgccuauaaucccagcacauugggagggcaaggcgggcagaucaccugaggucaggaguucaagaccagccuggccaacauggugaaaccccaucucuacuaaaaauacaaaaaauuagcagggcgugguggugggugccuauaaucccagcuacucaggaggcaggagaaucacuugaacccgggaggaggaaguugcagugagcugagaucacaccauugcacuccagccuaggcaacaagagcgaaacuccaucucaaaaaaaaaaaaaaagcuacacaaaacauauauuugucaaauuuauuuuauauauaaaugauccuaucaucuuuugugcucucuugaaauuuucuaaaagagaugacugggauucauggucaagaacaucucaaagaacauucuauaucugagacagcauuuaaaauggccuugccauacaaguuacuaguauuuguuauuauaauuuuaaaagugaugaaacaauucuccucauacaguugacaaaacuuacucccuguauaagguaucuugauaauucagaacuauaaugauaggauauaaauaggaugagaagaaagaaaaauaaucuaaaggaugagaucaagcuaaacugaagaaauaagaaaaugugauaaucgaaacucuuuaccucaguagauucaagauggagggaucauuucuauucugaaaacucuaguuaucucuugggucccaaggagaaaaucagugugagguucaaugacaguaugaaguuugaaacaggaagagacuggcgucucuuagagauucuagaugacacuauaugucaaggucuugaaaugcauuucccugagaacagcaccauaauagaugacucugcugagugcagcagcuguugagagaguauuuuuuuguuuuuggaaaucaaacagcaagaggagagagaggcaugcucagagagaacagagguuccagggaucaaagcuaaagaggaaagacugaagaaaagggaugacugcaaucuagugaaaaaugaugugaaguccagaggaagagucuucagagauccucggugaggcacaaggaaccagggcaugucccaaguccuuuggagaugacagagcagaagugcagugcagacugcaacagugaaggacaccggggacccauaaccagaaaauagauuagaaaaaaggaagagugacugugucaaagaagccgauggcccucagcuugcucaagaaaccagccagauaaggguguaaucaggggugauucccuugaaggaacuugggagaaucugauggcaauaucuaaagagaauguggggaaaagaacuaugagaucaugggccuguguccuggaacaagugcaucuagugcuuuuuaaaacaaauuuuugugaucuuuucaugagaaguuauuuguaugaaacucuauguuuucuuacagaucuuagcaaggaaaauuccuuagaaauacacagguauuuguagguuuguuucaaagucacuugagaaaauagauguugggaaacuuugucccauugugaaagagaucuggggguagaaguguccagcugaagaauaauucgguuccagcuauaaaaauguuagugaugcccaacuucagagauguaugaagaaaaugaaguaagccaggaaucaauccuacaaguacccagcagguuucaucuggcauuaucaucuuaucacauaaaauuacuguucuuuucaaaacauuuuaauauuacuauuauuuuuauagacauuuugguugcuccgaaguuagagaaacuacuauucugcugagguucaugaacacauguaguuaauauucugugugaaggaucauaaagccaaaaaaaaaaaaaagaaauauuaagugcaaguucauaaugguaacugguauuuugaaaacaacuaauauuuugacuguuaaguaaugccuuuucuccauaaugaaaugcguuauuucaaagguccuggaauauugcugauggucacauuuauagauacugaagaaaaauuuagaaggaucaaucaaucauuuacaggucaagucaucuuuccaauagaaaacaagugccacuaaguaauagcaaaacauaucaauuugguuuugcaacaagaaucauccaaaauuaaccaaaauaugaguuuuuccaagguuacauacugcuauuuaaaaugauacauguuaaauguacguuuuucaguauuauaaauaacuuguuauaguaaccacaguaggacaauuuuuauaaguggcaagcuagugacuggauaaaagguaaguuaaaaacauaggaaugguuuuuaguuuuucuuuaaaaagggcaaagcuacagccaaggaagaggacuugaaaaauaauggaauaagaacacacgggaucuaaaacagaaguuuuagaagauuaggaaaacaaaauuuuaguuuuucagacuuacuaacaacaacaacaaaaagccacacaugacuaaaaaagggaagagacuauuggaagcagacauuuaauuggcucccccaaagggauuuagauuuacaaccuaaacucaccaucuuucaucccagcagccauuuuucugcugauaauaaaauuguuggccugucuggucuuccaguuaacuguuccauuuaugccaucagcacagcuuaauaaaaaagcuuuucagaauaaaacaaauguacaaaaaaaugaaauuaaugucaugauuuuuuaaaaugacugucacagaucaccuacaauuaacugggaucagauuccuuccagcccagcuaacuguuuaauucuagucagcaaauauuuguuguaugucaauacaaggaguauguggggauacaagacaaccaaggcauaguuccugccccugaaggagcuuacaaucuauggggauuggcaauucauguacauauacauauacauacauacacauauauacacacacacauauauaauaaaucauacuaauuauacacacaaaugguagaaagcauacgugcuauaagaacacuaauggggaagcaauuaucucuggcuaggaauguuguuaaguuuaaaguaccuuuuaaauucacaguugaauuuuccucacacuggcagcaaugacuagcauagggguuaaggaauacuaaguaggggcuacugcaagagugucagauagcagucagggugaagcacaaggaaacaaaaaguggugccaauuacaagacaccuuguaauggagauaauacugacauggagauaauggagauaauacugacaauacuuuuucaaacugcuaggugcagggauaaaaggagaaucaaagacgccuuugaauuuuuuaucuagaaugacauagaauagcaauacuuuaggaaccucagaaaagucaguuucaagagaaagaugauuaauuugauucaggauauguuaaacuuaggguacuaguuggacaucuaggugaaacuaucugagaagaagaagauaauguaauggggcuucacauacagauuuaaaguucuucuccagagaaaugauuauugaagccaaagcccuagugugauuccuuaaagauaccaugucccugguaacacauacaucaggcucuuacauagaaagugaucuggagcaaauauauguuccuguucuuauugauccuguuuuucaccauccaaacugccaaucugcugucuacucucugauuuuucacccuuacauuuuagacaugauagauuugggcaccaguuuuuucugauuacaauauuggcucuccauccuauucucccuugggcuacuuuagguaaguuccuuguggauucagcucagcccaagaacugcccaugggauuuguccuagcuucuguguguuuguuuuguuuguuuuuuguuuuuguuuuuuugagauggagucucacucuguugcccagucuggugugcaguggcgugaucucggcucacugcaaccuccgccuccuggguucaagagauucuccagccucaaccucuggaguagcugggacuacaggcaugcaccaccaugccuggcuaauuuuuguauuuuugguagagaugggguuucacuauguugggcaggcuggucucgaacuccaggccucaggugauccgccuaccucggccugccaaagugcugggauuacaggugugggccacugcacccggccuguccuaacuucuggaccugaaaugcaguaagaaagaaugcucaaaagguaagagggacagcaaaagcaaaacaacauguuaauaaauacauuaacauaucaaaagcagaggaugauucagcaaagaaagagagaagcagucacagagguugaaaaaugaagucugaagaguaacauaagccaacagaagagagaugucaagaaggagagugugaucaacauccucacuuacugcaaaaaggucaaagaggaugagagcuuagaaaagacugcuagauuugaaaagugagaaguuacuggugacuccuugaaaguggaguucugauaaaguggugagaguagaagccaaacugcaaaaggucaagauguagaugcagaaauuacaguuaaucuuucaagaacacuggucagaauagggaagcaaaaagaucaaaugauagacugaagaguagcaagguggacagaagguugguuauuuuaguagggaugacauauuuuguaucuaaauagaggaaaagauguaaggggggaagagauuaaggauaaagaacaggagcauaacugauaagauacaauccaagaaaagguagaauggguaggaccaagcauguggaaguaaggaaaauacuuugggcaugagaaaaggaaaggaaagugaagacagcaacaguuaguggaguauagcaaacuuaacuuuaaaagagcuccccaccuuaauaaaucagaaguaaaaggcauauuuccuuuucaaacugaauuuucaguaaaaaucugaacuuaagcuaaauuaugaaaaauccaacccuucaaaaugagaaaagaauacaauucaaaacccagauuauuauuauuauuaguaguaguaguaguguuuuuagagaugggguccacuauguugcccaggcuggacuagaacuccugggcucaaguaaucaaucauccuaccucagcuucccaaguagcuaggacuacaaccacugcugggaccacugcaaccggcuaaaaccgaggcuaccgauuuaaucaugacacauuguaugcuuguaucaaaaugucacaggcacccuuuauauauguacaacuauuacauauccauaauuaaaauuuuaaaaaguuguuaaacccagguuauuaaaaacaaacaaaaccucaggugaucaugucagugacaccuaggaguacaaaucaaaauccacagcaccccccaaaauaagcuacugaauuuguauucaauuuaaaauauaugucaaauuaagaauauuaauuuuaucuacuaaaugaccaaucuuaugaauuucucuaauaaauggcuuauuuaauaacggaaguuauguauuuuuaaauccagaugaauaauacaggaggcauuucccaauaauuuaagcuaaaacaggaucagaaaugcuaauagucucuuguggcaaaauacuccacccccaggguuuuuccugauggcuauguuccaaaagcaacaugcugguuacauaggaagcacguaggcagcucccccaaaauacauauucacauguacccccaaaauauacauaguaaaaaauucuaaaacacauauucaugacuccaccauggagagucuagguagauggguuacacaauuccgucagguaauucacauacaaaacugugaacucuagaagacagaggagccauuacagaacccaaagaaauauaaacuauuaccugaaaacccuacccauuccaaccuccaacugauuuacagguacaaccaauuuguaaaaacaugcaagaccuugcuggauaguggaauaucccaacuagaaggacaagaaacagguggccaaauucuucucuacaauguuccaaagaacaauguauuuguggauaugacaagcaacauuuagauuuaacugcuucccaucaccagcuccugagcaagguacuuucacauauacugucuaauucaauccuuacaaaaccaaaucaucuauuaaugugucugaagauuauaggggcuuaaucuuaaagcauaaugaaguaaauccugcaggcaagcagacacucuauagaacucuccauuucuccaugaacuggguaguuaccauaaagaaagaauggggugagugcccaggcagcuucucuuuuguuccuuccuuuauucuagcucagugguucucagacuauguugugcauaagaauuauuguucagaguuuuauauacaaaauuacacauauuauaccuuaugggcuauuuaaaggauuuacuaggauaauuuuaggucuauggaauuuuuucuuacacucuugcuuuuagaauccuacuaacccagcauaagauuuaacaccacuacauguccuuggcuagugaaucaaugcaucauugcucauacuuuccagguccugcauaagggcagucuaguuggcuuuuacaggauucaaaaagcaaauugaauuggugucucaauuguuuaaacagagaggcaggguagaauaguuuaaacacaacacacagauauugcuguauuucaaggccagcacugcuuuugaacacauucauuuuuuaaaaguuuguauugauccagaugaaguccuacuuugaccacagaagacugaaguccaauaaaucccaauaaaaggacaauguuuuauggcucuacuccccaggcaauaucacuaaaggcaagacacgaugccacgaaugaugugcuuaaaccaagucccacauauugagggagaaacuuuaauaauagggaaauaacuauuuauuuuuaauuguguguccaauaucauggauccacuugacuaacuucuuguauagaaaaguauuguauucuguacauugacaaguacagaauacucauugaaaaaggcuaguauuuuaaaguuuaauuuucauuagaaaaggaccaaugcauuuuuuuaugugagaauggauuucucuaggacggaaaaauaugacucaauauuuaaaauauguauccuaccuacaacuuuucaagauuaaaucuaauguguaaagauaugucaaccuuguagagacugguucuuggacauccuccaaagacacuggacuauccucaggaaucuuaaaaggaagagaacgccacugugcucaccagguucaugguaaucuacauuacaauuauaucugggugugaguuuuacucuaguucauaaacacaaaaacaaaacaucauaugcaucuugcauuuacaaagcccaagcuaagaaggcauucacacaauuagccaggauaucacuguacauaauuuaaucaucuuuucaauguucccccuucuaaaucaucaaagccuaaauuaauccaaagguggcuggcaugccuucaccuucccuagaaaccauaugacaguuaaaguuugucuuaagauuccaugauucauuuugagucuuguagcggcaugacuacauuucaucuggccuggggcaagcacucucugaagagauauuacuguuucccaaaccugaauaauuugcugacugggggaggagaggauugcuauuuaauaaaaguaauugaagagcugugaauagugacugauugcugaugagcuaaucagaauaucaaggaagggaaauaauaaauaauaacuuauucagacaucacuguccaaguaaacagccggauaugccaaaugaaauuuaaucugauuaucauacucaccuuaaaagcaaacugucaagucuuucucuguccacuacuucauuugucucuuucauauuccacuguaagggggaugaaagacuuuguuuucagaaguugguuauauagcucacguguccggcaucccuucccuucucuuaccauccccauccaaguuguuacgcugcucccugacccucuacauuuuucucuucccuucuuuuaugcaauucuccucauuucuuuuaaaauuguuuccuacaucaaaacauuauuuuuacauuuuucucucuaaaaaauguaaguuggccauuacuuuucuuuagcuacaaugucuuaaauacuaagugcuggauacuacaccaaggguuguacacauauuaacuaauguaauccuuacaaugacuauguuaaguaggcaguauucacucuauuuuacaaugagacuaccaaguuuaagaaaauuauguuaacucaccccaggucuuauguuuacuaaguggcagaguugaauuuuuaacccauuucgugguugacugcaaagucuaugucaugaacacaucaauacuacccccaaauacagucaugcauugcuuaauaauggagauacuuuuugagaaaugcauuguuaggugauuuuguugugcagucaaagaauguacuuacacaaaaugauauacacauuuuuauuuauauauauuuuuucauauauaaagccaaaguucccaucaccauuacuaugcuacuacugugcaguggaaauuaaucucaugcacuaugggcaccaaaacaagaacaaaaacaauuuguugaaagaagaaagcuuuaaguuuuggaaccuauggggaaaaaaauggcuuuacugaggaggacuguuuaccccaaccucugaaaggaguugggaaaagauaauccuaaaagaaauguuacagcaaggcuuuaaaugaagaaugccagaagaagcuaaaaaaauuagauauaagagacuuuagagugaaauaaaacuguaguacagaaagguaguguuuaacaucagucuuuacagacagugucuggguucaaauccuaauuuuuguccauugggcaagcuacucaauguuucugugccucaucuggaauagaauaguacccauaucagugacauacuguugaguauuaaaugacauaauguauuuaagaacuuuagaagaaugccuagcauauaaugaugucccccaaaaaugaaaacuauuauuacauuuacucuucaacuaauuugaagaaaauuuuggauuucuuuaaauacaaucguuuuuaaaaauauaucuucaaaugaaaaaaaacuaucaucacuacagguggcauuauauaauaauacugcacucucauuuuuuuccacaaucaugacacauaugaaaaaugauauucuauagaaauauauaguagagucaacuguagaggcuacucagaagaggcgacagccauaccaaacuccacuacacucguuguccaaggacuaaaaagauggcaucucagucaauccucauucucugcacuuagccaaguugagggcugcaguuuaacccuuuugagggaagccugauguaguaagaaaugaauuacaucgauauuuauauucugacucucauaagcuuuuagauauuuauucagaggaagcaaugcagcaaaagcaaaaaguuaugugugagcaagacucaacugcauuaaacacaauaucaaaauugaguggaaaguuaaacguucaauauaagaaguuuugguuugacagaauaguuaauggagaagagaagguuacucacuucucuugguauuuucugcuccuuugcucaaauagccugagaagauaagucuggguuuccacucaugggaacagaacuauauaucucagaugaaacaggaacaccaguggaaacuuuaacaaaaacaaugcauauaagcaacaguuauaugcaccauuacaauuuaauguccucacuugcacaauguuggacuauugugaaaauaauaaaauuagugaaaagcagaauacaaaacaguauacaggcacuauaaaaucuaguguaauagugcaaucuaguggaaaaggauuaaaaagccaaguguaugagcuauuggguuagggacguaaagcugcaggaaaaauuucuguucacaauaaaaaauauaacaaugcucacaugcucuuuccaacuaaguaaccucuaaaaaagaaauauucuuauauuguauguuugcuuuaaauuguuauuaauuuccuuaauuauaaaaauccauacauucucauuguacuauacuuuccaauaguauaaccaggaggguacaaaauauaaauguucucccucauaucccuguugccaucccaccaaugucacugccuagcguaucuacccuuaaucguccucgugucuuuccauauucuauguguguacacacaaaaacacauaccgugcucuuuuuugcauaauaugaucacauuuuuucacuuagaauauaucuugaacauguuuacaugauagcacauuuuaaggcuacaucauuuucugcuaugugucucaaucauaauuuauuuaucaucaccucaaacuaagcuuguccaaacuaggacccauacucuuucccuuaaaaacugauccuauuccagcccucuucauccuguguguggcaccaccaucuguccucauguagaugacagaaaucuggaaaucauccuugaaaucuccucccgacaaacuuagcaccaaauucaaugcaacacucacuucuguugguuuuuacccccuaaaauaucccuccuaucuucaucuccccaucaccacgcuagcccacaaggucaucaacucuauccucaauuacuaaaggagcuuacuagucugcugcaaacuauucugaccccuccaaccuuuuccucacaaacagcuaaagugcucuuuuugaaaugcagaucugaucauguccugguuaaaucccugcaaagauuuucccauugcucuuaguauaaagauuaaauccuuuaagguugucuaccagguccugcaaaauuuguucccugaccuccugucuagccucauuuaacauugugcuuacccuuuuacugcuccaacgccacuggacuucuuuuagcacuuucuguugaccauauucaaccugccccagggccucuacagaggucuuccuuuuaccucauauauaccgucccuccuuacuaauauuuacucauccuuaagaucugaguacuuccuuggaagagccuuccuuaaacccccuaucuggccaaauccucuacuuacaaguucuagucagguucauagcaauuaccauaguuuuaagggcacauuuauauguguaauuguuugauuaaucaaauaaucuugaaaaaaacccuguucuuugucaaccccacuaguguaaaaaguuccacgauagccgagcuguguauucccuagcauccagcauggggucucaaaacuagucaacacucaaaaaaaugaaugaauaaaggaauuacuggccaggugugguggcucacaccuguaaucccaacacucugggaggcugaggugggagaaucaccagaggucaggaguucaagaccagccuggccaacguggugaaacuccgucuuuacuaaaaauacaaaaaaauuagcugggccugguggcgggugccuguaaucccagcuauuugggaggcugaggcaggagaaucacuugaacccgggaggcggagguugcagugagccaagaccucaucauuguacuccagccugggcaacaagaacaaaacucugucuccaaaaaaaaaaaaaaaaaaaaaagaauuacuaauuaguaaagaugaccaggauuuuuucuaguuuucuuauuaugauuaucaacacuauaauaaaaauccuuaucuguaucuuugaagcaccuucaccauuauaucucuaagcuagacuucuagcaguaaaacgguuagaugaaaaauaauacuguacauuucaaauucugauaagcacauguagucaucuguucuguuucuacuucggcaguacuggucuuucaugagaaugaacccaguaacuacagaaaaugaaagauguuaaaagugcuacacugauuaacuauuucauagaagagaaaagccaaugucauuuuacugcacagcaagaaacaugaauuugcuaagaaggagaaacaaaaaaccucagggcuauuuuuucucuuauuuugcuuuccaagguaaaagagcaacuauacuuccaugcauacugcugaagaaauagguaacaaauauuccacuuuaacugcuguaagaaaauuacugugaucccuucuuucaaauuugcagcgaaccccaaaucuccauaauaaucaaaguggugaucagauaaggaagugaaaagcuaaagaaugggaaagaauucauaccagagcugccuaacuccuauacauuuuuuaaaugagcggcuucauuuaucagaaaagagucugcguacaugucacaacagauaccauggcgauucccgugguacaggaugccaaagaucuauuccaaaaaauugauuagucuaagacaauuagauacaaagugaaaugugcuaaacaugcgugguuuuuaaauaaucaaaugcacuuaaacugcuauugcauaaacauugcacaaaaauucuuacaugaagauacaaaaaauaaaauaaaauucuaccaaagagugaccgaagaagaaaacagcacuguagcuuuuacuaacauauuguuuccaagaauauaacaauaaucaugccagcaacuaauguuuugaggcuaccuauuuauuucccaagguaacaucuuuaaguuuuaaaauguagacacuggggauuauuacuuccaaagcaggggagccagagccagagcaagcaagcacugcauucaaggaauuacaaguagccgccuguagaucagcugagcguugacaagccagaaacucaucuuugagcuuuucugucuuggaaauaugaacucagcccaagaacgcccguggcaucuucaacaacagggaugcaagccaucucaaacugcuguuugcauuauuacaaucccacaaaagugcauggggcccuucuaugaaagagagaauaaggaaaagagaaaguuguucaacauuagaaauauacuucauacagucagagugaaagugacugcauuucugaccuaacaacuggaguggaggagaaaguucuaagugugaggcagaagugaaagcugcagggaaaaguuagaaaauaugacagaagaauuuuucuaucauuucuucaccucucucauuggacuucuuaguuugcaagaacuaauaacuccaggguauaaaaauagcuuuuguagaauccgaaacuacucacaaaagggguccuguaaggaagcccuauauaauccacaaauucauuuuaagaaaucauauuuucaaaguuugauauacuaacccaaauaaacaaucaauaggcagaucaccauacaggaaagaaaaaucugccucaagacauguuugagacacuaagaaugugcccuucagccaggcagaaaccaggcuaaccugaaacagacagaaguuaaaaacauuugauaaaaauauuuuauuuugcuauguaaaagcuaaaaauuguaacuguuaaguuuuguagggagauacaucacaagggaggggagguugcagaagggacccuauuucccucuggagaagaggcagcugagcuccagcagccagccugcccccucuagcccuagguacccucggcauccacggccacucagccccaguagccugcuuggacagagcaagaaauuccaggaaagaguaauucuaggaagcaaauuaagcaaguuaagacacuuugcagggggaaaaggaaucuuucaucuucuucucagguuuucauguuugaaacagaaugggagagauaggaggguguguguuaaauuacccuguugcagcuauuuucaaguuguaagaaaugaacuugcaacacauagggcuauuuagacaguuuaucagaaaaauaaaauguucucaucacaauuaucuuucaggucuacacuaaaauguuaucaaggucuucaaguuaaauauucauugcaagaaaggugaauauuucugauauuuaaagaacagaauaaauaaaguugauuguuuuguugagcugcaauguuaggaaggccucauguugaaaucuaucuguaccuuuaacccaccgaugcuaguucuacuuuccgaagcaaacaucagagaguucauguugacuguuuagucuucucaaguuaaacacuuccagacccugugaggauaccucccaugacaggauugccagacccuucaacauccccauggacugcucuggaaguugucuaauuugucaaaaucucucuuuaaaugugacagccagaaauggacacaauacuacagaugugguugauuagagcaggguacuauuaauuuuugugacauauggacacuauacuacuaccagaaccuaacuaauuuuuuuuucuuuugcaaccauaucaugccacugguucauaauaaccuucauuuuccuaaagaacugccaccauacaaagucaucuccauacuuccauaccaaugaauuaugaugcauuuacuacuauaaaauauuuuuuugcuuucagcacagcauugcagcccacuuaaaaaccauguuaacucuaaauuguuaccuauuucuaacagcuaucccuuuucaauuaauccauggauuuuaaagcaagccucuuagaucuucaucaaagucauucguacaaaugcugaggaagacaaaacucagggcaaaggcuuaugauccuuaaccagggacgauacccugacgcaaacccaagaacguauacaccucgccggugcugguucagucugccucccgcucacacagcaauacugcuaauuaaucugcacaccaccucauacacaagagcauccugcauccuugacaaaugcuuugcagaaagcaggauuaacuuaucuuucaaaacaaaguguaagaaaucuauacauauuaaaauuauaauuauauacaaauauuuauguacacagaacaaagacuagaagggauacaacaucaauggaaaugguuguuccagagucagucuguggaaacuggagauuuguuuuuuacuuaauacugucuuuaauacgguuacagaauuuaaaacacugggaauuaugaagagagaauuuggcuuggaagcaauccaugugaaauagcauuuaagagcauugagacucuaucugauccuaucaaccugaaaacuugaaucagaaacauauucacuugaaaagacuuauugauaccuagaaacauuggcuuuuucuucuuuauuauuuuuuuuuuuuguuucucguacugcuacuuuaggcuuaauauuucuggaaaucagggagauaacagacuggagaacuggauuccgaaguuuagaaaaagccugaauggagugugcguuagucuauguaugcuccucacaucugucugucugucugucucugcuggggagguugagagggauagaaagaaaacagccaucauauugauauuucugugaagcuauggacuaagcgaucuccccuccagcccaagaauuucuaacgaacacagacccauaucaucaauuccccuagagucauuuuuuuacacuggagguaggaaauaaguguuagaauaugcauuuagguguuuacagaauauggaaggguaaguuuuaaggaaaggauuuggguagauuauggauaauuagcaaaaaagaaaaaggaagaagguggcuggguauuuuggagaaaaugugaucuauaaauacugcacuuauuagaaucagaaacaaucugaauauuugacuugggaauuuuuuuaacaagucaggauuucuucacuacuucaauauuuuguguacugcaugauuuucaccaguggaaaacuaguguuagaaacuggauacauguuaucuuuauuuccuugagguugucgcuaaccaguuuuuucugguguugucccuuauuuucaaugucugugagacaagugaaaaugccacuuugcuuagaaaugcaauuuauccaccauacuauaggauaaguaaaauacaugaagcaaaucaacagcuuuuagauuuauggcaaacuguuguaaaaauggauaaaauguucaauacaaaguccacuuacucuuugacaacuggaaauuguacuuugcuuagaaauaaauuuuccguaccauaccagaacuuaagccaaauacaggugguaagucagcagguucguaaauccauagcaauugucauuaaaaaugaauaagguguccaaauagaaaguccaguuauuauuugacaacugaaaauuuuacuuugcuuagaaauauauuuucucuauauuagaaauuaagccaaauauaugugguaagucagcagaugcauagaucuauagcaaauugucauuaaaaagggauaaaauguccaaauagaaaguacaauuacuauuuuacaagugaaaauuccaguuuguuuugaaaucguuuucuaaaacccuagaacuuaagcuaaauacauaagguaaauucaacagcuuuauaaauacauggcaaauuuucauuaaauggguaaaauguccaaagagaaagucuaguuauuaucuaacaagugaaaaucccacuuuguuuugaaauacaauuuucuuaacauacuagaaguuaaauauagguguuaaaucaacagcuucguagaucuacagcaaauucucauaaaaauagauaaaaugucuaaauacgaagcccaguuauuauuugauaaaauaaauaauacacauuaacuccucuuugcuguauaugcaacccugugcaaaaugggcagaaauagucaacaccagaaauaaauaucugagaaaauccaaaauucacauagauauuaaauauccaaaauauguuuaaaguucuuaucuauuaauuugguuuugguuuugguuuugaaaauguuuguuguucuagacaacacaaaaauguuaccuaaaguauugcucuauuaauguuaucuuucuguuuuauuuuuaguauuguuuuguuuuuuggauaacaaaaagguuuuaucuaaauuacuuauauauugaugcuguuuuuucccuuagaaaauucuauuucuaagcaaagugaaaauauuuucauauguagaggaauaaaaaacuacaauauguuagaauagugagaugggagaaaauucuucucaguuuucugguuuuaaauauuuauguacuaagguuguucauuuaaaauuuuaauuaaaaaauuaauauuauuuccuuuaaagaaagcucuccaaacuuaauguuauuuaacauuuaaaggcucuuuggaaagaaaauaaucgaggagaauuaauuugaucuuguuuuuaacuuuuagaaaguauuuaacugcaauccuaugaaaaauauuuauuguauagcuaccuauauaugcauagagaacgucugaaaaagcagacucuauaauguuuacugguguuauugcagggugaauagguuacaggugaccuuuucuuuagaguuuucuaggguuuucucuccugaauuuuguacaaugaccugaaauuacuuuuauuaugguaaaauacuaauuacguuuuuuaaaaaaaguccugguuagcauuuugaaaugaaaaaaucaaauugguucaaacuuguucaaacuuuuaaagucuuaagauggauuuuugaacuuuaauuuuuccugcuuuucaucuauacugguuuuaaaucucaauuuuuagaaaaauaaugucucaguuaacuaggugaaguaacuuucgaauuuaaacaaacaaacaaaacugguaagaauuugacagcggucaccagaacaguacucuaccaagcauaagaaauccuggaauuauucuaucuugcagaagagggugaacauccuaaagauuaaauuaaaaggcacuucuaaaaaguauaauuguguuuacccaacuuccuagggaaaugucuuuguuaaaaagcugcauuucauucauucauauuccggauagugggcauuuucuaauaaaaaguaaaaucucaguaaaugggcuacaguuuuguuuauuccuagaaaggcucucuuuuaaagugcggugucugcaacguuguuaugacaauaagucaaauucuuauugauauuccaaguauaaaauaauccguagcaauguuacuaaaaugugcucaauuuugcucuucaaauaugaaagcguuucaucuguguuucagaaaccuaacucagcuguagacaauuugguuuucccuuuuaacuuaaacuuguuuuacuaagaucaucaacagauugucaguuucccaagcaccugacacugaggcgcuuagaugggaauccgcguuaagguuuuauuuagcauccuuccucaucagaauuuuagcgucuuaucagccacugcaauuuucccugacauaaaauauauauguucauaguacaaaugcacgcaaauauuuguggccgaaucucggcaacccgcuggaaaggauuaaacgugcgguugccgugacuaaacgcauucauucacccuacaagauuuaggaaaauguaacguugcaagggaagcaaggucucuguguaaaccucguaaucgccaccaaaagucgguagcugggagccuucaaagcccgccaaacacacuggaagcauccacagcuguuuuaaauugguuuugguuucuggaaauagcgcacucgguacggcagcaucucuggccuccagccgggguuaacccugaccugaacgcccuguuuagcucccagcauuucaugauuccgcuucccugcuccguaaaaccgaagaaaaccgagauuuccgucaccgagaaaugcacuuagcaagagggggaaauucgguguuuuaaaugucacauuuuuguguucucuaccacuaucaagaaaaggaaaaaagauguguuuguguagcggggacgcagcuugacacccauuuccuuuggcucgcaucgcggucgcagagcccaaucgcggggaaacgggccccccagaaaaacaggcaacgacccccagcucuuugcuacagggaucgggagaggacuacccuggggcugggcggggagggggauguugggaacaggaauuggagauggaauuucugcgcccgcagagcagggaggggcccgcgggggcgcggagaggaaaaaaaggccaggggucaagccuggggagagagaagcugggccggggaaaugggguacaggguguacugaaggagggguacggugggguccgggacagaaagagaggcuggugcccaaagggcgcgcucaggcgcccggaacccgagcgggggagggggaggcggcggccuguuggccccgggaccuccacgucgcgcgcaggccacuaaccugucagcaagaaugugccaguggucgcggggcucauccugcgugucccccgacccugucccguccaagcacaggggucucccagcucccaccaccggggcaauugcauucuuggccuggcuaggccguccguccucgauucuccccuccccucccuuucuucuucccucccagcuuggccaguucagcaucagcaucccgcacccccucgguaaucccguacucccucuagcggcgggccacugcagcguggccaccgcccccacccccaucccccauccccgcaccccccuccacccccuagcccgcggagcacgcugggauuuggcgccccccuccucggugcaaccuauauaaggcucacagucugcgcuccugguacacgcgcuucaacuucgguuggugugugucgaagaaaccugacugcgcccugaggagaacagcggagaagguccaccgagccuggcgaaagguccgcugagcgggcugucguccggagccacuccgggcugcggagcacccaguggagaccgcgccuggcucaggugugggaccccauccuuccugucuucgcagaggaguccucgcguggugaguaugcggugaggacguuuuuuuuuuaaagaucacguucauuccccgugcuuaucgggagcugcgggagauggaguagcaccccagaaugucuccacgcaaaacuugucacgccuucacuggcuguaccccaaaacaaauggggaaaccaagccuuaaaggcuuggguuuccaggaccaaguccagauacgggcuguagacagagaugagcugcggacagugaugagcugcagacggucaggagcuauagaucgauuugcaauuugcucuucaaaugcgcuaccaagugccaugcuuuacaaacagauaagcgcuucaaaugcgcuacaaacuggcgcuucagaugcgcuacaagcacgcuucacgcgggcgacaaacugaugggagcuacaacuggcgcuucauugcgcuauaaacugaugggcgcuuuaugugccacaaacugacggaugggcgcuucaguggcgcuacaauccagaacgaggagcagcgauauaggagcugcagacagaaaacugaauugcgcuuuacaugcgcugcaaaaucugagcugcagaagaguagcacuacaaaaaacgcuacaaaaacgaugcgauuagccagcccgacaacagcgcuucauugcgcugcgaggcacaugaacugcagagguacaugagcugcggaacaauucacaccuaagaugcacuacaaagugguaagagcugcagagguacaggagcugcagaccguuugcgcuacaaauaaagcagccguagugggacaugagcugcggaguacaauuccucuguuuucuuggagcaggaccccacccuuucaccuuuuggaauggcucccacucuauuuuucugcaggacgguucucgcaugauggugcugguagacaaaauggagccccgggcaaaaauuaguguuuaacauucugcccacaccauucccgcuauagcaguggaguggaggggcacugauuggaguggaaaugggaaucuuuuggugauggcagagcaggcugccugccuacuugugcuugauugaaguggcgguguaguugugguggcgcgaaucagcguccagcaacaguuuguggaaacuguggguuugcugaguauggcgggggaauuggaucuguggauugcucuugcugcaugaaaugaaucuggcuuuggugacuggugggagggguuugggaggggggauucuggcggcggggggggggggugugcagauacucugcagcccuguagcagccagucucaggccugccccgcccauccuagugugccuucucugcggugcuuagcgccuccuccuacagcgccuccucagagcgcgccuccccugcagcgcgccuucccagagcgcgccuucuagaugcggccuccucaggccccuccucccagcuccuuagcgccugccugcccaggccccaccucucucuggccaccucauucugaggugagcugcucaggccccgccucuuccaggcccgccuuuucuguggugagcugcccaggcccugccucucccgggcccaccuacucugaggugaacuguccaggccccgccucucccggggccgcccccucugaggugaacugcccaggccccaccucuccugggcccgccuccucugaggugaacugcccaggccccgccucuccugggcccgccuccucugaggugaacugcccagaccccaccucuccugggcccgccuccucugaggugaacugcccaggccccgccucuccugggcccgccuccucugaggugaacugcccaggccccgccucuccugggcccgccuccucugaugugagcucacccagaucccaccuccccaggcccgccuccucuuagguagccugcucaggccccgccucuccaaggcuuggccccucccuaagccugccucugccgggcuggccuauagucccaccucccucagagccggcuagcacacaugcgcagugugaacccucagccccucccuucaggcgccgguccucugcaccugcgcaccuuccuugccugagcccuggcuguacagccccgccccccugcgguuucucugcuguguugguuuugcuuuuuggcuacuagagucuaauagaauaauaaauaaaacaauuaacaauaauaauuauaacuggaauuuaugagcacuuuuaauauguucuuugcauauauucaauaacauaaucccacaauuuaaacuccugauaguggcuuaugaagggaccuuguaaacugacauggcuggugccucuaaaggcaauuuagccaaauguuuuuacugcaaaugaaaaccaaaacuuaacaauuuauuuuuaaaaacuuuaaaaauauuuucacauuuaagguuuuuuuagaggcacuaguggaccuuugggaaucggauguuuugguggauacaaaauuggugcuguugguuuggccucugagugaggauaaggcuuuuauuugcgugccuaugaagcuggguguuuuccuugaaucucuaggugauuaacccuagccuauuugccuauguauaauaaauugugccugcacaugguaggcauucauuaaauauguguuaaaugaccagaguaaauugguuuauucagugucuugcuuggugucuguaggucucuucugauuugcuccuuuccuauggugcuuugcuguccuggguugccuuguuugcguuaucucucacauuuaacagaauaaaaaaaaaguguauguguuuuuaaacuccaaugauauaagcuguaauuauaauacaaagcaacuaaauuaauuuuaauuauuccaaauaauuagcuuuuuucauaaaaagcuaguuauuccaaauauuagcuuuuuucaugaaaagcuaguuauuccaaauaauuagcuuuuuucauaaaaagcuaguuauuccaaauaauuagcuuuuuucauaaaaagcuaguuauuccaaauaauuagcuuuuuucauaaaaagcuaguuauuccaaauaauuagcuuuuuucauaaaaagcuaguuauuccaaauaauuagcuuuuuucauaaaaagcuaguuauuccaaauaauuagcuuuuuucauaaaaagcuaauuuaaauuuggggcaaguguauuauuaaugguacauauuguauuaaaguuuguguaauguaauauaaaguggccacauuacaaaauauagguuguuucagcuugcaaaauuaaacaacuguauaaaacaaauuuauaacugauugcuaguaagagguaccauguaagaauuguguuuccagcugaaugaagaaauuuuaaaaccugguuccauauauuacaaaucaugagccaggacuuugguaggggaggaauugggggcuuuggcucccaaaaaucucugucacauacccccuccccaccacaaguacacaaucuauggaaaauuugugcuuaucauaauuacagcuuuaaguaauuuucccuucucuuuggauauuguauauuugcauauugaagagguucaaaacaacaguaauaacaugcauauuaagagaauuugcauuucauaaauaguacaagauaguacuaaaaaauuggacauuugaaaauaugaagcaacuaagaguugcuuaaugagaugucauuuccuaacaggauguucauuuaugguuuuuggcuacuauugcucuuugguguguuuguggaauagaaauuauuccaagcuauugugaagagucaauaauuaaccaaauguauuuauuuccuaaaaagacuaaaacugaaauuauuaucauguaaagauggcaucuguccuaggcaacuuggcuuuaugcaguuuguccuuucaguuuucaggaaugagaccucuugaccccuccccuccaaugcagccccuacuaagggggaguuuaaggagccauacauaguucuauaauucaaaucaaguaaacaugcuucuugucccagguuaacuugugcugccucagucgcuguuuaaacauuuuuauacgcacuguuaaccugccugcccauuacccuauuacuuuuaauggauaaacuacuguucccugggcaguugucucuuuuaacgucccacccuaaacuugccaacccucauaugaaggccucaggcuuguuauuggcaaaggucagaagucuuaagcuagugaccuugcaggcuaaaguaggccuugaauuuguuugaccaggaacuaaauuaaaaaauaaaaaagaaugaaaugucugguggcaggggggcagggguggggagggugguaagggggagggcaugcacccccaaguuccauuguugcagccccucccaucuuaacucuggucucuuuucacuuuucaacuaccuuccuuauauaccaaagguauuugaauuuuuaacucuuauugaucuuuuauuucccuaaaccauguaguaauuauuugcugauuuccuaauguauuguuauuucugucccaucacuguuuuuugcagauaauaaaaccaucagaccugggcuucaauaaagccccacuuaguggccgugauugacaaguggucaggcugcaccaggccaugcugugaaugcucuuuaggaagucuugucucaagguuuugaagauauuaaugucuagaugacaaaagugguaccuuagucaccuuacuuaugguuauuaguuguucauuaaugggacaugaaaacuccuaauuuaauaaggaaaaauugcauuauguugugauguuauauugucagggucagcaauacaauugucuuuaaggaguuggaaaugauacugaaugucacggguuaugauguguuuauuguguuuucuaauuuuuucuaaacuugaauauuuuaucuugaaugucaauuauuuguuguuuuuauagccuaaguuacuaaaguaauuaaguagugggguuaaaacuguuaaaaugucacacuacucccugucucuuaaagacccugcuugcuguauagccacuccuuggagaggcuacaccaacugcaaaggacacagggauaguaucuguggguggugacauuggggcaugggagguaccuaaagaguuuaggaguuggagaggaaggagcauuucuuuacagccaggggcugggcaucauguuuaauuaccacuuuuuuuuuuucuuguacucuauugguugaaaauaguaacuauuuuucaccuaacuucucuaauuaccaacuguguaucuuuuuggccuuauucuauguaauuuauuuggcguccauuuuugcagguaaaucacauagugaguauccagagaggaccaacuuauguauuuaaacuuuuguuuauuuaaaaguuuuauaaacuuucuuuaaaaguuuuaaacuuuuuaaaucaaaguuuuuuaaacuuuuuuaaacuuuuacauauuauguuuuaaacuuuuuauauauuuaaauuuuccaaauaugggacuugagauuauuaauaaaauuuaaaauaauuaaaucauucuaaaugcauuuaacuguauuuucaggaaguacacaggcagacacugugucaggauuuuuaugugugugauugucauuacacucauaauuagaaugcuuaaacacacacccuacccccaccuccccacacacauccacucacccccuaggagugcagcccugucccaccuuaacauuacaaaccuucauuuggggcuaugcugacaaaucuucauuaaaaacuauggauuacaaacugguaaacugcaagacaaauaaggccuugaauuuguuugaccaacacaguauuuuuaaaaaaguaaaugucuuuaggugggaaaugcaugcccauguugcuauaguugcagccccucccucuuuuaaucccacucuuuuuacacagauagucaccuuucuauuuucuaauuaauaacuuuguucauaucagcuaaccauuguugaauacucacuacauaauuuaccugcacuauuuaauuaaguccucauaauuaguuugagguauacuauuauugggcuucuuugaaugucccauuuuauagcuuuuccuaggaggcaucaauuauuauuucuugaaugacugcauaaugacaaaggaaacugacauacacauauugcugcuuagugccauuucugucccauagagaauuuucuuuggggauuuaaauuauggucagaaaaguaauuuaggcaguccugugguuuuugugguggugguuguuugauuugauaaccaguuaccuucucgguggcaguggaauaggguugugacaguuggccagaguacccuccugcccacagggcugaugaauacaugcauugugauuuuaauacucccuucuugcuuuaaugagauucuauuaguugcaguauuaacuauuuuuggccuggcuucuuuaauaacaaaaguuauuauuuuggcuuuaauuugcauaauugauuuuguauccauguuugccuugaaguuucuugcuguguuugaauacaaaacuacuuguuuagaggguuucaacauucuuuuauaguuuauaaagguaagcaugcuguugauaauguauuguugaaucauaaugaacagguggccuuugaggaagacaaggucauuugaacaucaaaaaguacuuugcuuuuuguuauauauggugcugauuacuaacuuucucuugagaguuuauuuucuuuguucacuaauuauuaauguaagcacguagagcaagggauaauuuaaauaccaaauccuuugugucugcuuuugcugcuuugaauguauaaguuggauuuauacauacauuuaucuuuauuuacagaaauaagcggguuuugaaaacaaaaaaaagaaggaguggaagagggggccaggauccaggccuccauccccacagaagugaagcuacagcugggaggucuccucccaccccaaccgucacccugggucccgacugcccaccuccuccuccucccccuccccccaacaacaacaacaacaacaacuccaagcacaccggccauaagagugcguguguccccaacaugaccgaacgaagaagggacgagcucucugaagagaucaacaacuuaagagagaaggucaugaagcagucggaggagaacaacaaccugcagagccaggugcagaagcucacagaggagaacaccacccuucgagagcaaguggaacccaccccugaggaugaggaugaugacaucgagcuccgcggugcugcagcagcugcugccccacccccuccaauagaggaagagugcccagaagaccucccagagaaguucgauggcaacccagacaugcuggcuccuuucauggcccagugccagaucuucauggaaaagagcaccagggauuucucaguugaucguguccgugucugcuucgugacaagcaugaugaccggccgugcugcccguugggccucagcaaagcuggagcgcucccacuaccugaugcacaacuacccagcuuucaugauggaaaugaagcaugucuuugaagacccucagaggcgagagguugccaaacgcaagaucagacgccugcgccaaggcauggggucugucaucgacuacuccaaugcuuuccagaugauugcccaggaccuggauuggaacgagccugcgcugauugaccaguaccacgagggccucagcgaccacauucaggaggagcucucccaccucgaggucgccaagucgcugucugcucugauugggcagugcauucacauugagagaaggcuggccagggcugcugcagcucgcaagccacgcucgccaccccgggcgcugguguugccucacauugcaagccaccaccagguagauccaaccgagccggugggaggugcccgcaugcgccugacgcaggaagaaaaagaaagacgcagaaagcugaaccugugccucuacuguggaacaggaggucacuacgcugacaauuguccugccaaggccucaaagucuucgccggcgggaaacuccccggccccgcuguagagggaccuucagcgaccgggccagaaauaauaagguccccacaagaugaugccucaucuccacacuugcaagugaugcuccagauucaucuuccgggcagacacacccuguucguccgagccaugaucgauucuggugcuucuggcaacuucauugaucacgaauauguugcucaaaauggaauuccucuaagaaucaaggacuggccaauacuuguggaagcaauugaugggcgccccauagcaucgggcccaguuguccacgaaacucacgaccugauaguugaccugggagaucaccgagaggugcugucauuugaugugacucagucuccauucuucccugucguccuagggguucgcuggcugagcacacaugaucccaauaucacauggagcacucgaucuaucgucuuugauucugaauacugccgcuaccacugccggauguauucuccaauaccaccaucgcucccaccaccagcaccacaaccgccacucuauuauccaguagauggauacagaguuuaccaaccagugagguauuacuauguccagaauguguacacuccaguagaugagcacgucuacccagaucaccgccugguugacccucacauagaaaugauaccuggagcacacaguauucccaguggacauguguauucacuguccgaaccugaaauggcagcucuucgagauuuuguggcaagaaauguaaaagaugggcuaauuacuccaacgauugcaccuaauggagcccaaguucuccaggugaagaggggguggaaacugcaaguuucuuaugauugccgagcuccaaacaauuuuacuauccagaaucaguauccucgccuaucuauuccaaauuuagaagaccaagcacaccuggcaacguacacugaauucguaccucaaauaccuggauaccaaacauaccccacauaugccgcguacccgaccuacccaguaggauucgccugguacccagugggacgagacggacaaggaagaucacuauaugu

SEQ ID NO: 12611 - RNA, 24166 nt, Homo sapiens
acucucauuuuuuuccacaaucaugacacauaugaaaaaugauauucuauagaaauauauaguagagucaacuguagaggcuacucagaagaggcgacagccauaccaaacuccacuacacucguuguccaaggacuaaaaagauggcaucucagucaauccucauucucugcacuuagccaaguugagggcugcaguuuaacccuuuugagggaagccugauguaguaagaaaugaauuacaucgauauuuauauucugacucucauaagcuuuuagauauuuauucagaggaagcaaugcagcaaaagcaaaaaguuaugugugagcaagacucaacugcauuaaacacaauaucaaaauugaguggaaaguuaaacguucaauauaagaaguuuugguuugacagaauaguuaauggagaagagaagguuacucacuucucuugguauuuucugcuccuuugcucaaauagccugagaagauaagucuggguuuccacucaugggaacagaacuauauaucucagaugaaacaggaacaccaguggaaacuuuaacaaaaacaaugcauauaagcaacaguuauaugcaccauuacaauuuaauguccucacuugcacaauguuggacuauugugaaaauaauaaaauuagugaaaagcagaauacaaaacaguauacaggcacuauaaaaucuaguguaauagugcaaucuaguggaaaaggauuaaaaagccaaguguaugagcuauuggguuagggacguaaagcugcaggaaaaauuucuguucacaauaaaaaauauaacaaugcucacaugcucuuuccaacuaaguaaccucuaaaaaagaaauauucuuauauuguauguuugcuuuaaauuguuauuaauuuccuuaauuauaaaaauccauacauucucauuguacuauacuuuccaauaguauaaccaggaggguacaaaauauaaauguucucccucauaucccuguugccaucccaccaaugucacugccuagcguaucuacccuuaaucguccucgugucuuuccauauucuauguguguacacacaaaaacacauaccgugcucuuuuuugcauaauaugaucacauuuuuucacuuagaauauaucuugaacauguuuacaugauagcacauuuuaaggcuacaucauuuucugcuaugugucucaaucauaauuuauuuaucaucaccucaaacuaagcuuguccaaacuaggacccauacucuuucccuuaaaaacugauccuauuccagcccucuucauccuguguguggcaccaccaucuguccucauguagaugacagaaaucuggaaaucauccuugaaaucuccucccgacaaacuuagcaccaaauucaaugcaacacucacuucuguugguuuuuacccccuaaaauaucccuccuaucuucaucuccccaucaccacgcuagcccacaaggucaucaacucuauccucaauuacuaaaggagcuuacuagucugcugcaaacuauucugaccccuccaaccuuuuccucacaaacagcuaaagugcucuuuuugaaaugcagaucugaucauguccugguuaaaucccugcaaagauuuucccauugcucuuaguauaaagauuaaauccuuuaagguugucuaccagguccugcaaaauuuguucccugaccuccugucuagccucauuuaacauugugcuuacccuuuuacugcuccaacgccacuggacuucuuuuagcacuuucuguugaccauauucaaccugccccagggccucuacagaggucuuccuuuuaccucauauauaccgucccuccuuacuaauauuuacucauccuuaagaucugaguacuuccuuggaagagccuuccuuaaacccccuaucuggccaaauccucuacuuacaaguucuagucagguucauagcaauuaccauaguuuuaagggcacauuuauauguguaauuguuugauuaaucaaauaaucuugaaaaaaacccuguucuuugucaaccccacuaguguaaaaaguuccacgauagccgagcuguguauucccuagcauccagcauggggucucaaaacuagucaacacucaaaaaaaugaaugaauaaaggaauuacuggccaggugugguggcucacaccuguaaucccaacacucugggaggcugaggugggagaaucaccagaggucaggaguucaagaccagccuggccaacguggugaaacuccgucuuuacuaaaaauacaaaaaaauuagcugggccugguggcgggugccuguaaucccagcuauuugggaggcugaggcaggagaaucacuugaacccgggaggcggagguugcagugagccaagaccucaucauuguacuccagccugggcaacaagaacaaaacucugucuccaaaaaaaaaaaaaaaaaaaaaagaauuacuaauuaguaaagaugaccaggauuuuuucuaguuuucuuauuaugauuaucaacacuauaauaaaaauccuuaucuguaucuuugaagcaccuucaccauuauaucucuaagcuagacuucuagcaguaaaacgguuagaugaaaaauaauacuguacauuucaaauucugauaagcacauguagucaucuguucuguuucuacuucggcaguacuggucuuucaugagaaugaacccaguaacuacagaaaaugaaagauguuaaaagugcuacacugauuaacuauuucauagaagagaaaagccaaugucauuuuacugcacagcaagaaacaugaauuugcuaagaaggagaaacaaaaaaccucagggcuauuuuuucucuuauuuugcuuuccaagguaaaagagcaacuauacuuccaugcauacugcugaagaaauagguaacaaauauuccacuuuaacugcuguaagaaaauuacugugaucccuucuuucaaauuugcagcgaaccccaaaucuccauaauaaucaaaguggugaucagauaaggaagugaaaagcuaaagaaugggaaagaauucauaccagagcugccuaacuccuauacauuuuuuaaaugagcggcuucauuuaucagaaaagagucugcguacaugucacaacagauaccauggcgauucccgugguacaggaugccaaagaucuauuccaaaaaauugauuagucuaagacaauuagauacaaagugaaaugugcuaaacaugcgugguuuuuaaauaaucaaaugcacuuaaacugcuauugcauaaacauugcacaaaaauucuuacaugaagauacaaaaaauaaaauaaaauucuaccaaagagugaccgaagaagaaaacagcacuguagcuuuuacuaacauauuguuuccaagaauauaacaauaaucaugccagcaacuaauguuuugaggcuaccuauuuauuucccaagguaacaucuuuaaguuuuaaaauguagacacuggggauuauuacuuccaaagcaggggagccagagccagagcaagcaagcacugcauucaaggaauuacaaguagccgccuguagaucagcugagcguugacaagccagaaacucaucuuugagcuuuucugucuuggaaauaugaacucagcccaagaacgcccguggcaucuucaacaacagggaugcaagccaucucaaacugcuguuugcauuauuacaaucccacaaaagugcauggggcccuucuaugaaagagagaauaaggaaaagagaaaguuguucaacauuagaaauauacuucauacagucagagugaaagugacugcauuucugaccuaacaacuggaguggaggagaaaguucuaagugugaggcagaagugaaagcugcagggaaaaguuagaaaauaugacagaagaauuuuucuaucauuucuucaccucucucauuggacuucuuaguuugcaagaacuaauaacuccaggguauaaaaauagcuuuuguagaauccgaaacuacucacaaaagggguccuguaaggaagcccuauauaauccacaaauucauuuuaagaaaucauauuuucaaaguuugauauacuaacccaaauaaacaaucaauaggcagaucaccauacaggaaagaaaaaucugccucaagacauguuugagacacuaagaaugugcccuucagccaggcagaaaccaggcuaaccugaaacagacagaaguuaaaaacauuugauaaaaauauuuuauuuugcuauguaaaagcuaaaaauuguaacuguuaaguuuuguagggagauacaucacaagggaggggagguugcagaagggacccuauuucccucuggagaagaggcagcugagcuccagcagccagccugcccccucuagcccuagguacccucggcauccacggccacucagccccaguagccugcuuggacagagcaagaaauuccaggaaagaguaauucuaggaagcaaauuaagcaaguuaagacacuuugcagggggaaaaggaaucuuucaucuucuucucagguuuucauguuugaaacagaaugggagagauaggaggguguguguuaaauuacccuguugcagcuauuuucaaguuguaagaaaugaacuugcaacacauagggcuauuuagacaguuuaucagaaaaauaaaauguucucaucacaauuaucuuucaggucuacacuaaaauguuaucaaggucuucaaguuaaauauucauugcaagaaaggugaauauuucugauauuuaaagaacagaauaaauaaaguugauuguuuuguugagcugcaauguuaggaaggccucauguugaaaucuaucuguaccuuuaacccaccgaugcuaguucuacuuuccgaagcaaacaucagagaguucauguugacuguuuagucuucucaaguuaaacacuuccagacccugugaggauaccucccaugacaggauugccagacccuucaacauccccauggacugcucuggaaguugucuaauuugucaaaaucucucuuuaaaugugacagccagaaauggacacaauacuacagaugugguugauuagagcaggguacuauuaauuuuugugacauauggacacuauacuacuaccagaaccuaacuaauuuuuuuuucuuuugcaaccauaucaugccacugguucauaauaaccuucauuuuccuaaagaacugccaccauacaaagucaucuccauacuuccauaccaaugaauuaugaugcauuuacuacuauaaaauauuuuuuugcuuucagcacagcauugcagcccacuuaaaaaccauguuaacucuaaauuguuaccuauuucuaacagcuaucccuuuucaauuaauccauggauuuuaaagcaagccucuuagaucuucaucaaagucauucguacaaaugcugaggaagacaaaacucagggcaaaggcuuaugauccuuaaccagggacgauacccugacgcaaacccaagaacguauacaccucgccggugcugguucagucugccucccgcucacacagcaauacugcuaauuaaucugcacaccaccucauacacaagagcauccugcauccuugacaaaugcuuugcagaaagcaggauuaacuuaucuuucaaaacaaaguguaagaaaucuauacauauuaaaauuauaauuauauacaaauauuuauguacacagaacaaagacuagaagggauacaacaucaauggaaaugguuguuccagagucagucuguggaaacuggagauuuguuuuuuacuuaauacugucuuuaauacgguuacagaauuuaaaacacugggaauuaugaagagagaauuuggcuuggaagcaauccaugugaaauagcauuuaagagcauugagacucuaucugauccuaucaaccugaaaacuugaaucagaaacauauucacuugaaaagacuuauugauaccuagaaacauuggcuuuuucuucuuuauuauuuuuuuuuuuuguuucucguacugcuacuuuaggcuuaauauuucuggaaaucagggagauaacagacuggagaacuggauuccgaaguuuagaaaaagccugaauggagugugcguuagucuauguaugcuccucacaucugucugucugucugucucugcuggggagguugagagggauagaaagaaaacagccaucauauugauauuucugugaagcuauggacuaagcgaucuccccuccagcccaagaauuucuaacgaacacagacccauaucaucaauuccccuagagucauuuuuuuacacuggagguaggaaauaaguguuagaauaugcauuuagguguuuacagaauauggaaggguaaguuuuaaggaaaggauuuggguagauuauggauaauuagcaaaaaagaaaaaggaagaagguggcuggguauuuuggagaaaaugugaucuauaaauacugcacuuauuagaaucagaaacaaucugaauauuugacuugggaauuuuuuuaacaagucaggauuucuucacuacuucaauauuuuguguacugcaugauuuucaccaguggaaaacuaguguuagaaacuggauacauguuaucuuuauuuccuugagguugucgcuaaccaguuuuuucugguguugucccuuauuuucaaugucugugagacaagugaaaaugccacuuugcuuagaaaugcaauuuauccaccauacuauaggauaaguaaaauacaugaagcaaaucaacagcuuuuagauuuauggcaaacuguuguaaaaauggauaaaauguucaauacaaaguccacuuacucuuugacaacuggaaauuguacuuugcuuagaaauaaauuuuccguaccauaccagaacuuaagccaaauacaggugguaagucagcagguucguaaauccauagcaauugucauuaaaaaugaauaagguguccaaauagaaaguccaguuauuauuugacaacugaaaauuuuacuuugcuuagaaauauauuuucucuauauuagaaauuaagccaaauauaugugguaagucagcagaugcauagaucuauagcaaauugucauuaaaaagggauaaaauguccaaauagaaaguacaauuacuauuuuacaagugaaaauuccaguuuguuuugaaaucguuuucuaaaacccuagaacuuaagcuaaauacauaagguaaauucaacagcuuuauaaauacauggcaaauuuucauuaaauggguaaaauguccaaagagaaagucuaguuauuaucuaacaagugaaaaucccacuuuguuuugaaauacaauuuucuuaacauacuagaaguuaaauauagguguuaaaucaacagcuucguagaucuacagcaaauucucauaaaaauagauaaaaugucuaaauacgaagcccaguuauuauuugauaaaauaaauaauacacauuaacuccucuuugcuguauaugcaacccugugcaaaaugggcagaaauagucaacaccagaaauaaauaucugagaaaauccaaaauucacauagauauuaaauauccaaaauauguuuaaaguucuuaucuauuaauuugguuuugguuuugguuuugaaaauguuuguuguucuagacaacacaaaaauguuaccuaaaguauugcucuauuaauguuaucuuucuguuuuauuuuuaguauuguuuuguuuuuuggauaacaaaaagguuuuaucuaaauuacuuauauauugaugcuguuuuuucccuuagaaaauucuauuucuaagcaaagugaaaauauuuucauauguagaggaauaaaaaacuacaauauguuagaauagugagaugggagaaaauucuucucaguuuucugguuuuaaauauuuauguacuaagguuguucauuuaaaauuuuaauuaaaaaauuaauauuauuuccuuuaaagaaagcucuccaaacuuaauguuauuuaacauuuaaaggcucuuuggaaagaaaauaaucgaggagaauuaauuugaucuuguuuuuaacuuuuagaaaguauuuaacugcaauccuaugaaaaauauuuauuguauagcuaccuauauaugcauagagaacgucugaaaaagcagacucuauaauguuuacugguguuauugcagggugaauagguuacaggugaccuuuucuuuagaguuuucuaggguuuucucuccugaauuuuguacaaugaccugaaauuacuuuuauuaugguaaaauacuaauuacguuuuuuaaaaaaaguccugguuagcauuuugaaaugaaaaaaucaaauugguucaaacuuguucaaacuuuuaaagucuuaagauggauuuuugaacuuuaauuuuuccugcuuuucaucuauacugguuuuaaaucucaauuuuuagaaaaauaaugucucaguuaacuaggugaaguaacuuucgaauuuaaacaaacaaacaaaacugguaagaauuugacagcggucaccagaacaguacucuaccaagcauaagaaauccuggaauuauucuaucuugcagaagagggugaacauccuaaagauuaaauuaaaaggcacuucuaaaaaguauaauuguguuuacccaacuuccuagggaaaugucuuuguuaaaaagcugcauuucauucauucauauuccggauagugggcauuuucuaauaaaaaguaaaaucucaguaaaugggcuacaguuuuguuuauuccuagaaaggcucucuuuuaaagugcggugucugcaacguuguuaugacaauaagucaaauucuuauugauauuccaaguauaaaauaauccguagcaauguuacuaaaaugugcucaauuuugcucuucaaauaugaaagcguuucaucuguguuucagaaaccuaacucagcuguagacaauuugguuuucccuuuuaacuuaaacuuguuuuacuaagaucaucaacagauugucaguuucccaagcaccugacacugaggcgcuuagaugggaauccgcguuaagguuuuauuuagcauccuuccucaucagaauuuuagcgucuuaucagccacugcaauuuucccugacauaaaauauauauguucauaguacaaaugcacgcaaauauuuguggccgaaucucggcaacccgcuggaaaggauuaaacgugcgguugccgugacuaaacgcauucauucacccuacaagauuuaggaaaauguaacguugcaagggaagcaaggucucuguguaaaccucguaaucgccaccaaaagucgguagcugggagccuucaaagcccgccaaacacacuggaagcauccacagcuguuuuaaauugguuuugguuucuggaaauagcgcacucgguacggcagcaucucuggccuccagccgggguuaacccugaccugaacgcccuguuuagcucccagcauuucaugauuccgcuucccugcuccguaaaaccgaagaaaaccgagauuuccgucaccgagaaaugcacuuagcaagagggggaaauucgguguuuuaaaugucacauuuuuguguucucuaccacuaucaagaaaaggaaaaaagauguguuuguguagcggggacgcagcuugacacccauuuccuuuggcucgcaucgcggucgcagagcccaaucgcggggaaacgggccccccagaaaaacaggcaacgacccccagcucuuugcuacagggaucgggagaggacuacccuggggcugggcggggagggggauguugggaacaggaauuggagauggaauuucugcgcccgcagagcagggaggggcccgcgggggcgcggagaggaaaaaaaggccaggggucaagccuggggagagagaagcugggccggggaaaugggguacaggguguacugaaggagggguacggugggguccgggacagaaagagaggcuggugcccaaagggcgcgcucaggcgcccggaacccgagcgggggagggggaggcggcggccuguuggccccgggaccuccacgucgcgcgcaggccacuaaccugucagcaagaaugugccaguggucgcggggcucauccugcgugucccccgacccugucccguccaagcacaggggucucccagcucccaccaccggggcaauugcauucuuggccuggcuaggccguccguccucgauucuccccuccccucccuuucuucuucccucccagcuuggccaguucagcaucagcaucccgcacccccucgguaaucccguacucccucuagcggcgggccacugcagcguggccaccgcccccacccccaucccccauccccgcaccccccuccacccccuagcccgcggagcacgcugggauuuggcgccccccuccucggugcaaccuauauaaggcucacagucugcgcuccugguacacgcgcuucaacuucgguuggugugugucgaagaaaccugacugcgcccugaggagaacagcggagaagguccaccgagccuggcgaaagguccgcugagcgggcugucguccggagccacuccgggcugcggagcacccaguggagaccgcgccuggcucaggugugggaccccauccuuccugucuucgcagaggaguccucgcguggugaguaugcggugaggacguuuuuuuuuuaaagaucacguucauuccccgugcuuaucgggagcugcgggagauggaguagcaccccagaaugucuccacgcaaaacuugucacgccuucacuggcuguaccccaaaacaaauggggaaaccaagccuuaaaggcuuggguuuccaggaccaaguccagauacgggcuguagacagagaugagcugcggacagugaugagcugcagacggucaggagcuauagaucgauuugcaauuugcucuucaaaugcgcuaccaagugccaugcuuuacaaacagauaagcgcuucaaaugcgcuacaaacuggcgcuucagaugcgcuacaagcacgcuucacgcgggcgacaaacugaugggagcuacaacuggcgcuucauugcgcuauaaacugaugggcgcuuuaugugccacaaacugacggaugggcgcuucaguggcgcuacaauccagaacgaggagcagcgauauaggagcugcagacagaaaacugaauugcgcuuuacaugcgcugcaaaaucugagcugcagaagaguagcacuacaaaaaacgcuacaaaaacgaugcgauuagccagcccgacaacagcgcuucauugcgcugcgaggcacaugaacugcagagguacaugagcugcggaacaauucacaccuaagaugcacuacaaagugguaagagcugcagagguacaggagcugcagaccguuugcgcuacaaauaaagcagccguagugggacaugagcugcggaguacaauuccucuguuuucuuggagcaggaccccacccuuucaccuuuuggaauggcucccacucuauuuuucugcaggacgguucucgcaugauggugcugguagacaaaauggagccccgggcaaaaauuaguguuuaacauucugcccacaccauucccgcuauagcaguggaguggaggggcacugauuggaguggaaaugggaaucuuuuggugauggcagagcaggcugccugccuacuugugcuugauugaaguggcgguguaguugugguggcgcgaaucagcguccagcaacaguuuguggaaacuguggguuugcugaguauggcgggggaauuggaucuguggauugcucuugcugcaugaaaugaaucuggcuuuggugacuggugggagggguuugggaggggggauucuggcggcggggggggggggugugcagauacucugcagcccuguagcagccagucucaggccugccccgcccauccuagugugccuucucugcggugcuuagcgccuccuccuacagcgccuccucagagcgcgccuccccugcagcgcgccuucccagagcgcgccuucuagaugcggccuccucaggccccuccucccagcuccuuagcgccugccugcccaggccccaccucucucuggccaccucauucugaggugagcugcucaggccccgccucuuccaggcccgccuuuucuguggugagcugcccaggcccugccucucccgggcccaccuacucugaggugaacuguccaggccccgccucucccggggccgcccccucugaggugaacugcccaggccccaccucuccugggcccgccuccucugaggugaacugcccaggccccgccucuccugggcccgccuccucugaggugaacugcccagaccccaccucuccugggcccgccuccucugaggugaacugcccaggccccgccucuccugggcccgccuccucugaggugaacugcccaggccccgccucuccugggcccgccuccucugaugugagcucacccagaucccaccuccccaggcccgccuccucuuagguagccugcucaggccccgccucuccaaggcuuggccccucccuaagccugccucugccgggcuggccuauagucccaccucccucagagccggcuagcacacaugcgcagugugaacccucagccccucccuucaggcgccgguccucugcaccugcgcaccuuccuugccugagcccuggcuguacagccccgccccccugcgguuucucugcuguguugguuuugcuuuuuggcuacuagagucuaauagaauaauaaauaaaacaauuaacaauaauaauuauaacuggaauuuaugagcacuuuuaauauguucuuugcauauauucaauaacauaaucccacaauuuaaacuccugauaguggcuuaugaagggaccuuguaaacugacauggcuggugccucuaaaggcaauuuagccaaauguuuuuacugcaaaugaaaaccaaaacuuaacaauuuauuuuuaaaaacuuuaaaaauauuuucacauuuaagguuuuuuuagaggcacuaguggaccuuugggaaucggauguuuugguggauacaaaauuggugcuguugguuuggccucugagugaggauaaggcuuuuauuugcgugccuaugaagcuggguguuuuccuugaaucucuaggugauuaacccuagccuauuugccuauguauaauaaauugugccugcacaugguaggcauucauuaaauauguguuaaaugaccagaguaaauugguuuauucagugucuugcuuggugucuguaggucucuucugauuugcuccuuuccuauggugcuuugcuguccuggguugccuuguuugcguuaucucucacauuuaacagaauaaaaaaaaaguguauguguuuuuaaacuccaaugauauaagcuguaauuauaauacaaagcaacuaaauuaauuuuaauuauuccaaauaauuagcuuuuuucauaaaaagcuaguuauuccaaauauuagcuuuuuucaugaaaagcuaguuauuccaaauaauuagcuuuuuucauaaaaagcuaguuauuccaaauaauuagcuuuuuucauaaaaagcuaguuauuccaaauaauuagcuuuuuucauaaaaagcuaguuauuccaaauaauuagcuuuuuucauaaaaagcuaguuauuccaaauaauuagcuuuuuucauaaaaagcuaguuauuccaaauaauuagcuuuuuucauaaaaagcuaauuuaaauuuggggcaaguguauuauuaaugguacauauuguauuaaaguuuguguaauguaauauaaaguggccacauuacaaaauauagguuguuucagcuugcaaaauuaaacaacuguauaaaacaaauuuauaacugauugcuaguaagagguaccauguaagaauuguguuuccagcugaaugaagaaauuuuaaaaccugguuccauauauuacaaaucaugagccaggacuuugguaggggaggaauugggggcuuuggcucccaaaaaucucugucacauacccccuccccaccacaaguacacaaucuauggaaaauuugugcuuaucauaauuacagcuuuaaguaauuuucccuucucuuuggauauuguauauuugcauauugaagagguucaaaacaacaguaauaacaugcauauuaagagaauuugcauuucauaaauaguacaagauaguacuaaaaaauuggacauuugaaaauaugaagcaacuaagaguugcuuaaugagaugucauuuccuaacaggauguucauuuaugguuuuuggcuacuauugcucuuugguguguuuguggaauagaaauuauuccaagcuauugugaagagucaauaauuaaccaaauguauuuauuuccuaaaaagacuaaaacugaaauuauuaucauguaaagauggcaucuguccuaggcaacuuggcuuuaugcaguuuguccuuucaguuuucaggaaugagaccucuugaccccuccccuccaaugcagccccuacuaagggggaguuuaaggagccauacauaguucuauaauucaaaucaaguaaacaugcuucuugucccagguuaacuugugcugccucagucgcuguuuaaacauuuuuauacgcacuguuaaccugccugcccauuacccuauuacuuuuaauggauaaacuacuguucccugggcaguugucucuuuuaacgucccacccuaaacuugccaacccucauaugaaggccucaggcuuguuauuggcaaaggucagaagucuuaagcuagugaccuugcaggcuaaaguaggccuugaauuuguuugaccaggaacuaaauuaaaaaauaaaaaagaaugaaaugucugguggcaggggggcagggguggggagggugguaagggggagggcaugcacccccaaguuccauuguugcagccccucccaucuuaacucuggucucuuuucacuuuucaacuaccuuccuuauauaccaaagguauuugaauuuuuaacucuuauugaucuuuuauuucccuaaaccauguaguaauuauuugcugauuuccuaauguauuguuauuucugucccaucacuguuuuuugcagauaauaaaaccaucagaccugggcuucaauaaagccccacuuaguggccgugauugacaaguggucaggcugcaccaggccaugcugugaaugcucuuuaggaagucuugucucaagguuuugaagauauuaaugucuagaugacaaaagugguaccuuagucaccuuacuuaugguuauuaguuguucauuaaugggacaugaaaacuccuaauuuaauaaggaaaaauugcauuauguugugauguuauauugucagggucagcaauacaauugucuuuaaggaguuggaaaugauacugaaugucacggguuaugauguguuuauuguguuuucuaauuuuuucuaaacuugaauauuuuaucuugaaugucaauuauuuguuguuuuuauagccuaaguuacuaaaguaauuaaguagugggguuaaaacuguuaaaaugucacacuacucccugucucuuaaagacccugcuugcuguauagccacuccuuggagaggcuacaccaacugcaaaggacacagggauaguaucuguggguggugacauuggggcaugggagguaccuaaagaguuuaggaguuggagaggaaggagcauuucuuuacagccaggggcugggcaucauguuuaauuaccacuuuuuuuuuuucuuguacucuauugguugaaaauaguaacuauuuuucaccuaacuucucuaauuaccaacuguguaucuuuuuggccuuauucuauguaauuuauuuggcguccauuuuugcagguaaaucacauagugaguauccagagaggaccaacuuauguauuuaaacuuuuguuuauuuaaaaguuuuauaaacuuucuuuaaaaguuuuaaacuuuuuaaaucaaaguuuuuuaaacuuuuuuaaacuuuuacauauuauguuuuaaacuuuuuauauauuuaaauuuuccaaauaugggacuugagauuauuaauaaaauuuaaaauaauuaaaucauucuaaaugcauuuaacuguauuuucaggaaguacacaggcagacacugugucaggauuuuuaugugugugauugucauuacacucauaauuagaaugcuuaaacacacacccuacccccaccuccccacacacauccacucacccccuaggagugcagcccugucccaccuuaacauuacaaaccuucauuuggggcuaugcugacaaaucuucauuaaaaacuauggauuacaaacugguaaacugcaagacaaauaaggccuugaauuuguuugaccaacacaguauuuuuaaaaaaguaaaugucuuuaggugggaaaugcaugcccauguugcuauaguugcagccccucccucuuuuaaucccacucuuuuuacacagauagucaccuuucuauuuucuaauuaauaacuuuguucauaucagcuaaccauuguugaauacucacuacauaauuuaccugcacuauuuaauuaaguccucauaauuaguuugagguauacuauuauugggcuucuuugaaugucccauuuuauagcuuuuccuaggaggcaucaauuauuauuucuugaaugacugcauaaugacaaaggaaacugacauacacauauugcugcuuagugccauuucugucccauagagaauuuucuuuggggauuuaaauuauggucagaaaaguaauuuaggcaguccugugguuuuugugguggugguuguuugauuugauaaccaguuaccuucucgguggcaguggaauaggguugugacaguuggccagaguacccuccugcccacagggcugaugaauacaugcauugugauuuuaauacucccuucuugcuuuaaugagauucuauuaguugcaguauuaacuauuuuuggccuggcuucuuuaauaacaaaaguuauuauuuuggcuuuaauuugcauaauugauuuuguauccauguuugccuugaaguuucuugcuguguuugaauacaaaacuacuuguuuagaggguuucaacauucuuuuauaguuuauaaagguaagcaugcuguugauaauguauuguugaaucauaaugaacagguggccuuugaggaagacaaggucauuugaacaucaaaaaguacuuugcuuuuuguuauauauggugcugauuacuaacuuucucuugagaguuuauuuucuuuguucacuaauuauuaauguaagcacguagagcaagggauaauuuaaauaccaaauccuuugugucugcuuuugcugcuuugaauguauaaguuggauuuauacauacauuuaucuuuauuuacagaaauaagcggguuuugaaaacaaaaaaaagaaggaguggaagagggggccaggauccaggccuccauccccacagaagugaagcuacagcugggaggucuccucccaccccaaccgucacccugggucccgacugcccaccuccuccuccucccccuccccccaacaacaacaacaacaacaacuccaagcacaccggccauaagagugcguguguccccaacaugaccgaacgaagaagggacgagcucucugaagagaucaacaacuuaagagagaaggucaugaagcagucggaggagaacaacaaccugcagagccaggugcagaagcucacagaggagaacaccacccuucgagagcaaguggaacccaccccugaggaugaggaugaugacaucgagcuccgcggugcugcagcagcugcugccccacccccuccaauagaggaagagugcccagaagaccucccagagaaguucgauggcaacccagacaugcuggcuccuuucauggcccagugccagaucuucauggaaaagagcaccagggauuucucaguugaucguguccgugucugcuucgugacaagcaugaugaccggccgugcugcccguugggccucagcaaagcuggagcgcucccacuaccugaugcacaacuacccagcuuucaugauggaaaugaagcaugucuuugaagacccucagaggcgagagguugccaaacgcaagaucagacgccugcgccaaggcauggggucugucaucgacuacuccaaugcuuuccagaugauugcccaggaccuggauuggaacgagccugcgcugauugaccaguaccacgagggccucagcgaccacauucaggaggagcucucccaccucgaggucgccaagucgcugucugcucugauugggcagugcauucacauugagagaaggcuggccagggcugcugcagcucgcaagccacgcucgccaccccgggcgcugguguugccucacauugcaagccaccaccagguagauccaaccgagccggugggaggugcccgcaugcgccugacgcaggaagaaaaagaaagacgcagaaagcugaaccugugccucuacuguggaacaggaggucacuacgcugacaauuguccugccaaggccucaaagucuucgccggcgggaaacuccccggccccgcuguagagggaccuucagcgaccgggccagaaauaauaagguccccacaagaugaugccucaucuccacacuugcaagugaugcuccagauucaucuuccgggcagacacacccuguucguccgagccaugaucgauucuggugcuucuggcaacuucauugaucacgaauauguugcucaaaauggaauuccucuaagaaucaaggacuggccaauacuuguggaagcaauugaugggcgccccauagcaucgggcccaguuguccacgaaacucacgaccugauaguugaccugggagaucaccgagaggugcugucauuugaugugacucagucuccauucuucccugucguccuagggguucgcuggcugagcacacaugaucccaauaucacauggagcacucgaucuaucgucuuugauucugaauacugccgcuaccacugccggauguauucuccaauaccaccaucgcucccaccaccagcaccacaaccgccacucuauuauccaguagauggauacagaguuuaccaaccagugagguauuacuauguccagaauguguacacuccaguagaugagcacgucuacccagaucaccgccugguugacccucacauagaaaugauaccuggagcacacaguauucccaguggacauguguauucacuguccgaaccugaaauggcagcucuucgagauuuuguggcaagaaauguaaaagaugggcuaauuacuccaacgauugcaccuaauggagcccaaguucuccaggugaagaggggguggaaacugcaaguuucuuaugauugccgagcuccaaacaauuuuacuauccagaaucaguauccucgccuaucuauuccaaauuuagaagaccaagcacaccuggcaacguacacugaauucguaccucaaauaccuggauaccaaacauaccccacauaugccgcguacccgaccuacccaguaggauucgccugguacccagugggacgagacggacaaggaagaucacuauauguaccugugaugaucacuuggaauccacacugguaccgccagccuccgguaccacaguacccgccgccacagccgccgccuccaccaccaccaccgccgccgccuccaucuuacaguacccuguaaauaccugucauguccuucaggaucucugcccucaaaauuuauuccuguucagcuucucaaucagugacugugugcuaaauuuuaggcuacuguaucuucaggccaccugaggcacauccucucugaaacggcuauggaagguuagggccacucuggacuggcacacauccuaaagcaccaaaagaccuucaacauuuucugagagcaacagaguauuugccaauaaaugaucucucauuuuuccaccuugacugccaaucuaacuaaaauaauuaauaaguuuacuuuccagccaguccuggaagucuggguuuuaccugccaaaaccuccaucaccaucuaaauuauaggcugccaaauuugcuguuuaacauuuacagagaagcugauacaaacgcaggaaaugcugauuucuuuauggagggggagacgaggaggaggaggacaugacuuuucuugcgguuucgguacccucuuuuuaaaucacuggaggacugaggccuuauuaaggaagccaaaauuaucggugcaguguggaaaggcuuccgugauccucucgcugcacccuuagaaacuucaccgucuucaaacuccauuuccaugguucuguuaauucucaaggagcagcaacucgacugguucucccaggagcaggaaaaacccuugugacaugaaacaucucaggccugaaaagaaagugcucucucagauggacucuugcauguuaagacuaugucuucacaucauggugcaaaucacauguacccaaugacuccggcuuugacacaacaccuuaccaucaucaugccaugauggcuuccacaaagcauuaaaccugguaaccagagauuacugguggcuccagcguuguuagauguucaugaaaugugaccaccucucaaucaccuuugagggcuaaagaguagcacaucaaaaggacuccaaaaucccauacccaacucuuaagagauuuguccugguacuucagaaagaauuuucaugaguguucuuaauuggcuggaaaagcaccagcugacguuuuggaagaaucuauccaugugucugccuccauaugcaucugggcauuucaucuucaguccccucauuagacuguagcauuaggauguguggagagaggagaaaugauuuagcacccagauucacacuccuaugccuggaagggggacaucuuugaagaagaggaauuagggcuguggacacugucuugaggauguggacuuccuuagugagcuccacauuacuugaugguaaccacuucaaaaggaucagaauccacguaaugaaaaaggucccucuagaggauggagcugaugugaagcugccaauggaugaaaagccucagaaagcaacucaaaggacucaaagcaacggacaacacaagaguugucuucagcccagugacaccucugauguccccuggaagcuuugugcuaaccugggacugccugacuuccuuuagccuggucccuugcuacuaccuugaacuguuuuaucuaaccucucuuuuucuguuuaauucuuugcuacugccauugacccugcugcaggauuugugucauuuuccugccugguugcugagacuccauuuugcugccacacacagagauguaagaggcaggcuuuaauugccaaagcacaguuugagcaguagaaaacaacaugguguauaucucaaauugccugacaugaagaggagucuaacggugaaguuucacuuuucaucagcaucaucuuucacauguucauuaucaucugcucuuauucuugcauguuuaaacacuuaaaauuuuuaguauaauuuuuaguguguuuugaaguggugacuaggcuuucaaaaacuuccauugaauuacaaagcacuauccaguucuuauuguuaaacuaaguaaaaaugauaaguaacauaguguaaaauauuccuuuacugugaacuucuuacaaugcugugaaugagaggcuccucagaacuggagcauuuguauaauaauucauccuguucaucuucaauuuuaacaucauauauaauuucaauucuaucaauugggccuuuaaaaaucauauaaaaggauauaaaauuugaaaagagaaaccuaauuggcuauuuaauccaaaacaacuuuuuuuuuccuucaauggaaucagaaagcuugucaaucacucauguguuuuagaguaauuacuuuuaaaauggugcauuugugcuucugaacuauuuugaagagucacuucuguuuaccucaaguaucaauucauccuccauacauuugaauucaaguuguuuuuuugucaaauuuacaguugucaauugaucuucaagcugcagggugccuagaaaugggccguugucuguagcccuggcaugugcacacggacauuugccaccacugcaagcaaaagucuggagaaguucaccaacgacaagaacgauuagggaaaauaugcugcuguggguuaacaacucagaaagucccugauccacauuuggcuguuuacuaaagcuugugauuaacuuuuuggcaguguguacuaugcucuauugcuauauaugcuaucuauaaauguagauguuaaggauaaguaauucuaaauuuauuauucuauaguuuugaaguuugguuaaguuuccuuucacucaauugauuuauuuuguuguuaaucaaauuuauguuaauuggauccuuuaaauuuuuuuuggcauuuuccaacaaaaauggcuuuauucauaagaaaggaaaaaaaucaauggaauuugauaucuaaagaaguuagaaagggagcaaaauaaaaaacauaaaggagauagaugaauuaguaagcaaaucaguagucgaguuuuucaaacuggcaaaauuaauuaauugacuuuuagcccaaauuuacauuguuaauuaaaucaagaaggaagaagaucuaagagcucccauugauaggcaagccuagagagaacuagcuaaauuuaucaugcuaggauauugaaacacagaaaguuuacauacauuuaugaagggucaauuuaguuuggacagugagguauuugucuuaguggaaaaaaggagaauuagucugaucaaaucgugaaguaauacagugaacuugcaggugcacaaaauaagagggccacaucuauauggugcagucuggaauucuguuuaaguuuguagguaccucuuggacuucugaauugauccaguugucauccaccacagacaucucacaucagauacagacaguuccaagauugacaacagagaacaaccugcuggaaagaccugggcagaaauggagagcccugcgggaaccaugcuacauuuucaucuaaagagagaaugcacaucugaugagacugaaaguucuuuguuguuuuagauuguagaaugguauugaauuggucuguggaaaauugcauugcuuuuauuucuuuguguaaucaaguuuaaguaauaggggauauauaaucauaagcauuuuagggugggagggacuauuaaguaauuuuaagugggugggguuauuuagaauguuagaauaauauuauguauuagauaucgcuauaaguggacaugcguacuuacuuguaacccuuuacccuauaauugcuauccuuaaagauuucaaauaaacucggagggaacugcagggagaccaacuuauuuagagcgaauuggacauggauaaaaaccccagugggagaaaguucaaaggugauuagauuaauaauuuaauagaggaugagugaccucugauaaauuacugcuagaaugaacuugucaaugauggaugguaaauuuucauggaaguuauaaaagugauaaauaaaaacccuugcuuuuaccccugucaguagcccuccuccuaccacugaaccccauugccccuaccccuccuucuaacuuuauugcuguauucucuucacucuauauuucucucuauuugcuaauauugcauugcuguuacaauaaaaauucaauaaagauuuagugguuaagugcaaacuguguccugaucauuucagcaucuaccagcaucaagggaauggggugggguaggguggggaaggcugagagaguagggagagugggagaggcuagaguaggguggggcuguggggagggugggauuguuggaaggguagggagguaggaggguggguaggguagggguggaauugaguuugggauagugggguggugguauaaagaacauuauugauuacaaccuaguaugaauuauauagccagaauacuccaggaaaucaguuauuccagcugcaaaaguuuaacauauaaaauaaagauacacaauuaauagcaacucugguugcuauuaucacaaacuuuaacaucaguuuuacuuuaaauacuugagauucauuaauauaaaauuaugaaguauuaggacauagaagaa

SEQ ID NO: 12612 - RNA, 22266 nt, Homo sapiens
uugggauccaggcucugagucucuucucuuugggaguauccaucaaaaugacuuuuuuuaaaaacagauuuucccccaaccagaagaaucugcacaaacuuggcagcguuuuuacuuguuuaaugaguuuaagacauuacauggugaaagagaagcauuuuggacuccugcauuuuuauuuaccauucccagacugacgagaaaaagaaaauuccucacauaacagcccuucucuaaagaaaaaggaaaaaguggcuguaagauuagaacauugcuacaaagggaaugcugcauguuuuaucaaaaugcaaugaccaggaaugaugguugauuaaaaaaaaacaaaacaaaaaccacucuuuccccaccccacccccccaaacccugaacuggaaucaggaaagacggaggaaacaaucaaaaucaccauucuauugcuuugacaccuuuacuaggugaauugguggcauucacaaagcuaauagggacguuuauaucaagaaacauuucuguauauauuguugaauuuuaguuguacauauacuuuguauguuuuugucuucuuucauauauggaguaaaagccacaaaacgcugagugucuuguauauuucucucucugugugucucugucccucucuuuccucccuccucccucacuucccuuccccccauuaaauuuucuaucacccuuaaaaaaauuccuauuuccuaauaugggaagucauauguauauauaugaacaucaagugccugcaaagaugucaguuugcacacuagccuuugucuuagguaguuuaacauuaaccauggauguucuuucaacuuucuuuacauauuacguuuuuauuguaauuucuacacauuuaccuauguuuuaaacauuagaaugaccuauccucaaguuaacuucuagacaucacaguaguuucuagugcugaaacugaguauucuccuuucccuuuucccagccaaaauaauacagccauauuugucuuuguuuggaugcaguuuuuuaaaauauaggaaagaaaaaaauagagaguagagugcacaauuaugccuacuuaauguuuaaaacccauugccagcuagcuagguaggaaaaugcacuaugcuggaugaaauacauccuuccgaucuuggggaaagcacagaaauaaugaaaaugaaaaguccuuucgucauacaagcaggaagccccauacugcgagaauuaauggcuacagaccugggcauccuucaaauuaugaaccuugaaaccacugagccauuuaucagaagucaauagagauacucagagugcuccauauaaugacagcgacauacagucgugcaaaaggacagucacuauaauuagacacaaagcaaagacuacuuaccaauauacccguuccuuuuuuuguugagcaacuuccacgcucagucagucuucagaaugguuuaaaaccgaucagucuugucauuuucuagcauucgcauuguuacauuaggaaaaauguuuucuuuucuuuuuucccccuuccuacugugaaacuuuggguucguagcuccccaggaucaauucugaacaaagccuccagcugcagugccauccaauuugaagcagacauuggggacaauuuaagguuuuuauccacaagaagguuuuuuuccauucucuuaaaugcagccauaauuagaguaauuuuucauguagcccgcugauuacagcguuuuuaccgucaaagauaauuaccuguaauuuucuuccacuuuuaauacuaaaaagccaucuuuauuuagauucaggaacaggaaaggcgaaacaaaagagggaaauuauucuguuauucauacacaaauugcagagacguaggaccuaaaauugaaaauuaaccaaaauuauaaugcugaaaagaauggaagaggcugcagaaguacagcugguaguggggcuuugcugaauuauucaaauuacguuagggagaaugcuaccauacaucgaaaccaacacuaauuuuucguuaaaaaaaauucaccagaugcaugccaaaccacugugagugcauaacauucugaaacccggcaaaugcauguugacauauucgagguguugucaugaugcauuuguaucuaucucuuuaucucuuaacaggaguuuaauuaaacaagaaauucugccaaguagucccccccaccccagacugcccuuggaacugggcuuucucuggauccucugaaccuuaaggguuaauauuuuuacucuuuagaauguauugacccuaugguaagcggauucccgagggagggauugguaggaggggcgugggcgaaaggcaucgcccagugguggugccuacgacgccuccccacguucggacuucuccagagguugcagaguucgagcuguggagccuaguucugaccguauuuccuauuuaaaaagagauaaagugggggagagagagaacaauagcugggggugggguagaggagggaggggaugaagagaacgauuucucuuuggcaccaauaaacaucucauuaucuuuugacacaacuuagucaaaagguuucugccgccggagaaaggccuuuuugcacuggaauggaaaaccaaagauuucucaggcacuuaacaucucuaguugcuuacaaugucuacacggucaggaaacagagucaucuauagauagaacagcaccgcuucuugcuggagacuuccuuggugcgucccuaaaucuggguuuucuagcucccuagcuugguucugcgucucagccaaucaugccccuccaaccccaaggucgcagcguuuguucucggagggcaguaacuccaagauccgcauagccucccccucccccccgccccaacacaccagcuugaggcaaagacccugaaaagcagccuugaagggguucagaggccaguuauuccggaaaccuucccccaaguggaggaaagaugucgaaggggcuucaccguccagagauucaucagacuacaccugccuuugcaaauguccgcauaccugugguucuaaaggagccccgucgcgagcuccguuugauaucuugucgccucaaaaucuaaaaucauggccacguguaaagaccucucuggauuuaccuaggauuagcugugaauaauaauuuucaaauagauuuuagcuuggaaucuccagcagagucucuccacaccuuauagaaacaugguacuuuucgcaggcuccagucacaagcugcaccaaauacaucaacaacauagaaaacaagaaagacaaaucgaauacuuaaggaucccauucucacucgaauccuuucacucaacagaacaacaacccuuuuuacuguuagaggggauaaaaggucagcauagagaaaucuauaaagcaaaguuguagcccaugauaaauuacaacggcaacauguaucuuggaaagugugagaagagaaauaagaacuguuccuugaaguaugcaagaaauaaaaacuuacccucagugaauaucucuuaagcaaugaucaggguuuagaaaucuauacugaaccaaagcacaggagaauauuuuucugagucucagggcagaagcucuuucucuauauucuugguugagugagcacauccaggugugaaauuguuugcacaccccagcaccucuuauauugccagcaaaauuagcuguuauuacugucacuguuuagugaugguuagcgugguacaaaaaaaaaaaaaaaaaaaaaaaaaacugcuguaaucaagaccuggcgcaucuuugcaaauuacagauaauuguaaacguccagauuaugauaauagcauccuaauccagccugcaauauaauuauuacagaguguuacaucugaaacuguccaguagggcuaauucagccauuauuuagacccuauuuuugcacugcaaauggguugcugagcugaaaauguacgauuguaauuucacagggcacucaaugaguaaugguauaggaagaggaaaauacaaaagugaaaugugaacaguagcgaucaaaucaaacccugaaggacaaaagacuguuugauucauauggaaaaagaagagcgagaauuaagaaaauagcaaaucaguggucugaagcauuucauguccaaaucuucaauagugcagggcugauguguuugcaagggcugcugcaucugcugcuugucuggagucuaaaauaauuuuucuuuuucuuucuuuuuuccaacccccugucuuuuuuucccccuucucucuccagaaacauuuuccuguuuuaaaaaugugucccucccccaaagcaaagaacauuugucaguuucaccauuguuuccacaaaaucgccugagagugugccugucacuuguuuaugaacauuuucuuaaaugaauuugcugucucucuuguuauccaagcaaaaugcccuugggcacuuguguuucugcccucugucuucauucucuuucagcaggaacuaagucauagaauccuaaaggauauuagcagaaaacguauuaauugcugcuaauuaaauauagccggcugggaagcugucuucuccaguuggcuuggcuggcuauugguuuuaauccuaucauuaacuuuuauuaauuaacauucccccccccccauauaaaccaguccagcugcugcuuuugcuaccugucaccaaugugcuaaaaugagcaaggucaaucuuauuaaaauauaggaggaccaaagaaggagggaguuagagcaagagagggagaguuagagcaagagaggcuggagacaggcugggggacuaugcuggucccagagucaaagagcucuagggguucaagcuguuucuuccaggaggaugaacccugcccugguggaggguucuggagucuaguucugguuccugguggggaccuccuagucaaagauaccuaaagcccauuuauccccaggagcucaauuuucccaccaugaauacagagaauuuccuaggcaucuuuucuagccucugggccaaugugugucgacucucccuccucccaccacuucacagacccgggagcugcccaaccagggccacccugcaggauggcaagcagguuuccuagcucuugugaauuuaagggcaauaaugaaauguccccuguuuagugaccccuguuuauagaugaaaguugaguccauauccugcucuuccuccgccccucuucccugaccuugcaaauggcaaguggcagaaauaguccuggauaacaauaagcuuccauuggcagguuucugucuucuugguuagcgagagaaaaaaaaagccuuuaaaauaaaucauagcuugggaacuguuuaccacccuucacccucacccacuucuuaaaaaaaaaaaaaacacuagacugcauggugaagaucccacagagaauccuuaccgaagcuaggagagagggaggguauguguguagaaugauguuauaaagccauuuuuuucccuuccuguggugaaaggucguaaugugugguauuucacgguuuuauauaaaucuugguuuaggauguggaacagacucaauaauacaugugcuuuuggcaaagagacuccuucggaucccauaaaucagaaguaaauaagaaguccaagugaacaaaagagcaggaacauuuaauugaugcaaagcaggacucucaucugcuuuaaagagagguucauguaaauucccucaguuccuaucuucacgguuagagcccgaccuauaaaacagguuauuacauuacagccggcagccuuggaugauugaaaggaaaggcuccccaccccaaacacacacacacacacacacacacacacacacgcaauagauacaauguauacuuucugcccugaggaaucuaaagccugucagaugcaacagaaaacgcuggggguuggcgcgggggggaagagacagggcugcguagaaaauauuuaaccaaucccacaugugccaccgcuauuugggcuauuuuuaaggcccagaguucgcugcgacugggcugagguugaaaaaaaccaagcacugugugcaaagaccgcgggcaaccugggagcgcgagccgaggccgagagcaagccgcagcgcccccuccccaagcucuggagcggcgggagccuccaccggcuacugugggagggggugcuuaaggguggaggagcugggugaccgcaggcggauccgccggcguggcgagcuucccagaggugcccgagggcgucugcccucugggugugccuccgggagggcuagagagcucuagguuggcaagaucccagugaccauugggaggcgcgcgauccaagggguugcagggauggggcggagaggaggggcgguuggguagccuaaaggucccucucccagaauacaaggaagcgcuaagaaggaggaugugggggcaguguuccagcaggcaucccaggcucuuccggcuggagagcucaggagacugagcggugucaaggcuggagugagcuauagggugcgcugggaggaggugagcgcagccuggcuuuggcgcgcugugggugacucccaggacggcgcggccaggacgccgcgagccguggggcguccggugggaucaaaggaaccagaggaggccagccgacgcgucugggauugugggauaaggggcgggagagaggagauugacaugggcggggagauccuggccuggccugugucaccggaggggguugugugcguuugugucuuugugcggaucaacgcucucgggccugaggccgugcccuggguggauccgagugugaguggacaggcucccgggugggugcccagacgggagggagagcgagcgagcgagaucaagggcagcgaggucugcggguuccucugugugugugucucaggcccuguggcucagcacuggagccgccuggcacccacaggaaugcggcuucucucggauccccaggccgccccuugucccacaaggagguggccgccaggaaaaaggggggaaaaggggcagaaauccgccuagcucaacccgagccucaaacaaaggccaauuuaucugaucucuuacaggauggcccaggagguggucugggcaccgaagaaucgcgcuggcccugaccgcaugccccagccuuccugggguuugugaggagcucugaaggugggggugagguguuguaaguaagggguggggaguaugaagacgcccacugaaaagaacauuaaucuuagaaaggacuugauucgucuugggagcacuauacugagagcuaggcaaguggaaaccggaaggggcaggcagaggggucacccagugcgaugucaagaguggggccggcugguccgggaauaugcuggggaguggagcacguuuauauucgacguaggaaaaacaauggagaggaagagaagguggaagggagggcaagggagagaaacaucacauagauauuuuuagacuuugcugaagaucuguuauuuuuacauccuugggcucgggacggcagggaguuaaauuccccugagagaauccccauggggccagggaaagcccgcugcagacugguuuaccagaauauuuuuguccacggcucccagaccaagcuaaaaaauaaaaaccgcacgagagaaaaggccuuugcgaguggaagaagugagguuggcacaagggaaggaauccugaaaccaagucuguguccgcgcggcguuggucugggccaccucgcaaugaggcuuuagugaucuuaacgacaagcagccucaaagcuaggguggaggaguggucauuuagaaagagcuucccucuuucucuagaagaauccgaacccucccuucccucagcucggccgcgcccggugaauagggaugaggaagggaucccccuucuuuuccaccaguaauggggcuggggaguugauagggacagcuggaaaaauaucugcccucuuugugugcacaaaggaaaacaguauguuccaagcacauucuugccacucacaggcagccaguaggugagaaauauuggaggugugcagugggugcgcccucacccccaaccuucccaaacacgcaccccuuggcagggagaggcguccgcgcaggggaaagccaggcgcuggcacaccgcgggcgcggguuucucccagucggagucgccagaaauaaagcgcuagcucucgguguaauggaaacucccgaaauccuuacaagcaaagaaagaaaagcaggaaguggauaucuucaucucuuccccaaucccccuauucucugugagcgcagaaaacaaaauggggcacccuuuggcuucccgcccccccccccgccccccgcaaaccuuccuauugcccccucuuccccgcacccagugcuccuuccgagaaaguacggcuggagcggacuggggagacggaaauauugagucgcggccgcugggggugccggaggaggggugcacaggccaggcugccgggcguaguucugccucggagccaggcugcgggauaugucuaaagagcggucaaaauacugauuccuccaagaagcaagcuguuccacacuggcgggccugguaacucuucuagaaaaaaaguaaaggagaagagaacgaaaaaaauaaaggagguggaagggagguagggagagaagaggaggaggaggcaggcagagagacagagaaaaugagagagaaagagagagagagaggagagagagacgagacagagagagaaacauguagguaagguaaauuccccucaaggcacauagcgugccuuuucaggucuagucucccaacccuggaagagccuucugagaaauccucagugacaggauauaauuuuuuaugcucuaaucuacccccacuuuaagaaggcucuuuugucacauuuauugcugcugacuuccuagcuguaaaauauuucacaugcaucuuguaauuuccaacccaacauuuuccuucguauccuaaggaaagagagucuggcccacugaaggacggccagacagaaagacaccuacaauucaggccugggucuuuaggugcagugcauagcucuggucaugcuguugguaucuacaugcaggagugcaagaagaaggaagggacacagggcacagcugcagcaaguccuuccucucugucccaaagaaggcuucccaaaggagaaauccuaguaaacagauucuauuuugcaucauuuagaaccuguuugccacuguuuuauguaaaagcaaaacagaggaagcuccuuccugaaaaaaggaaggcgggaagggaaauauuaagaguauuaucucacacaaaaugaaaucaacacggcgccacaaugcuuucauuccuuccuuuccccaacccugaaguucccucuucacaauaucugcaauguuuucaucucucgaaaagagccgauacauuuauaaucauacuccaaagaguccaagguucuaucauuugccaugcuccaaacauuuuagauuuuuaaaaaauguaauaggugugaggcuagauuucuuuuucauuuucucaucucuggaaacucccuuugaaggguaauuugucuaauugcucuggcacuacacagaggcugaugggugggggcgcuucuccaagauaauugcuuugagcuuagaauucagagggguuauugagggauuucuguugccuucuaacucacauacagggugagagggauguauuuuuauuucagcauuacuuucuaccugaaacaauuaugagauauggcaguacuauaaacaugccauauauauuauauauauauaugcacacacacacacaaaguauagcauugaacauauauacauauacagucugcaugcauagagccccgacuucuguuuucuuuuuugccuuguuggaucucugcagagcuuguccuucuuuaguugccuucaauaaaacuucacuagccaguuaucagaggggcagaaugaaguauuuuucagaaacauuccgcuuuucauggucgaaauaauuuuauuuauccagaauauacaguuuaauuccucuaucuacacuuauuuacauggcuaaaauaacauugaaaaaagucuuuugaaaaguugaggucauagauuucaaggcaccauugaaaguguccacaguugcgcaaaaaaaguccucuguaaaaaaagggggggucuuuugaaaugcaauaacuuacaugcaaaaaaaagcuuuacacaugaaucuuuuucaguuuuccgaacuuccccauaugaauuccuuucuuuaugauuuucuagaacagcaaaacacaguagucccaaaaaagagaguaagagagagcagcccaucuaauagagugucccggaggccagcgccagcgggugcuguaaggagcccggcggcggcaggugggaauugauugagcuggcugcacuuguguaccaggaugcagaguucuccagguagcuggacgcuggggacugguuggaggucggagggugggcaugagggugguggcugagcgagcgggacgagcccuggggcucccacaccgcuggagacugcggcgaguuacacgccauugggucgcuggagcugggacugugcuccgggggcaucuccccguuuuucaugaucuucuugaucuuggaucuuuuguucugaaaccagauuuucaccugaguuggggaacaaaggcacacguuaccgggacacucagaggucgcccgcgccuuccccggggcggcgacuggaggcaucuucggaccucugggcggcccagcccugccuggcgucuccccgccgcuugcggccuaccgccaagaagcuaugccuuaggcaaaccauggagcucuggccccagagggcgcccuggccggcucggggcgccccggcccagcgaggccacgaccccaaggcuugucuuuuguuugggcugggggugggggacgccagcgcggcgggugugcgcccgaguguccucggcggcggcgcgccucguguaagccugcgcaggacgcgcggaacgcggcgaaggucuccaaaacaaucgcgcgagcccggcggggaaggggcguggggcgggcuacgcgcgccuguggucagaaaaaggagcgagcucccaaccucccguccuacucccuucacucccucugcagcucagagaggccagaaucugacugcagcucuuggcggcgacucgaacauucuuuaugcuuccguaggccccagcuggguuggaggaguaaaaggaaugggacaauccaggaagacuucucacguacaauagcgccccccaccucgcgacccuucgguggccguggccugaagcucccguaggcucagggcacgacccuucaguuucuccgcuccaggcgacguucucagccuuuucuuagccugagaccaccgcgagaacaccaggccuugcucacccccgaggaggcucuacauuguuaagaaaaccagauagcugcucugggcugccuaggccgcccuagaaauaacccuccgcuugcuuucaacccgcgaaauuggccccacagcuccggaggcccgcuacggggugggggcggggggcgcgguuagugggagguaucuccagaccgcugaugaauaccauccccaccgucucaaggccugacucaccgaguuaaagcauaggggcugaugucuuugggucuguuaguuucucacggguacugucaaaacagcuccagucccaucgagacugaaccgcgcgacccaaccagacgugcagcucaggcaggucuagugcauggcagcgccguauuuaccuguguuugugucaaucccagcgaggcggccagcucggcgcguuccggcaaggcgagguacugagucuucugaaaccuucucuguaaugcggccagcugaaagcuggaauaaauaguccuggguuuacgaacuuucuuugguuugccauucaccauucucaccucgggcucggucacuucuuucucuaaauaaucaaaacagacucaguuaaagcuugucaccagacaaugccccuuuugcggaagggccucaaauagaguccuagaguuucuuaccacucagucuucauucuuugcccauaucaccaccaccuuugcuuuucaggaccgcgauaaauaugcaccuaccccaaauauggaaaagcgggauagccucugauuaauuccuacucuguucauucagauaguuugugcaaagcgcuuccuacaacacugcuuucuccuuggcaucugggauucagcucuugcggucguugcuucuucucccggacuuguuuuuacgcccacccugugcuccuccgcguuuccgccccuccccaggcuucaagaacaccagccccuccccaggcuucaaggagguggcccugggccgugacccuacuucugucggcgucuguucgggcgcccgcagaagccagacucuugggcagggaagacgcuaaccgaggucuccaaaguucaaagacccacaagcaaacugcuccuucacuucagcagcaagcggucggggccgccgcagacagagggucgauuaugcaacccccauaaucucgcugcagaucugcgagggcacagaugugucugguuucuuuuacaaauagacuuaauauguucuuggcaaaaaaaaaaaaaaaaaaaagaaaucuuccacuuaugcacggaauacagagagagugaaagaaacguagacaccucaacccggggcucucuuuuaaaguucagcaagagucacacacugagaaggaaccgguggugggguguuuucguaggaaaggggcggcaggucaggaugagauucucacugucaugaguauggguuugggcgggagggggagggauugccaaacgcguguuguacaaaccugcccuggggcuacaacuccccuuccucaaaacuaccaccccucuggaacugacggagaaccucuccagggugugugugugugugugugugugugugugugugugugucaaguuccagggagaaguguggaggaugagggcuguggucucaauucugccagaguaggggaugcuaauauuagcaggauuauuaaugugcuggugggaagagaucaaaccuuaccaauaaaaccucuccgccgagccucaugccuuucucuuaccgcccaagcucacuaacccucuuaaacucucuaaguaaguuucaaagcggacgaaaaaggaggacggaaagacaaauugugggcgccuauggagacagaaaaaaaaaucuauccuacaacgugaccccucagcaacccuccuccaccuuuaaauggcuuuuuguuuuuggaaaugccuggauaaaccgcaaaacucucggcgcgcucuucucuggcuggcuacaacuccuuaacccccccacccccacccagcgugcucagggcacccgcaccgugcuagcuuguggcggcucucaaacuaauccugacugaguuuuugaggcagccuucuauucccacucgcaccaacccagcacgcuuaccaaaauucccaaguaaccuucucuuuguuacgcaaacgccaggagcugcuugauucuuucuucucuccaccccuauccccuuuccagccuagccggcuuccuggccgggcaagcugggaauucagcgacugaagggccuuggaaggugccggaggggagagacgcuaguucgaaccuccacagggcucuccuacuaaaaaucccuaaaaugcuggcccgagaaacucucuuuguuggagggucugaguccuacucccuucugccgcgugcgcccccacugccgugaaccgcugugacccccaaucuaccaccccaucucgcgcccccagcguccuagucgcccuguaucugcccagccuucccccuguccauguaccuggcugguugguggcgcuugggacgcgguuguaggcgccgccguacuggugguaggagcuagcguagcuauagucggcauaagcuuuggcuggguagcucccggcggagccguucacgccgugauacugauacugguagggguugagagcuuugccauaggaagccgagguaggagagcaguagccgugcggggcuccccccguagggcuguaguagucagaaucgguagcugaagacucgggcaaaguuggcgauuccugagacggauggugcauagcugcggacgucuggaacggagcuuggaagucgccggaucggaugcuggggacccuucugucaaacacuccugucaucgcucacgggcggcggcagcggcuguccuugcuguuguggcggcggcagcugcccuaguuggcuguggggcugcucuggucuaagcagacauggcugugggagcgagggaggaggaggaagaggaggaggagagaaggaggaggcggcggccgcggcgaggaggagacugggagucgugaagucucugucuccggccggcugacugcuggcugaggcgcagcacagccuugguuaaauccuuaauugcgcgcuuacgcacagcgggguggaucugguucuauuggccagggccucgggagcaacaguaacacccuaacucguccaacuaguuuuagcacaacaaagcauugcuuaaaaagggggugggggguacugaggggguguguguguuugugugugugcgcgcccgcgcgcuuguguguguuuuugcuuguuguggaguggggaggggucuuagucuaucuguuuuuaguaaauuccaaagacaucgcagaagccacagcacaaggcucugugaugucuggggacaauguguuccaaucagaagccucaaaagugcacauguuuugggaaugaggugggcgaccaucuuuccuugcuucccacuaccccgcccccgugggcugcaccaaaggcgaguguagaauuaaacacugauacugaaauagggagucaaggugcagggaguggggagcggggggauguaggauggaggcaagaaggaagggaaacagcauuuuuuuuuuuuuuaguggaguguugggaagcaaguuguaacuuacauguuuugaaaauuugcucuuuggggaaagaggcaacuuccuuugcaggagaugaguaucucccggacgcgggcuggacaggaaugcccaagaaggcacaauguccauuaagccggugaauggcagggagaguuccugcagcccaaaguccuuauaaugacuuuuaaaaauuacugucuuaaacacauauaacuuaaggaagcccaaauccucguugcuggcuugcaaaaagagccaaacagcuccacuucuguuuaauauuuucaucuauuuucaagacauuggaauaaaggcucuuuaacuauguucaguggccaaagacucccgcaaaggugaauggauccauguauaaccugccauaccuccaggaaagaaugggaaagucucggaaguggggaaggagacaaggaucaaagccuuugcaaagucagaugaugcucauugauuucccccuccuggcuccaugaauguggcccagucucuccauuucccagacccggguuucuguacccucuccccuuuauuuccugcugcaaagacauccuacuuagcucguaugcaagggaagaaaggauucaagaaucauucaguugauacacgagaucuaaacuuugcucuucaggaggugcuauccuuguucuagucgugauucagcugggaguuuagaaauucagcauaaaagucucucccaauccccauuguuacuccccucaaauaggcaacuccgcggacuagauccugauuuggggccuuccuacaucuuccuuuacgggguccaagaccggcaaucugggaguuccacaggcuaucuaggguuaucuggccuccccuccguuuucccuccuaccgaagaagaaagcgucuguguuaguugugucuaguauuaguuuagccuuacuuggaguguggagccacucggccuaaaacaggccgacggguagagguagggugucuggaacucagagcaagauacagccccgcucaggaacuccaaagcagagcugccgugcgugcaccaacucccugccuuugcggucuggacugcaccagaaaaacacagcuauugucgcacuuccuuucgggggaaacuucagcaccgggagacuggcgcccagcagcauucuccuucucccacuggcccgagucacgagcuuugggccugggcugccgcgggcuucucugagauagacuucgggguaaacagagcugcagcugccagccagcccugacuugacgcugucgauuaccgacaggcuguuaaccgucuagauguaggcugugaggagcuaaagaacaggagggaaacaugggucugcgguccugggcucugcucuggagaaguuaucggcgcccaucgagucaccugauacacacugccauuuaauuacagaaaucgcuuccucagaucaaugccaaggacaguucaaagcaccucccggcaaagacaagugggcagggagccaggccucccuuccucugguccccuaucuucgacacuuuugguuaaauagagauuugaguuaccacaugguuauacugaacaggguguuccuagcaaugcccuuacaccuugcugagauggcagauucuaaccaggaugggauuggaagcugcagaauuggggcaaaauuuagaaguucgggauccgauugaaaauaauguuacaaugucaaauuaguucuagaccuugcuaaauuucacccccccaaaaccccgcagucaaaauggacauucuuucccacauuucauaaaagacaaaaaggagugggccgggagggaagaauuuaacuucuuuguuucgguuccuaaagcguuagaacguuggcccucacgcagacuugagccauucugcugcugggugagaccaaaucuggaugugucucuacagguccagagccucaacuuucuugauuuuguuccucuuuucaagguugaccccacuccccacuccaccccuuccuuaaaggcagccgggagggagaggaagcacuaaguuaaaagcagcggagagucuguucacaguacaguuuuauuuaauuucacaauauaggcauuguagcucugugcacugccggcugcucugcgggccugucugcggcuucggacccacgcucaggacauacaccggccaguaucccggcucucggagcagcaaacuuuugcugguguugugagggaguucucacacuagggccuccagcuuuguccuaaggccagcgggcuggacgcuauugccucucaaaauccaccgacaaauccagccguggagaaacagccccacggcaucaaacucuuccagcagugcgcuucccgcugagacacguaggaagaauguaaguaauuucaucuuuuaguagcugaaaucugcaaagggagggaaggggaaguagcgggagggaagcccuaagauaagugcaagucuuuaccacgagcgccacccaguguccucgagcaacauugcgcaaauggcaaaccccaagcucagucacuggccagacaccaacugguccuuaguguuagaguucacuuccagguggcuuucuuucucuguacuuccaauacaucuuucucucaauucccaugcccuuuccuuuccuucuuguacauucauacuuuuccuuccuccucccaccggcucaccuuuuucugggucaccuuuuucuuggugcccccuguccuaucccucaauucuuagguguaaggcgcuccuucaguguccccaccuggggugacuggaaggcaucaaggaugacucuccuuuccuagccuuuuauuauuauuauuauuauuauuauuaucauuauuauuauuauuauuauuuggacagagucuugcuuuguugcucaggcuggagugcaguggcaugaucuuggcucacugcaaccucugccuccuggguucaagcgauucucuugccucagccuccugaguagcugggauuacaggcaucugccaccacgcccggcuaauuuuuguacuuuuaguagaggcaggguuucgccauguuggucaggcuggucucgaacuccugaccucaaggaauccacacaacuuggccucccagagggcuagcauuacagaugugagccaccgcccccggccgccuuuccuagacauuugugaagaagcaggcccuccuuuaguuagaugaggugcuugggaagcuuucggucauucacuacuaugggcugaaaagagugccacugagugugcagggagagagccgcagaagggggugggguagcagaaaaucuuaauaacagcauuuacucaacuuucuccauguagccuaucuggagaucuguuuacucauagaagugccaacaguagaacaccuuuucuuuugggcuugaaacucagaaaauucagugcaguugaaaauauuuaauuuacgaacuuaagauauuuuuaauauggaaacuuucauuuauauaaaacauuguacacaucaauuggaugugcauaauucagguaaauaaaggaccccuuaauaugaugcuagcauuguauaggcauacuugguauaaaaagcacuuugacuuuaucaguagaauacucauucuuuaaaaguccaguuuugggggugagguuuauuuuucuuuuuauuugcacugcuuuauccauuaucuuuuuuuaucuguccagugaaaaaugcucugagcaauucacucuuaucaugauccauuuagaguacuuuucaucccagaaaucucaaacacaacaaaacugguuaagucaaacauuuuguggagguagaccugaguaaucauuuuauuacaauggagcugcaguuaucuuugagcuggggcacuaaggccguuuaauaacuuaagguaacagcucugaaauauucaauuugauauuuguauagaaaaagcacauuucuuggaacuagggugggaugaaaagauaggaguuaugauugcaaaaguagcaaaggcuuucaaaaauagcacaaguuguuggucacugguuuuggcaaugcaacugaauggccuuugucucccaauagagggcuaggcacacugacuuggaucuagcauucagaggugguucaucugaguuaggaaaacuauuuaauuccccauguagguucaaacuucuucccauguguuuaugaggcugaacuaacuaggcccaagcuaaaauguuuaggagcccauuuaaaucaacagugagcuuaucuagggagagagaagagggaaagugggugugaaggguaacaggauaaauagaaaaaagguuuccucccaugcugaaauuaauuauaauauccccuugcccucaagaaaaauguguuuggaguuaaagagcauccccaacaaaguaaaucucaaaggauucacuaguaggcaauuauauaaauauucugaauaaauuaaaaauccccagagggaaaaacuauuuuccacuuaauuccaaccuaauaagauuuuugguuuauuuccaaaugauagggcagaucauagacuucuacacguuuuguuuuuauaauuaagacauuaaaauauguuuauucauuuaacuuaaacauaacuagcuaggaaaacgccuuaaguauccacucaaaucuauucucuaugagacaaauuuaauauaccacagcugaaaacacuucaaguucaucuaacuaggaaguaaaugggauuauauuauuauaugucuuugcaaacugaaauugaggcauauucuucauccuaaauucggauuucaucuucuugaaaggaagguuuggcugugguacuauuuacaaaaccuuuauucuucuuaaagauauacaaauauuccaaauucuaaaaauaccccuuguggaguuaaaagaaaaguaauugacagacaggaauucagagcaaugauccaccucuugcaaggaaauagcaagagugaagcuucagucaucuuuaauaacauccuaauuccaagaucuauuuagaauuuuaaaguucauugauccuaagccacuguauuuuaugaucugacaauauuguaugcagagaugcagaaaaccaauucugaagccaaagccagauuauucaaacacugugagcugcguaaaacuuggcccacaacguacaugcacaagggcagaugguauaauuuuauaggcauuuuuaccaucugcccuaauuauaucauuuuaauagauuaaaacaaacagaaagaaaauacaaaaccuuucucuacagcuguguuuacuaccuuuaccuuuuauaaagaaaaaaauucuuaaacaggcaaccccagccugagauaagagguuucccugcuguguuacacagcacaaucagucgaagcugcagugcccaccuggacuugcaucccucugugcuccugcagaauaaaauuaaggcaacagaaaggaaaagucaauagcuuuccaagugaaguguagcugacagcaauggagucacuuuuaaaaauugugggcagaaaagauacguuauuugcagcaagaagcuuaguaauacucaauguauauagcccaugggcaguuaagcaaaauuuuacuuuuucaacauuaagucuucaguuuuauuuuauuuuacuguuucaacauagcaggcucuuggaugguacauguagcaaaguauaauaaacauauaccuuaguauaauuuauugcugcauccugauuuauaauuuugggcauauaacugcauguguccaguaguuugugugcauuccccuguugaugcaugcguuucaguugguuacuuagcgaaucaaggaacacuguaguuguugcuccaacuuuuggacagaccucacuuugcagacaaccuacuaugcgucugcaugcaccacuauuagucuaaaaugagguuuagggaugucuggaauuuuucuuacaaguuccaggaauccuuggaguuagagaaggaaaagauacuuaugacacucgggauguuagcaagguauauaccagcauugcauuaaauaauuucuuagaauaaaaaaagcaaaauuggaaaucaacaaaucagauaaacaaaaacuauaggcaagaaaaacugucuucauacaugaaaaaauucagaauguaccauuauucccuacaguucucuguugccuucuuuguuauuugagucucuagcugcuucauggguacacuguuacagccuuuuuacacaugccauucaagagauucagacacauuuaggguuauguuauagaguaacugugcuagguugcuagcaguuaaccugcauagcaaacuuggagaggauaggaagaauguuuuagcaucaggauaaauagaugaaccaaagaggauaucauauuugcuaaagugauaauacuuuuaauggaauuauuccugaagccuguuaauuuggcacaaaaauagggcggaaaguaucuaauaauuaaaauugccugguaagucuuccuaacuuauaagaauaauggaagagauuagaagagaaauaggccaaagaacagaaagcaaaaugauagaaauagaucuacuuugcacucugaauuaaaauaaucacuggggaacauucaggaaaaaguacuuguccacccgaggacugucuuuuagggaacacuucucagagaaguuggaaugaaagucacuucuuugugacucccuuuuacuagggucauuaaaauucaacauggccuuaaaaaucacaguuuaggaaaaauguucuguaaauguuucgaguacguuauugggcuccauuccucuucagagucuuauggcgaguauuuggcaugucuugcaaauuuuauagaccuuuaaaugguuuuucccaaagggauuucacauauaauucacuuauacuuucacagugccuugagaagcagcuaugucugccuguuuugggugguccucaacuuuuauauauuugccuuucauuuaacuugaacuugcucauauuccauauuggcauuccuaccucacccuuuauugguggguuugaguggugaugugguggcacugccugccagcuacugcuguugggaguaaagugccugccuggccuuugaacagugccaaguuuguauucccucugucucacacuaugccuaggaauaucugggcauggaauuuccagcucaaugcagggcugccaucucccccucucuugccuaaucccucccaucaccauccuugcaauugucacuuucuccaugggcauggaggcuaaccacugggcuugccuagccuccugcuccagucccugcagaucagcgugcuccugaaaaugagagaugccuggcucagugcucccaugucuaugaaagacaaauggccaccucaucugcucuccagggauugggccagaggagauaac

SEQ ID NO: 12613 - RNA, 22266 nt, Homo sapiens
guuaucuccucuggcccaaucccuggagagcagaugagguggccauuugucuuucauagacaugggagcacugagccaggcaucucucauuuucaggagcacgcugaucugcagggacuggagcaggaggcuaggcaagcccagugguuagccuccaugcccauggagaaagugacaauugcaaggauggugaugggagggauuaggcaagagagggggagauggcagcccugcauugagcuggaaauuccaugcccagauauuccuaggcauagugugagacagagggaauacaaacuuggcacuguucaaaggccaggcaggcacuuuacucccaacagcaguagcuggcaggcagugccaccacaucaccacucaaacccaccaauaaagggugagguaggaaugccaauauggaauaugagcaaguucaaguuaaaugaaaggcaaauauauaaaaguugaggaccacccaaaacaggcagacauagcugcuucucaaggcacugugaaaguauaagugaauuauaugugaaaucccuuugggaaaaaccauuuaaaggucuauaaaauuugcaagacaugccaaauacucgccauaagacucugaagaggaauggagcccaauaacguacucgaaacauuuacagaacauuuuuccuaaacugugauuuuuaaggccauguugaauuuuaaugacccuaguaaaagggagucacaaagaagugacuuucauuccaacuucucugagaaguguucccuaaaagacaguccucggguggacaaguacuuuuuccugaauguuccccagugauuauuuuaauucagagugcaaaguagaucuauuucuaucauuuugcuuucuguucuuuggccuauuucucuucuaaucucuuccauuauucuuauaaguuaggaagacuuaccaggcaauuuuaauuauuagauacuuuccgcccuauuuuugugccaaauuaacaggcuucaggaauaauuccauuaaaaguauuaucacuuuagcaaauaugauauccucuuugguucaucuauuuauccugaugcuaaaacauucuuccuauccucuccaaguuugcuaugcagguuaacugcuagcaaccuagcacaguuacucuauaacauaacccuaaaugugucugaaucucuugaauggcauguguaaaaaggcuguaacaguguacccaugaagcagcuagagacucaaauaacaaagaaggcaacagagaacuguagggaauaaugguacauucugaauuuuuucauguaugaagacaguuuuucuugccuauaguuuuuguuuaucugauuuguugauuuccaauuuugcuuuuuuuauucuaagaaauuauuuaaugcaaugcugguauauaccuugcuaacaucccgagugucauaaguaucuuuuccuucucuaacuccaaggauuccuggaacuuguaagaaaaauuccagacaucccuaaaccucauuuuagacuaauaguggugcaugcagacgcauaguagguugucugcaaagugaggucuguccaaaaguuggagcaacaacuacaguguuccuugauucgcuaaguaaccaacugaaacgcaugcaucaacaggggaaugcacacaaacuacuggacacaugcaguuauaugcccaaaauuauaaaucaggaugcagcaauaaauuauacuaagguauauguuuauuauacuuugcuacauguaccauccaagagccugcuauguugaaacaguaaaauaaaauaaaacugaagacuuaauguugaaaaaguaaaauuuugcuuaacugcccaugggcuauauacauugaguauuacuaagcuucuugcugcaaauaacguaucuuuucugcccacaauuuuuaaaagugacuccauugcugucagcuacacuucacuuggaaagcuauugacuuuuccuuucuguugccuuaauuuuauucugcaggagcacagagggaugcaaguccaggugggcacugcagcuucgacugauugugcuguguaacacagcagggaaaccucuuaucucaggcugggguugccuguuuaagaauuuuuuucuuuauaaaagguaaagguaguaaacacagcuguagagaaagguuuuguauuuucuuucuguuuguuuuaaucuauuaaaaugauauaauuagggcagaugguaaaaaugccuauaaaauuauaccaucugcccuugugcauguacguugugggccaaguuuuacgcagcucacaguguuugaauaaucuggcuuuggcuucagaauugguuuucugcaucucugcauacaauauugucagaucauaaaauacaguggcuuaggaucaaugaacuuuaaaauucuaaauagaucuuggaauuaggauguuauuaaagaugacugaagcuucacucuugcuauuuccuugcaagagguggaucauugcucugaauuccugucugucaauuacuuuucuuuuaacuccacaagggguauuuuuagaauuuggaauauuuguauaucuuuaagaagaauaaagguuuuguaaauaguaccacagccaaaccuuccuuucaagaagaugaaauccgaauuuaggaugaagaauaugccucaauuucaguuugcaaagacauauaauaauauaaucccauuuacuuccuaguuagaugaacuugaaguguuuucagcugugguauauuaaauuugucucauagagaauagauuugaguggauacuuaaggcguuuuccuagcuaguuauguuuaaguuaaaugaauaaacauauuuuaaugucuuaauuauaaaaacaaaacguguagaagucuaugaucugcccuaucauuuggaaauaaaccaaaaaucuuauuagguuggaauuaaguggaaaauaguuuuucccucuggggauuuuuaauuuauucagaauauuuauauaauugccuacuagugaauccuuugagauuuacuuuguuggggaugcucuuuaacuccaaacacauuuuucuugagggcaaggggauauuauaauuaauuucagcaugggaggaaaccuuuuuucuauuuauccuguuacccuucacacccacuuucccucuucucucucccuagauaagcucacuguugauuuaaaugggcuccuaaacauuuuagcuugggccuaguuaguucagccucauaaacacaugggaagaaguuugaaccuacauggggaauuaaauaguuuuccuaacucagaugaaccaccucugaaugcuagauccaagucagugugccuagcccucuauugggagacaaaggccauucaguugcauugccaaaaccagugaccaacaacuugugcuauuuuugaaagccuuugcuacuuuugcaaucauaacuccuaucuuuucaucccacccuaguuccaagaaaugugcuuuuucuauacaaauaucaaauugaauauuucagagcuguuaccuuaaguuauuaaacggccuuagugccccagcucaaagauaacugcagcuccauuguaauaaaaugauuacucaggucuaccuccacaaaauguuugacuuaaccaguuuuguuguguuugagauuucugggaugaaaaguacucuaaauggaucaugauaagagugaauugcucagagcauuuuucacuggacagauaaaaaaagauaauggauaaagcagugcaaauaaaaagaaaaauaaaccucacccccaaaacuggacuuuuaaagaaugaguauucuacugauaaagucaaagugcuuuuuauaccaaguaugccuauacaaugcuagcaucauauuaagggguccuuuauuuaccugaauuaugcacauccaauugauguguacaauguuuuauauaaaugaaaguuuccauauuaaaaauaucuuaaguucguaaauuaaauauuuucaacugcacugaauuuucugaguuucaagcccaaaagaaaagguguucuacuguuggcacuucuaugaguaaacagaucuccagauaggcuacauggagaaaguugaguaaaugcuguuauuaagauuuucugcuaccccacccccuucugcggcucucucccugcacacucaguggcacucuuuucagcccauaguagugaaugaccgaaagcuucccaagcaccucaucuaacuaaaggagggccugcuucuucacaaaugucuaggaaaggcggccgggggcgguggcucacaucuguaaugcuagcccucugggaggccaaguuguguggauuccuugaggucaggaguucgagaccagccugaccaacauggcgaaacccugccucuacuaaaaguacaaaaauuagccgggcgugguggcagaugccuguaaucccagcuacucaggaggcugaggcaagagaaucgcuugaacccaggaggcagagguugcagugagccaagaucaugccacugcacuccagccugagcaacaaagcaagacucuguccaaauaauaauaauaauaauaaugauaauaauaauaauaauaauaauaauaaaaggcuaggaaaggagagucauccuugaugccuuccagucaccccagguggggacacugaaggagcgccuuacaccuaagaauugagggauaggacagggggcaccaagaaaaaggugacccagaaaaaggugagccggugggaggaggaaggaaaaguaugaauguacaagaaggaaaggaaagggcaugggaauugagagaaagauguauuggaaguacagagaaagaaagccaccuggaagugaacucuaacacuaaggaccaguuggugucuggccagugacugagcuugggguuugccauuugcgcaauguugcucgaggacacuggguggcgcucgugguaaagacuugcacuuaucuuagggcuucccucccgcuacuuccccuucccucccuuugcagauuucagcuacuaaaagaugaaauuacuuacauucuuccuacgugucucagcgggaagcgcacugcuggaagaguuugaugccguggggcuguuucuccacggcuggauuugucgguggauuuugagaggcaauagcguccagcccgcuggccuuaggacaaagcuggaggcccuagugugagaacucccucacaacaccagcaaaaguuugcugcuccgagagccgggauacuggccgguguauguccugagcguggguccgaagccgcagacaggcccgcagagcagccggcagugcacagagcuacaaugccuauauugugaaauuaaauaaaacuguacugugaacagacucuccgcugcuuuuaacuuagugcuuccucucccucccggcugccuuuaaggaagggguggaguggggaguggggucaaccuugaaaagaggaacaaaaucaagaaaguugaggcucuggaccuguagagacacauccagauuuggucucacccagcagcagaauggcucaagucugcgugagggccaacguucuaacgcuuuaggaaccgaaacaaagaaguuaaauucuucccucccggcccacuccuuuuugucuuuuaugaaaugugggaaagaauguccauuuugacugcgggguuuugggggggugaaauuuagcaaggucuagaacuaauuugacauuguaacauuauuuucaaucggaucccgaacuucuaaauuuugccccaauucugcagcuuccaaucccauccugguuagaaucugccaucucagcaagguguaagggcauugcuaggaacacccuguucaguauaaccaugugguaacucaaaucucuauuuaaccaaaagugucgaagauaggggaccagaggaagggaggccuggcucccugcccacuugucuuugccgggaggugcuuugaacuguccuuggcauugaucugaggaagcgauuucuguaauuaaauggcaguguguaucaggugacucgaugggcgccgauaacuucuccagagcagagcccaggaccgcagacccauguuucccuccuguucuuuagcuccucacagccuacaucuagacgguuaacagccugucgguaaucgacagcgucaagucagggcuggcuggcagcugcagcucuguuuaccccgaagucuaucucagagaagcccgcggcagcccaggcccaaagcucgugacucgggccagugggagaaggagaaugcugcugggcgccagucucccggugcugaaguuucccccgaaaggaagugcgacaauagcuguguuuuucuggugcaguccagaccgcaaaggcagggaguuggugcacgcacggcagcucugcuuuggaguuccugagcggggcuguaucuugcucugaguuccagacacccuaccucuacccgucggccuguuuuaggccgaguggcuccacacuccaaguaaggcuaaacuaauacuagacacaacuaacacagacgcuuucuucuucgguaggagggaaaacggaggggaggccagauaacccuagauagccuguggaacucccagauugccggucuuggaccccguaaaggaagauguaggaaggccccaaaucaggaucuaguccgcggaguugccuauuugaggggaguaacaauggggauugggagagacuuuuaugcugaauuucuaaacucccagcugaaucacgacuagaacaaggauagcaccuccugaagagcaaaguuuagaucucguguaucaacugaaugauucuugaauccuuucuucccuugcauacgagcuaaguaggaugucuuugcagcaggaaauaaaggggagaggguacagaaacccgggucugggaaauggagagacugggccacauucauggagccaggagggggaaaucaaugagcaucaucugacuuugcaaaggcuuugauccuugucuccuuccccacuuccgagacuuucccauucuuuccuggagguauggcagguuauacauggauccauucaccuuugcgggagucuuuggccacugaacauaguuaaagagccuuuauuccaaugucuugaaaauagaugaaaauauuaaacagaaguggagcuguuuggcucuuuuugcaagccagcaacgaggauuugggcuuccuuaaguuauauguguuuaagacaguaauuuuuaaaagucauuauaaggacuuugggcugcaggaacucucccugccauucaccggcuuaauggacauugugccuucuugggcauuccuguccagcccgcguccgggagauacucaucuccugcaaaggaaguugccucuuuccccaaagagcaaauuuucaaaacauguaaguuacaacuugcuucccaacacuccacuaaaaaaaaaaaaaaugcuguuucccuuccuucuugccuccauccuacauccccccgcuccccacucccugcaccuugacucccuauuucaguaucaguguuuaauucuacacucgccuuuggugcagcccacgggggcgggguagugggaagcaaggaaagauggucgcccaccucauucccaaaacaugugcacuuuugaggcuucugauuggaacacauuguccccagacaucacagagccuugugcuguggcuucugcgaugucuuuggaauuuacuaaaaacagauagacuaagaccccuccccacuccacaacaagcaaaaacacacacaagcgcgcgggcgcgcacacacacaaacacacacacccccucaguaccccccacccccuuuuuaagcaaugcuuuguugugcuaaaacuaguuggacgaguuaggguguuacuguugcucccgaggcccuggccaauagaaccagauccaccccgcugugcguaagcgcgcaauuaaggauuuaaccaaggcugugcugcgccucagccagcagucagccggccggagacagagacuucacgacucccagucuccuccucgccgcggccgccgccuccuccuucucuccuccuccucuuccuccuccucccucgcucccacagccaugucugcuuagaccagagcagccccacagccaacuagggcagcugccgccgccacaacagcaaggacagccgcugccgccgcccgugagcgaugacaggaguguuugacagaaggguccccagcauccgauccggcgacuuccaagcuccguuccagacguccgcagcuaugcaccauccgucucaggaaucgccaacuuugcccgagucuucagcuaccgauucugacuacuacagcccuacggggggagccccgcacggcuacugcucuccuaccucggcuuccuauggcaaagcucucaaccccuaccaguaucaguaucacggcgugaacggcuccgccgggagcuacccagccaaagcuuaugccgacuauagcuacgcuagcuccuaccaccaguacggcggcgccuacaaccgcgucccaagcgccaccaaccagccagguacauggacagggggaaggcugggcagauacagggcgacuaggacgcugggggcgcgagauggggugguagauugggggucacagcgguucacggcagugggggcgcacgcggcagaagggaguaggacucagacccuccaacaaagagaguuucucgggccagcauuuuagggauuuuuaguaggagagcccuguggagguucgaacuagcgucucuccccuccggcaccuuccaaggcccuucagucgcugaauucccagcuugcccggccaggaagccggcuaggcuggaaaggggauagggguggagagaagaaagaaucaagcagcuccuggcguuugcguaacaaagagaagguuacuugggaauuuugguaagcgugcuggguuggugcgagugggaauagaaggcugccucaaaaacucagucaggauuaguuugagagccgccacaagcuagcacggugcgggugcccugagcacgcuggguggggguggggggguuaaggaguuguagccagccagagaagagcgcgccgagaguuuugcgguuuauccaggcauuuccaaaaacaaaaagccauuuaaagguggaggaggguugcugaggggucacguuguaggauagauuuuuuuuucugucuccauaggcgcccacaauuugucuuuccguccuccuuuuucguccgcuuugaaacuuacuuagagaguuuaagaggguuagugagcuugggcgguaagagaaaggcaugaggcucggcggagagguuuuauugguaagguuugaucucuucccaccagcacauuaauaauccugcuaauauuagcauccccuacucuggcagaauugagaccacagcccucauccuccacacuucucccuggaacuugacacacacacacacacacacacacacacacacacacacccuggagagguucuccgucaguuccagaggggugguaguuuugaggaaggggaguuguagccccagggcagguuuguacaacacgcguuuggcaaucccucccccucccgcccaaacccauacucaugacagugagaaucucauccugaccugccgccccuuuccuacgaaaacaccccaccaccgguuccuucucagugugugacucuugcugaacuuuaaaagagagccccggguugaggugucuacguuucuuucacucucucuguauuccgugcauaaguggaagauuucuuuuuuuuuuuuuuuuuuuugccaagaacauauuaagucuauuuguaaaagaaaccagacacaucugugcccucgcagaucugcagcgagauuauggggguugcauaaucgacccucugucugcggcggccccgaccgcuugcugcugaagugaaggagcaguuugcuugugggucuuugaacuuuggagaccucgguuagcgucuucccugcccaagagucuggcuucugcgggcgcccgaacagacgccgacagaaguagggucacggcccagggccaccuccuugaagccuggggaggggcugguguucuugaagccuggggaggggcggaaacgcggaggagcacagggugggcguaaaaacaaguccgggagaagaagcaacgaccgcaagagcugaaucccagaugccaaggagaaagcaguguuguaggaagcgcuuugcacaaacuaucugaaugaacagaguaggaauuaaucagaggcuaucccgcuuuuccauauuugggguaggugcauauuuaucgcgguccugaaaagcaaaggugguggugauaugggcaaagaaugaagacugagugguaagaaacucuaggacucuauuugaggcccuuccgcaaaaggggcauugucuggugacaagcuuuaacugagucuguuuugauuauuuagagaaagaagugaccgagcccgaggugagaauggugaauggcaaaccaaagaaaguucguaaacccaggacuauuuauuccagcuuucagcuggccgcauuacagagaagguuucagaagacucaguaccucgccuugccggaacgcgccgagcuggccgccucgcugggauugacacaaacacagguaaauacggcgcugccaugcacuagaccugccugagcugcacgucugguugggucgcgcgguucagucucgaugggacuggagcuguuuugacaguacccgugagaaacuaacagacccaaagacaucagccccuaugcuuuaacucggugagucaggccuugagacgguggggaugguauucaucagcggucuggagauaccucccacuaaccgcgccccccgcccccaccccguagcgggccuccggagcuguggggccaauuucgcggguugaaagcaagcggaggguuauuucuagggcggccuaggcagcccagagcagcuaucugguuuucuuaacaauguagagccuccucgggggugagcaaggccugguguucucgcgguggucucaggcuaagaaaaggcugagaacgucgccuggagcggagaaacugaagggucgugcccugagccuacgggagcuucaggccacggccaccgaagggucgcgagguggggggcgcuauuguacgugagaagucuuccuggauugucccauuccuuuuacuccuccaacccagcuggggccuacggaagcauaaagaauguucgagucgccgccaagagcugcagucagauucuggccucucugagcugcagagggagugaagggaguaggacgggagguugggagcucgcuccuuuuucugaccacaggcgcgcguagcccgccccacgccccuuccccgccgggcucgcgcgauuguuuuggagaccuucgccgcguuccgcgcguccugcgcaggcuuacacgaggcgcgccgccgccgaggacacucgggcgcacacccgccgcgcuggcgucccccacccccagcccaaacaaaagacaagccuuggggucguggccucgcugggccggggcgccccgagccggccagggcgcccucuggggccagagcuccaugguuugccuaaggcauagcuucuuggcgguaggccgcaagcggcggggagacgccaggcagggcugggccgcccagagguccgaagaugccuccagucgccgccccggggaaggcgcgggcgaccucugagugucccgguaacgugugccuuuguuccccaacucaggugaaaaucugguuucagaacaaaagauccaagaucaagaagaucaugaaaaacggggagaugcccccggagcacagucccagcuccagcgacccaauggcguguaacucgccgcagucuccagcggugugggagccccagggcucgucccgcucgcucagccaccacccucaugcccacccuccgaccuccaaccaguccccagcguccagcuaccuggagaacucugcauccugguacacaagugcagccagcucaaucaauucccaccugccgccgccgggcuccuuacagcacccgcuggcgcuggccuccgggacacucuauuagaugggcugcucucucuuacucucuuuuuugggacuacuguguuuugcuguucuagaaaaucauaaagaaaggaauucauauggggaaguucggaaaacugaaaaagauucauguguaaagcuuuuuuuugcauguaaguuauugcauuucaaaagacccccccuuuuuuuacagaggacuuuuuuugcgcaacuguggacacuuucaauggugccuugaaaucuaugaccucaacuuuucaaaagacuuuuuucaauguuauuuuagccauguaaauaaguguagauagaggaauuaaacuguauauucuggauaaauaaaauuauuucgaccaugaaaagcggaauguuucugaaaaauacuucauucugccccucugauaacuggcuagugaaguuuuauugaaggcaacuaaagaaggacaagcucugcagagauccaacaaggcaaaaaagaaaacagaagucggggcucuaugcaugcagacuguauauguauauauguucaaugcuauacuuugugugugugugugcauauauauauauaauauauauggcauguuuauaguacugccauaucucauaauuguuucagguagaaaguaaugcugaaauaaaaauacaucccucucacccuguaugugaguuagaaggcaacagaaaucccucaauaaccccucugaauucuaagcucaaagcaauuaucuuggagaagcgcccccacccaucagccucuguguagugccagagcaauuagacaaauuacccuucaaagggaguuuccagagaugagaaaaugaaaaagaaaucuagccucacaccuauuacauuuuuuaaaaaucuaaaauguuuggagcauggcaaaugauagaaccuuggacucuuuggaguaugauuauaaauguaucggcucuuuucgagagaugaaaacauugcagauauugugaagagggaacuucaggguuggggaaaggaaggaaugaaagcauuguggcgccguguugauuucauuuugugugagauaauacucuuaauauuucccuucccgccuuccuuuuuucaggaaggagcuuccucuguuuugcuuuuacauaaaacaguggcaaacagguucuaaaugaugcaaaauagaaucuguuuacuaggauuucuccuuugggaagccuucuuugggacagagaggaaggacuugcugcagcugugcccugugucccuuccuucuucuugcacuccugcauguagauaccaacagcaugaccagagcuaugcacugcaccuaaagacccaggccugaauuguaggugucuuucugucuggccguccuucagugggccagacucucuuuccuuaggauacgaaggaaaauguuggguuggaaauuacaagaugcaugugaaauauuuuacagcuaggaagucagcagcaauaaaugugacaaaagagccuucuuaaaguggggguagauuagagcauaaaaaauuauauccugucacugaggauuucucagaaggcucuuccaggguugggagacuagaccugaaaaggcacgcuaugugccuugaggggaauuuaccuuaccuacauguuucucucucugucucgucucucucuccucucucucucucuuucucucucauuuucucugucucucugccugccuccuccuccucuucucucccuaccucccuuccaccuccuuuauuuuuuucguucucuucuccuuuacuuuuuuucuagaagaguuaccaggcccgccaguguggaacagcuugcuucuuggaggaaucaguauuuugaccgcucuuuagacauaucccgcagccuggcuccgaggcagaacuacgcccggcagccuggccugugcaccccuccuccggcacccccagcggccgcgacucaauauuuccgucuccccaguccgcuccagccguacuuucucggaaggagcacugggugcggggaagagggggcaauaggaagguuugcggggggcgggggggggggcgggaagccaaagggugccccauuuuguuuucugcgcucacagagaauagggggauuggggaagagaugaagauauccacuuccugcuuuucuuucuuugcuuguaaggauuucgggaguuuccauuacaccgagagcuagcgcuuuauuucuggcgacuccgacugggagaaacccgcgcccgcggugugccagcgccuggcuuuccccugcgcggacgccucucccugccaaggggugcguguuugggaagguugggggugagggcgcacccacugcacaccuccaauauuucucaccuacuggcugccugugaguggcaagaaugugcuuggaacauacuguuuuccuuugugcacacaaagagggcagauauuuuuccagcugucccuaucaacuccccagccccauuacugguggaaaagaagggggaucccuuccucaucccuauucaccgggcgcggccgagcugagggaagggaggguucggauucuucuagagaaagagggaagcucuuucuaaaugaccacuccuccacccuagcuuugaggcugcuugucguuaagaucacuaaagccucauugcgagguggcccagaccaacgccgcgcggacacagacuugguuucaggauuccuucccuugugccaaccucacuucuuccacucgcaaaggccuuuucucucgugcgguuuuuauuuuuuagcuuggucugggagccguggacaaaaauauucugguaaaccagucugcagcgggcuuucccuggccccauggggauucucucaggggaauuuaacucccugccgucccgagcccaaggauguaaaaauaacagaucuucagcaaagucuaaaaauaucuaugugauguuucucucccuugcccucccuuccaccuucucuuccucuccauuguuuuuccuacgucgaauauaaacgugcuccacuccccagcauauucccggaccagccggccccacucuugacaucgcacugggugaccccucugccugccccuuccgguuuccacuugccuagcucucaguauagugcucccaagacgaaucaaguccuuucuaagauuaauguucuuuucagugggcgucuucauacuccccaccccuuacuuacaacaccucacccccaccuucagagcuccucacaaaccccaggaaggcuggggcaugcggucagggccagcgcgauucuucggugcccagaccaccuccugggccauccuguaagagaucagauaaauuggccuuuguuugaggcucggguugagcuaggcggauuucugccccuuuuccccccuuuuuccuggcggccaccuccuugugggacaaggggcggccuggggauccgagagaagccgcauuccugugggugccaggcggcuccagugcugagccacagggccugagacacacacacagaggaacccgcagaccucgcugcccuugaucucgcucgcucgcucucccucccgucugggcacccacccgggagccuguccacucacacucggauccacccagggcacggccucaggcccgagagcguugauccgcacaaagacacaaacgcacacaacccccuccggugacacaggccaggccaggaucuccccgcccaugucaaucuccucucucccgccccuuaucccacaaucccagacgcgucggcuggccuccucugguuccuuugaucccaccggacgccccacggcucgcggcguccuggccgcgccguccugggagucacccacagcgcgccaaagccaggcugcgcucaccuccucccagcgcacccuauagcucacuccagccuugacaccgcucagucuccugagcucuccagccggaagagccugggaugccugcuggaacacugcccccacauccuccuucuuagcgcuuccuuguauucugggagagggaccuuuaggcuacccaaccgccccuccucuccgccccaucccugcaaccccuuggaucgcgcgccucccaauggucacugggaucuugccaaccuagagcucucuagcccucccggaggcacacccagagggcagacgcccucgggcaccucugggaagcucgccacgccggcggauccgccugcggucacccagcuccuccacccuuaagcacccccucccacaguagccgguggaggcucccgccgcuccagagcuuggggagggggcgcugcggcuugcucucggccucggcucgcgcucccagguugcccgcggucuuugcacacagugcuugguuuuuuucaaccucagcccagucgcagcgaacucugggccuuaaaaauagcccaaauagcgguggcacaugugggauugguuaaauauuuucuacgcagcccugucucuucccccccgcgccaacccccagcguuuucuguugcaucugacaggcuuuagauuccucagggcagaaaguauacauuguaucuauugcguguguguguguguguguguguguguguguguuugggguggggagccuuuccuuucaaucauccaaggcugccggcuguaauguaauaaccuguuuuauaggucgggcucuaaccgugaagauaggaacugagggaauuuacaugaaccucucuuuaaagcagaugagaguccugcuuugcaucaauuaaauguuccugcucuuuuguucacuuggacuucuuauuuacuucugauuuaugggauccgaaggagucucuuugccaaaagcacauguauuauugagucuguuccacauccuaaaccaagauuuauauaaaaccgugaaauaccacacauuacgaccuuucaccacaggaagggaaaaaaauggcuuuauaacaucauucuacacacauacccucccucucuccuagcuucgguaaggauucucugugggaucuucaccaugcagucuaguguuuuuuuuuuuuuuaagaagugggugagggugaagggugguaaacaguucccaagcuaugauuuauuuuaaaggcuuuuuuuuucucucgcuaaccaagaagacagaaaccugccaauggaagcuuauuguuauccaggacuauuucugccacuugccauuugcaaggucagggaagaggggcggaggaagagcaggauauggacucaacuuucaucuauaaacaggggucacuaaacaggggacauuucauuauugcccuuaaauucacaagagcuaggaaaccugcuugccauccugcaggguggcccugguugggcagcucccgggucugugaaguggugggaggagggagagucgacacacauuggcccagaggcuagaaaagaugccuaggaaauucucuguauucauggugggaaaauugagcuccuggggauaaaugggcuuuagguaucuuugacuaggagguccccaccaggaaccagaacuagacuccagaacccuccaccagggcaggguucauccuccuggaagaaacagcuugaaccccuagagcucuuugacucugggaccagcauagucccccagccugucuccagccucucuugcucuaacucucccucucuugcucuaacucccuccuucuuugguccuccuauauuuuaauaagauugaccuugcucauuuuagcacauuggugacagguagcaaaagcagcagcuggacugguuuauaugggggggggggaauguuaauuaauaaaaguuaaugauaggauuaaaaccaauagccagccaagccaacuggagaagacagcuucccagccggcuauauuuaauuagcagcaauuaauacguuuucugcuaauauccuuuaggauucuaugacuuaguuccugcugaaagagaaugaagacagagggcagaaacacaagugcccaagggcauuuugcuuggauaacaagagagacagcaaauucauuuaagaaaauguucauaaacaagugacaggcacacucucaggcgauuuuguggaaacaauggugaaacugacaaauguucuuugcuuugggggagggacacauuuuuaaaacaggaaaauguuucuggagagagaagggggaaaaaaagacaggggguuggaaaaaagaaagaaaaagaaaaauuauuuuagacuccagacaagcagcagaugcagcagcccuugcaaacacaucagcccugcacuauugaagauuuggacaugaaaugcuucagaccacugauuugcuauuuucuuaauucucgcucuucuuuuuccauaugaaucaaacagucuuuuguccuucaggguuugauuugaucgcuacuguucacauuucacuuuuguauuuuccucuuccuauaccauuacucauugagugcccugugaaauuacaaucguacauuuucagcucagcaacccauuugcagugcaaaaauagggucuaaauaauggcugaauuagcccuacuggacaguuucagauguaacacucuguaauaauuauauugcaggcuggauuaggaugcuauuaucauaaucuggacguuuacaauuaucuguaauuugcaaagaugcgccaggucuugauuacagcaguuuuuuuuuuuuuuuuuuuuuuuuuuguaccacgcuaaccaucacuaaacagugacaguaauaacagcuaauuuugcuggcaauauaagaggugcuggggugugcaaacaauuucacaccuggaugugcucacucaaccaagaauauagagaaagagcuucugcccugagacucagaaaaauauucuccugugcuuugguucaguauagauuucuaaacccugaucauugcuuaagagauauucacugaggguaaguuuuuauuucuugcauacuucaaggaacaguucuuauuucucuucucacacuuuccaagauacauguugccguuguaauuuaucaugggcuacaacuuugcuuuauagauuucucuaugcugaccuuuuauccccucuaacaguaaaaaggguuguuguucuguugagugaaaggauucgagugagaaugggauccuuaaguauucgauuugucuuucuuguuuucuauguuguugauguauuuggugcagcuugugacuggagccugcgaaaaguaccauguuucuauaagguguggagagacucugcuggagauuccaagcuaaaaucuauuugaaaauuauuauucacagcuaauccuagguaaauccagagaggucuuuacacguggccaugauuuuagauuuugaggcgacaagauaucaaacggagcucgcgacggggcuccuuuagaaccacagguaugcggacauuugcaaaggcagguguagucugaugaaucucuggacggugaagccccuucgacaucuuuccuccacuugggggaagguuuccggaauaacuggccucugaaccccuucaaggcugcuuuucagggucuuugccucaagcugguguguuggggcgggggggagggggaggcuaugcggaucuuggaguuacugcccuccgagaacaaacgcugcgaccuugggguuggaggggcaugauuggcugagacgcagaaccaagcuagggagcuagaaaacccagauuuagggacgcaccaaggaagucuccagcaagaagcggugcuguucuaucuauagaugacucuguuuccugaccguguagacauuguaagcaacuagagauguuaagugccugagaaaucuuugguuuuccauuccagugcaaaaaggccuuucuccggcggcagaaaccuuuugacuaaguugugucaaaagauaaugagauguuuauuggugccaaagagaaaucguucucuucauccccucccuccucuaccccacccccagcuauuguucucucucucccccacuuuaucucuuuuuaaauaggaaauacggucagaacuaggcuccacagcucgaacucugcaaccucuggagaaguccgaacguggggaggcgucguaggcaccaccacugggcgaugccuuucgcccacgccccuccuaccaaucccucccucgggaauccgcuuaccauagggucaauacauucuaaagaguaaaaauauuaacccuuaagguucagaggauccagagaaagcccaguuccaagggcagucuggggugggggggacuacuuggcagaauuucuuguuuaauuaaacuccuguuaagagauaaagagauagauacaaaugcaucaugacaacaccucgaauaugucaacaugcauuugccggguuucagaauguuaugcacucacagugguuuggcaugcaucuggugaauuuuuuuuaacgaaaaauuaguguugguuucgauguaugguagcauucucccuaacguaauuugaauaauucagcaaagccccacuaccagcuguacuucugcagccucuuccauucuuuucagcauuauaauuuugguuaauuuucaauuuuagguccuacgucucugcaauuuguguaugaauaacagaauaauuucccucuuuuguuucgccuuuccuguuccugaaucuaaauaaagauggcuuuuuaguauuaaaaguggaagaaaauuacagguaauuaucuuugacgguaaaaacgcuguaaucagcgggcuacaugaaaaauuacucuaauuauggcugcauuuaagagaauggaaaaaaaccuucuuguggauaaaaaccuuaaauuguccccaaugucugcuucaaauuggauggcacugcagcuggaggcuuuguucagaauugauccuggggagcuacgaacccaaaguuucacaguaggaagggggaaaaaagaaaagaaaacauuuuuccuaauguaacaaugcgaaugcuagaaaaugacaagacugaucgguuuuaaaccauucugaagacugacugagcguggaaguugcucaacaaaaaaaggaacggguauauugguaaguagucuuugcuuugugucuaauuauagugacuguccuuuugcacgacuguaugucgcugucauuauauggagcacucugaguaucucuauugacuucugauaaauggcucagugguuucaagguucauaauuugaaggaugcccaggucuguagccauuaauucucgcaguauggggcuuccugcuuguaugacgaaaggacuuuucauuuucauuauuucugugcuuuccccaagaucggaaggauguauuucauccagcauagugcauuuuccuaccuagcuagcuggcaauggguuuuaaacauuaaguaggcauaauugugcacucuacucucuauuuuuuucuuuccuauauuuuaaaaaacugcauccaaacaaagacaaauauggcuguauuauuuuggcugggaaaagggaaaggagaauacucaguuucagcacuagaaacuacugugaugucuagaaguuaacuugaggauaggucauucuaauguuuaaaacauagguaaauguguagaaauuacaauaaaaacguaauauguaaagaaaguugaaagaacauccaugguuaauguuaaacuaccuaagacaaaggcuagugugcaaacugacaucuuugcaggcacuugauguucauauauauacauaugacuucccauauuaggaaauaggaauuuuuuuaagggugauagaaaauuuaauggggggaagggaagugagggaggagggaggaaagagagggacagagacacacagagagagaaauauacaagacacucagcguuuuguggcuuuuacuccauauaugaaagaagacaaaaacauacaaaguauauguacaacuaaaauucaacaauauauacagaaauguuucuugauauaaacgucccuauuagcuuugugaaugccaccaauucaccuaguaaaggugucaaagcaauagaauggugauuuugauuguuuccuccgucuuuccugauuccaguucaggguuugggggggugggguggggaaagagugguuuuuguuuuguuuuuuuuuaaucaaccaucauuccuggucauugcauuuugauaaaacaugcagcauucccuuuguagcaauguucuaaucuuacagccacuuuuuccuuuuucuuuagagaagggcuguuaugugaggaauuuucuuuuucucgucagucugggaaugguaaauaaaaaugcaggaguccaaaaugcuucucuuucaccauguaaugucuuaaacucauuaaacaaguaaaaacgcugccaaguuugugcagauucuucugguugggggaaaaucuguuuuuaaaaaaagucauuuugauggauacucccaaagagaagagacucagagccuggaucccaa

SEQ ID NO: 12614 - RNA, 23710 nt, Homo sapiens
agaaggugagaauuaugugauuaucuagauaugaaggauacaggagaaucagugguguccucuuuucuuccucaggacccuggguggacagcuaugccauguacugugagguagggaacacacuggcagcagaagguuucaggcagacacugaugaaguagaguaaaauguugaauuuaaaacucagacugggugugguggcucaugucuguaaucccagcacuuuaggagucugaggcagguggauuaguuggguccagcaguucaagacaagucugggaaacaugguaaaacuccaucucuaaaaauaugaaaauuuagccaagcgugguggcacacaccugcaguccugcuacucaggaggcggaggugggaaaauaaccugagccugggggauugaggcugcagugagcugagauuacaccauugcacucaagccugggcaaucagaaggagacucugucucaaaaauaaaauaaaauaaaauaaaauaaaauaaaauaaaauaaaauaaaacucaaaggcacaauguuaagaugacauuuaggcaguuggauauccaguuauauaacauaaaagagacaucugagucuggagaaaugaauuuuggacucauuuguguauagauguaaaauucaagcucugggagaugguguugcucagaauacaaggugacaggaacagaagaggugagauaggaccaccagaaacuucaacuuuuagaggauggcuggagaaagauauuucaaaagaucugaaaaggugaagagaguucucagcaaucccugaagucuaugguauacccugaggacucagggcuaucuggaggaauagccaugacauggguggugcauguguguguguugcguauuugcacguguguguucccaauauagauaaggaacccaagacugcuugguagauaauucuaucauuaaaaggauaacaagaaauacgcaaacaccaggacacacauaaauuugacaaauuagauuaaauggccagauaugguuuggauuuguguuccugcccaaaucucaccucucguguuggaggaggggccuggugggaggugauuggaucauggguuggugacuggacuuccuccuugcuguucuccugauagugagugaguucuuacgagaucuggcuguucaaaugugcguggcaccuucuucuuggcuuuccuccuccugcucugguuauguaagaugugcuugcuuccccuuuuccuuccaccaugacuguaaguucccugaggcuccccagucauguuuccuguacagcuugcagaaccaugauccaaugaaaccacuuuucuuuauaaauuccccagucucagguagcucuuuauaguaauuccagaaugaacuaauacaugagccaacacccuaagaccacaaaguaccaaaacccauccauuaugaaaagauaaucugaauaggcuuacaauuaaaacaaauaguuacaaacuaucugaaaaagaaaacuucaggcacugaugguuucacugaaaauuccuaccaagcauuugaagaagaaauaaaaacaauucuacacaauuuauuccauaaagcugaagagaaggagggaccaguaguuuuaugagguuauaaugucaaaaccagauacagacauuacagaaagugaaaacuauagaccaauaucacuguugagcauauaaauaaaaacucucagcuaaauauuaccaaauuaaauucggugacauguaaaaggaauaauacaggacaaacuggaacccaacaucuucuugaauagaguuuaucuuagagaagaguguuuaagaugaggcaagcuauuuuaauaugucccagaaauagcuccaauuggauggucauaggauagucugcaaagaggcuuaaaucaccugggccuauugcuaugccugucucuccucacuccucucugcuuguuauuuucugugguucucaguuggggaccgcgcugcccauaaaagggcuuuugguggugugugggcaugguuccuuuucucuuuucuccacuuuccuguuaguuuucccaugucuggagggcauuuaugugugcaugugaagggagacagccucuguggcaugugcuauguucucacacaaugaaacauuacgccauucucagaucauuaaagagcccugcuccagacacucucagggugaugugauuuaucuucuuuaccuuccaaacuuaacuuuccagcgcaggcguuuuugcugaguugugucaauccagauauccgcuggguaagaccguucggucuucccacaaucuucugguccuucucucugcaugguuucaggaaauggcaccugcaucucauagcugcacuguccugcucaauuggcugccugagacagaauccuggaugugccuguuauucacagucuccccuccccuuccauugcuguuuauaucuuuugaaccuggcauuucuauugaaccucggcucccucugucccacucuuggugauaauauugcuucacaauaugcaucauaacauaugauuugaucaggcauuuguuuucucuuuuaacgcucuuuuucuccaccacuuucccucaguacagauuacagagaccaugucacuucucauuguauccccaggcacaaggccugaaauguaauguuaguaaacaguuggcgaaugaagaugaaaugcaagccaucacccauuuucacauggaguccugggaagggaccccuaaugagacucccugccucugcuuguccaccugccccaaacucuaaucuuacucuguaugcaggugacuuuucagaagacacccuagacuccuuaacuaucugagagagcugcuccuuggggcugugcagaacagaaaauucucccauuucagugcaugcgauggaccuugaauggaugagcaugagcaguggcccccuagggaggcuggggaugaggggccaggguccagucccucccuacacccucccaacuuuggaaagcagcacugccuguccuaacuucuuaauguuuucuaacaaaaaaaggggcccagcugccauggguuuuucccucagacugagacuuuucugaaaugcaaauauuucaggcacaugacggauauugcucaauauuugcugaacacauuaaagugaauuccguuuaagauccuuggccugaaaggcauuuggggcccauuuaggggcuccaagguggagguugcugccuauguggacagggaagagccagaggauucacauuucauccagggccucugggccccugcacugcgagcaugcgcacuucccacuagaggcucuggggugaccccccuuccuccguucacuauggaaaccaaggcugggacuggccucuccuccuguuccugggucugccaagaacagccuauuccacagcuguguaaucuguuccguauuacagaguucgaaguaacccaccagcaaaacugucugcuccagaauauuuuaaguuacagcuucuccguauauuuucugugucuauucacagaacuucuauuuacagaauuuugauuuaaugaguaguugagauauauuuuuguagucuucacacuuuucuacuaagcugcuggcccugagaggacuuauugcccaacucaaauaggggccccccuggagacacccagcaagauuuauuauccccaugacucucaggacagcauuagagcuccaucccagaucuugagccuugggucaagguaguuguggaugccuuccaaguacuagcuucgucucauuucucacagugucuuugguccuuuuuguuauuacucugaaggucggaaucucugguucgugggcacacaccuuauuaggcagccaucaagcuacugacccgucuaucccauugcaccugcgcaugugugcuuuccccacuaacaggcuaucccaggcuuuauuuugucccacuaccccaccuacccaaacuucuacucccaguaauuugauuuugggggggaauugaaccucuucauucuucaggaagaagaugauaucauuuuagcagguguacaguugggcuccaggucuagccugugcuucauuucagacuugugcaucagaccuaaggcuuuaagccuuccaaguguaaucucucaggguggucuuaaucgacaggcccugguacagcauuggacaacccuucugucagaaguguaguguguugugugcugcaggagaggccuucugcacagucugcuugaugcuggcaacuucacuagaaugaaguccagguagaaguuauccaguccugcccaggcagcaacugaaguccaagcagcucucuggccagagcgcugauacucacuucagcagagccaccuuuuauuguugucaugccccaagccugcacuuuaauuucaagaauccauuacaucucggagggugacaugugagaaugcaguuuuaaugagaucacaauguuaaaaaccauagccuauggccaaagccaaguugagauuuaaauaguagguucaaacacuuuucuuauuaaaaaauauaucaaaugaacuaaauauuuuauuucuuuauuuauuuaauguuugagacagucucgcucuguugcccaggcuggagugcaguggcaugcucucagcugacugcaaacuccaccucccagguucaagcgagucuccugccucagccugccaagcaguugggauuaagggugcccaccaccacacccggcuaauuuuuguauuuuuaguagagacgggguuuugccacguuggccaggcuggucucgaccuccugaccucaggugaucugcccgccucaccuucccaaagugcugggauuacaggcgugagccaccgcaccuggccuaaauauuuuauuuaaauaguuagaaaauaauacauacccaaacaaaauaaagaauaauauugauggagauuuaaaugcaauaaaugaggauuauauuuaugaagcauggggguaauaagucuguucaagagacauucuuaaaaacaaugaauauaauuagcauauuucuguaagauguucccaagaaaaugguagauaucuauaaauagaagaaggagaaaaaggagaaguagauggagaggagaaggaggagguggaggagggugaggaggaggagaaaaguguugaaauaauuccaacuaagacugauaucuaggaauuacccuggugaagugggaagcuuaagaguccuguuggagggacuggugugguaauggcucugccaaaaguguuaugugcgugcaaacccaaagagagaaagcacagaaaaccuuucaacaucaaccugcuugaggaaaaauaaagugggaaaagauacauacucacagugaggacucuagacaugucaagacaauuuuuaaauaugcuuuuggcuucgaguggcaauaacuagauucaagacagcauauuuaagaagcugcugaugagaagaaacccgggaagagcugaaggaccacaucagcccagaccaaggaugcugaagcagcauuaaggucccugguuucagaugcucaggcaaugacccuuuuuuucauggagagccuguaggagugacaguuuugucuuugcccacugggaaucuguuuuccauaccuggaaaacaggguuaccuauguuuccccugcuacccuuuggucaucucagagacacuaccagauauuacccaugggaccuauuuuuuuuuuaaaucucaggaaagacuuggguguggcuuccaacguggaggacucaguagcuucagagaggguccugagagaaggugaauugaagaaugagggugcugggcagagggaaaagacauuaucauacaaguuugugcuaaaagauauagcaauccuucugcuauggacuaaguauggaaaaaaauaaaauggaaucaaaguuacccaaaggaaguguaaaacccaaauuuaugcccguuaaagcauuaaugaugcucuaaguccacugccuacuuaaaaaguucauaguucacauggguugauaggaaauuacguuaacgacacacugcauuuccccuuuucuuauagccuaucugauuugguagggagucgaucauuuuuuauuggaauuucucaggauuccaaccucagacauccacuuuacaguuuacacauuuucuuggacaagcccgacuguuccucucacugguucgcauaaagcucauguuuacaaagccgcccagaccuuucucugggacucucauauuuaacuuaauucuggauauacccagguaagcguuucccaagaaacuugaccccaacaucccaaaaacuuaagguaucuuucccuuaaacuggccccuucuccaguacgcauccaucucacuucucuccugcccuagaucuucucagcccaaacaggaaaccccgggaucgcucucccagcaggugaagccucgccauggacccuccccgucggggccccgcgcugccccgcccgcccccagccgcuggccaaggccgcggucgcgcaggcgcagugccgcgucccgccgccgccccgcccugcccgucgcugcggaaggcgccgcgcgcagcaacgcgcacuuccucuccaggaauccgcggagggagcgcaggcucgaagagcuccuggacgcagaggcccugcccuugccagacggcgcagacaugucagaacaaaguaaggaucugagcgacccuaacuuugcagccgaggcccccaacuccgaggugcacagcagcccugggguuucggaggggguuccuccguccgcgacccuggcagagccgcagagcccuccucuaggcccgacggccgcuccgcaggccgcgccgccuccccaggccccgaacgacgagggcgacccgaaggcccugcagcaggcugcggaggagggccgcgcccaccaggccccgagcgcggcccagccgggcccggcaccgccagccccggcgcagcuggugcagaaggcgcacgagcucaugugguacgugcuggucaaggaccagaagaagaugaucaucugguuuccagacauggugaaagaugucaucggcagcuacaagaaguggugcaggagcauccuccggcgcaccagccucauccucgcccggguguucgggcugcaccugaggcuaaccagccugcacaccauggaguuugcgcuggucaaagcgcuggagcccgaggagcuggacaggguggcgcugagcaaccgcaugcccaugacaggccuccugcucaugauccugagccucaucuacgugaagggccgcggcgccagagagagcgccgucuggaacgugcugcgcauccuggggcugcggcccuggaagaagcacuccaccuucggggacgugcggaagcucaucacugaggaguucguccaaaugaauuaccugaaguaccagcgcgucccauacguggagccgcccgaauacgaguucuuuuggggcucccgggccagccgcgaaaucaccaagaugcaaaucauggaguuccuggccagggucuuuaagaaagacccccaggccuggcccucccgauacagagaagcucuggaggaggccagagcucugcgggaggcuaaucccacugcccacuacccucgcagcagugucucugaggacuagcaaagucuggaggcagaugaaugguuucugacccucaccagggcuguggaagggugggggugggucauuauaguauucaggauuuacagugcaguauucacguguaacuuuuaaguuuucaguacagugcuuuuauaccuuuaaugcaauguuguauucauuuggguacuauuguguaguauuuaggauguaugcauguuuguuuauauguaagcuugguuggugcuuucgcuuuugugcuaccuuucuuggauuuuuguaccagagaugugcuaaacugaugaaauacauugagaaaguuuccaucuuauucuuuuauaugggacugaugauguguguugggguagacugcuccugcagaguuuggaagaagucaccagcaaagccggccuaaccaagaaaagucaaggcccuucaugaccuugcugggcacagaaaacacccucguggaguacacuaauuugaacuggacuggucucagugugagcacuuggcacacuuuacuaaacacauauacaaccccaccgugagucaacuuuaaaguaaacauuaaagauucuugugauacaaucauuuuuggaaaaguguacuuuaucauuuuaacaaagcaguaugguugggaaugagacaauucucuauuuuacaguguauacagauacaacuauuuccccuaauagggugggaaaaaucgcuacucaugauuacuccuaaauuugugaaguuuauaguucuauugucuuuaaauguaacucauguuuauuucaaaaacauucacaaauauagaaaaguauacaaaacaaaacaguaagauugucuguaaucacaucauaugggaauaaaaaacaaaaauaauuuccuucccuuaaguuucuacauuuuaucaaaauuaauagaugucuugugacaucuauuaauauacauauaacauauuuauaauauaaaagagugagacauugugcuaagcccuaacauguauuuuucuccuuuaauccuugcaacaggccugucaggcaggcaccuacugccucugcaccauggaggaaacacaggaauaauguagguaaugaacuuuccauagcucauaaagguuaauaagagaaggagcuaggacuugaacucagaaugaauccagagcccacauuugucuccaccugccuacgacugcccuauaccccguggcuuuuagguuauuuauuuuuaaauuuauuuuuacauuuuaugugggagccuacaaucacauggguucaugggccacacauacaaaaaggcuaggaauuuuauuuuucuaauucucaugauauuuuggagaaagcaauaucauucugauugugcaaauuaagaaacuuacuuuuggagagguuaauuaaccuaacaaagugauauuccuauuuagcagugaagcuaggauuugaaacaaucucuccugaggguuggaggugaaggcaccuucucugacaaacacacaagacaccugagagagggagguggguuguccaucaggaugucuguggccuugcagcccuucaguugcggugagccacuagguaauccucagaggauggggugggcugcgggugggcauuaggggcaaugccugaagaaaaaucucacugugaauuuuuaguccugcaagggguagcggggagaaagggggcuuuaauaagacuagaaguccuuuaaacuacaaaagagugggaaagaccauuuggccaaagccagaaacuuuucuguggaagauggauaaugaagaggacacaugucacauaacaccccaaagaaguaaacugggaguccuauuagggugagggaauuauaauuuggaauugccaacacuuacuggcauuacuuaacaggugggggcaggugcuggaaaugcuuaggaagccccuguucaugcugagaugaaauccaucccgguuuaaaagcuuccugugaagauuuucaaggggguucugcagagaaagggggacauuucugcaaucacccaggcaggggugaccuggcuuugauggcaccucuuacacaaaaccaaugugagugucucaccuguucagaaguguuaggauuguuuggaaaucuuaccuccccacaacccaucgaaaaguuucuccagaaucaaaauaaaccugcccguuaucauuuaaaauuguggggauauccaggauguuucauuucuggaguaggacugugggcuguuguuccugccacacauggugcuggucaucuucucuaaugccuuaauacuucccucacugcuggauugaugccuugcaggagcaguaaccccugugcgcuucuugcagucaagcccagaaaucaccaggcaaacagucuccuuacauccccguuuaacuccuuauguuguguccacuuuccucucugcugucagaggcagggagaaccacccuuuccaaagcugucccaagcucacucacacaggcacccuagccaggccauagaggaccuagcccuugcaggagaaacagaaugugagaaugugagaaugugagaaaggaguaaggcauggggcagagcgacucgucccuaaugcugccuaggaggcagccagaccuagagaaagaggcuuccagaugugaaaugaguuuacuucaugacaccugauccugcagagauagcagcuuggggcauggggagagagaacccagcagcucucuuggguuuucaugcugggcucuaaauagaaagacuggaggguuugucaaauauuuaccaaaagauucaccuacaagguccugggauaggucaaucaggaaggggucagcugguccucaguguugcaguccaacaugacagugugcugaagcccagacugcugugggugggagagacuuuccuaaauccccauaacaugucaacuuuuaccugccaacuggaaccucauuucuucacaaacaccugcaaacauauuuugauuuguuaauuucauuuuaugaaaggaagggaaaagggaucuuuauaaauuuaauauaaaauauaaagacaccugguguaaguuguccugagaggaaauaaauaacuuuaagcaguaucauuauuaaauagaaauguuuuaagugaacuucuuaugcaguuaaauauuuccucugcuugaaaacccuuuuauguccuucuccaaccugagucuuaccugaccaacucaugaacacuauuuccugggagaacacacucccuaaccucuaagcacagccauguucuaaaugcacccaaaauacaccugcuguuuauaauuaugugccuuuuauuucucuccuccuggauuguuacauacuuaaggguuagaauugucuuuauccuguucauuauuugcuugacacuugagguaaggauggggcauaagggcugcacuugauacauauuuguuauauaaguuaaguaacucaacauauuagaaaagaccuacccauccacacaagaaaacaaaaccauauguggcugacaaaaauuagccaauuuaaagggcgcgguggcucaugccuguaaucccagcacuuugggaggccgaggcaggcagaucacgaggucaggagaugagaccauccuggcuaacauggugaaaccccgucucuacugaaaauacaaaaaaauuagccggacgugguugcgggugccuguagucccagcuacucgggaggcugaggcaggaaaauagugugaacccgggaggcggagcuugcagugagcugagaucccgccacugcacuccagccuggggcgacagagccagacuccaucucaaaaaauaaauaauaauaauaauaauaaaauagagguaacguaggacgggcgcgauggcucaugucuguaaucucaccacuuugggaggccgagaugggcggaucacuugaggucagaaguucaaggcgaggcuggacaacauggugaaacccugucucuacuaaaaacacaaaaauuagcugggcgugguggcacgugccuguaguaccagcuacucaggaggcuaaggcaggagaaucccucgaacccgggaggcggagguugcagugagacgagaucaugccacuaaacucuagccugggugacagagcaagacaccgucuccaaaaaaaaaaaaaagcaaaguggagguaauguagauaaguugaaauuagugaaagaaaaaaaaacagaaggcagaaaaacaauggaagcaaaaacuuguuucaagaaucacugcuacaaacacucuaacaaaauaacccaauaucuaguaguuuuuuuagaaaggaaaaauaguacaaagaaacaacuuauuuccugacuuuuuaaugaucgccauucuaacuggcgugagaugguaucucuuuucuuucuuuuuuuuuuauuuuuuauuuuugagacagagucucucucugucacccaggcuggagugcgguggugcgaucucggcucacugcaagcuccgccucccggguucacgccauucuccugccucagccuccccaguagcugggaccacaggcgcugccaccgcgccuggcuaauuuuuuguauuuuuaguagagacgggguuucaccguguuagccaggauggucucgaucuccugaccuagugauccacccgccuuggccucccaaagugcugggauuacaggcgugagccaccgcgcccggcuggugugagauaguaucucauugugguuuugauuugcauuucucugaugaccagugaugaugagcaugggugaagcuggaagccaucauucuuuauauauauauauacauauauauauauuuuuuuucauuauacuuuaaguucuaggguacaugugcacaacgugcagguuuguuacauauguauacaugugccauguuggugugcugcacccauuaacucaucauuuacauuagguauaucuccuaaugcuaucccuccccccuccccccacccccaacaggccccagugugugauguuccccuuccuguguccaaguguucucauuguucaauucccaccuaugagugagaacaugcgauguuugguuuuuuguccuugcaauaguuugcugagaaugaugguuuccagcuucauccaugucccuacaaaagacaggaccucauccuuuuuuauggcugcauaguauuccaugguguauaugugccacauuuucuuaauccagucuaucauugauggacauuugaguugguuccaagucuuugcuauugugaauagugcugcaauaaacauacaugugcaugugucuuuacagcagcaugacuuauaauucuuugaguauauacccaguagugggauggcugggucaaaugguauuucuaguucuagaucccugaggaauuaccacacugacuuccacaaugguugaacuaguuuacagucccaccaacaguguaaaaguguucuuauuucuccacauccucuccagcaccugccguuuccugacuuuuuaaugauugccauucuaacuggugugagaugguaucucauuguuguuuugauuugcauuucucugauggccagugaugaugagcauuuuuucaugugucucuuggcugcauaaaugucuucuuuugagaagugucugaucauauccuuugcccacuuguugaugggguuguuuguuuuuuucuuguaaauuuguuugaguucuuuguagauucuggauauuagcccuuugucaggugaguagauugcaaaaauuuucucccauucuguagguugccuguucacucugaugguaguuuuuuugcugugcagaagcucuuuaguuuaacuacaucccauuugcuaauuuuggcuuuuguugccauugcuuuugguguuuuagaccugaagucuuugcccaugccuauauccugaaugguauugccuagguuuucuucuagaguuuuuaugguguuaggucuaacauuuaagucuuuaauccaucuugaauuaauuuuuguauaagguguaaggaagggauccaguuucagcuuucuacauauggcuagccuguuuucccagcaccacuuauuaaauagggaauccuuuccccauuucuuguuuuugucagguuugucaaagaucagaugguuguagauugugguauuauuucugagggcucuguucuguuccaguggucuauaucucuguuuugguacaaguaccaugcuguuuugguuacuguagccuuguaguauaguuugaagucagguagcgugaugccuccagcuuuguucucuuggcuuaagauugacuuggcaaugugggcucuuuuuuggucccauaugaacuuuaaaguaguuuuuuccaguucugugaagaaagucauugguagcuugauggggauggcauugaaucuguaaauuaccuugggcaguauagccauuuucacgauauugauucuuccuacccaugagcauggaauguucuuccauuuguuuguauccucuuuuauuucauugagcagugguuuguaguucuccuugaagagguccuucacaucccuauaaguuggauuccuagauauuuuauucucuuugaagcaauugugaaugggaguucacucaugauuuggcucucuguuugucuguuauugguguauaagaaugcuugugauuucugcacauugauuuuguauccugagaauuugcugaaguugcuuaucagcuuaaggagauuuugggcugacaaaaaccaccugauuaucucaauagaugcagaaaaggccuuugacaaaauucaacagcccuucaugcuaaaaacucucaaaaguuagguauugaugggauguaucucaaaauaauaagagcuauuuaugacaaacccagagccaauaucauacugaaugggcaaaaacuggaagcauucccuuugaaaacuggcacaagacagggaugcccucucucaccacucuuauucaauacaguguuggaaguucuggccagggcaaucaggcaggagacagaaauaaaggguauucaauuaggaaaagaggaagucaaauugucccuguuugcagaugacaugauuguauaucuagaaaacccauugucuuuuuuuuuuucuuugagacggagucucacucugucgcccagccuggagugaaguggcgcgaucuaggcucacugcaagaucugucucccggguucaugccauucuccugccucagccuccugaguagcugggacuacaggcgcccgcaaccacgcccagcuaauuuuuuguauuuuuaguagagacgggguuucacaguguuagccaggauggucucgaucuccugacuucaugauccgcccgccuuggccuccaaagugcugggauuacagguaugagccaccgcgcccggccuggaaaccaucauuccaagcaaacuaucacaaagauagaaaaccaaacaccgcauguucucacucauaggugggagcugaagaaugagaacacauggacacagggcagggaacaucacacaccgaggccugucgagaggugggaggcugguggagggauagcauuaggagaaauaccuaauguaaaugaugaguugauggguguagcaaaccaacauggcacauguauaccuauguaacaaaccugcacguugugcacaugugccccuagaacuuaaaguauacaaaagaaaaaaagaagcaacuuauuacuagauaaaugggccaaggacacagagaggucagugccuuaauaggaaacacaaacaucaaaugagaaaaugaaaaacaaauacaaucucacugauuaaguaaagauacuuuguguauaugaauugaucaaagauacaauaaaaaugaauauccuguacuagcaagagugaauugaaauuggcauccuuggacccugcuauaguuguauaaauuacuacaugcuauuuuaugcauucauucagagugcuuacugaguaccuaauaugcggcagaugcagggcuaggaguuagggaugcaagagugaacagaauagacauuguccugugcuugccgagcauucacugaauugaaagaagcaggugaauaaaaauaauuacauuucagcgcagugagugccauccuaagagaaguguggggccuaaagaggcacaaacaggugcacacgacucagacuguccuagagaggugaggcauaaauugguucuauaggaugagaagcaauuagcaacgugaaaacgguguguggaagggugaaguugggaggaggcucucuuugugucccgggaucugcugugugaccacacacacaagcauacggggcuauauaaugaguuucucaaaauaaauagaguaaaaaggagaagggaaauaaacaaauuucagaauuggcuagaggcuaggaaaaaaaaacaugcuggcugaagauacagucaauuuccucaaggaugugacaaagaagagggcucauaugaaucacaugaaaggcuaacagauuuagaagaagccaugcugaaggauagccuucuuuugaacagacaccuuuguuuuuuuauugcugcuguuguugucugcuuucugaugaggggucuaaaacaucccuccuuaucucuuuauuugcccaauuauucuuggguucagcuacucaggguuuggagcccuuaacuauauuacauauuuucccauaucuaaacgguuucaugucucuucuauuagcccaccaacuuuauacuaaaaaaucuuuaagauuccuguuugcuguauaaauuaguuuguuuauguauuuauucaauagagauuucuugaacuucaacuauauggcugacuugugcuaggaacugguacaauuuggugaauuaaacaagauggcucuuggccucaaguaguuuguuuauaaacuuuuuuuuuuuuuuuuuugagauggagucuggcucuguugcccaggcuggagugcaguggcgccaucuuggcucacugcaagcuccaccuccuggguucaugccauucuccugccucagccuccccaguagcugggacuacaggugccugccaccacgcccggcuaauuuuuuguauuuuuaguagagacaagguuuugccgugucagccaggauggucucaaucuccugaccuugugauccacccgccucggccucccaaagugcugggauuaaaggagugagccaccacaccuggcuuauugauaaauuuugcauugauagagcacaacaaagagguacaaaugaaacuucaaauacaaauuauaugauuggauaagauauaugaaaaaaaugggccaggcagaguggcucacaucuauaauaccaacacuuugggaggccaauauguaagaauugcuugaggccaggaguucaagcccaaccugggcaacauagcaagaccccaucucuacaaaaaaaguuuaauuuaaauaaaugacgugguuaaauugauagagaaugguugagaagacaaacuaaggcaggaagcccaagaaauaauuuucugaaaaggugaaauuuaagcugauaauuaauugaaggauaacaagagaguuagcaaagaucaaagggaagaucaagauaaauccaggcauguauguauguauauauaaauuacgcauguauacauauauguguguaauauauauacauauauaugcacaucaucccaucugggccuucauauauauguauauguguauaauauauacauauauaugcgcauagauguguauaauauauacauauauaugcgcauagauguguauaauauauacauauauaugcgcauagauguguauaauauauacauauaugugcgcauagauguguauaauauauacauauaugugcgcauagauguguauaauauauacauauaugugcgcauagauguguauaauauauacauauaugugcgcauagauguguauaauauauacauauaugugcgcauagauguguauaauauauacauauaugugcgcauagauguguauaauauauacauauaugugcgcauagauguguauaguauauacauauaugugcgcauagauguguauaguauauacauauaugugcacauauauaugcacauauauguguauaauaaguacacauauauaugcacauauguguguauaauauauacauauauaugcacauaugugugcauauauauacauaugugcacauauguguguaauauauacauauaugcacauauauguguguaauauauacauauaugcacauauguguauuuuauaugcacguauguguauuauauauacauauaugcacauauguguguauaauauauacauauaugcacauauguguguauaauauauacauauaugcacauauguguguauaauauauacacauauaugcacauauguguguauaauauauacauauauaugcacauauguguguauaauauauauacauauauaugcacauauauguguauaauauauauacauauauaugaagggccagagugaaucaccuagauuuuucugguggccuuuaccaugagaaauagcauuauaaaugggcugagcagcaugugacacccaguugucuuuucuugucugucuccacaguugaggcugcacaaguuaaauauuuaacuucuugguuuuucagcuguguuccagucaagagauguacagagagguuuaucugugcuuuuccuuccuacauccuuuuucucuuucagggaauguauaaggaaagucaggagcuauuguugcucguaugauggcaguauaaaaacagcuaaagaaaucauagagagguugagccugacaucuacaaacugcuggacaaauaccaauagccaccuacuuguaucuauaguuuuuggcauguagaauaaaaucucauucuuuaagcuauugucuuguggguuuuuugcuugcuuugugcagcucaaagcaucccuaacugguaaagucuccaaaaaauucuuuucucgucucccauucugugucugguacucacaugaggguauuacugaccauagguggaccccgauuagguuaugacaagcagaguaauucuaucuccuugcugcaguucuuagaucagauaugagaacuuaaucaguucugggcaaucaggucauguagauuagaacuuccauucauuucauggcaauguucaugagaauagaauuagggcuucuggcucugaaguuuguaccacuuuggcauuuagaguuaucucagaaaaauguauaauuuuuuuaaaaauucagcuuguuauuuauaagccaguuuuguuauuugcucaagaaaucauacuaauaaugguggugcuuucugggguugcgaaggggaaagaaaggcucagaaccaggagagagaggaagguaucagggcagcccuguaggcaaugguaagcaggcagauuguauuuaaagaguaaauggaaaccacuaacgacuugcagacucaucuaauugacauuaggcuuuuaaaauauugcccuccuuaguauacucagaaugaauugagaagggaaagcaucaaaguugagagucugcuaagagaugaagaugauguagacaugaugaaggaggguauauuuguggcucaauugaggaauggaggauggauagguaagggacauggaagauuagaucuggauucucagguuucaggcuugagcacucggugaauagugugauuuuuuuuuuuuuuuugagacagagucucggucuguuguccaggcuggaguguaguggcacaaucauagcucauugcagccuugaccuccuaggcucaagugaucaucccaucucagccucccaaguaguugagacuauagaagcacaccaucacaccuggcuaauuuuuguauuuuuuguaaaggcggagucucaccauguugcccaggcuggucucgaacuccugggcucaagcgauccucagccucccaaagugcugggauuauagauggugagccaccgcaccuggccauaagugugauuugaugaaauggagaagggaggugaaaaacagguuuuggaugaaaacaguaaagaguucauacaaacacucagugacauguccuaaaagaaauaugagguucacaauuauuaaagaugccuagcucaagauagagaaucauagcccugcacuggagcaacccauuuauccagagugaaagcacagaguaacuagaagcggauauucugggaaacuaagacauuaccacguguaguauugaaggaaaagcugcuacggagacuaaaaacaguaccugguuaagagauagaaaguaagccaggagagugauagagaugagaaucaaaauagcagcauuucaagccaaaggaaguggccaauagugucaaacacuguugaguuauuagaaguauuugagggguuuauuugcauuuaguaggaucuuugcugauaagagaagggaauaaaggagauuaaguucaaaggcaugacgcguguucacccuucacucaggugagagauaaugguaacuuuaacuagggaaugaauaaugaagauggagauuaauugaaaaauugagaaauaauuggggguuacauugccaaaaauggaugauugaugaaaugcuagaaauaaaaacagggaggaaucagguuuauggccagguuucugacaugcacaauuuugugugucguaucaguuacugaguuugugagaaaagagaaagcagauuuacgugggaggaggaugaguucaguuuuauauauuuugaguuuaacguaaaugccaggcaucuaaacagagauguccauuugauuagggauaaaugcauaagaaaagaugcagauuaaaaugucaugaaccuauggaugggaagggauggauuugcaaagguauucucugcuucaccugagcaguuuaggcaggacagacacucuucugcuuaaucucagacacuuacaccagcuauccacacuugaucuuagccaaaaggccgagaagcaauacaccagcuauccucagguacuuacauuacuuuuuguuccuaaaggcauaugaguuugggaaucucggagagugagagggaagaggugcaggauggagcauugaggagaacaaauauuacauggaaaagcagaaagauaacucucaaauaauaucaagaaacagugggaagagauuaggaauaagugagauuuagagaauguaguuuuagaaaugccaaaggagggauuggucaguuguuaaauuuaguugaggcaugaagcaauaaaauaacuaagaaguguuuacugaaauuacucauaaagagauuauuuucauuuuaugaagaacaauuucaaugggauaguugucaacagaaaccaaacuucagcgaauuaaguauggagcaggaugugaauauaaaugauguauauauucaaugguugauggagagauaccaguauugaagacauggcgagaucuauauuauaaaauggaguuacuauacaggauugggaaugcaucguccauaggaaugagacagaaguaugaaaugacugauugauguauaccuguuguaucuguggcagaaaguugauggugcuucuauuuucccagaggagugucagggaaagucaaaauuuaagacagagaaggaaagugaugagagagaaagacagucccagaugugucccauagaauggagaaggcaggggaucuucccaggagaaucucucaugggagacuccagcagauauuagaaaauuuaauuuaccgauauguacaagguaccaccacugcauuucuuauuuguuccacaaaugcaagacugucucaguauauucaucauaucuguaaucuuaagaaaaaccacaugaucaugucaaugcaugcaggaaaggcaucugacaaaauucaacucccauucauaacaaaagcucucagcaaucuaggcacagaaaagagcauuaccaaccugguaaagcacauuauaaaagaaacaacaacuacuacuauaguuaacauugcuuaguguguuuaaugaccaaaaacuggaugcuucccucuaagauuggagggaaggguagaguaugcuguccacucuuaucacuccuuuuccacuuggugaugaaaguccuagccaguucaauaagacaggaaaaggaaguaaaaugcuuacaggcugaaaaugaagaaauaaagcuacuucuauuugcagauggcauaauugucuauguagagaaucucaaauaauguccaaaaaaccauaccugaauuaagaagagacuuuagcaaugucacaagauacggggucaacacacaaaaccaauuacauuucuauauaccagcaauaacucuuggaaacagaaauuuaaacauuuaaaacucaguaccauuuauaauaacucaaaaauacuuaugaauacauacaucaaaacauauaggaucucuauuuugaaaagcuuauaaagcacugauuagaaaaucaaaaaauaccuaaauaaauggagagaaauaucauguucauagaucagaagacucaacaugguaaacagaucaaacagacauguaggauucaugcaauuuuuaucaaaaucccagcaguuuaucuggaauugucuugauuuuggcaccagaagucccacuuucuaggaauccccucugugggaugugaaaaaccccaaauuuuuggccaugaguaaagaagauuggagaaaaaacuagaaaacccauauggcaucacccaaacaagggcuguaugcauuuuacugccaaauggagacagcacauauuaucuguuucuuguaauugcugucacuguuuuuuuccugaccacuaaugcguauaaccacgauuugcaguucacagugaucagugaauuacugugagcugcaaaucgugaaucauucuaacucuugugacuuaaauauguaaaugaagcauguuguaaucaugaguguuugucuguauuugacuuuagcuguggauuaacuguucuacuuugaaucaauuuugugcuaguucaguuuuuaacuuuacaaaccuugagaccauauuuucuaauaauucagauaguaaaaacacaaacaauuacaauaccaaugcagcaaggcccagaaggcuaaaugauuguguuauuuuaaugguacaugaaggacacagacaacuguauuacaaagguaaguaaacaaaacagagcauauugcacaauaggcagaaaaauaauguggggcuggguaugguagaggagguuacaugaucugugugacuuugcuagggcugccguaacaaaguaccauagauuggguggcuuaagcaacaaaaaucuaucuccucacaguuauggagguuggaagucccagaucaaggugucaguggguugguuccuucugggggcagugagaacaugaucuguuccuggucucuuugcuuggcuuguagauggugcagaugacugucuucuuuuugugucuuuucauuaucaucccucugugugaagacuaaauuuuaccauuuaaggaugauauaagcacguaauucuaaaaggaacaaaaguuucuuuucucuuuuucuuuucuuuucuuuuauuucuguuauuuuuuggauuuuuggucuccuaaacaaacacugauguucaguugaaaauggcagccacugaauuaccuuugguauaccaaacaaaccagcacacaucauuauaucauuuuauugauuucuauuugaaaaugaguaaaguuacauuaccuuuaaaauuauucgaacauucagugacauauccuacaagagauaugagguucacaguuaauaaagaugccuagcucaagacagagaaucauagcccugcacuggagcaacccauuuauccagaaagugcagaguaacuagaaguggauauucuggaaaacuaaaacauuguauuaguuuugguauacaauacaaaccagcacacaucauuauaucauuuuauugauuuauguuaaccuacaaguugcauugaaaaugucuuucaacaaacaaaaugggaaauuuugauaauagauacauugguucuuuacaguguagagcugacucugacaagucuuacugucaaucaugcugccuacaauacagcaagugaugcgucaaauaaugauaaccaaaaaaaaaaugcacuccacauuuuagacauguuuauuugaaaaauggagcuuuaaauuaucuuuugguuucuaugaaacuuuucauuaaaccacagaaaaca

SEQ ID NO: 12615 - RNA, 28631 nt, Homo sapiens
accuagaacuggggaaggacgcaccuggcccggccagcggcccaugaagccgucuuucucccacgggccgucccuggcucgacccugugcccagggcagggucaggcccagugggucucucuguggagggaggggcugccugggguaucuggggguggugagggggugucccagccccagcccuuccccaggccucaugugggcaccaccccucguuuacgggcucugggagcggguggggccccuccuccuccugagcuguaagguuuuucuuccagugggguuugcacaaggguccacgcccacagccucagcccggaaccugaaggcucugaggcuuccuaggggguucugcggccuugcacuguggguccucccagcucggcagcccucugcugaggcaauguccucuuggagcaaaaaacagccuccgcaccauuccucccagggugcaucugagcccaggccccaggacacuauccccggggguccaaggcggguggggaccgcccucccgacgaagcuucuuugcgcccugcucacucuccucagcccccaggugcacugggggauccugcaggaagccugcgggcggggacugggggguguguuuggggcagcggugucuagacccuggccugccugagggccgggagcuuggacuucaggccucaggagucaggagagggccaccacgcucccuuccccucgccacaguggucccaggcgggagggagcggacacgggcuuugcggcacaaccugguccuuguucucuggcugggcuagggucaccuggagcuggugcccgugauauccgccugacgcggaagugggcaccguuuucuggaugcucccuuacuuucucagcgcuguguggagggggaaugccccgugcuucucacccugucuucgccuguccccaccccaagcuccacugggcggggaggagaggggcaccuccauaggacucagcuauccccccaacucccacaggaaccucaggcccagaguccccaggagggagcagccggcaacacgguuuccgcuguggagacggggcguccuggcuugaguucacuccucuccagguggagcugccgccgugagaccaaggccaggccccccucgggccccagggcuccgaggcacuuccuuggguuggugugcuggauggaaguagggcuguauuuccuaagaccugcggggcagaccuggccucuggaggugagaauuugcugggccuguuaugggugaaagaggaaaaccagccuguggggggcaucucacaguccccucugucccucagguaggaugcguggggcgugguggagccacgggguaggggaacggggacccccucaggugugugggggcugggaggugggugcaaggccccccgucucaccgagaagggacuuggagagugagauggugucugaguuaggauggcaggcucagcugaccucgucccagaggcacucagcaagggccagggacggcauccccgccgggcacauggcaguucauccucagagacacuguguaugggagggaggagaagcccacaccucucugaggcaaacuucaggacggccaggggccccugagcaccccgcccaccuuucucccggcgcccauguggggcgaugcucucugcccuccuuugagcucugcaguauccugggacguugggcccucuguccugcuugcucugucugugcuggggagugggcaggaguggacagagauccgcccuucuccaagagucccagccgugggaggcuucaccuuccagaagguuccuccuguuucucugugccuacuacgaggcucauccucacaccugaggacugucuccuugcugguaggcucaccgcguggaggaaagggggccucuggucaccuuccccacaagcacagacacgcagugucacagggcaguugagacuguguuacugagcccagcggacaaccugggaacacauccugguguaucaccuuacuggcugcaggagcucagggacagccguaaucacucugugccucaguuuccucgucuguagaacgggaccaguuugcaugaggcucccgggcagagccuggaacccgugaacccaagagcagucgucaucaggccaacgugcacucgagcagagaugucuccccaaguccagcuugcuucauauccccugcaguucugguggugggaacccagaagucagaacacaucuaccuccuggcagcuggaggccacagcgccccgaguuugggacaugccccucucugcauguccgugccaauuccucaaggcuaucggccagccccucccacucaaggcaccccauggagccuccugggagaucuucagacccagggcaggugggggcuggaucugcccuuccuucggugccccaggucuguuaugggcacgggcugugagcuggugccaaggacagaggcaucaggccaggccaaacugcugcacacagcuggccacggggccguugaucgcagacagucaggcuucaggcugucugacacgggccgucugcuccuccuuggacaguugcagcacucaaauguuaaaacaauuuuuuaaaauaaauuuuucuacuuuuuuuuuuuuuugagacagggugucacucucuugcccaggcuggagugcagugguaugaucauggcuugcugcagccucaaccuccugggcucacgugauccucucaccucagucucccacauagcugggaauacaggugcgcgccgccgcaccuggcugauauuugguagagauggggucucacuauguugcccaggcuggucuccaacuccuggacucaagcaaucugcccaccuuggccuucuaaaauacugagauuacaggugugagccaccacaccuggccccaaauaaaacaauuuaaaaaggaaaaaaguguguguguggcaggaagaggagggugaggcccggaaggaacugaaggaaacaaacucaaggagaacagcugguccccacgccagcgucgacgcuccaaguccuucaccucggagccgagcaggggcugggggcacggggagcuuguggccuuucuggugaagugacucuuuucuggaacuuuccaaacacccuccccgccccccgccaugccccccaccgccuuuccuuccuucuuucucacccgcuuccuuauuccuuacuguucaucacagacaaaguuccuggguaggagugcgggcaacugccguuugggauccaugggggccucccgccauugggcagccccucucccuggcuuguggggaggcucaggugagcccaggucucccucucccaccgcaugggagugcaggauccacaggcugauggcuguuugccaaaggauggggacauuggggcacagcacggggacacuuacucagcagacagcacccugacuggcaagauugaagagcuccccuuccuugcuaagacucccaugaaacacacagggggcugcucagggggugcaggcggcaggagcggggacagcucagagguggguguggcacaggguucauggcauaagagggguggccucgggagccagggcgggggcagccuggagccagcagcccugaggccaugcacauccacagcaugcuggcggugacagccccgacccguggcaggggagcaggcucugggcuugucugacccgugagcacccaguggccugguggccucagcccucguugccagccucuuucuaaggucaagccugugcucuccagccagagaaggcaugcugggcugggcugggcuggggugggcagggcugagcugggcagggcagggcagggcugggcugggcagggcugggcagggcagggcagggcugagcuggguagggcagggaugagcugggcugggcagggcugggaaggucagggcugggaagggcagggcagggcagggcagggcugggcugggcugggcugggcagggcaggacagggcugggcuggguagggcagggaugagcugggcugggcagggcugggaagggcagggcugggcuggacugggcuggacugggcagggcugggcagggccggguggagugggcgaugguguccaucccgcuuaguggcuuccucucacaggaagucugaccacccuucaaugcugggggucuaggcugggcagguggacguggggguccauuucuaggcucuagacccaaggccuuccugcugcucagagguuccuaggcucagcagagagggcggggacagaagguccgaaauuccauguccuugggaucccaucugcccguccuucccgcccagcccagcccagucugucugcuccccagccucccacgccccccauuggcgugcaugagugacaugcgugucccgcacacccucgguccuguuguccaucucccccaucgcccgcacacccucgguccuguuguccaucucccccaucgcccgcacacccucgguccuguuguccaucucccccgucgcccgccacccacgccguccccacugccuuaggcuggcugccccuuuggacaggggcuuugucuacccaagucacaggacacgugaaauucagccuuaauuaaguuguugggugauggagucccagaugugggaggcucagccagacccucuugggcugcccacccggagagcgacuggggcugagagccucgccuggggccacugugcagcugccgccucccgccucccaccucccgcaaaggccugggaguggggcccaaggcagcugcagccccacagccuggccuugacccugggcugccccacagccccccugcuggcuccgugcccacugggaaaacaagcuccuuaucucgaaugcuuccugugaacugcaaacagccacgugucccuugggagccacucuugaugaacgugcccucugucccacgacccagggugaggccguucacccucgggcugggggccaccgggacuggaggcucuaggccuggaaugaggggaggggaccugcggcagggcagagccaggcuggagaccacugcauugggagggugaggagggagaggagggggcaggaggguuuggguccaaggccugguugcacaggacagcuggggaugggggagaggggcacaggccagaaaggcuggggcugcgggggcuagcuaagaggcgaggguucuggguggcagcagcaggcagggaccuucccggcggccccaguggcucccucccucccagaacccuuucuccuuccuugggccuagagcuuccuccacguacuuuuccccgcccccgccuuuccccucucucucaccccgcucaaacaugcugugaccuuuccagggccccuggacaucacucacugggugacagagguugacaggcauggagcuaaggaaugggaggcagggcgggggcggccaagccucuccagccgcucccuucccgcuugccccacagacgggccucccuggaugguccugggucagcacacacgcucccaggcgcuuccuuccccaggagacaguccccagccccuggcggcccagauccuccugcucaggccgacgcaucccaccugggccccagaaaccucuuuggaaagggacagucaccucagaguggcaagcacuuaaaagagacccccaacaggccggugugucgugguggcaggcagggugugucuggagagaagggggacguguccccagcugggccugggggcggcuccgugggaaagucccaccuggucccagccccgggucuccagccuucagacuccuugggggucucuguggccuggcagaggucgguggccccucaguggaggugaggccucuccugggucaccaccgcacaccggccugcugggaagcugggguucugggccacagccggcccuggacguggaggggggcaucaggccagaccccccaggggcucacagggcucugggaggcccuggcaaccccagggugcccccaagcccucagaaggguugucccuacuuggaggggaccacacagccaggugggcaggaacaggcaccacggcggcccuucccuguccacccucucaccaguggcccgcagugcaguccaggaagcaccggacagagcacggggcagggaggggaggcccguacuggcuucacagaggucugggaggggcuagccccugugcagacagaccccugaagccuagagccgccggcccagcugagguccuucccaggggccauucugggaccccugaccccaugcaccugugucacagggcuaugagcgcccccagccccaggaccuccacguuucucucuagagggaagaggaggaggacggcaggccugcuggccccacacuuacugguuggggacgcucagagggggcagccgccaugccgggaaguuagggugggcagaggagcagcggugccaggacccccaggccaugcugccaccccggacccugaacagugggcuagugugugggccuggggagugagggcccaggccgggcugggucucgcuccauaaacccuggcuggccggagcugcagacaucacuguugacacaggggugaugucacugccggccaauggggagacccucgggggcccuacgugugccucucugugcucccagggcccccgccacgcacgccgccugcucugaaugcugccugcauaaaccgguuuuucuaaaugucuuuggggcccugcuugcccccugggccccaucuccugcucaucccaccccacccuugggcccagccuaugagccaagcgggaguggggaguggcggagagcccugggccugcccgcucccacaggcaugugggccccagagcccugaccccugcaccuucaccucgccagccucucucccaucugccacgaccccagcugccaccauggcuccccacagucaccccugggccgucucuuccuccugucgggagaauguuccuccugggagagccugaggcccccucucugcuccuugcucccccgucugucuccccugcccugccuugcagcccugcccuggguccauaugcucagagcuggcuacauauccuguggcugcccaugacacauagcucccccaggcagggccggaccccgggcaccucuuugccuccagggccggccccacucuguuggaggucagccgguuccgaggccuccaagccgccuuucuacuucucgauuccagggccuggucuccacucccucugggcuuuggggugcaugcugcagugcagccuccccgcgccccggccuccaugcacccugcucgugcugccucagaggcuuggcaucucccccaucuuccagccaggcagccaguuuucugcaacguggggcccacggucagcgucccccacagcccugccagcccuucuccccggggguccgcccugcacccccuucccaggagcuugcucugcacccacugcugggccuccuggccuaggggcuuggcacgugccugugagcagaggcgcugggcaggaggaggaggaggagccugcagugccuggcgcccguguguguuuacugguccggccccagccccgcgccgcuccccgcggacccggccucccgccuguguccagccagguguugggugauggagcggggcucccuaaggacaaggagcacagugucugcuuucuuugcaagcacagugcugacaaggaacagaauacccacagcgacugcuuccaggaaacggcugcagggcgggcgggagccucugcgagagcagccccuucccagcaagccggccugcaggugggcuuccaggaaggggcccccgcuggcuucccucagcccuggaagggggccaacggugucaccaggagcaggccagggagcgggguagaggggggagaaagagaaaggagaggcgcggaggagggaaggagggacggggcgcaggccuaugcuaugccuagugugguuaccacagccuuaagggagagcaaggcugaccacagcuccuucucgaaccuuccaaucccccuuuugagaagucacaagaucuccacucaggucuuuggcucucuggggcuugucaggcaucacacacacacacacacacacacacacacacacacacacccgugcacacccaucugaaaacacaagcaagcugggccacugggggagaccauucccugagacccagccgggguccagguugaggggcugaccuccuggcccccauguugggagggccgaggagggcccccgcccggacccacugcgcccuuggcucugagugcucagaucccacccccaucucuagagaggaggaaaucauuuaucuuccugggagcucggggucggggagagggggcugcccuccuugaguccccgacuguuuucuuugagacuucccagggugcauuguagucagacccaaaacaucgcuuugucccuguugaagggacuucacuuccuucguagaguugggauuuucugucuccauucggugguauaccaagugccugccucccacacccagcugccccuaaucccugccugaaaacgugcuccugggucacggaauucaugcugagacacagccacacacagccaggcucagggguccacccuccagggaacaccaccccgcuacagggccacgaucacacacacaccccgcggagcaucuccgggccggacaggacccacgcccuccacagcccggaaaggcggguuaacuggucagcaugcagagacccaccaaguggagaccccgcucccaggcacagacgcacagcuguggaugcacguccucggugacaagguagcugaggucgcgugccccggguguguacggcccacagagccacaggggacucgccaggagaugcgugcaccgaggguccagcguggccacagcagcagcacgcgccucaaguccucuucucuaacuggaugacuuggucuucacucaaccuaaacgugccgcagaaacuuggguggguggagggucugggugugaagaccucggugccuaacagggucugggacguggccagaagccagggcacccucagggucucccugaacgguggaaguuccucccuccccagauuuccuggcaccuuugcaggcagccacaacccucaccccggccccgccacccccauguugggguuugggagugaaauuccagcccguuugcuucuccgcacugaagucagugcaggggcguuuucaaagugccuuuggguguuggggugccuggagccugucuaacaacccucucuaagccccuuuucuaaaaagcaggaaaucggguugggccaaagauaaacacacauuccaaccuggcaggucgcucagagcuaggggcucgggcgggcucccagcccccgccccggggugcggcaggaggcuccgaggcugagcaccugcugcggggcccccgggccuguggcuccccgccugcccgccucacccugagguucagcccccugaacgcugcccccaccaccucccuguuucagggccuguggcccagacccccuccagcacucaggggcugcccuagggacaccaccccaggaacugcccuaggaagcccguuccgcugcagggagcagagaaaccugggcugcccagagguaggcgcugccccugaguacacguccugcucucagggggcagccagcgugggcacagccaugggcagugcugggagauggugggggccaccaagaggccugugucccuuccccagcgggugugaggaggaacagcccuguccccauacagcucccagguggaaacuccagagcaagcgugucauucauacaccccgggcccagagauguggacguguccagcacgccuguucucuccaagugaccaggaggagacaaucccuaggagcugacacaggugacgaaggcccgagguggcccgccuuuucccccggccccauucccauguguccuuccccaggcagggauuugaagugggcagagucuuccauguucuccaggagagguuuucugggugccccucucccccucccuacgguuccccugccccgccacccugggcaccccuggggcugccugccgcacccugcagccgccaccuggggaagccggcuuuuaucuccugagcccugcuuuguaaaccuccugcagaguuggauguuuauaauaaaggccguuuauagaccuaacucuugacauguaauggauggguuacuucauccugccggccaaaacccacuuggguaagucaaauuggccuguagggucaggaagaugaaugcggccucacccugggcuggccccagcgaccucugaccuccuccaugagauggcagccagucccaggggcaccaucccagagacuucaagagacucccucaccggaugucuacaugcauccuggggggugaccacccgcccagguuuuagcacacaagugugucccuggaaaccccucggucucugacaguccccagggcccacagcuggauggggagggggcaagagagggugcagaggggaggccagacccaagggacguggggaaccacccugcucuuccgcccuggacaccaagaccccaagggcggcugggccgguaggggaggggcgucccuaaccgccuuccugucuguucuuugucagucggggaggaauuuuccugacagcucugugcacugggaauggggguggaaggcaggggggaggggggaaggaauggggaggccgggaccccacccuuauuuccaggggcugccccuuguguucccagcgccugcacagcgaggggccgggagcugggaggccuggcugagggagcugccggccacuggccucugcggggaagcugacccggaacccaugagugggcugccuuggcaccuggggagcgaaccccugcauaccgggguucuuggagcuccagcagcaagaccccggggagggagcccgggagccccucacccugggcccucccgcuccuccucaccuccucccuguggccacccucaacuucuuccucccuccuccugguccccuggccuccuuaggaccucugccccaaggccaccugcccacugagaagcccaccggcucccccacaacccccuggcuccuugugcggggccgucccuccggcguggccccggcucccacccacagcaaaaggggagcaggaacgggacuggcgcgggguucgugccccugucgggguggggucgcccagagcaccuugugggccucccagagcggccauggccagcucuaccccagucaccuagcccgggcuucaggggucuggggccagcaccaaggcgucauucugaugggacuuuggggcgacaggaggcacucgcucggggaugguuuggugguccccgaccccugccucagagcgcaggcccccuccgcaagcccagcccccgcccagucugugaagccccuggucccacagccccuccacugccaucacugcaugcugaccgccugcccugcaccccugagguccacacacccugugcucaccccaccccuggugugugcugcgcugcacccaucccagaaucccccacccuggaacccccaucccccuuuucauguacuccuccccaugccccccagccccccucugcccaaggcuggccucccccacaucaugcccacagcccggauuccagaguccucgagacaaauugcuguaacaguguuuauugaugaugaguccagggcuccugcugaagcccugguggggaggggcacagagcgagauggggcguaauggaaugcuugaaggcugcuccgugaugucggucggagcuuccagacuaggcgagggcagggugaggccucgggcacacagccggcgcccagucacccggcccagauggagggcggccgggcccugcacaggcacuugccaagguggcucacacucacgcacacucguacugagacucaaggccgucuccacaacuccaaccagugcaaaugacuuagugcaaauuaaauucagaagggacgggggaaacagagucguggaggcuuugaaucucucagaaaaaaggaaagacaggaaagcucagaaacaaagagacagaaggaugaaaaagaagaagagggaggugguggggacggcgucaucccgcuggaggagcucagcucugggaugaugugguggcugguggucaaccguccgccgcaggggguggccaugaagauggagucgccggugcggggugggugcugcgggcgcugcuguuccgauggugucuuugauguugggcugaugaggucugguuccucuagcuucaccuagagauagcgacacgugggugggaugggggcagggugcucgggggccuggaggcuuccggaaggagcgcuggugcucaccuuccagagccgauuccugagucagguagugcagugguuguaaagugcagcauauucauuuccaagcuagaggguuuuguguccggauucaaaggcccaggcuugagcuggguagcaccauuucuguggauggggaaggagugaggucccacucagcuccucucgcgugccccccaccccaaguguggcaggaagccccucaccuuucauguuguggguucugggagcccagagggcagccauagugugccgacuccguggaggaaguaaagaaacagacccgcuucuugccgcagccccaccagccuaagguguucuguagaagacagaggucggggcagugagaugguggcccggcggggcggucugggcagggccgcguccugacgcagggagggcagacacgcucaccaggaaggccggacgcgccuccucuguccucgccgucacaccggaccaugucauguccugcuugucacguccaccggaccuggcgucuuggccuucggcagcuggugggcacguccaccccagcuggagaccuggcuguggggagaacgagagagucguguggggagaacguguugguuguguggggaggggcgggugggggcugaggguggcagagggggaaaaacucacccucgucuccagcccgaacgcugaggcaccgaucccggcuccgucgccgcccgcgaggcccgccuuggccacgggcucuggaggccagugccucccgcucgccgcccgcugcgcuccucaccccugccugcaccauccucccuccugagagcucauucacuccgccccgcccgccucgccuagucuggucucgccccaugcccuugacuccccuggaugcuguacugucugccaagccagccccaggggcugagcggugagggcauacagcgucaccaaguccacugugggcccucuccgcaccagacccugggccgcagugccucgugggaccggcgcccgcaggccgagccccugcagccuccuugcugcgcaaugucccggggccccccucccguggccgcuucgcccuccuggugacguccugcugcaacuccccgagcacugccugucuucccgcucuccagcccucgaggcuccggcauaggccugagaaagccgugccggagcugccccugugccugcuacuaaaugaauugcggugggugagguggcagcuggggaccccucuguccuguguccccugccaugucccugucugacccaggccugggguaccaccccacgugcuggacccuacgcuggccaccccugugcucccucccugcccucuugcucuuucugccuggaacgggcccauaaccccccagccuugcgcagucucggcuccccccgagaagaugucaccuuugcuaacucuccugcccccauccugccccucugcugggagggugucugcuucuccccgccagcccucgauccccuaaaccuccuucuuucagaaggcuggggaagcgaggccuggggagggaagggacucaccugcccggcagaugggguccucaccugcccgcugcugccagcuacaccuccguugcccaggcccugggaucaaacccugcccaccagcuccccucguccaaccagcugccacguccuguaaccaaaagugaccgggaugaaugccuggcucccccuucuuuccagcccuagcucaggcccaucguccccagcugaugucgcccugucugcacgaugccugggcgccuacuccacacuccucacuggccucaggccccaccagcccugccucgagcuagccccuccacccgucaucacuccugccagacuccagauguccaaggugcuccuuggcucccacaagcucuccuccagcaccccaucuuccccugguugccccucgguuccccacuuccccaguuucccccguuaccccccacccaucccacccccucccucacccugcuccucgguccuagcccgggcuuuuucuaacugggguggccccgcccagaauucccgccccugcccugccggccaaucagagcagggcccucccgagggcccccgcagggcccaccuccgcccuggacaguuccagcacacgucucucucacccagcacccauccuggaauucuccaaagacggccuccccgcaccccuccuuuggcauccggagacagggcugagcauugccccaucaccucccucaggguccaggacuucucccucccagaccacugucuccccucaggggacaccaugccugcugcucccugccugccagcgcccugcacauacuuugcacauggcugggggccagcugcgggucccuggggacucggauggcacagagggccccuuccugccaccaucacggcucagaccucacguuccuggagaguagggguggggugcugaggggcagagggaagugccgcaaacccccuggugggcgcggugccagccccccaggccgauucccauccaguugaccgagcuugugcuggucaccgcgguuuccgcaggacagaguccccacagccgcugggcaccccggucccauucgcggccacuuuccugucugaagaccgcauguugccgggcugugcuuacggcucgcgggcgcacucuacugacaagcggugggcggccucacagacucucccaggcccgcguggggcaccacgguugggaguggaguggagacuggcgaguuucgacucccccagccaccccgcuguggguccgucggucaccaccuuggccuuuggugaggguuguuggggcccugcagucccugggguucaccucaagucucgagugucaaagccgugaaggggagcaccagggccaagggacccagaguucacggguccaaucacccagcaggcccucugggauguggaagggcuggccgcgccuucggcaaacccucuguucccauggccccaccggaaagggcugagugcuugccugcugagcacugaccgccgggcuuugucgugcgugaaccccacgacaugggggaauuuccauggcaugaaaauucucaggcuuuuccaugaguggacccccaaguuaggagaccaaggcagacccccacauuuugcuaaaaguggaguccagccuugggucaccuucagacugugaugugagucaccacugccgccucucggccauuuccgucuccacagccacaaccgauucugugccaucgcugggagaugggcucacuggggacagcacccaagacccaaggggagacucaggaaauacuccggaaauacaaaugcuccaggcaaggcggcuccccaggccccucgcuccugcuccaggcauugugggaggggcuagcacaggauccggucgugcugccagcaaugcgcaggcacggggaacaccugugggcaaauucaccucuccacgugccaacuaccgccggccggacgugaugaucccugagcguggagcacacccgagccaucgaacauccuaaccccaucaggauccccaccccguaccgaguccacaagccgcagggugucugcugcacccacgauaauggauuaucuccagcaacacaaggauccuggaccagagaauaaagcagcaguggcgcucccagcucuuuagcaucuuaagcuccugaauuagcaccucaaaccugcauugaaugagaauguuaaugucuggccacuuagggcugaggagaucagaguguucacuggggaggcaauugucaguucaguaaaaggcuggggauuugggggcuguccuuagacggagucggagcugugcucugggauagauguggaaaauguaagauuuugguggaacacacugugaucaucacauaaguaggcgugacuugagucccaggccaugacacugaagcccucggagugugacccggggccacggggcuguggauaaugcccgaccugaagaucuggugcggcucccaugaguguccuauucccagaugacccccgugaacccugcgacgcguggcuugggugacccgggacguuuccacgggcgaaccccaguuggggcgggcucgggcugugaugugugagccugcacugccgccgcgcggccacuuccgauuccacaacuacaaccaauuccgugccauccaggcggugagaccgaaggagaagccuccagaaauacccaugugcuaugcaagagcccccgggcucugugccugccagagacccugcgagaaggguuucacacuagggccgagauccccaucauccauggaacugggacaccucauuguuccccuaguaucuccucccaucuccccaaccuucaacagugcacccuggggugaaucagacacguagcccgauauggcucccaugaguguccuauaccucacgaccccugugaacccuguggcgcccggcuuggaugaccugggauguuuccacgggcgaaccccagcuggggcgggcucaggcugugaugugugagccugcacugccgccgcgcagccaccuccgauuccacaacuacaaccaauucugugccauccgggcggugagacugaaggggaagccuccagaaauacacaugugcuaugcaagagcccccgggcucugugccugccagagacccugcaagaaggaucucacccugaggccaagauccccaucauccaaagaauggggacacuucauugucccccaaguaucuccucucaucuccccaacccucaauagugcacccuggggugaaucagacacauagcccgauguggcucccaugaauguccuaucccugaugacccccgugaacccugcggcgccuggcuugcgggacccgggacguuuccgcgggcgaaccccagcuggggcgggcucgggcugugaugugugagccugcacugccgccacgcggccacuuccgauuccacagcuacaaccaauucugcaccauccggguggugagacugaaggggaagccuccagaaauauucaugugcuaugcaagagccccugggcucuugagccugccagagacccugugggaggggucucacgcugaggccgagauccccaucauccaaagaauggggacacuucacugucccccaaguaucuccucucaucuccccaaccuucaacagugcacccuggggugaaucaggcacguagcccgauguggcucguacaaggguccuacccccgaugacccucgcgaaccaaugcggugccuggccuguugacccgggauguuucugcaggcaaaccacagguagccgggcucgggcuaugacgccugagccugcccugcuaccacguggccaccuguguuuccauaccuucaacugauuccguggcaucugggcagcgagacuccaggaacacugugcgcucugcuuggcaggcucccaggaucccuguuccugccaaaggccuugugggaaacgauucccucuggagcaugcgcuugaguccuugggucccagucaugaucaccucagaacacagggaucccucauuuuggaagucucugcucuccugucccagcuucagugccugacccaggugauacggggccaugguccucugaugagguccuugagucugauuccagcagcacagagccuccagggcagagccgaggugaggcucuggaaaaugcacugucaggcucacacaagcacauguuggccagauguacagauuccacagcacaaggcaggcaauugggcacagaccgcacagugcacaaacaccauugauccccauccuuuaucgauuccacaaaccgcgggaugucugcugcacccacauuagcagauuaucucagccaacacaaggauccuagaccccagaauaaagcagcaguggcacucccagcucuuuagcaucucaagcuccuaaauuagcaucucaaaccugcacugaaugggaauguuaaugucuggccacuuaagauugacaagcucagaguguucacuggggaggcaauugucaguucagaaaaaggcucgggauuugggggcuguccuuagucggaucugugcucugggauggauguggaaaguauaagcuuuuggcggaauuugcugugcucaucacgcggguaggcgugacuugagucccaggccaugacacugaagcccucagagugugaccuggggccacgcggccguggauauggcccgauacgaagacgugguguggcucccaugagcguccuauucccagaagaccuccgagaacccugcggcaccuggcuugggugacccaggacguuuccgcgggcgaaccccauccagggagggcuugggcugugaugugugagccugcacugccgccgcgcggccacuuuugaguccacacuuacaaccgauucugugccauccggguggugagacagaaggggaagcguccacaaauacccaugugcuacgcaagagcccccaguuucugugccugccagagacccugugggaggggccucacgcugaggccgagauccccaucauccaaagaauggggacaccucauugucaccaaaguaucucaucuccccaacccucaauagugcacccuggggugaaucagacacguagcccaauguggcucccaugaguguucuaucccucacuacccccgugaaccuugcggcaccuagcuugcgugacccgggacguuuccgcgggugaaccucagcuggggcgggcuugagcugugaugugggagccugcacugccgccgcgcggccacuuccgauuccacaacuacaaccgauucugcaccaucggggcggugagaccgaaggggaagccuccagaaauacacaugugcuaugcaagagcccccaggcucugugccugccagagacccuguaggaggggucucacgcuuaggccgagaucccuaucauccaaggaacugggacaccucauugucccccaagcaucuccuccaaucuccccaaccuucaacaaugcacccuggggugaaucaaacacauagcccgauguuagucgcaugagugucuaucucugacaacccucgggaaccaaugcggcaccuggccugggagaccugggacguuucugugggugaaccccagccaggcgugcucgggcugugaugugugagccugcacugccgccgcgcggccacuucugauuccacacguacagccgauucugcgccaucagggcagugagacgggccucccuuggugaggucagcaagaugggccgcccucggugaggcuggcauccaagacugaaugggaagccuccagaaauaccugugcgcugugcuuggcaggcucccacgaucccuguuccugcuggaggcccuguugggagggucucccucuggaccuugggcucaaguucuuugggguccaagucaugaccacugcagaacagagauuucucuuugccuccaaguauccacuguccuacgugcuaugggagcugucaucgguggugucccugggauuaggcucccagccaugcaugggcuccuagacagccccaggguucucccauugggaaaugccgcucuacuacacaucagccacagcgcauuaaugcuugguucuccuggugaaaccgccucugcaaaaauuauuacagaaaaucggccggcggugguggcucaugccuguaaucccagcaguuugggaggccgagguggguggaucaccugaggucaggaguucaagaccaaccuggccaaccugacgaaaucccaucucuacuaaaaauacaaaaauuagcugggcaugguggugggcgccuguaaucccagcuacuugggaggcugaggcaggagaaucacuggaacuccggagguggagguugcagugagccaagaucgagccauuggacuccagccuggaugauaagagcgaaacucugucucaaaaaaaaaaaaauauauaacagaaaauuaugacaaugaaagagaucugacguaaccaacucugucuugccuucuuauucauuucugggugcaggcuggacuaacuuugggaagaacuuaguuuauaguuuaucuuugaaacaaagacaauaacagcccuuucccaggacagacccucuuccugccuggggacuagacuuucaggacuaacaaauuagccacagauuagaaauuaugguuuaggagucauggagucacacaucuggaggcugaaagauuuuuaaccuccucaaauugcuccuaggauuacaucacuguugcagaaccuaagaucagugguugagauauuucgcagacccuguacuggguggaucagcuggcaccccccagauugauaaacuggcucaucuagucuuguggcccccacccaggaacugacucagcagaaaaagauggcuuugacucuccaugauuucaucucugacccaaccaaucagcacucccuauugacucgcccccuacccaccaaaugauccuuaaaaacuuugauccccaaauuuccugggagacugauuugaguaauaauaaaacucuggucuccugcacggccgacucugugugaauuaaacuuuauugcaagucaccuguugugauaaagcagcucuguccagaccggcggcagggagaaccuguugggcgguuagacggguucagacacuacucuccugggggugauggacaucucuucuguucacugauucccggaggaagauuugggagauuuugccugggagcaggcaaacaccucgggcuauuugcuuucuaauggggcauuugcauguguauaggacagaccgggagcugcccaguuucugcuuccaggcgcaccugcuaagaguagucuugccagugaagcgacugcugggguacagcagcacagcacaggggaccuaguuuuuuuuuguuuguuuuuuuguuuuuugagucucgcucuguccccuaggcuggagugcaguggcaugaucucggcucacugcaggcuccgccucccggguucacaccauucuccugccucagccucccaaguaggugggacuacaggcgcccaccaccucacccggcuaauuuuuuguauuuuuaguagagaugggguuucaccguguuagccagguuggucucgaucuccucaucuugugauccgcccgccucagccucccaaagugcugggauuacaggcgugagccaccgcacccagcaggggaccuaguuuugaggacuacuggggucgggucuggucugugcuggccacgguaauggugagugccugggugcuaugauccacacacaggguggcaccaacaugaaaguggccagagccccagccaaggugcccagagcacuuggguggggaugugggcacagcgcugucaccuggaggcagaugugggcacagugaugucacauggacagguauauaaccacagugaugucaccaagacaggacgugggcacagugcugucaccgggauaaagaugugggcacggugcugucaucuagauagacacaugagcacugugugucaccuggauagggauauggcacagugucacccggauagggacauggcacagcgugucaccuggauagggacacagguauagcgugucaccugggugggacaugggcauagcacaucaccugggugggacacggguacggcacgucaccuggauagggacacggguacggcacgucacccgggugggacacggguacggcacgucacccgggugggacacggguacggcacgucacccgggugggacacggguacggcacgucacccgggugggacacggguacggcacgucacccgggugggacacggguacggcacgucacccgggugggacacggguacggcacgucacccgggugggacacggguacggcacgucaccuggauagggacacggguacggcacaucaugcgggugggacaugaguacagcgugucauuagauagaggggcuuucucuucucucuccccuguggcugggaccuacccagauauaaguaaugggauagcccacuugggcuuugccaguucccugaggcugccauaaggaagccccagaaacugggcugauuggaacaaccacguggaaugcgucucucccuguuucgaugcuagaaggucagagucgggguggucagggcuggcuccuucuucgagcucuaagggaggcuccagugcuggccgacuuucccaguguucccaggcucccagaccugucaccccagccgugcccaucuuccaggaugcucucauccugcgccuucacgcagcguugcucucucgugccucuccucuaccugugaggacaccaugauguuugauucagggccugcccuacugcagucugaccugaucgauugcgucuauaaugacccuauuuccaaaugaguucgugcucugagaugcugguggucagggcuucaacuugucuuuucuggagaggcacuaaacagacuccaugaggaacugaggaguccagagcagugagauggaaggaggcugggcccugacccugggagcuggcgaucuucacacucaugacccucucaugucucucuccgugacagagaaaagccagcucugggcccauucaggaucguccugggguuuccuggcuguggcagcuguaccucccucucaccugugcccaccacuccagagccggugugugggcucacgcugguggcugaguccugaccgugggguaaccaagggggaggcaugaagaugaggucccgagaggagacacaggaccguucuccugaugugagcaggggugagcacagucucauaggacuguguccuuauaggaagaggagaggaggacacagacacacacggagggaugaccccgugaggacauguggagaaggcaggaucuauaagccaaggagagaggccuuggaggacccagcucugcagcagcccugaucuuggacuccagccuccaggacugggagaggauauauuucccucauuuaagccucccgguccauggcgguuuguugcggcagcccuggcagacucacccggcugcaacgugaccaguggguggaagcggccaccacauuggcaucugcuggggugcugccugggugcugcugcugcgcaugccuggugucaccgucccuggcucagccugcuggcccugggcccuaagccugcagcuccucuggguccugggccaugggugucuguggcccccuggugaggggugcuugcuccuccggauguccccuguguuuugggauuggagggguuugauuccuggggcugcugugacagugaucacagacuggguggcuuuagccauaggaauggacucucucacagcucuggagcccagagguucaccacccaggggagggcagggccgcccucuuucgcaaggcccuagcguggccccuccuugccccuucuggcuucugggggcuccagguguccugugguguguggcugcguugcuccagucucugccucugucuucacacggccuccuccacugugugucugucucugugugcaaauuucccucuuguuacaaggacgacacucauugaauggaugcuuccccccgccucaauucagugugacuuugucuuuauuugguugcacccacaaaagcccuuguccacagaagaccccacucacagguccuggguggacaugaauuuccggggacacucacagguccuggguggacaugaauuuccggggacacucacagguccuggguggacaugaauuuccagggaacauuauucagugcagcauaaagugguaagagacagauguagggcacuggacuguccacguggguucacguguggccucgugaaguccagguggcccuugccccuucccacuucuugcccaucuucuuuccugaccaccuguccugcuggcuucaggcccagccccagagccgggcaguagcgucucacagacagccuggagcuccaucuuggcagaagguccgaucccuuccaacaaagccccugcccuuugaccgugaggagguggugcuucucugauugaauccugacagagccacuucaucucagggaucacaaaauggagcaaaauaagauguucagcccaagaaggaauggagcgagaugucacgaggcugacgguuugacccaugacucugucugcugccauuuccuugacgucggugcacugacccagccgcagcugccucugcggcacccgugcaugccacuuacagggacgcgguaacagucuuuuccccacuccgugcucccuuugcaaggaagcuucaccucuguucaugccaggaggauggaucuauuuccccuccccugaaaucugggugcauuuugaccaauaaaaugcagugggauguugcucugggacuucaaagcugaccguuaagaagccuuaguuuuuuuuccccaugaaaagccacguacggcucucacugucaugagaaugccaugcugugaggaagcccaagcuagccguguggagagaguuccuagaaagggcaccagagugccagauucggagggcaaggcuacuuggaccgaccggcugagcccagcuucugguggauggcagccgcauggcggagccuggccggucacccacgggcagaagauguacccagcuaagcucugccccgaauccuggcuugcagagcugugagagcucacgucacggcucuuuuaagucacuggcuugggaguaguugcucauccagcaaggacuggugagaagcccgagccccuccacuucucugagccucacuuuucugcaccagggaguuccccugggaaucagccacaaaauaucagggaagccggcguucacgcaacuccucaccggcuggcugagggaaaggagacgggguugggacucaccuccagggcagguagaagagagacaguccuggggaaauccagguguggaguuuuagugaggcugguccuggcugucacccacguugaggacguugugcauggugugggcugggccugcugugggguuuccccucuggccugagcucacgguguggugcagccuggcgagcucuuagcugcucagaguucagaguuggaaaggggcaggauugaggcagccugccauggugggccccagaauacacacaugggaggcucuggggggucccugcggagcagcucuggcucauccugugcccgcugacacccagccugugccugccugugccccuggaccucugggugugucugagggccuuggccugucuuuggaggccuggaguuuuaauggggccgguccuggcugucagucacauugaggaugucaugcaugguguuggugacuugccaucuuggcaacacacagcuggcuccuggccucucugcugucgaccccgcagcccucuccccagccucugcugacccuacagcccuccuccccacccggucucugccggccucccccaccagcacaucucggccuggugccccugcugccggccauccagggccuguggauccagcucuuccuuuuggggugaagacugucaccuucugccacgagcccuguguucucacucaaggaccccacugguuugugaggugucuguugggcuggacacaguugcugcuuccaagcugggaacgcagugucccugggccucugucccuuccagccuuguuuucugcuggucuucucuuugggaucucucucucucucucucucguugucugugcuaacaguucuuagagacucucuucaggggacuucuccuccuccugacucugaaguccuccuguauccccacuuuccugccccugcuuccuuaggcucacgcugacaucagcaagguggccccaggacacccucuccagggcugccuucucgucucucccaaaacacucacagccucccagagccagacccuccccccucaaagacaagccaugcugucuucagguccucuuucucccacucguggacaggccccagccaggcugguccgggccaucuucuuccccaggacccccauccuccacccacaggaguggccacuaucuggaaucucagcacgccaaugccagugggaucugagccaggaaggcuggagaagucucucgguaggaaagguggcuggcccuccucuuccucgccaggcuccuaggggucgugaguagagggauguggacagaggggacaaauggcccagacuuugucuggggcucacagugcggucccagagaacaggcaccacgugggagggguguacaugucggaguggcuucgugaaggccagggcaggggcuugggcaggacaugcccugcggaggagagccccuugcucccugcuuggugagaaagggcuaucugaccaggugggguuuuaagcccuugaccgugggucugguucauagcaggagcucgagggauauuuguuggauaaaugaaaggaucaguagaugagcaaguggacugacuaaggcuuagagaaaggaggacguggccugggcuuuucaaggcacagaggacgccuuccugguccagauucaagagggagcgagggccuccuuccucccuccacgccaaucguuccuggccccuuccagaaucaucuggaagcuaauccuuuagaaaacaaauauuucagacaucucaacaacacaggcccuccaaguggggccugagcagaugggcuggggccuggaaacuaucccacacccccagacgcuggagcccaccacaccgccccagcaacguccgcgggggacgcagaccucggccaggaaagugucagagccgccggccaccugccugggcccccgcuccugggcccuguccauuccccuuggcagcuugagccauggacaggacauuccugaaggcugaggcugcacauugggggguuuggggcuggaaaggccggggcaagguccacagucacccgcggcugggccgugcggcugccucuccugccucccucccuccccaugugcaccuucccgcguggggcuggccaggaaauggggcauuugucucuguggcccuuccugcugucugugccgggcugcccaucuggucuuuaccacuaggucccuuucugcccagcauccacugcacaugguucaggcuggccaccaaggcugcacucagagucucagggacugggucaacauggcccccuguggugggguugccuccugcucgccaggcucuggggagcagcugcgcuuggcacccaacugcucccgguggagcccuuuuucccacccagcccagaagcucccugagcacggagacugucuucuuuggaccucuucuauccccagcagcagaccugggcccugucccggaacucggagcccagcacauaggggcacccagcgaugggccgagagcguucaugagccccgaguggggccagccccgccugaaaaggccaucaucacggagacaggagcagggcuggcagagagacgaggacaagggcuuggaggugggaggugggugcugccgccgggaccagugagggccagugaggaccacucucucugcacguguccuccggcccugugcauggagcccggcccacucacugggagcggaagugauugcauuguucucagauuugguccguaacagucuccagaaggauccucuacguucuccucccucuacccccagcagcuucaggagugccgagccacaaggcugcaggagccuggguccccagucgccuggaggagacccugcccacaccauacucagaccacccucccagaauggugacugugcagagaugcacgcaugucggcugcaccccgccaucuuggggugaguacagugagggaggaccacacggggggcaggagggaagggggacaccucuccacacaggagcgccugcccuguccugacacacgugcugcccuggggacaaaucauuuccucgcucccaacccuagugucucuguccauaaauaggggugggggcagagccacacuuuagugcuuuccaaugcugcgugcugcaggcaaacacagcgugcacucagauuaaacucagggagacuucccuccauggagaugggguguggcaggugcaggcugguagagggaggguggcugugggaggaaggucccggccuguguggcccugcuggucuggcagagggagggcggcuauggggaggacccugaggguggaaggucccaga

SEQ ID NO: 12616 - RNA, 28631 nt, Homo sapiens
ucugggaccuuccacccucaggguccuccccauagccgcccucccucugccagaccagcagggccacacaggccgggaccuuccucccacagccacccucccucuaccagccugcaccugccacaccccaucuccauggagggaagucucccugaguuuaaucugagugcacgcuguguuugccugcagcacgcagcauuggaaagcacuaaaguguggcucugcccccaccccuauuuauggacagagacacuaggguugggagcgaggaaaugauuuguccccagggcagcacgugugucaggacagggcaggcgcuccuguguggagaggugucccccuucccuccugccccccgugugguccucccucacuguacucaccccaagauggcggggugcagccgacaugcgugcaucucugcacagucaccauucugggaggguggucugaguauggugugggcagggucuccuccaggcgacuggggacccaggcuccugcagccuuguggcucggcacuccugaagcugcuggggguagagggaggagaacguagaggauccuucuggagacuguuacggaccaaaucugagaacaaugcaaucacuuccgcucccagugagugggccgggcuccaugcacagggccggaggacacgugcagagagagugguccucacuggcccucacuggucccggcggcagcacccaccucccaccuccaagcccuuguccucgucucucugccagcccugcuccugucuccgugaugauggccuuuucaggcggggcuggccccacucggggcucaugaacgcucucggcccaucgcugggugccccuaugugcugggcuccgaguuccgggacagggcccaggucugcugcuggggauagaagagguccaaagaagacagucuccgugcucagggagcuucugggcugggugggaaaaagggcuccaccgggagcaguugggugccaagcgcagcugcuccccagagccuggcgagcaggaggcaaccccaccacagggggccauguugacccagucccugagacucugagugcagccuugguggccagccugaaccaugugcaguggaugcugggcagaaagggaccuagugguaaagaccagaugggcagcccggcacagacagcaggaagggccacagagacaaaugccccauuuccuggccagccccacgcgggaaggugcacauggggagggagggaggcaggagaggcagccgcacggcccagccgcgggugacuguggaccuugccccggccuuuccagccccaaaccccccaaugugcagccucagccuucaggaauguccuguccauggcucaagcugccaaggggaauggacagggcccaggagcgggggcccaggcagguggccggcggcucugacacuuuccuggccgaggucugcgucccccgcggacguugcuggggcgguguggugggcuccagcgucugggggugugggauaguuuccaggccccagcccaucugcucaggccccacuuggagggccuguguuguugagaugucugaaauauuuguuuucuaaaggauuagcuuccagaugauucuggaaggggccaggaacgauuggcguggagggaggaaggaggcccucgcucccucuugaaucuggaccaggaaggcguccucugugccuugaaaagcccaggccacguccuccuuucucuaagccuuagucaguccacuugcucaucuacugauccuuucauuuauccaacaaauaucccucgagcuccugcuaugaaccagacccacggucaagggcuuaaaaccccaccuggucagauagcccuuucucaccaagcagggagcaaggggcucuccuccgcagggcauguccugcccaagccccugcccuggccuucacgaagccacuccgacauguacaccccucccacguggugccuguucucugggaccgcacugugagccccagacaaagucugggccauuuguccccucuguccacaucccucuacucacgaccccuaggagccuggcgaggaagaggagggccagccaccuuuccuaccgagagacuucuccagccuuccuggcucagaucccacuggcauuggcgugcugagauuccagauaguggccacuccuguggguggaggauggggguccuggggaagaagauggcccggaccagccuggcuggggccuguccacgagugggagaaagaggaccugaagacagcauggcuugucuuugaggggggagggucuggcucugggaggcugugaguguuuugggagagacgagaaggcagcccuggagaggguguccuggggccaccuugcugaugucagcgugagccuaaggaagcaggggcaggaaaguggggauacaggaggacuucagagucaggaggaggagaaguccccugaagagagucucuaagaacuguuagcacagacaacgagagagagagagagagagaucccaaagagaagaccagcagaaaacaaggcuggaagggacagaggcccagggacacugcguucccagcuuggaagcagcaacuguguccagcccaacagacaccucacaaaccagugggguccuugagugagaacacagggcucguggcagaaggugacagucuucaccccaaaaggaagagcuggauccacaggcccuggauggccggcagcaggggcaccaggccgagaugugcuggugggggaggccggcagagaccggguggggaggagggcuguagggucagcagaggcuggggagagggcugcggggucgacagcagagaggccaggagccagcuguguguugccaagauggcaagucaccaacaccaugcaugacauccucaaugugacugacagccaggaccggccccauuaaaacuccaggccuccaaagacaggccaaggcccucagacacacccagagguccaggggcacaggcaggcacaggcugggugucagcgggcacaggaugagccagagcugcuccgcagggaccccccagagccucccauguguguauucuggggcccaccauggcaggcugccucaauccugccccuuuccaacucugaacucugagcagcuaagagcucgccaggcugcaccacaccgugagcucaggccagaggggaaaccccacagcaggcccagcccacaccaugcacaacguccucaacgugggugacagccaggaccagccucacuaaaacuccacaccuggauuuccccaggacugucucucuucuaccugcccuggaggugagucccaaccccgucuccuuucccucagccagccggugaggaguugcgugaacgccggcuucccugauauuuuguggcugauucccaggggaacucccuggugcagaaaagugaggcucagagaaguggaggggcucgggcuucucaccaguccuugcuggaugagcaacuacucccaagccagugacuuaaaagagccgugacgugagcucucacagcucugcaagccaggauucggggcagagcuuagcuggguacaucuucugcccgugggugaccggccaggcuccgccaugcggcugccauccaccagaagcugggcucagccggucgguccaaguagccuugcccuccgaaucuggcacucuggugcccuuucuaggaacucucuccacacggcuagcuugggcuuccucacagcauggcauucucaugacagugagagccguacguggcuuuucauggggaaaaaaaacuaaggcuucuuaacggucagcuuugaagucccagagcaacaucccacugcauuuuauuggucaaaaugcacccagauuucaggggaggggaaauagauccauccuccuggcaugaacagaggugaagcuuccuugcaaagggagcacggaguggggaaaagacuguuaccgcgucccuguaaguggcaugcacgggugccgcagaggcagcugcggcugggucagugcaccgacgucaaggaaauggcagcagacagagucaugggucaaaccgucagccucgugacaucucgcuccauuccuucuugggcugaacaucuuauuuugcuccauuuugugaucccugagaugaaguggcucugucaggauucaaucagagaagcaccaccuccucacggucaaagggcaggggcuuuguuggaagggaucggaccuucugccaagauggagcuccaggcugucugugagacgcuacugcccggcucuggggcugggccugaagccagcaggacagguggucaggaaagaagaugggcaagaagugggaaggggcaagggccaccuggacuucacgaggccacacgugaacccacguggacaguccagugcccuacaucugucucuuaccacuuuaugcugcacugaauaauguucccuggaaauucauguccacccaggaccugugaguguccccggaaauucauguccacccaggaccugugaguguccccggaaauucauguccacccaggaccugugaguggggucuucuguggacaagggcuuuugugggugcaaccaaauaaagacaaagucacacugaauugaggcggggggaagcauccauucaaugagugucguccuuguaacaagagggaaauuugcacacagagacagacacacaguggaggaggccgugugaagacagaggcagagacuggagcaacgcagccacacaccacaggacaccuggagcccccagaagccagaaggggcaaggaggggccacgcuagggccuugcgaaagagggcggcccugcccuccccuggguggugaaccucugggcuccagagcugugagagaguccauuccuauggcuaaagccacccagucugugaucacugucacagcagccccaggaaucaaaccccuccaaucccaaaacacaggggacauccggaggagcaagcaccccucaccagggggccacagacacccauggcccaggacccagaggagcugcaggcuuagggcccagggccagcaggcugagccagggacggugacaccaggcaugcgcagcagcagcacccaggcagcaccccagcagaugccaaugugguggccgcuuccacccacuggucacguugcagccgggugagucugccagggcugccgcaacaaaccgccauggaccgggaggcuuaaaugagggaaauauauccucucccaguccuggaggcuggaguccaagaucagggcugcugcagagcuggguccuccaaggccucucuccuuggcuuauagauccugccuucuccacauguccucacggggucaucccuccgugugugucuguguccuccucuccucuuccuauaaggacacaguccuaugagacugugcucaccccugcucacaucaggagaacgguccugugucuccucucgggaccucaucuucaugccucccccuugguuaccccacggucaggacucagccaccagcgugagcccacacaccggcucuggaguggugggcacaggugagagggagguacagcugccacagccaggaaaccccaggacgauccugaaugggcccagagcuggcuuuucucugucacggagagagacaugagagggucaugagugugaagaucgccagcucccagggucagggcccagccuccuuccaucucacugcucuggacuccucaguuccucauggagucuguuuagugccucuccagaaaagacaaguugaagcccugaccaccagcaucucagagcacgaacucauuuggaaauagggucauuauagacgcaaucgaucaggucagacugcaguagggcaggcccugaaucaaacaucaugguguccucacagguagaggagaggcacgagagagcaacgcugcgugaaggcgcaggaugagagcauccuggaagaugggcacggcuggggugacaggucugggagccugggaacacugggaaagucggccagcacuggagccucccuuagagcucgaagaaggagccagcccugaccaccccgacucugaccuucuagcaucgaaacagggagagacgcauuccacgugguuguuccaaucagcccaguuucuggggcuuccuuauggcagccucagggaacuggcaaagcccaagugggcuaucccauuacuuauaucuggguaggucccagccacaggggagagagaagagaaagccccucuaucuaaugacacgcuguacucaugucccacccgcaugaugugccguacccgugucccuauccaggugacgugccguacccgugucccacccgggugacgugccguacccgugucccacccgggugacgugccguacccgugucccacccgggugacgugccguacccgugucccacccgggugacgugccguacccgugucccacccgggugacgugccguacccgugucccacccgggugacgugccguacccgugucccacccgggugacgugccguacccgugucccuauccaggugacgugccguacccgugucccacccaggugaugugcuaugcccaugucccacccaggugacacgcuauaccugugucccuauccaggugacacgcugugccaugucccuauccgggugacacugugccauaucccuauccaggugacacacagugcucaugugucuaucuagaugacagcaccgugcccacaucuuuaucccggugacagcacugugcccacguccugucuuggugacaucacugugguuauauaccuguccaugugacaucacugugcccacaucugccuccaggugacagcgcugugcccacauccccacccaagugcucugggcaccuuggcuggggcucuggccacuuucauguuggugccacccuguguguggaucauagcacccaggcacucaccauuaccguggccagcacagaccagacccgaccccaguaguccucaaaacuagguccccugcugggugcgguggcucacgccuguaaucccagcacuuugggaggcugaggcgggcggaucacaagaugaggagaucgagaccaaccuggcuaacacggugaaaccccaucucuacuaaaaauacaaaaaauuagccgggugagguggugggcgccuguagucccaccuacuugggaggcugaggcaggagaauggugugaacccgggaggcggagccugcagugagccgagaucaugccacugcacuccagccuaggggacagagcgagacucaaaaaacaaaaaaacaaacaaaaaaaaacuagguccccugugcugugcugcuguaccccagcagucgcuucacuggcaagacuacucuuagcaggugcgccuggaagcagaaacugggcagcucccggucuguccuauacacaugcaaaugccccauuagaaagcaaauagcccgagguguuugccugcucccaggcaaaaucucccaaaucuuccuccgggaaucagugaacagaagagauguccaucacccccaggagaguagugucugaacccgucuaaccgcccaacagguucucccugccgccggucuggacagagcugcuuuaucacaacaggugacuugcaauaaaguuuaauucacacagagucggccgugcaggagaccagaguuuuauuauuacucaaaucagucucccaggaaauuuggggaucaaaguuuuuaaggaucauuugguggguagggggcgagucaauagggagugcugauugguugggucagagaugaaaucauggagagucaaagccaucuuuuucugcugagucaguuccugggugggggccacaagacuagaugagccaguuuaucaaucuggggggugccagcugauccacccaguacagggucugcgaaauaucucaaccacugaucuuagguucugcaacagugauguaauccuaggagcaauuugaggagguuaaaaaucuuucagccuccagaugugugacuccaugacuccuaaaccauaauuucuaaucuguggcuaauuuguuaguccugaaagucuaguccccaggcaggaagagggucuguccugggaaagggcuguuauugucuuuguuucaaagauaaacuauaaacuaaguucuucccaaaguuaguccagccugcacccagaaaugaauaagaaggcaagacagaguugguuacgucagaucucuuucauugucauaauuuucuguuauauauuuuuuuuuuuuugagacagaguuucgcucuuaucauccaggcuggaguccaauggcucgaucuuggcucacugcaaccuccaccuccggaguuccagugauucuccugccucagccucccaaguagcugggauuacaggcgcccaccaccaugcccagcuaauuuuuguauuuuuaguagagaugggauuucgucagguuggccagguuggucuugaacuccugaccucaggugauccacccaccucggccucccaaacugcugggauuacaggcaugagccaccaccgccggccgauuuucuguaauaauuuuugcagaggcgguuucaccaggagaaccaagcauuaaugcgcuguggcugauguguaguagagcggcauuucccaaugggagaacccuggggcugucuaggagcccaugcauggcugggagccuaaucccagggacaccaccgaugacagcucccauagcacguaggacaguggauacuuggaggcaaagagaaaucucuguucugcaguggucaugacuuggaccccaaagaacuugagcccaagguccagagggagacccucccaacagggccuccagcaggaacagggaucgugggagccugccaagcacagcgcacagguauuucuggaggcuucccauucagucuuggaugccagccucaccgagggcggcccaucuugcugaccucaccaagggaggcccgucucacugcccugauggcgcagaaucggcuguacguguggaaucagaaguggccgcgcggcggcagugcaggcucacacaucacagcccgagcacgccuggcugggguucacccacagaaacgucccaggucucccaggccaggugccgcauugguucccgaggguugucagagauagacacucaugcgacuaacaucgggcuauguguuugauucaccccagggugcauuguugaagguuggggagauuggaggagaugcuugggggacaaugaggugucccaguuccuuggaugauagggaucucggccuaagcgugagaccccuccuacagggucucuggcaggcacagagccugggggcucuugcauagcacauguguauuucuggaggcuuccccuucggucucaccgccccgauggugcagaaucgguuguaguuguggaaucggaaguggccgcgcggcggcagugcaggcucccacaucacagcucaagcccgccccagcugagguucacccgcggaaacgucccgggucacgcaagcuaggugccgcaagguucacggggguagugagggauagaacacucaugggagccacauugggcuacgugucugauucaccccagggugcacuauugaggguuggggagaugagauacuuuggugacaaugagguguccccauucuuuggaugauggggaucucggccucagcgugaggccccucccacagggucucuggcaggcacagaaacugggggcucuugcguagcacauggguauuuguggacgcuuccccuucugucucaccacccggauggcacagaaucgguuguaaguguggacucaaaaguggccgcgcggcggcagugcaggcucacacaucacagcccaagcccucccuggaugggguucgcccgcggaaacguccugggucacccaagccaggugccgcaggguucucggaggucuucugggaauaggacgcucaugggagccacaccacgucuucguaucgggccauauccacggccgcguggccccaggucacacucugagggcuucagugucauggccugggacucaagucacgccuacccgcgugaugagcacagcaaauuccgccaaaagcuuauacuuuccacauccaucccagagcacagauccgacuaaggacagcccccaaaucccgagccuuuuucugaacugacaauugccuccccagugaacacucugagcuugucaaucuuaaguggccagacauuaacauucccauucagugcagguuugagaugcuaauuuaggagcuugagaugcuaaagagcugggagugccacugcugcuuuauucuggggucuaggauccuuguguuggcugagauaaucugcuaaugugggugcagcagacaucccgcgguuuguggaaucgauaaaggauggggaucaaugguguuugugcacugugcggucugugcccaauugccugccuugugcuguggaaucuguacaucuggccaacaugugcuugugugagccugacagugcauuuuccagagccucaccucggcucugcccuggaggcucugugcugcuggaaucagacucaaggaccucaucagaggaccauggccccguaucaccugggucaggcacugaagcugggacaggagagcagagacuuccaaaaugagggaucccuguguucugaggugaucaugacugggacccaaggacucaagcgcaugcuccagagggaaucguuucccacaaggccuuuggcaggaacagggauccugggagccugccaagcagagcgcacaguguuccuggagucucgcugcccagaugccacggaaucaguugaagguauggaaacacagguggccacgugguagcagggcaggcucaggcgucauagcccgagcccggcuaccugugguuugccugcagaaacaucccgggucaacaggccaggcaccgcauugguucgcgagggucaucggggguaggacccuuguacgagccacaucgggcuacgugccugauucaccccagggugcacuguugaagguuggggagaugagaggagauacuugggggacagugaaguguccccauucuuuggaugauggggaucucggccucagcgugagaccccucccacagggucucuggcaggcucaagagcccaggggcucuugcauagcacaugaauauuucuggaggcuuccccuucagucucaccacccggauggugcagaauugguuguagcuguggaaucggaaguggccgcguggcggcagugcaggcucacacaucacagcccgagcccgccccagcugggguucgcccgcggaaacgucccgggucccgcaagccaggcgccgcaggguucacgggggucaucagggauaggacauucaugggagccacaucgggcuaugugucugauucaccccagggugcacuauugaggguuggggagaugagaggagauacuugggggacaaugaaguguccccauucuuuggaugauggggaucuuggccucagggugagauccuucuugcagggucucuggcaggcacagagcccgggggcucuugcauagcacauguguauuucuggaggcuuccccuucagucucaccgcccggauggcacagaauugguuguaguuguggaaucggagguggcugcgcggcggcagugcaggcucacacaucacagccugagcccgccccagcugggguucgcccguggaaacaucccaggucauccaagccgggcgccacaggguucacaggggucgugagguauaggacacucaugggagccauaucgggcuacgugucugauucaccccagggugcacuguugaagguuggggagaugggaggagauacuaggggaacaaugaggugucccaguuccauggaugauggggaucucggcccuagugugaaacccuucucgcagggucucuggcaggcacagagcccgggggcucuugcauagcacauggguauuucuggaggcuucuccuucggucucaccgccuggauggcacggaauugguuguaguuguggaaucggaaguggccgcgcggcggcagugcaggcucacacaucacagcccgagcccgccccaacugggguucgcccguggaaacgucccgggucacccaagccacgcgucgcaggguucacgggggucaucugggaauaggacacucaugggagccgcaccagaucuucaggucgggcauuauccacagccccguggccccgggucacacuccgagggcuucagugucauggccugggacucaagucacgccuacuuaugugaugaucacaguguguuccaccaaaaucuuacauuuuccacaucuaucccagagcacagcuccgacuccgucuaaggacagcccccaaauccccagccuuuuacugaacugacaauugccuccccagugaacacucugaucuccucagcccuaaguggccagacauuaacauucucauucaaugcagguuugaggugcuaauucaggagcuuaagaugcuaaagagcugggagcgccacugcugcuuuauucucugguccaggauccuuguguugcuggagauaauccauuaucgugggugcagcagacacccugcggcuuguggacucgguacgggguggggauccugaugggguuaggauguucgauggcucgggugugcuccacgcucagggaucaucacguccggccggcgguaguuggcacguggagaggugaauuugcccacagguguuccccgugccugcgcauugcuggcagcacgaccggauccugugcuagccccucccacaaugccuggagcaggagcgaggggccuggggagccgccuugccuggagcauuuguauuuccggaguauuuccugagucuccccuugggucuugggugcuguccccagugagcccaucucccagcgauggcacagaaucgguuguggcuguggagacggaaauggccgagaggcggcaguggugacucacaucacagucugaaggugacccaaggcuggacuccacuuuuagcaaaaugugggggucugccuuggucuccuaacuuggggguccacucauggaaaagccugagaauuuucaugccauggaaauucccccaugucgugggguucacgcacgacaaagcccggcggucagugcucagcaggcaagcacucagcccuuuccgguggggccaugggaacagaggguuugccgaaggcgcggccagcccuuccacaucccagagggccugcugggugauuggacccgugaacucugggucccuuggcccuggugcuccccuucacggcuuugacacucgagacuugaggugaaccccagggacugcagggccccaacaacccucaccaaaggccaagguggugaccgacggacccacagcgggguggcugggggagucgaaacucgccagucuccacuccacucccaaccguggugccccacgcgggccugggagagucugugaggccgcccaccgcuugucaguagagugcgcccgcgagccguaagcacagcccggcaacaugcggucuucagacaggaaaguggccgcgaaugggaccggggugcccagcggcuguggggacucuguccugcggaaaccgcggugaccagcacaagcucggucaacuggaugggaaucggccuggggggcuggcaccgcgcccaccaggggguuugcggcacuucccucugccccucagcaccccaccccuacucuccaggaacgugaggucugagccgugaugguggcaggaaggggcccucugugccauccgaguccccagggacccgcagcuggcccccagccaugugcaaaguaugugcagggcgcuggcaggcagggagcagcaggcaugguguccccugaggggagacaguggucugggagggagaaguccuggacccugagggaggugauggggcaaugcucagcccugucuccggaugccaaaggaggggugcggggaggccgucuuuggagaauuccaggaugggugcugggugagagagacgugugcuggaacuguccagggcggaggugggcccugcgggggcccucgggagggcccugcucugauuggccggcagggcaggggcgggaauucugggcggggccaccccaguuagaaaaagcccgggcuaggaccgaggagcagggugagggagggggugggaugggugggggguaacgggggaaacuggggaaguggggaaccgaggggcaaccaggggaagauggggugcuggaggagagcuugugggagccaaggagcaccuuggacaucuggagucuggcaggagugaugacggguggaggggcuagcucgaggcagggcugguggggccugaggccagugaggaguguggaguaggcgcccaggcaucgugcagacagggcgacaucagcuggggacgaugggccugagcuagggcuggaaagaagggggagccaggcauucaucccggucacuuuugguuacaggacguggcagcugguuggacgaggggagcuggugggcaggguuugaucccagggccugggcaacggagguguagcuggcagcagcgggcaggugaggaccccaucugccgggcaggugagucccuucccuccccaggccucgcuuccccagccuucugaaagaaggagguuuaggggaucgagggcuggcggggagaagcagacacccucccagcagaggggcaggaugggggcaggagaguuagcaaaggugacaucuucucggggggagccgagacugcgcaaggcugggggguuaugggcccguuccaggcagaaagagcaagagggcagggagggagcacagggguggccagcguaggguccagcacguggggugguaccccaggccugggucagacagggacauggcaggggacacaggacagagggguccccagcugccaccucacccaccgcaauucauuuaguagcaggcacaggggcagcuccggcacggcuuucucaggccuaugccggagccucgagggcuggagagcgggaagacaggcagugcucggggaguugcagcaggacgucaccaggagggcgaagcggccacgggaggggggccccgggacauugcgcagcaaggaggcugcaggggcucggccugcgggcgccggucccacgaggcacugcggcccagggucuggugcggagagggcccacaguggacuuggugacgcuguaugcccucaccgcucagccccuggggcuggcuuggcagacaguacagcauccaggggagucaagggcauggggcgagaccagacuaggcgaggcgggcggggcggagugaaugagcucucaggagggaggauggugcaggcaggggugaggagcgcagcgggcggcgagcgggaggcacuggccuccagagcccguggccaaggcgggccucgcgggcggcgacggagccgggaucggugccucagcguucgggcuggagacgagggugaguuuuucccccucugccacccucagcccccacccgccccuccccacacaaccaacacguucuccccacacgacucucucguucuccccacagccaggucuccagcugggguggacgugcccaccagcugccgaaggccaagacgccagguccgguggacgugacaagcaggacaugacaugguccggugugacggcgaggacagaggaggcgcguccggccuuccuggugagcgugucugcccucccugcgucaggacgcggcccugcccagaccgccccgccgggccaccaucucacugccccgaccucugucuucuacagaacaccuuaggcugguggggcugcggcaagaagcgggucuguuucuuuacuuccuccacggagucggcacacuauggcugcccucugggcucccagaacccacaacaugaaaggugaggggcuuccugccacacuugggguggggggcacgcgagaggagcugagugggaccucacuccuuccccauccacagaaauggugcuacccagcucaagccugggccuuugaauccggacacaaaacccucuagcuuggaaaugaauaugcugcacuuuacaaccacugcacuaccugacucaggaaucggcucuggaaggugagcaccagcgcuccuuccggaagccuccaggcccccgagcacccugcccccaucccacccacgugucgcuaucucuaggugaagcuagaggaaccagaccucaucagcccaacaucaaagacaccaucggaacagcagcgcccgcagcacccaccccgcaccggcgacuccaucuucauggccacccccugcggcggacgguugaccaccagccaccacaucaucccagagcugagcuccuccagcgggaugacgccguccccaccaccucccucuucuucuuuuucauccuucugucucuuuguuucugagcuuuccugucuuuccuuuuuucugagagauucaaagccuccacgacucuguuucccccgucccuucugaauuuaauuugcacuaagucauuugcacugguuggaguuguggagacggccuugagucucaguacgagugugcgugagugugagccaccuuggcaagugccugugcagggcccggccgcccuccaucugggccgggugacugggcgccggcugugugcccgaggccucacccugcccucgccuagucuggaagcuccgaccgacaucacggagcagccuucaagcauuccauuacgccccaucucgcucugugccccuccccaccagggcuucagcaggagcccuggacucaucaucaauaaacacuguuacagcaauuugucucgaggacucuggaauccgggcugugggcaugaugugggggaggccagccuugggcagaggggggcuggggggcauggggaggaguacaugaaaagggggauggggguuccagggugggggauucugggaugggugcagcgcagcacacaccagggguggggugagcacaggguguguggaccucaggggugcagggcaggcggucagcaugcagugauggcaguggaggggcugugggaccaggggcuucacagacugggcgggggcugggcuugcggagggggccugcgcucugaggcaggggucggggaccaccaaaccauccccgagcgagugccuccugucgccccaaagucccaucagaaugacgccuuggugcuggccccagaccccugaagcccgggcuaggugacugggguagagcuggccauggccgcucugggaggcccacaaggugcucugggcgaccccaccccgacaggggcacgaaccccgcgccagucccguuccugcuccccuuuugcugugggugggagccggggccacgccggagggacggccccgcacaaggagccaggggguugugggggagccggugggcuucucagugggcagguggccuuggggcagagguccuaaggaggccaggggaccaggaggagggaggaagaaguugaggguggccacagggaggaggugaggaggagcgggagggcccagggugaggggcucccgggcucccuccccggggucuugcugcuggagcuccaagaaccccgguaugcagggguucgcuccccaggugccaaggcagcccacucauggguuccgggucagcuuccccgcagaggccaguggccggcagcucccucagccaggccucccagcucccggccccucgcugugcaggcgcugggaacacaaggggcagccccuggaaauaaggguggggucccggccuccccauuccuuccccccuccccccugccuuccacccccauucccagugcacagagcugucaggaaaauuccuccccgacugacaaagaacagacaggaaggcgguuagggacgccccuccccuaccggcccagccgcccuuggggucuugguguccagggcggaagagcagggugguuccccacgucccuugggucuggccuccccucugcacccucucuugcccccuccccauccagcugugggcccuggggacugucagagaccgagggguuuccagggacacacuugugugcuaaaaccugggcggguggucaccccccaggaugcauguagacauccggugagggagucucuugaagucucugggauggugccccugggacuggcugccaucucauggaggaggucagaggucgcuggggccagcccagggugaggccgcauucaucuuccugacccuacaggccaauuugacuuacccaaguggguuuuggccggcaggaugaaguaacccauccauuacaugucaagaguuaggucuauaaacggccuuuauuauaaacauccaacucugcaggagguuuacaaagcagggcucaggagauaaaagccggcuuccccagguggcggcugcagggugcggcaggcagccccaggggugcccaggguggcggggcaggggaaccguagggagggggagaggggcacccagaaaaccucuccuggagaacauggaagacucugcccacuucaaaucccugccuggggaaggacacaugggaauggggccgggggaaaaggcgggccaccucgggccuucgucaccugugucagcuccuagggauugucuccuccuggucacuuggagagaacaggcgugcuggacacguccacaucucugggcccgggguguaugaaugacacgcuugcucuggaguuuccaccugggagcuguauggggacagggcuguuccuccucacacccgcuggggaagggacacaggccucuugguggcccccaccaucucccagcacugcccauggcugugcccacgcuggcugcccccugagagcaggacguguacucaggggcagcgccuaccucugggcagcccagguuucucugcucccugcagcggaacgggcuuccuagggcaguuccugggguggugucccuagggcagccccugagugcuggagggggucugggccacaggcccugaaacagggagguggugggggcagcguucagggggcugaaccucagggugaggcgggcaggcggggagccacaggcccgggggccccgcagcaggugcucagccucggagccuccugccgcaccccggggcgggggcugggagcccgcccgagccccuagcucugagcgaccugccagguuggaauguguguuuaucuuuggcccaacccgauuuccugcuuuuuagaaaaggggcuuagagaggguuguuagacaggcuccaggcaccccaacacccaaaggcacuuugaaaacgccccugcacugacuucagugcggagaagcaaacgggcuggaauuucacucccaaaccccaacauggggguggcggggccggggugaggguuguggcugccugcaaaggugccaggaaaucuggggagggaggaacuuccaccguucagggagacccugagggugcccuggcuucuggccacgucccagacccuguuaggcaccgaggucuucacacccagacccuccacccacccaaguuucugcggcacguuuagguugagugaagaccaagucauccaguuagagaagaggacuugaggcgcgugcugcugcuguggccacgcuggacccucggugcacgcaucuccuggcgaguccccuguggcucugugggccguacacacccggggcacgcgaccucagcuaccuugucaccgaggacgugcauccacagcugugcgucugugccugggagcggggucuccacuuggugggucucugcaugcugaccaguuaacccgccuuuccgggcuguggagggcguggguccuguccggcccggagaugcuccgcggggugugugugugaucguggcccuguagcggggugguguucccuggaggguggaccccugagccuggcuguguguggcugugucucagcaugaauuccgugacccaggagcacguuuucaggcagggauuaggggcagcugggugugggaggcaggcacuugguauaccaccgaauggagacagaaaaucccaacucuacgaaggaagugaagucccuucaacagggacaaagcgauguuuugggucugacuacaaugcacccugggaagucucaaagaaaacagucggggacucaaggagggcagcccccucuccccgaccccgagcucccaggaagauaaaugauuuccuccucucuagagaugggggugggaucugagcacucagagccaagggcgcaguggguccgggcgggggcccuccucggcccucccaacaugggggccaggaggucagccccucaaccuggaccccggcugggucucagggaauggucucccccaguggcccagcuugcuuguguuuucagaugggugugcacgggugugugugugugugugugugugugugugugugugugugaugccugacaagccccagagagccaaagaccugaguggagaucuugugacuucucaaaagggggauuggaagguucgagaaggagcuguggucagccuugcucucccuuaaggcugugguaaccacacuaggcauagcauaggccugcgccccgucccuccuucccuccuccgcgccucuccuuucucuuucuccccccucuaccccgcucccuggccugcuccuggugacaccguuggcccccuuccagggcugagggaagccagcgggggccccuuccuggaagcccaccugcaggccggcuugcugggaaggggcugcucucgcagaggcucccgcccgcccugcagccguuuccuggaagcagucgcuguggguauucuguuccuugucagcacugugcuugcaaagaaagcagacacugugcuccuuguccuuagggagccccgcuccaucacccaacaccuggcuggacacaggcgggaggccggguccgcggggagcggcgcggggcuggggccggaccaguaaacacacacgggcgccaggcacugcaggcuccuccuccuccuccugcccagcgccucugcucacaggcacgugccaagccccuaggccaggaggcccagcagugggugcagagcaagcuccugggaagggggugcagggcggacccccggggagaagggcuggcagggcugugggggacgcugaccgugggccccacguugcagaaaacuggcugccuggcuggaagaugggggagaugccaagccucugaggcagcacgagcagggugcauggaggccggggcgcggggaggcugcacugcagcaugcaccccaaagcccagagggaguggagaccaggcccuggaaucgagaaguagaaaggcggcuuggaggccucggaaccggcugaccuccaacagaguggggccggcccuggaggcaaagaggugcccgggguccggcccugccugggggagcuaugugucaugggcagccacaggauauguagccagcucugagcauauggacccagggcagggcugcaaggcagggcaggggagacagacgggggagcaaggagcagagagggggccucaggcucucccaggaggaacauucucccgacaggaggaagagacggcccaggggugacuguggggagccaugguggcagcuggggucguggcagaugggagagaggcuggcgaggugaaggugcaggggucagggcucuggggcccacaugccugugggagcgggcaggcccagggcucuccgccacuccccacucccgcuuggcucauaggcugggcccaaggguggggugggaugagcaggagauggggcccagggggcaagcagggccccaaagacauuuagaaaaaccgguuuaugcaggcagcauucagagcaggcggcgugcguggcgggggcccugggagcacagagaggcacacguagggcccccgagggucuccccauuggccggcagugacaucaccccugugucaacagugaugucugcagcuccggccagccaggguuuauggagcgagacccagcccggccugggcccucacuccccaggcccacacacuagcccacuguucaggguccgggguggcagcauggccuggggguccuggcaccgcugcuccucugcccacccuaacuucccggcauggcggcugcccccucugagcguccccaaccaguaaguguggggccagcaggccugccguccuccuccucuucccucuagagagaaacguggagguccuggggcugggggcgcucauagcccugugacacaggugcauggggucaggggucccagaauggccccugggaaggaccucagcugggccggcggcucuaggcuucaggggucugucugcacaggggcuagccccucccagaccucugugaagccaguacgggccuccccucccugccccgugcucuguccggugcuuccuggacugcacugcgggccacuggugagaggguggacagggaagggccgccguggugccuguuccugcccaccuggcugugugguccccuccaaguagggacaacccuucugagggcuugggggcacccugggguugccagggccucccagagcccugugagccccuggggggucuggccugaugccccccuccacguccagggccggcuguggcccagaaccccagcuucccagcaggccggugugcgguggugacccaggagaggccucaccuccacugaggggccaccgaccucugccaggccacagagacccccaaggagucugaaggcuggagacccggggcugggaccaggugggacuuucccacggagccgcccccaggcccagcuggggacacgucccccuucucuccagacacacccugccugccaccacgacacaccggccuguugggggucucuuuuaagugcuugccacucugaggugacugucccuuuccaaagagguuucuggggcccaggugggaugcgucggccugagcaggaggaucugggccgccaggggcuggggacugucuccuggggaaggaagcgccugggagcgugugugcugacccaggaccauccagggaggcccgucuguggggcaagcgggaagggagcggcuggagaggcuuggccgcccccgcccugccucccauuccuuagcuccaugccugucaaccucugucacccagugagugauguccaggggcccuggaaaggucacagcauguuugagcggggugagagagaggggaaaggcgggggcggggaaaaguacguggaggaagcucuaggcccaaggaaggagaaaggguucugggagggagggagccacuggggccgccgggaaggucccugccugcugcugccacccagaacccucgccucuuagcuagcccccgcagccccagccuuucuggccugugccccucucccccauccccagcuguccugugcaaccaggccuuggacccaaacccuccugcccccuccucucccuccucacccucccaaugcaguggucuccagccuggcucugcccugccgcagguccccuccccucauuccaggccuagagccuccagucccgguggcccccagcccgagggugaacggccucacccugggucgugggacagagggcacguucaucaagaguggcucccaagggacacguggcuguuugcaguucacaggaagcauucgagauaaggagcuuguuuucccagugggcacggagccagcaggggggcuguggggcagcccagggucaaggccaggcuguggggcugcagcugccuugggccccacucccaggccuuugcgggaggugggaggcgggaggcggcagcugcacaguggccccaggcgaggcucucagccccagucgcucuccgggugggcagcccaagagggucuggcugagccucccacaucugggacuccaucacccaacaacuuaauuaaggcugaauuucacguguccugugacuuggguagacaaagccccuguccaaaggggcagccagccuaaggcaguggggacggcguggguggcgggcgacgggggagauggacaacaggaccgagggugugcgggcgaugggggagauggacaacaggaccgagggugugcgggcgaugggggagauggacaacaggaccgagggugugcgggacacgcaugucacucaugcacgccaauggggggcgugggaggcuggggagcagacagacugggcugggcugggcgggaaggacgggcagaugggaucccaaggacauggaauuucggaccuucuguccccgcccucucugcugagccuaggaaccucugagcagcaggaaggccuugggucuagagccuagaaauggacccccacguccaccugcccagccuagacccccagcauugaaggguggucagacuuccugugagaggaagccacuaagcgggauggacaccaucgcccacuccacccggcccugcccagcccugcccaguccagcccaguccagcccagcccugcccuucccagcccugcccagcccagcucaucccugcccuacccagcccagcccuguccugcccugcccagcccagcccagcccagcccugcccugcccugcccugcccuucccagcccugaccuucccagcccugcccagcccagcucaucccugcccuacccagcucagcccugcccugcccugcccagcccugcccagcccagcccugcccugcccugcccagcucagcccugcccaccccagcccagcccagcccagcaugccuucucuggcuggagagcacaggcuugaccuuagaaagaggcuggcaacgagggcugaggccaccaggccacugggugcucacgggucagacaagcccagagccugcuccccugccacgggucggggcugucaccgccagcaugcuguggaugugcauggccucagggcugcuggcuccaggcugcccccgcccuggcucccgaggccaccccucuuaugccaugaacccugugccacacccaccucugagcuguccccgcuccugccgccugcacccccugagcagcccccuguguguuucaugggagucuuagcaaggaaggggagcucuucaaucuugccagucagggugcugucugcugaguaaguguccccgugcugugccccaauguccccauccuuuggcaaacagccaucagccuguggauccugcacucccaugcggugggagagggagaccugggcucaccugagccuccccacaagccagggagaggggcugcccaauggcgggaggcccccauggaucccaaacggcaguugcccgcacuccuacccaggaacuuugucugugaugaacaguaaggaauaaggaagcgggugagaaagaaggaaggaaaggcgguggggggcauggcggggggcggggaggguguuuggaaaguuccagaaaagagucacuucaccagaaaggccacaagcuccccgugcccccagccccugcucggcuccgaggugaaggacuuggagcgucgacgcuggcguggggaccagcuguucuccuugaguuuguuuccuucaguuccuuccgggccucacccuccucuuccugccacacacacacuuuuuuccuuuuuaaauuguuuuauuuggggccaggugugguggcucacaccuguaaucucaguauuuuagaaggccaaggugggcagauugcuugaguccaggaguuggagaccagccugggcaacauagugagaccccaucucuaccaaauaucagccaggugcggcggcgcgcaccuguauucccagcuaugugggagacugaggugagaggaucacgugagcccaggagguugaggcugcagcaagccaugaucauaccacugcacuccagccugggcaagagagugacacccugucucaaaaaaaaaaaaaaguagaaaaauuuauuuuaaaaaauuguuuuaacauuugagugcugcaacuguccaaggaggagcagacggcccgugucagacagccugaagccugacugucugcgaucaacggccccguggccagcugugugcagcaguuuggccuggccugaugccucuguccuuggcaccagcucacagcccgugcccauaacagaccuggggcaccgaaggaagggcagauccagcccccaccugcccugggucugaagaucucccaggaggcuccauggggugccuugagugggaggggcuggccgauagccuugaggaauuggcacggacaugcagagaggggcaugucccaaacucggggcgcuguggccuccagcugccaggagguagauguguucugacuucuggguucccaccaccagaacugcaggggauaugaagcaagcuggacuuggggagacaucucugcucgagugcacguuggccugaugacgacugcucuuggguucacggguuccaggcucugcccgggagccucaugcaaacuggucccguucuacagacgaggaaacugaggcacagagugauuacggcugucccugagcuccugcagccaguaaggugauacaccaggauguguucccagguuguccgcugggcucaguaacacagucucaacugcccugugacacugcgugucugugcuuguggggaaggugaccagaggcccccuuuccuccacgcggugagccuaccagcaaggagacaguccucaggugugaggaugagccucguaguaggcacagagaaacaggaggaaccuucuggaaggugaagccucccacggcugggacucuuggagaagggcggaucucuguccacuccugcccacuccccagcacagacagagcaagcaggacagagggcccaacgucccaggauacugcagagcucaaaggagggcagagagcaucgccccacaugggcgccgggagaaaggugggcggggugcucaggggccccuggccguccugaaguuugccucagagaggugugggcuucuccucccucccauacacagugucucugaggaugaacugccaugugcccggcggggaugccgucccuggcccuugcugagugccucugggacgaggucagcugagccugccauccuaacucagacaccaucucacucuccaagucccuucucggugagacggggggccuugcacccaccucccagcccccacacaccugaggggguccccguuccccuaccccguggcuccaccacgccccacgcauccuaccugagggacagaggggacugugagaugccccccacaggcugguuuuccucuuucacccauaacaggcccagcaaauucucaccuccagaggccaggucugccccgcaggucuuaggaaauacagcccuacuuccauccagcacaccaacccaaggaagugccucggagcccuggggcccgaggggggccuggccuuggucucacggcggcagcuccaccuggagaggagugaacucaagccaggacgccccgucuccacagcggaaaccguguugccggcugcucccuccuggggacucugggccugagguuccugugggaguuggggggauagcugaguccuauggaggugccccucuccuccccgcccaguggagcuugggguggggacaggcgaagacagggugagaagcacggggcauucccccuccacacagcgcugagaaaguaagggagcauccagaaaacggugcccacuuccgcgucaggcggauaucacgggcaccagcuccaggugacccuagcccagccagagaacaaggaccagguugugccgcaaagcccguguccgcucccucccgccugggaccacuguggcgaggggaagggagcgugguggcccucuccugacuccugaggccugaaguccaagcucccggcccucaggcaggccagggucuagacaccgcugccccaaacacaccccccaguccccgcccgcaggcuuccugcaggaucccccagugcaccugggggcugaggagagugagcagggcgcaaagaagcuucgucgggagggcgguccccacccgccuuggacccccggggauaguguccuggggccugggcucagaugcacccugggaggaauggugcggaggcuguuuuuugcuccaagaggacauugccucagcagagggcugccgagcugggaggacccacagugcaaggccgcagaacccccuaggaagccucagagccuucagguuccgggcugaggcugugggcguggacccuugugcaaaccccacuggaagaaaaaccuuacagcucaggaggaggaggggccccacccgcucccagagcccguaaacgagggguggugcccacaugaggccuggggaagggcuggggcugggacacccccucaccacccccagauaccccaggcagccccucccuccacagagagacccacugggccugacccugcccugggcacagggucgagccagggacggcccgugggagaaagacggcuucaugggccgcuggccgggccaggugcguccuuccccaguucuaggu

SEQ ID NO: 12617 - RNA, 33876 nt, Homo sapiens
cugaaagaagagacgacucagcccugagccagccacaccugaugggguccugcuggggcaccacagaagcccuuccucgccacugcccagugguggguucagcggcggagacuggccuguucugggagacagagaagggaggccgcacacaggauacuggccucccuccuccaagccgcccuccuuccuugagggaucuuccaagcuccaggugguguuuccugggccugagugggggagaugccugguggaggaggcguagaggggaagggaggggcaccagggccagagcaauggcccagaggggacacacacagggcagccuccuggucgcacccugaguaaccccggccugccccucacucgccggcugcggucucagucuucuuaccuggcggguggggcugguaagcacagagccugccccugacacauggggagcauuuagggagacacacacagagggcucucgguacgcccagccccaugagcgggagaaaugugaugcgaaagcccuaccuucacacccagagucuggggaggcaggagagcugggcagcaggcuggguccuccaccugcguaguucaaaacuguacccucaagcaagcccucaggccugaccuggggcaguagggagaccccagguggggucuagagcuggugccagaggguccuaagccucagaacagcuugcccuuggccucaggucagcagugaggaguggaggcaaacccuagggcugccucucugaguggcuuucugagcuggccaggguugggcaggaggagggugaggcugcuuccauuucaccugcacccagagcuguaccugguagaggaaggaagagaugacugugcugaggccgggaacugccuggaagacacaggcccacaaacaucucuggccucagccuugggaggcaagauggcguggguacugccugaccacaggaggacuugggggcacuggggugagcaaccccacggcccugcuauucuccgcagccugacaucaugccaucagggcaauggacuccuuguuggcugucugugccuccagcugugagucugcaguugcccgucugcuacguggccaaugcccagcacaguggcuaaccuggggcacucaagaacaauggaacgaccaucaacaggucccugucuuucucaguuggccaucaauuaaaaugcggagaauagcucuacuuuugaggaugaagugauagaacagauguacagcagguagcacagggugacacccugucuguggaaacuucuggagugaaggcuggcuuguaaggacuaagacuugccagauagcagguucauuagaugugauggaagguaagagagauggggacugcuaacacccagaauucuggugucaacaacugaggggcugggaugguuauuccuugagaugggaggaagagcuucacaugcuaguggauaaacugagcaggcauuggaucuacgugcccaaucucaagagggcgaaacaagaguuccacguuugggagucuucaggacauaugccaucaucaaagcugugguguggaagaguucauccagggggugaaguuggaggaagggaaggauagaggaagcccaggccaggaugaggccagugcuuaauggaagggagagcaacaaggaaaacaaaaugacgggacaguaaaacuggaccaaguggccacaggagccaaagggauagcacauuucaggguuuaaggaauguuauuccauugucuuccagcccccaugguuucugaccagaagucuguggcaauucaauucaccauucccugcuauguggugccuuguucucuucuuucaagauuuucuuuuuuaauuuucauuuuuauccauuugacuuugaugagccuaggcaugauuuucuucaaacugauccuauucagauuuuguuucuucaaauugauccuauucagauuuugaugaacuucuugaauccauaaguuuauguuuuuaaaaucaauuugagaacuuuuucaucauuauuucuuuaauauuuuuuuuucugcuccauuugcucucuccuccccuucuggaacuccaauuuccuauauauuaauuuuugggguuuuuuuuucuuuugagauggagucucacucugucacccaggcuggagugcaguagugugaucuuggcucccugcaaccuccaccuccuggguucaagugcuucuccugccucagccucccgaguagcugggauuacaggcacgugccaccaugccuggcuaauuuuuguaguuuugguagagaugggguuucaccauguuggccaggcugcucuugaacuccugaccucaagugaucugccugccucagccacccgaagugcugggaauacaggugugagccacugcaccuggccaucuguuaaguuuuuaacacuauucacauguacuugagucucuuuucauguuuuuaaagccuuuucucucucucucauuuucguauugaguugaauaacuucuauugcucugucuucaaguucacagacuuucuucuguccucucuacacuacugauccuuucauccaguauuuuguuuuuuacuaauuucagagaguguauuuuucaguucaaaacaucaauuuagauauuuuuaaauauuuucuacuggucugcugaaauuuccugucauuucauucacugaaaguguauuuuucuuuaucuucaugggcauaguuauaauagaggccuuguuugaugauuccaacaucauggcuggccucagucaauugucuucccuugagaagaaaauaccgguuucuggcccugacauaugucauacaguuugggauggccuccuggacuuugugaauauuauguuguuggagacucugaaauguccuguauuugucuggagagcacugaugcauuuguuuuagcaggcaauuaacuugauuagcugccaguugcaaagagucucaccugaggugacaggagucccagucucaguucagauugcuuucugccccauaccagaaaccagggcagauuugacacauaaaaggcccuucucuagccuuuuuugagagucucaucucacucuccagcgacuuugauugccuccagcuccuuuccugcuuccucuggccauaauaauggcaggacuucuuuuaauccccucuuuuuuucacagguguugaacauggcaggcauucuauuggaauuauagauacccacaccauacccugacuaccccaucaaaaucuaccugcuuuugcuaacuuucuagaguccuugguaguuucuguuuguuugugauucgggguuuacaguuguuaugugcaggagugcugguuuguuaaaguuugcuacuccauacuagaaggagaaccaagagaaguuuccgaguggggagugagagcaagcgggugagcaggaaaaggcugcugaguggucaagucuaauaaaaaaaaaagggugcccugaauuuggcuacaagaagguuggugguugucgugaaaaguccucucagugggugaggagauagcaggaaacugaggacuagguaucuucucuuauguugaggaaguuucuuuuuaguccuagccugcucaacacgguuuauaacugguagugcauuuuagauuuuauuacauacguuuuuggcacuucucaauauuaucauaugguuuuucuuccuuuggcuuauuagcaucaugauauuaauggauuucuucauguugagucauccuugcguuccuggaaacaaacucuacuuggucaugguguguuauuacuuuaauuuaauacacugcuggauuuaauuugcuaauucucuuauugacaauuuuugcaucuuucuuuacaugugaccuuggacugugguuuuuccuuuuuugugccauuguguuugaguuuuguuaaucaggguuaugcuaacaccaaaaaugaauagaaaccguguccaucuucuacacuugaaacauuuuguauaguacaggcaugaucuugaguguuuaaaaaacuuucccguggaacacucugggcccugugccuuuuucugggguagcaucuuguaacccucaguugacaaccugguaauugguauguucagauuuucagauuuuucuuuuucuuuuuuuuuuuuuuuuugagacagagucucgcucugucacccaggcuggagugcagugguaugaucucagcucacugcaaccuccgccucccggguucaagcgauccuccugccucagcuuccugaguagcugggauuacaggcgugcgccaccacauccggcuaauuuuuauauuuuuaguagagacaggguuucaccaaguugaucagguuggucucgaacuccugaccucaugauccgccugccuugaccucccaaagugcugggauuacaggcgugagccacugagcccggccgauauguucagauuuuucuagguccucuugagacaauuuccagguauauguucacuuaaacaagaccuuuacauuucauuuuuaaaauuccuuuuaauaucauucccaauaaauuucauuuaaucgacaaauaucuuuuaaucucuaugauguguuggauccuaaaaacaggauauauucaaccugaaucaacacauagaaucucuauaagcacagacauacaauggauuacagucucuuugcucucuucccucacaaggaucaugucagaagagaauccagguagacacuuguugaccuacagcugacuugcaccuauccacacauccauuuauccauccauacauccauucacccacacacacaucuauucacccauccaucacccacccacuccaucaucuaccuauccauacaucuacccaucugcccaucugcuuauccauccaccaacccacccauccauucauggagcccacauugaagguccaaggcugagaaauauaagcuaaguggcuggaagaccaaacugauacuuuaaauggccuccacaggcuaaaaccauggacagaauagaacaagauaagacgauguucugggauccagggaagaucugagugaauaauuuacaaggugcuagccgggccccuccucagcccugcuguuuguuacauuuauguugaugugccacuuccuagaguuguuuugagggcaggaauggaacuuuauccaucuucaugauucuagggcuuuguacagggccuggcauauguguauugaacagaugaugaaggcaggaaggaccagagugucguggaaggucccgcacagagcccggaacaugggacauguggccgcugagggcugggugcuggggaggguugcggcugcuugcuucaacaccacagagggcuccaguguagauuucuuucccucccacaaagcucugagcccagguccaggggugggggaaaccccuguggucucagcccgcucccaccugcuggggccggccagcccucagccacugcagcgccacggagcaucaggagaggccucgaaagucuuccuccccacagugcugcugagcuggggccagggaccaggcuggggcguauccuaggccccguccucggcaggagaaaggugggggugggcacugcuugucuucucccccacuaccuccaccgacucugcagagaaccaauuugccuuaucagaaauucccgagaguggcuggcuaaaccaaauagcuaggauuccugcucagaggcacaucuguuccugauagacgggaggccagggacgacaaggcaggggaagggaagcagagguacucggccagaccuucccgaagugaugcucccagccaggcgggggagccagccagccugagagugggcagaccuggguugcccccagggccugaggcaggaggagcucccugcuccccauacuccccccagcugaggagccagggucugcauuugguggggcugggggcaggguggaaaugaccccauccgugcaugcgugcgaugcugcugggccacaccgagcuccucccagcuggggugccucccugcgcccggcccagcaccaccccuuccaccccacccaccccacccgcuagugcaccuccaaacccucucaggcuccaggaguucccacacuuagaccaucucuccagaauugauggcuagaguggcucacucuccccuuaaaagccccuccccgccucccagagcucacugaaggucaaguucagcuucuuggcucagcaccgaggcccuuugagcugcagccaucucccuccaugugugcacaccugugccugcacaugcgguucccugugccuagaacgcccuucccacccacguccugccaaugcccacgcuccuguccgaccccgcgggaggagcaccccugucugcauggucuuucucagccccagaccuccaggugccuuugccucaccccgcucacaccaccagguccccuuggcccaggaauuccuucuucugaagcccuggcuccccagcaccaggagcaggcauagccaagugcgcgaacaaagaaugaagacugggaggaggcgaucaggagagggcaguggaggaggcuggaaggagagaggggcaauucuggcucuccgaggacuccgaggaggacuccgaggaggccuggggaaggugaagguuugcaccacuuuucuguccccugggagagccaggcacgugggaacagucugaagauggggaggggccuguucuugcuuccagucauggcaccuuggggucccaccugcccccuaccacugggcuccaacaugugccugcaccccccucccucaaugcagucuggggccacccuccuccacacccaccaccccacugacaccgccacucuggggcugcaggcuuucaagggcagaggcauccccaucucugugugcuccacggccgagcugagucagggggucucaggcuuuggacaaucaaggagggaggaggcgagaggauggagugcaguagaggggguggguagguaauagguccugucacccugagggucuaagcaccugucuaugugaaggggguacugaaaggcagacuuggagagggguucccuggagggagcggcugcaggcggccgcucuccugccauccuucccuguguagccugugcaggcagcauggaguccccacuccaacucccagauggacaugcaccccgguacccccaacccccaagacacaucucauucagccaucccccagaggaagcaagccccacccucgcuccaggucuguggugcgguccccucuccccggccucagcagccccuuccaccgaggaggagcccagcacggagggcacggcacuggggagagggccgggcuggcggccggaaugugccgcggccaguguaaacagaucauuucugucugccuuggggggagggcugggagcggggagggaguugucuugggcuuuguuauguucugaaaaaaaaaggcaaaaaauuugggucacaaaccacaaacuguuuugcuuucggcaugacuggcauaaacaggcauuuucucuuugguuucaggccggcugaggccugggcuggcuggggcugggagccgggggacaggcuggagacuacacucugagccuggggcugcagccccggccugggccagaggggagugggcagggccaggggcccagcugagaagguggagaccaggcuugagggguggggcugucagccugugggugccagcccuggccuggccgcaccugugugggagcugggaagagcggggacccugggggccagacccagagggacagguuccuccaggaugaggccugcugagcgggccggugggcaaccucagcaaggaugccuggcagcugggucuccccggcaagcuaacccggggggcagggggcaagcuaaccuggggggcagggggcaggggccaagcuaacccaggggcaggggccaagcuaacccggggggcaggggccaagcuaacccaggggcaggggccaaucuaacccggggggcaggggacaagcuaacccggggggcaggggacaagcuaacccaggggcagggggcaagcuaacccagggguagggggcaagggggaagcuaacacaggggcaggggacaagcuaacccggggagcagggaguuagccauugguggggugccagagucccucgaggcacccuccagggccuucugucugaccccucuggucugggagccccagacagagccccagggauccuggagaggacuugccagcaggcgucuugggaccaugguuagcagugucucuggcggaugguggggggcucaaugccagaacaaacaggaagggagaccagggaggccagacuccugggggucaggauggcacaguacagcagagggcgugcgugaguuaccaggacaagggugauaccagagggccugggcaagagggcagcaggugcagccugggacugggaguggaggggugggugggaggaccagggauggggccaggugcuggaaagccuggccagggccuggauuugccaguggcccacgggauucacggagggcucuaaguggagagaggcagacucuggccccacugcucuggucccauauggagcauggccagaggggcuggcucuacaggaggcuggacagcagcaggggccagggccugguggaguccguggaucuccucaacuaacucaaugugaggugugguggagggcagugguggaccggcagacgcaugcugggugaggggucugcaggacauccuggaggagugaagcuggccacagcaggugccauuggaaguguguccucuucauucucagagcguuugugggacagguccacacgggcugccauugugcagaggaauuccaaggcagacuccaugccgagggugcaaccacgccaagaugaccugggcaaaggucugcaggggaaggggucuaggcaggggcaacccaaccugggaccacuguggcugggcaggugucauagcggugguggugauggguagugugggucagguggccucaugggucaucaugaggguguugcuugucaccaaggaaauaagguaccacugcuggacuaugaaccgagcugugccacgaggccacgugggugcugcguggagguuggguuaggguuaggguuagguuaggcuggagugcagugucuguucacaggugccaucgcagcucacuauaaccuuggacuccugggcucaagugauccuccuggcucagccuccuggguagcugggauuacagguucgagucacugcacaugacgggacagaccuuucugagggccacaauucaccccauggccucagggucccauggugucuguugaacaaacggcauggccuaugcagcccaggccaucugccccccauuacagcucugaccucagcccccuacacaggcccuccaccucuuccugcugcagcucccaccaacccaaacccccgacuuccugcuguggcucaaacacucccagaccacucauguuuuaucccugugaggaagaacgcucuuucuggaugcuucauacuccuuccucagcuccuuccagucucugcccccacgccaacuucuccaugaggccucagcuccguccagucucugcccccacgccaacuucuccaugaggccugucuugcuuaaaagagcaccgaacaccuuucgcuuucuucccuccaugacgcugagcuuaucucuuggcugaaaguccagcauguggguagugccuguccauguguuuguauacguggaugaguggguggguggauggaggagugaguggauggauggaugagugggugagugagagucaaguggguagauggacagaugaguagacagaugacuggggguggauggagggcgaguggauagauggaugagugggugaguggguagauggauagaugaauagaugaauagauagaugacuggguggguggauggagggugaguggauggauggaugagugggugaguggguaagugggugaauggguagacggauagauggauagaugacuggguggguggauggagggugagugguuggauggaugagugggcgagugagagguaagugggugaguggauagauggauagaugaauagauagaugacuggguggguggauggagggugaguggauggauggaugagugggcaagugagagguaagugggugaguggguagauggauagaugaauagauagaugaguggguggguggauggagggugaguggauggauggaugagugggcgagugagagguaaguggguagauggacagaugaguagacagaugacugggggguggauggagggcgaguggauggauggaugagugggugagugagaguuaaguggguagauggacagaugaguagacagaugacugggggguggauggagggcgaguggauggauggaugagugggugagcggguaagugggugaguggguagauggauagauggauagauagaugaguggguggauggauggagggugaguggauggauggaugagugggugagugggugaguggguagauggauagaugaauagaugaauagauagaugacuggguggguggauggagggugaguggauggauggaugagugggugagcggguaagugggugaauggguagauggauagauggauagaugacuggguggguggauggagggugagugguuggauggaugagugggcgagugagagguaagugggugaguggauagauggauagaugaauagauagaugacuggguggguggauggagggugaguggauggauggaugagugggugaguggguaagugggugaguggguagauggauagaugaauagauagaugaguggguggguggauggagggugaguggauggauggaugagugggcgagugagagguaagugggugaguggguggauggacagaugaauagauagaugacugggugaguggauggagggugaguggauggauggaugagugggugagugagaguuaaguggguggauggacaggugaguagauagaugaguggguggguggauggagggugcguggauggauggaugagugggugagugaguggguaagugggugaauggguagauggauagaugacuggguggguggaugggagggugaguggauggauggaugagugggugaguuuguggguaagugggugaguggguggaugaugagugggcgaguggguagauggauagaugaguggauggguagaugggagggugaguggauggauggaugagugcgugagugaguggauaagugggugagugggugggugggauggaugaauagguggauggaugggugaguggauggguggguggguggacuguuggguggacgaauagauggguggauggaugagugggugagacuggguaagugggugaguggguagaugggauggaugaauagauggaugaauggguggauggguggagggguaaguaaauggaugaaugagugggugagugaguaguaggugggguguuuguggaugggauggaugaauagguggaugggugggugaguggaugguuggguggguggaugaauagaugggugaaugggugcgugggugagugagugggugaguggguggaagaauagauggaugaguggguggguggauggaggggugaguaaauggauggaugagugggugagugagugguaaguggguggaugggauggauaaauaggugaauggguggauggugaguggaugguuuggugggcagauggaccaguggauggaugaguuggugaaugaguggguaaguggauggguggagggauggguggauggauggguggagggaugggugguuggaugguuggauggauggguggagggauggguggauggauggguggagggauggguggauggauggguggcuggauggguaggggauggguggagggaugaguggauggaugaguggagggauggguggagggaugguuggauggauggguggauggauggguggagggauggguggagggaugaguggauggaugaguggagggauggguggagggauggguggauggauggggggauggauggguggagggauggguggggggauggauggguggagggauggggggauggauggguggagggauggagaguuggagcugccaggaugaacugagaauuugcaaagcagggagaggggagaagagagggcccugcagucucagaagcccuggaaugaggcugggcccagugaagcaggaugaaggcugggcagcccugagugggugucaagagaccaggcuaaacccgggggaaccagggugaguggcuuugcccaguucugcagagaggucagggaaggucacaagggguccggggaagcagagggcaggcaggcugcaagugaaaggaaagaagcugcacagaagcuccuggcugugggcaagaguggcugagcaggcccagggugcggggagagccaguguggaagugaccuggggccaguggggacaggagcaggagggcccaggcucauggggcuggaggcugggcccugaagcagacccagagaggaagcgagaccaugaggccggcccugcgugggccugggggacugcagggcugggggaggggcacagggcagagcugccugggcuugcagggaaagcaacuccaccuggccucaggaagguggacaggacuaggcuuccaucuacaucuacagaagggccucagagcagccccgacccccugggggucagcaaugccaccugggcccuggacccuccagcuuagaccuagcacugaggugcagagccagggaccagcucaggaagggcauggugccccccauauccaaucugcucuucuccaacccccagcccuccucaucuucaaggcuaaucccuccuccuccaggcaacuccccaaaccaccgcccacccucucccuucccuuggagugguucucagauggugugggcagugacacuguccguguagacguguccccaggccucagaggcuugggugacagcccagcacccuccagugcccggcacaggagaaaugcuagggacagaggcagccaucaagggacagggcuugaccaggggcagacccugggggccaggaugcaagcacgcccccaacccagucaggccccuccccaccgccugcccagcacugaaggcugcagggcccugggcacacuucugggcuccuucuguggcgccccugucccuccauccccacagcaggcggggcacaggcagauccacugcccaaggcugcuggaaaguuccuggagggggauggagagaagaggcugggccaggcucccagcagcccagccuaccccuccucccaugcucagggacccuugaaagcuagaggccagcacccuugggacagguggguacaggcugagcccuggcaggaggcagugguacuaaugacaucugggcagccucaaccuuggaagggggcugagucccugggugagaguggcccugagcccccaucuccagccacagauacgguuuccagaaccuuuuagagguugcccagccccaguccucuaaggcuguuggugggggaggcauucccuggaguugguacugaugguacuuugcuuuuucucugaaaaagccccccaggcuccuacccuucguggcacccccaucuuugagaacuuggugccugacacugucccagacccccuggcuucaggugcacgacagugagucugagagucuggcuuccagcucucucauuucuccauguaugugaucaggggacggagagagguguccacaccccuaaggccuuccuuccccuucccucuucuaucccccucugccugcuuccaggugcucagccccuucccucccucuggcaguccaguacccaagucagagaguggaacacucagaagaucaugacuuuuaaugcuuuauugggauugcaagcguuacaagguuaaagacaaaacccaagcaugggauuuugccggaaauauuagcguuaaaggaguugaguugagucaaacacgggccgcaagguggaccgaggcggcaggcacaggugacauucaguguuuggcgugggggucuucaggugauggcagaggaggggacccaagagggggccccccacugaagacauuggggacacggggaggagacaagauggagagccacgacuaggcacggaggucagacaggcagcccgggccaggaugguuaguggcccaggggagagcugcaaaccuggggacgcaaggggcuggucggcaagugcccccgggaacacccacuccggcgaggcagaauauaacacuggguggguggguguccugacgaaugggcagguaauuuggggugccucgaagcguuuuggaucucaggccaauguggguuccacaauugugacaauuuggcucuuugggcuucuguccaauguuccgaauggcccacucacagggcgcuugccgagggacccucugcgacugaggcggacuggcauggacgacccccggggucaugccagccccgucaccaggacccagaagccucaggccucuagacugcuagucgggcugcgugcaggggggcugagcugggggcacaagugggggcgagguaaaccucccagaggccgagucccugccgcagcccuaggcgccgcggugguggcugcuauggcaucaccagacccgugggcuccggggcccaagcaaccuggucgaugggcagaccuggcagcucuccugcucugugggcucagacccgccugaccucccuacuccccggccucaccccaccuugcccccaagaggucccacagagcuucggaccuccuggagacaaggcagggugcugaggggcgggcaagaugucaccgagggagaggggaggguuccucaagugugcggaaggcggccacccugccccagccugauggaacccucuguuuacacaccugcuagccccuuccccuccggccagccucaggccagccaggagcccccuccuguggccuccgagcacccuccugacaccugaggagacccugcccaaccccccccuccgcccucaggacuucuggggaccagccacuguccccagaagccaggccggacaguggccuucuccacuccccucugacuucuccaagggggcucaguggccagugccccccaggaggcuccacccucaacucaacccaagcaacagggacagaugaaaaacaaaauccaaucagggcgauaaauggcggggggcaggacgugguggucuccaggcuggcuucgugcguucuugcuuuugucacugccccccuguuacaugggggggggguuuaauuugguuucugagcgcauaaagcuaaggagggguaaaaaaaaaacaaaaaaaaaaaaaaaaggaaaaaugccccaagaaacaaagagggggaauagaucaauugacaugaaauuuggggguuccuaauuucucuauguaauucugcaagucugcugucaauccuccugacuuuuccauccaaaaucucccgggaccacuuccuaccccagaacuccccccgcccagcccccacugccccccacccaccccuccaaccgccagacuucccacacuccccgcaucagugcacggcccccgaggacuccacauuucuugggggguccccaggagacgggcaaagaugaucccuaggugugcuccgguggggggguccccaagaucuuccuuccaggagcacaccagggagucaggcuacucgugggggcaugucugcucagcuaccgccaucuccaauguggccaaacuccuuccucacucuggcugggccaacacacaguaaguaagguguaucgggaaugggugggguauggggagcaucguggcucacgcugcgggggccguggggacaggcgccaaggaggccagccucacaagggcaucucugucaugguggaaagauggaauuaggccugggacacaccccgcccacccuacggguguaucccaaaugccgccggccgcacacucaggccgcaccaucugagcccccuccucugagaggcagggcacagacagggccgaggggcaguggagaugggaacaggagcggggcucagaccaugaaaacauuggagaaucuuagcgggacuuuggccugauccauacagauaucguaguugcuuagauaugcuuauuguuuucauccaauuuugugggggugugcgugugugugcgcaugugugugugcaggugggugcuugcgugugcaacgugugugcugcguguuugugugcugugagcuguguucauguaugugcugcgcaugagugugugugcugugugugcaugugugugcuguguguuugugugugugcuguguucaugugugcugugcaugcgugugugcugugugugcaugugugugcugugugcuguguucaugugugugcugugugugcgugugcugugugcaugugugugcuguguuugugugugugcugugugugcuguguucgugugugcuguguucgcgugugugugcugugugugcaugugugugcugugucuuugugugugugcugugugcuagugugugugcugugugugcaugugugugcgugugcugugcguuugugugcugugugcucgugugugugcugugugugcgugugugcugugcguuugugugugcugugcguuugugugugugcugugugugcaugugugugcgugugugugccgugcguuugugugcugugugugcaugugugugcgugugugugcugugcguuugugugugugcugugugcucaucugugugcugugugugcugugcguuugugugugugcugugcucgugugugugcuguguucaugcgugugcuguguguuguguguguguagcugcggggaugcauaaaguaugagugcuuuuuaggaugggaauugagauguaagauuugggggugagggucgugccaauuacauuucauuugcauggauuuugguuuucaugcucuguccuccccuccuuuggucuuacugggucccucugacugcucugugauuuuuagugauggaaaagggagugaggagccagucuggguuguugcuauuuucggauggccaguuuacccugaaaauucccgugagaagggagauggcgguagcagcgacgugcccaccugugauuucugggguccuucuuuucucuuugcugguucagggacucaaguccaggccaauuugacucaaaguccaagggagaagagaaagagggggguggggagugccaaauuccuuuauuuugccaauuguuucucagccaauucguuuuuaauacuuuuuuuuuuuagccaauugauuuuuuuuggugguuguuuuuuuuaaagccaauuucugagcuuuugugggguguuucuaaaaagccaauuaguuuuaagaggguuguugugggggggggggaaggggguuaguuuaauguuuugauuuuuuauguguggggauaauuggggauaauuuggggggaggguaugugaaggguguuuaaagccaaucgauuuuguacauguuugaagaugcugcugugcuuccucagcccgauggagggggccgaggagaguagccuguuucggggaggcggggcacggggacugggucaggagaagccccagggggacguggaaccgagagauuuucgggauggaaccugauggaaacguccguggucaggaggaggcugcaggaugguggcgccgggcugcagacuugcggcaguuuugcucacuuccgauugcuggccaucucugggggggcgcccccgugggcggggucuuggguggguagagcaaucaggggacggugacguuuggccucccugaacgccucgagcuccuuggcgagcacgugaccccggcgggcacgcaggagggcaggcaggccccugcgcaggcgcuggguggacugcuuccaggugucauauuggaagaacuugcccacgggguaucuggggaaguuguccugggaggggaaggggcuggucagcaggugccugcucuccacgcucuuccgccugagccgcccgccugaccugacaggccaccccugugacugaucagugacuugagcuaauguccacgggcagagggacagaaggagccagcgucugagcugcucccgggccacacagcaagcaaggaagucacggguccuugucccuggccaagaggucccagaggccacaggaaacgcugggcgcccgaagcccuauuucucugucucuagagagugggaaaggggcccaggacccucaccggaagcacggucggaggggucgacacgucccucucggacuuggcggggguagcacaguacgucuccaggagggccaggucacagcugcggaaacagcacuccucaacgaugccacggcugcgacggcucacacggcuugcgggccugccuggaagucccacagcacagagagagccguguuagcaccgcacugaccccagcccccggaggcugaagggggagcaaaccaccccugcccucaggccaggcccuggaaggacgcagccacccugcgggucaggggagggaagugagagcuggcaggcagaggcgucccaggaagaagagaggugagaggggaggugagugggacccagaccagcccguggccucugcugccuccuuccucagaugaaaaaugggcacaagcucuuggucccacaaccagagggacaccaccaggaccaaaggcucacaaugggagugguuuggaaaaugugugggaugugagcccaguucaggggcccccacaggagggacugcugucccugagcuuggacucuggccuggcaccaccuaggaggcuggaggggcccacaccaccccuggagcugcugagacagggagacaagggcaggagaggagaagacgggaggagaggagugaggaggcgugauggaaccacucccuucuuuccucccgucuucccccucucccccacagcaaugcucagcuggaaggggaaggucgcugggggcuccaccuuggggugccaaagggcaggugccaucagccggaggagggagcaggagccccaucacgggggucccccaagugggggcuuggcccuccccuccucucaggaaagccuggugcagggaagcuucucccugggcaaggacuggcuggcaccaggcccugcagugccacuuccuacccccaaauggggcaggcaagagagagggcacaggagaggccagggcgggcaggggcuuccagagucaagcagcaggaacuuuucagagagaagcuuugaagugcauuugcauccugugagcccauuucacagcgugaguaagcaguggugguaaagaugucacguggugagugucagguggaauaagccgugcggccucugccaguaaggagcggccccuccccugccccaucaggcaugcccaggcaccaugccugccucugcauccacccagccccccuaucuggggguggggucucaaggacaaugggccaugcacccaccugccagcccccaggcuggagaaccaagagagaaacaugaggaaaggcugaagcguccuugaggucagcaggugggcaccccccacggcagccuuggggcccaaggaggcgcaugcaccgcucaccccugccacccaccaacugcacuugucuuauugauuuuaauuauauaaaucacuuuauugauuuuaauucugaucauucaccgaacgcacgucccuugucagaauguccaaaaggugcaggaagaaaggcaggcucuuccuccagagccugaagcccugcacuaggcgugcggugccucaggagcaggagccucacggcccccaacagaaauucugaugcccagggagaccccugugagugccccugacgucuagggggcaccucuggcccacccuucgaaggaggcgugugaugggaaaggcagcugguguggaugcccugggacaccgcacgugcucagaaacgcggcgggaaggucaaagucucagagcaagcggcugggcugcugaccuaggagugugcuccccuggcuugagguugggcguccucaccggucacucuaggggccugaccaggucugaggaagccccucccagcuacuuacugaaguagaagccgcgguccccacagacgaacuggaggguguccaccagcuccccgccgcacagggucucacuggggcgguaagcagcaaugcagcacgaggcgaaggccaagaaggugagaagcaccagcaucgacuuccccauugggauucccauuggugucugggggcgggagagaaguggcgugagcggggcagccaggccaagccccaggccagaggugccccucccaaaccaaauuugccaaccuacaaauucaguugaaaauugaaagcacggcuuuccuauaaacauuauuuuuauuacaaaaguaacacacaggucauaaugccgaggugagggcgcagggccaugugcagaaugaagcguccagaagcacacagaaaaggcccaguuccuuccauuugcaagaagcacuaguaauuuuacacgaggggugaccaucuccacggucauuauugcaggagcucagcggcauccacagcugcaggggcccaggcuggacacccgaccuggccuccguccuaugacaccaugggggcagggccagcccagcgucacaucgccacuucucaggccuccagcgccagccaagauggcagacagccccaccccuacagagcaugugcauccaggaggaccagucccuuccuccccacaacccccagcugagcaggggggguccaggaggaccaucgcccucaaagcagcaggccaguccugcugggccagccccgccccucccccuggcuuuuccaccuuuccagucugcagcugagccaggccugggucaaggacuccaaugguuaacacaaccacgccacccaugcucuagaaaccuuguuuucccagucacccaguucuccaacuccagucugccuuggguacccccaaacacacacacacacgcccagagccuccuuuccaggccucaaaucgaaccaguaaggccaggggccuccagaacaucucccuauuugcgcuaccaaacucuccccgugggagcuggagagaccagcucaggccaccugggaaguccgacaccagguuccccagacuacaaucuggaaggggaggccagucuuaggacacacccccuccacaggcugcagggccacagggccggguuaacccacucgggggugggaggccgggagccaccacagcaaguuggcccugccccugcagaagguggaacccuccaggcgggcagccccagccuucgcuccgcagacccaggggaguuuuugaugcaauaaauuaugugagcgacugagcaggcagugggacagaagcacaacuuugcaugcccucucuaaagacuagugggcagcugcgccgaggaucugaaagccuccuuggucaucuccuugacuggacccuggccaguccucucaccgcccccucugccacccccuuccaaauucuaagagcacacuccgccagcuggccacucuagcccucgccgcgcuuccgcaacaagccccaccacucugaacuuggagguccgggucaggggaccggcagaaagcaggacaggaagcaugcagcggugcggagcaggugagggcccaggaaaaguccugagcugggcaaggagggggccgaagggaaggaacagaaagggaaggagcaggugagggagcagagaccaggugggggcaggggcagaggaaaagaggggaggggggugcuguccgagaggcagcgggcuggcggcugcagggcccgaggcccaggcgugggccgugcccccugcugcccugccucaggcuggagugggauggcagcggggguccucacuccacagcccugguuaccuacagcucagcagaaggcucgcuggggcaggaggaggaggaggaagaggaggaggaggaagcuggaagucucuuucacaggagaagcuaauguccaguuugcaggcuggucagugccucagcuuuuaugugugagccgacuccucccagcccgggcuccacccuaccccccaccccucucccugcugaccacucccccgcgccuuugcucccgcccucucccuccucccagccagucucuucucuccugcacccccaaccgggagcccuggaccaucccguagcgaagugccaugggcucccauccugcacccccggcucaucucugcacagggcagugaagggggggggggucuccuucccaccuccuuguauggaaacuuccacgcugcccacugggcaggggccgcggccucucuccgggucgaaggcucugcccuucuuagccucagaccagcagccccucucccccucucccgggacuccuguuuggaaauguugcggacagagccagagggggugugggggagaugucgcgaauguggcgucugccaugacuccugccaacucggccccucuccauccuggccccgcccacccccgucuuccucucgcggucucgcuggcaccgcgucaacauaccagggugggcuucugcggcuccgcgccccuccucguuacccagcaccccggaggccagggcccgcaaggcacgaaucacacaugugaggcggcacccccugcacccacagaccgaccgggaagucgccccugcagacaccucacaccucccucggcccuucccgacgcccccaccccacccccagcuccgccgccagggugagcgcggggcuccgcgcagggaacgggacccgcagccguccguccuccuccuccuccuccuccucccccccgggcucagccgccccgccgagccccgcaggccccgggccgggagcgggcggaggaagggccgggcguccggcgcaagcccgcgccgccccagccccggccccggcccggcccgcacacgccgcuuaccuggaagccggcgacgcugccgcccaccucccugcugcgugucgcaaaccgaacagcgggcguuggcccuccugccggacacuccucugccagcgccgcucuggccgagucgcgggggccgaaugugcgacggggcagagcggggggauggcuuuuuuuuggggggggggggagaauucgucugauuguccagggaggacgggcugucuucgggcuggggcgggccagauguuguacuuuucgggggggaaaagguaucgggaaaugaggucagcuguuguaucaaggauagaggggggcagagauagugggagagacagagugaacgugaaaggggggggccgaagagagggcgagggggagagaggacagcgagaggcgggcaggcgcacagcgggagagaacagcacggagagaaacagaaagcguguaauuaauccacuuugguucggcgaaggcgagagggcgggcgugagggggggagggagucggaggcuaggagcugggggggacgggagggagcgaagggaagguugcgggagaaagagcgggggccggggccagacgccaagaggggcgcggggagcacagagaagcggagggaagggcgccacgucgaggggccgggggaggcggugacuggggggcggaguggaggcugcacccggaccgcgggcgcccagcucgguuugggccgacggagcccucugccgucgcgagcccgggccucgggagggggacaggcgguggcggcaccggggccgcuccgggacgcagcgcggaaaggggagcggcccgaggcugcgcgccggggggagggcuggagggggagcgcgggggggggugacaacgccggcggccugcgagccggacugccugcggggggaaccgccuccucgggcgaagcggggauggggggaguugagguagaugaagaggaggcggcggggaauccgcaggcccggcggagcgcgaccccgcggacggcgcccgggacgggagucagcagcgaggcagcgggcggcgucgacgcggggccgccuugcccgauggaggcgcuggugggcagagcgcgggcaggcgugggccaggaggcgggggcggccggaaggggggggccggggccggccgggccucacgcagcuccgccggagagcaggcgaacugcgggcgcccacgcccggcucuuauagucgcgccagcccgcggcccagggcccgcgcgggccucgcuggccucgcgcccgcgccaaugggcgcccgcggagcccucgccccgcccccggcccgcccccgcaacccgagccaagagcggggcggggggugcgggcugggggcccuggggccccggggggggggcggcggucgcaggggcuggggggugcgcgggggcgaggcuggguggggggcagggagccgcagagcgccaaggccaugcugaaugcccguucuagagaauucaggggccccaucccggguuucuggggugcccgggcggccugugcucgugagcuggggucuccgggcaggcaggggcaggcgggcucccagcgccccaccaggaggcugcacugcgggugcgccccgucugagugcagaugcagguggcuuggggcugagucgggggguccuugcugguuguugcggcugagggggccccugggcucgggcggggcgcgcagccgccaccugccccagcaggaggagccggccacgcggcgcuuggagccucagccagaucccgagcgccccccggugccgcgccggagccccggagcccccgccaggugcgggacgcgcggaaggccggcugcgccgggccgaaucugggccaggcuuggagccuacggaggcuccggccgccagaggagagaggaucagggcgggaaacacagcucaaauccuaccugcauggccgagcucaccggggugcgucuaaguagcucgccuuugcggcccacccaaaauaucuggauaaugguuaccccguccucagugcguuggacuugcauagacgcgaguucggucucgggggccaccacgauaauuugggggucuggggaaaccaucuccuggagaguuugaacgauguaagaaagcacugugauuuuuaccaagucaaaaaccacgcacaaaaucccgcaccccgccagccccccgccgccuaagccuagccaaggggaaggggccgccggcggaaucucgcgccccccuggccccccucgccccccucgcuccgccaucaaucacuucgcccgcgcuccgcgcgcgccucccggcggaguccuaggcccgcgggcuagaggcacuuuaccgcccggcgggagcgccucuccuccgcgucccucgccccagcccccugcccgccccacuuugggacccuccagccgcuuuccccacaaaugagaucuuugcaaugagcaaacgaaaguggcgcggauuucggggcgcccagcaggagcgagcgcagccgccagccgcaaguccgcagccgugucccgcgccccacgccggccuccccggcggcagccggagacgagcgccagcaccggcgggacagcagcagaugcgggccgagagccggucaggggcgcagaggcggaggggaucggcgcggcggggagcucaccgcgaagcuggaggcugcguccgcgggcgcaccaggagcucaggcagcgagcgaucgaacgcucuguggcaggcgguggacgcugcugaaggugagcgagaccccggggccaguccucaguguccgggagcaacgcccaguccguuggaagacccggggacaaugcccaaauuugggggagacugggggcaaugcccggucgcuuuccuggacacggggaagcccucccuguccacguccugagggcgcgcggccgacccaaguguguuugggcaacgcuagagagaaauuucccaaauccgaguugcucuggggacuucguaggagacagagaggcccgaaaccagugcccgcugugcgcgggguuggggaagcugcaguggguggccggcgagccgggaacaaugcccaaauuuuggggaacgcaaggcagaguucuuucugccuugcgggcuuagcgaauggguguccuggaggaggggaccccggggacuccguuaaugugggaaccgugauuaaugacuaaacucgagacuccagaaaaauagauuacagguuugggggaugagagaaguugcuccaugcaauugggaacauagagaaagaggucucaaauaggggccagcuagcuugggggaccaauuugugaggagggguaguuaaagaaaauucuccauaugaaauugggaauuuugccguagagccauauuacguaaaauuggcagaugaaagcaaggaacacauuuuggggauccaaacacauucuugguguguuagggggaagcugagauuaauuuucacaucuuaagaauauaaguuaguggccuggacgcuggcagcagccggggaaaaaauaaccuucauaauuacuguggcuucagggaaagguuuuaacacccuucagagauggaagaaagcacugucuagauuuugggggagccuggagugugaucaguacauuuggggaaagcaaaauaaaaaauaaaaaaauaaaaaaucaguauuauuuuucuaugcuaauuuuuaaaugauuuccauuagcuuauuuuugguaaauaagaaaaagacuauauauuuuccuggaugucgucugcauuugggggagccccagugaaacacauuucaaguuuuugggacacauggaaauuacccaauggagauuugauaucuaaauuucuggaaaccuaguuaguagcuaggaaacuuauaggucgcagguuuuuccaugccugggauuucuugggacccagggacauuuuuuagugugcuuuggggguccauggaacauuuucuaaauguagggggacccagggcagggaccauaaagucaggagacucauaaaucaguauuaaaaaaaaaaaaaccucaauuguuuugugaagggaaaaaaaucucaauuugcuuuggaaggcugggagacaauaccgcaauuugggggcuccaggaaaaucguuuuugaaucuaaagaucuagggaaguugcucagaguccuuggaggacuuggggguccauauguacauuuuaaagaaaggggauucagaauuccuaggucuuaggacuuaggaauuuucagauuuugugauagggagugugcagugugcuugaaggaaauauugcuuaacuuugagaugacucaguggguuguuuggagcccaagaaaucagugcuguccugugauccgagggcaaugcugaauguuccuagagggccuggagggcagcguccagaacauccaaguaugggggaccaggaaaaggguccagugugauccuggccguugggguuucagaccaaugccugaauuuuagaaaagcaagauucuuguuaugaagcuccugggacccagagaauuguuuaauagucaauauguugugaugcagagaaagugcucggaauguuugggaacuggggccguuagcaacaccuggcauaacagaaauaaaaguaggcucugcccaagggguccuuuugugcuugguguagcccagagggacccgggagacccugugugauuuggggggaccuggagaauccugggucacacuugagcaccuccugguaacugcucagugugcuccagggaccuggguggcacugucuacaucuuaagggaccugauucguggccaggcagcauauagagccauagacguuaaugccccaaagcuuugugacucacacacccacaacauucucaauagcuuuggggaaucacuggggaaaucccuccauuuuaugaaacucaggcaaucagagggcaggucguuuaugauucagaaaaggauucaacaugcucuggguguaaugaccgaauuugggggaagguaugggaagcaauuuucauacucugaggguuccaaccuuccagcccugcugagugucaugagggacuugggauucaacguguaaaguuuagggaacccagguuagugugaauagauuugcgggacccaacagcaaaugucccaugcugaggugaacgggaaggggcgcggggguggggugggggggcgcggaauggggcggacgugugccggaaacaguaagcuuaggagacccuggaguuaauauucaaaauuaugcgggaaaguuccacuuguuuuggaaacaaugccuaaauguggaaaaggcacuguccacauccuggggagccaggcaaauuggucagcgcgaccaccacggaccaagggcuucgucuuuaaaauuagggaagccggguuaguggccuguaaaucugugggaccuggaggggguguauaaaacuguccagagccugggagaaagcacaucuggggccccaggccacauaguguaagucuggaaaagcccgccgggacugauguguuuugacguccccggaaauuaacguccaagaaaauuauugugacccgucgaaauggugaguauauuuagaagacuugggaagcaaugcuuaaauuuagaggaucccagaaaaaguaaaauguccgaguucggggaaagcagggaaguuguuccguggauuggaaucccccgaggaucaagggcuaauuguugagcucaagcuucccgggcagcggaaggaaggcgcugccggggauucaccuuggcuggggcgcgcgcggagcacuggcgcccuccccgggaacccgagcgcgggcggcgcgggcagguagcgcggagcgcccuggcgcgcacggccggcugaaauucugcuuuucguucuuugggguuuuucuuccuuuugcuuuuauuuuuuuuuuucuuugccuucuccacacggagagcgcguuuguggcggcagcccgagcuuagcgggcguccggguguaaggaagaaacccaagggccgcgagggagcgaccaggacgcugcuucccgggcgcucccgggacucccagauaccugcucgguccccgcgugggagguccgcaggcucccccucgccacugcgccccacucgccuccgcgcugcgagccuaggcgaagccgcggccgagccgccaccgggggcaggcuaguccccggcuuggcuugggggcccggagcacccccgguggccaccuccggccugccccggagcuuugcgcgcgccguucgggccuucgccagcaccaaacaagggugaaaccaguuuuguuuggguaacacugaagagcagaggaaguggggaggaaaaugagaaacacggggcccgggaggaggggggugcagggcugcacgccgcuggggugccaggggucucuuuucguucucuccaagcgaauuuucagggaaagucuguccacuccggcuggggaaagcccaguuccuuauaggcaaauauuaaacccgcaugcaggcgcccaacggcccugucggcaggaacaaggucaccccuuggcguugggcaaugucgggcgauggggcaguggcccuaaggggaccugugggguggguggggguacugccagagagggggcaccgcuggggaccagcagaauggugggggauccuggggcaacuacagugggcauugcuuguccccauugucaccccauaggaggaccccggcuagaaggggggcaucucaaagccugacacuggggaggcagaaguuaauggccuuggacagguguggggagcugggcaggaugaggcaucucuuucacauuagcuuggcaagacagggagaacccgcccccaccaugaaaaacagcccauuuuccacccacagaacaagacacgugggaauguccccuucaaauuucugucugcaucaaucacccccaugucccauuccaagaacaucuggcccaucucuccccacccaucacugccccccuucccaccagccuucugcagccuccccguguccccagcucucuggccucuccggcugugccuauagaagggggagccuccagcagagaaccccuggcuguguugauguuuuccucugcagggugacuuguaaauuugggggugaggagcauuugaaaggugccugucugcaaaccugguccccgggagagcggacuagguugccgaggcucccgucauggacaaaaccagggcccccagggccagcucuaggcuccccccaccuucuccuccacgccugcuucccaggcuggggacagguugggcaucgggggugagccccaguuccgaguuguggguucuccuccucuuugggggugcuggggacaauuacaccagugaccuguuugggggucccuucccuuuguucugcccugccgaggugccuucccccagggggccaccgcucaugcuugaaaaugcaugccuggacuuuuuaagguaggaagaaggcugagggucaccuuggggugcccacagcaggguguaguggcccuguagggagggaggagcaggugggggagugggggugcacacauguucccccucccucguggggcugccugcugagugcucuccuuauuuagucagaagugaccagggcaggcuggaggcuggggcagacgcgggucacccugaggcucgaaaagcacaccggcuccccucuagucaagaccagcaucgggguucuuccucaagacuggcuccucccccacuacuuccagcccccggagguaggaagggucccgccagcaguccaaggguguugggagggggccagggucuccucccacccagagcuuggccggcaggaacuuuagccccaagcagcguccgccccccagcccugaaccagcaccucaccagggcaacgcuggucuccucuccacuggcaaacccacauuccacagaggaugaacauccccucaaggacucagacucaccccauggagccuggcccaugccccagccucggccuguggcugcuccccauccccucgcucaccagcccugaagugggccuuucucauucccauuuccuccccagcucuggcucugagcucaccgcuccgccguccgugggaccaagcccagcauuuuacaaacccagcuccuuucuccaaggguccucagagcgccccuccgucacccccugcagggcgccgcagacgaggcgcugaccuugcgcucacuccccucgcuggggaaggacacacucgcuggcgucagcccggccggccugggaaguaggacuaaggacccgaacugcaacccuccacaccagacagcacagaccaccccaaggcugcucaaucugcccaaagccaaaaguacgugggggauauggguccagguuggggugcuugggagagggcccugggagagggguucagacggugcacacuccaaaggacugaggcggcgccacuguguuaccauuuuauugagugucuaagguaaagacaccuuugaaagaacacucccggcuucuaucugggaugggcaaaucagccugaagagucaccugcuggaucccucccugcaggcccugucguggggcagguacagggacuccaauccaugugccuccagcuccaacgcuccccaaguccuggagccuccccugucaccccagugccugaccagugaaugggugcugcccccacuacagagcucccucuggcugaggcagaggccacuggcugggccuuucuagccaccuuucaccccucuugcacacgggaagccccgcaggcuccugaccacaaugggauccugacgccggagccccuuaggcccuuugcucagaaggccucugguuauuaccucaauucugaacagccaggaggccugagacugucacccacuuugauaaauacagaccgacagaaaggucaggccauuggugcaagaccccauggccagcagccuggggcggggagaacccgggggucucacagcccccagcagagcccagcuuuccuuggguuuuuagguucuuccccaaugauauuuucccuuuuucccucucuacccacuuucugccccccaucuucuccccuuuggcugcccgcucucucccugccccucuccccuucuuugcccucuuucgucucccaggagcuccccugccaggaccucggugccguggagacugcggggaaccugcucugcccacaccugcucuggccccuagacggaagcaccuggagccaaccacggaacuccagaucccagcugugugacugaauccacgccagccucucugagccaaagcugcuugcagaagggggagaucccaguucgaagacucccgcgcagagccuguggcccucucugccaggccucagggugccugagacacucaccucucugccucgcaguuggggcugaggcuggggcuggcugccagccucaguucugggagcgcuggggucgccugggccacaggccacagcagcucaccucaggacugggcucucuggccugcuggggcucaggcuguggggcaggcugggcagggggcugagcuggcagcgauucagagcccuggggcugggggcuggaauccaccuccucccacacaagcucgguggugacucuucggccccuggggaaaaacaaaaagauauugcugagaugaccucuuuuaaaagcaaagccccccuccccauacaccccaagccugagcccugucccaucccccuccccggguuccuucaggucaccuugucaggaucugggcagcggcuucccccucuagccccuccccugccuagagcucccucuuucaaaguauaagggagggaagaaguggugagaaguuugccuagaaagggcuucccggugcugauggagaggccgagacccuucuguuggacaggcugcccuguuccugggugaggaugggcuucugccuggcacuggggguggagggugcacacgaauggcccgccuugaggggucauggcacggaauaugaaagccuccuccaccuccaaacacccccaccuuggaaggagauaaggagggggccccagcaaaagccacuggacacacagcucugcuugacgaggccagugagggacggcguggcugugcuuccuggggaaaugaacccccuccccacagacaccacccuggguggaucgaggagucuggguccagggugcaacagagaaaaacuucaugcaugaaugagcauucccagggaaacugccuuggccccagggcgccucucugugccagggaggcugggagagcagcaagggggaccaggugcgccaucaggaggagagaagcuaaaccuaggggggacauggagggcgguuguugccucucccggcauuucuccucagucuccuguccaauuucuugcugguggucaggaggcauagggaggcaggagggaaggaagcuuuaccuguaaaaugguguauauauguauaaauaaaaucucugcgccagaaucucgggccccuggcuccucugcaaagucuccuguuugucucugggaaugggaugggggaugcaacgggaggaaacuuuucacacagaaagacucuuccuuucacacuugugaagacagcuguguguucccgcugggaagagcggccuagcccuccuccccuaccccucccauuuugcuuggugaauuagucaaggaaaaccuauuuuccuugcaaaagccucaguggcuuugugcagcccuaaaggagaacccucuccacaauggccuuuccugcacaccccaucccugaaguugaggcugcucucaggaggcuucccugcacccuccagcagcagaaguucu

SEQ ID NO: 12618 - RNA, 33876 nt, Homo sapiens
agaacuucugcugcuggagggugcagggaagccuccugagagcagccucaacuucagggauggggugugcaggaaaggccauuguggagaggguucuccuuuagggcugcacaaagccacugaggcuuuugcaaggaaaauagguuuuccuugacuaauucaccaagcaaaaugggagggguaggggaggagggcuaggccgcucuucccagcgggaacacacagcugucuucacaagugugaaaggaagagucuuucugugugaaaaguuuccucccguugcaucccccaucccauucccagagacaaacaggagacuuugcagaggagccaggggcccgagauucuggcgcagagauuuuauuuauacauauauacaccauuuuacagguaaagcuuccuucccuccugccucccuaugccuccugaccaccagcaagaaauuggacaggagacugaggagaaaugccgggagaggcaacaaccgcccuccauguccccccuagguuuagcuucucuccuccugauggcgcaccuggucccccuugcugcucucccagccucccuggcacagagaggcgcccuggggccaaggcaguuucccugggaaugcucauucaugcaugaaguuuuucucuguugcacccuggacccagacuccucgauccacccaggguggugucuguggggaggggguucauuuccccaggaagcacagccacgccgucccucacuggccucgucaagcagagcuguguguccaguggcuuuugcuggggcccccuccuuaucuccuuccaagguggggguguuuggagguggaggaggcuuucauauuccgugccaugaccccucaaggcgggccauucgugugcacccuccacccccagugccaggcagaagcccauccucacccaggaacagggcagccuguccaacagaagggucucggccucuccaucagcaccgggaagcccuuucuaggcaaacuucucaccacuucuucccucccuuauacuuugaaagagggagcucuaggcaggggaggggcuagagggggaagccgcugcccagauccugacaaggugaccugaaggaacccggggagggggaugggacagggcucaggcuugggguguauggggaggggggcuuugcuuuuaaaagaggucaucucagcaauaucuuuuuguuuuuccccaggggccgaagagucaccaccgagcuugugugggaggagguggauuccagcccccagccccagggcucugaaucgcugccagcucagcccccugcccagccugccccacagccugagccccagcaggccagagagcccaguccugaggugagcugcuguggccuguggcccaggcgaccccagcgcucccagaacugaggcuggcagccagccccagccucagccccaacugcgaggcagagaggugagugucucaggcacccugaggccuggcagagagggccacaggcucugcgcgggagucuucgaacugggaucucccccuucugcaagcagcuuuggcucagagaggcuggcguggauucagucacacagcugggaucuggaguuccgugguuggcuccaggugcuuccgucuaggggccagagcaggugugggcagagcagguuccccgcagucuccacggcaccgagguccuggcaggggagcuccugggagacgaaagagggcaaagaaggggagaggggcagggagagagcgggcagccaaaggggagaagauggggggcagaaaguggguagagagggaaaaagggaaaauaucauuggggaagaaccuaaaaacccaaggaaagcugggcucugcugggggcugugagacccccggguucuccccgccccaggcugcuggccauggggucuugcaccaauggccugaccuuucugucggucuguauuuaucaaagugggugacagucucaggccuccuggcuguucagaauugagguaauaaccagaggccuucugagcaaagggccuaaggggcuccggcgucaggaucccauuguggucaggagccugcggggcuucccgugugcaagaggggugaaagguggcuagaaaggcccagccaguggccucugccucagccagagggagcucuguagugggggcagcacccauucacuggucaggcacuggggugacaggggaggcuccaggacuuggggagcguuggagcuggaggcacauggauuggagucccuguaccugccccacgacagggccugcagggagggauccagcaggugacucuucaggcugauuugcccaucccagauagaagccgggaguguucuuucaaaggugucuuuaccuuagacacucaauaaaaugguaacacaguggcgccgccucaguccuuuggagugugcaccgucugaaccccucucccagggcccucucccaagcaccccaaccuggacccauaucccccacguacuuuuggcuuugggcagauugagcagccuugggguggucugugcugucugguguggaggguugcaguucggguccuuaguccuacuucccaggccggccgggcugacgccagcgaguguguccuuccccagcgaggggagugagcgcaaggucagcgccucgucugcggcgcccugcagggggugacggaggggcgcucugaggacccuuggagaaaggagcuggguuuguaaaaugcugggcuuggucccacggacggcggagcggugagcucagagccagagcuggggaggaaaugggaaugagaaaggcccacuucagggcuggugagcgaggggauggggagcagccacaggccgaggcuggggcaugggccaggcuccauggggugagucugaguccuugaggggauguucauccucuguggaauguggguuugccaguggagaggagaccagcguugcccuggugaggugcugguucagggcuggggggcggacgcugcuuggggcuaaaguuccugccggccaagcucugggugggaggagacccuggcccccucccaacacccuuggacugcuggcgggacccuuccuaccuccgggggcuggaaguagugggggaggagccagucuugaggaagaaccccgaugcuggucuugacuagaggggagccggugugcuuuucgagccucagggugacccgcgucugccccagccuccagccugcccuggucacuucugacuaaauaaggagagcacucagcaggcagccccacgagggagggggaacaugugugcacccccacucccccaccugcuccucccucccuacagggccacuacacccugcugugggcaccccaaggugacccucagccuucuuccuaccuuaaaaaguccaggcaugcauuuucaagcaugagcgguggcccccugggggaaggcaccucggcagggcagaacaaagggaagggacccccaaacaggucacugguguaauuguccccagcacccccaaagaggaggagaacccacaacucggaacuggggcucacccccgaugcccaaccuguccccagccugggaagcaggcguggaggagaagguggggggagccuagagcuggcccugggggcccugguuuuguccaugacgggagccucggcaaccuaguccgcucucccggggaccagguuugcagacaggcaccuuucaaaugcuccucacccccaaauuuacaagucacccugcagaggaaaacaucaacacagccagggguucucugcuggaggcucccccuucuauaggcacagccggagaggccagagagcuggggacacggggaggcugcagaaggcuggugggaaggggggcagugauggguggggagagaugggccagauguucuuggaaugggacaugggggugauugaugcagacagaaauuugaaggggacauucccacgugucuuguucuguggguggaaaaugggcuguuuuucauggugggggcggguucucccugucuugccaagcuaaugugaaagagaugccucauccugcccagcuccccacaccuguccaaggccauuaacuucugccuccccagugucaggcuuugagaugccccccuucuagccgggguccuccuauggggugacaauggggacaagcaaugcccacuguaguugccccaggaucccccaccauucugcugguccccagcggugcccccucucuggcaguacccccacccaccccacagguccccuuagggccacugccccaucgcccgacauugcccaacgccaaggggugaccuuguuccugccgacagggccguugggcgccugcaugcggguuuaauauuugccuauaaggaacugggcuuuccccagccggaguggacagacuuucccugaaaauucgcuuggagagaacgaaaagagaccccuggcaccccagcggcgugcagcccugcaccccccuccucccgggccccguguuucucauuuuccuccccacuuccucugcucuucaguguuacccaaacaaaacugguuucacccuuguuuggugcuggcgaaggcccgaacggcgcgcgcaaagcuccggggcaggccggagguggccaccgggggugcuccgggcccccaagccaagccggggacuagccugcccccgguggcggcucggccgcggcuucgccuaggcucgcagcgcggaggcgaguggggcgcaguggcgagggggagccugcggaccucccacgcggggaccgagcagguaucugggagucccgggagcgcccgggaagcagcguccuggucgcucccucgcggcccuuggguuucuuccuuacacccggacgcccgcuaagcucgggcugccgccacaaacgcgcucuccguguggagaaggcaaagaaaaaaaaaaauaaaagcaaaaggaagaaaaaccccaaagaacgaaaagcagaauuucagccggccgugcgcgccagggcgcuccgcgcuaccugcccgcgccgcccgcgcucggguucccggggagggcgccagugcuccgcgcgcgccccagccaaggugaauccccggcagcgccuuccuuccgcugcccgggaagcuugagcucaacaauuagcccuugauccucgggggauuccaauccacggaacaacuucccugcuuuccccgaacucggacauuuuacuuuuucugggauccucuaaauuuaagcauugcuucccaagucuucuaaauauacucaccauuucgacgggucacaauaauuuucuuggacguuaauuuccggggacgucaaaacacaucagucccggcgggcuuuuccagacuuacacuauguggccuggggccccagaugugcuuucucccaggcucuggacaguuuuauacacccccuccaggucccacagauuuacaggccacuaacccggcuucccuaauuuuaaagacgaagcccuugguccgugguggucgcgcugaccaauuugccuggcuccccaggauguggacagugccuuuuccacauuuaggcauuguuuccaaaacaaguggaacuuucccgcauaauuuugaauauuaacuccagggucuccuaagcuuacuguuuccggcacacguccgccccauuccgcgcccccccaccccacccccgcgccccuucccguucaccucagcaugggacauuugcuguugggucccgcaaaucuauucacacuaaccuggguucccuaaacuuuacacguugaaucccaagucccucaugacacucagcagggcuggaagguuggaacccucagaguaugaaaauugcuucccauaccuucccccaaauucggucauuacacccagagcauguugaauccuuuucugaaucauaaacgaccugcccucugauugccugaguuucauaaaauggagggauuuccccagugauuccccaaagcuauugagaauguugugggugugugagucacaaagcuuuggggcauuaacgucuauggcucuauaugcugccuggccacgaaucaggucccuuaagauguagacagugccacccaggucccuggagcacacugagcaguuaccaggaggugcucaagugugacccaggauucuccagguccccccaaaucacacagggucucccgggucccucugggcuacaccaagcacaaaaggaccccuugggcagagccuacuuuuauuucuguuaugccagguguugcuaacggccccaguucccaaacauuccgagcacuuucucugcaucacaacauauugacuauuaaacaauucucugggucccaggagcuucauaacaagaaucuugcuuuucuaaaauucaggcauuggucugaaaccccaacggccaggaucacacuggacccuuuuccuggucccccauacuuggauguucuggacgcugcccuccaggcccucuaggaacauucagcauugcccucggaucacaggacagcacugauuucuugggcuccaaacaacccacugagucaucucaaaguuaagcaauauuuccuucaagcacacugcacacucccuaucacaaaaucugaaaauuccuaaguccuaagaccuaggaauucugaauccccuuucuuuaaaauguacauauggacccccaaguccuccaaggacucugagcaacuucccuagaucuuuagauucaaaaacgauuuuccuggagcccccaaauugcgguauugucucccagccuuccaaagcaaauugagauuuuuuucccuucacaaaacaauugagguuuuuuuuuuuuuaauacugauuuaugagucuccugacuuuauggucccugcccugggucccccuacauuuagaaaauguuccauggacccccaaagcacacuaaaaaaugucccugggucccaagaaaucccaggcauggaaaaaccugcgaccuauaaguuuccuagcuacuaacuagguuuccagaaauuuagauaucaaaucuccauuggguaauuuccaugugucccaaaaacuugaaauguguuucacuggggcucccccaaaugcagacgacauccaggaaaauauauagucuuuuucuuauuuaccaaaaauaagcuaauggaaaucauuuaaaaauuagcauagaaaaauaauacugauuuuuuauuuuuuuauuuuuuauuuugcuuuccccaaauguacugaucacacuccaggcucccccaaaaucuagacagugcuuucuuccaucucugaaggguguuaaaaccuuucccugaagccacaguaauuaugaagguuauuuuuuccccggcugcugccagcguccaggccacuaacuuauauucuuaagaugugaaaauuaaucucagcuucccccuaacacaccaagaauguguuuggauccccaaaauguguuccuugcuuucaucugccaauuuuacguaauauggcucuacggcaaaauucccaauuucauauggagaauuuucuuuaacuaccccuccucacaaauuggucccccaagcuagcuggccccuauuugagaccucuuucucuauguucccaauugcauggagcaacuucucucaucccccaaaccuguaaucuauuuuucuggagucucgaguuuagucauuaaucacgguucccacauuaacggaguccccgggguccccuccuccaggacacccauucgcuaagcccgcaaggcagaaagaacucugccuugcguuccccaaaauuugggcauuguucccggcucgccggccacccacugcagcuuccccaaccccgcgcacagcgggcacugguuucgggccucucugucuccuacgaaguccccagagcaacucggauuugggaaauuucucucuagcguugcccaaacacacuugggucggccgcgcgcccucaggacguggacagggagggcuuccccguguccaggaaagcgaccgggcauugcccccagucucccccaaauuugggcauuguccccgggucuuccaacggacugggcguugcucccggacacugaggacuggccccggggucucgcucaccuucagcagcguccaccgccugccacagagcguucgaucgcucgcugccugagcuccuggugcgcccgcggacgcagccuccagcuucgcggugagcuccccgccgcgccgauccccuccgccucugcgccccugaccggcucucggcccgcaucugcugcugucccgccggugcuggcgcucgucuccggcugccgccggggaggccggcguggggcgcgggacacggcugcggacuugcggcuggcggcugcgcucgcuccugcugggcgccccgaaauccgcgccacuuucguuugcucauugcaaagaucucauuuguggggaaagcggcuggagggucccaaaguggggcgggcagggggcuggggcgagggacgcggaggagaggcgcucccgccgggcgguaaagugccucuagcccgcgggccuaggacuccgccgggaggcgcgcgcggagcgcgggcgaagugauugauggcggagcgaggggggcgaggggggccaggggggcgcgagauuccgccggcggccccuuccccuuggcuaggcuuaggcggcggggggcuggcggggugcgggauuuugugcgugguuuuugacuugguaaaaaucacagugcuuucuuacaucguucaaacucuccaggagaugguuuccccagacccccaaauuaucgugguggcccccgagaccgaacucgcgucuaugcaaguccaacgcacugaggacgggguaaccauuauccagauauuuugggugggccgcaaaggcgagcuacuuagacgcaccccggugagcucggccaugcagguaggauuugagcuguguuucccgcccugauccucucuccucuggcggccggagccuccguaggcuccaagccuggcccagauucggcccggcgcagccggccuuccgcgcgucccgcaccuggcgggggcuccggggcuccggcgcggcaccggggggcgcucgggaucuggcugaggcuccaagcgccgcguggccggcuccuccugcuggggcagguggcggcugcgcgccccgcccgagcccaggggcccccucagccgcaacaaccagcaaggaccccccgacucagccccaagccaccugcaucugcacucagacggggcgcacccgcagugcagccuccugguggggcgcugggagcccgccugccccugccugcccggagaccccagcucacgagcacaggccgcccgggcaccccagaaacccgggauggggccccugaauucucuagaacgggcauucagcauggccuuggcgcucugcggcucccugccccccacccagccucgcccccgcgcaccccccagccccugcgaccgccgccccccccccggggccccagggcccccagcccgcaccccccgccccgcucuuggcucggguugcgggggcgggccgggggcggggcgagggcuccgcgggcgcccauuggcgcgggcgcgaggccagcgaggcccgcgcgggcccugggccgcgggcuggcgcgacuauaagagccgggcgugggcgcccgcaguucgccugcucuccggcggagcugcgugaggcccggccggccccggccccccccuuccggccgcccccgccuccuggcccacgccugcccgcgcucugcccaccagcgccuccaucgggcaaggcggccccgcgucgacgccgcccgcugccucgcugcugacucccgucccgggcgccguccgcggggucgcgcuccgccgggccugcggauuccccgccgccuccucuucaucuaccucaacuccccccauccccgcuucgcccgaggaggcgguuccccccgcaggcaguccggcucgcaggccgccggcguugucacccccccccgcgcucccccuccagcccuccccccggcgcgcagccucgggccgcuccccuuuccgcgcugcgucccggagcggccccggugccgccaccgccugucccccucccgaggcccgggcucgcgacggcagagggcuccgucggcccaaaccgagcugggcgcccgcgguccgggugcagccuccacuccgccccccagucaccgccucccccggccccucgacguggcgcccuucccuccgcuucucugugcuccccgcgccccucuuggcgucuggccccggcccccgcucuuucucccgcaaccuucccuucgcucccucccgucccccccagcuccuagccuccgacucccucccccccucacgcccgcccucucgccuucgccgaaccaaaguggauuaauuacacgcuuucuguuucucuccgugcuguucucucccgcugugcgccugcccgccucucgcuguccucucucccccucgcccucucuucggccccccccuuucacguucacucugucucucccacuaucucugccccccucuauccuugauacaacagcugaccucauuucccgauaccuuuucccccccgaaaaguacaacaucuggcccgccccagcccgaagacagcccguccucccuggacaaucagacgaauucuccccccccccccaaaaaaaagccauccccccgcucugccccgucgcacauucggcccccgcgacucggccagagcggcgcuggcagaggaguguccggcaggagggccaacgcccgcuguucgguuugcgacacgcagcagggaggugggcggcagcgucgccggcuuccagguaagcggcgugugcgggccgggccggggccggggcuggggcggcgcgggcuugcgccggacgcccggcccuuccuccgcccgcucccggcccggggccugcggggcucggcggggcggcugagcccgggggggaggaggaggaggaggaggaggacggacggcugcgggucccguucccugcgcggagccccgcgcucacccuggcggcggagcuggggguggggugggggcgucgggaagggccgagggaggugugaggugucugcaggggcgacuucccggucggucugugggugcagggggugccgccucacaugugugauucgugccuugcgggcccuggccuccggggugcuggguaacgaggaggggcgcggagccgcagaagcccacccugguauguugacgcggugccagcgagaccgcgagaggaagacgggggugggcggggccaggauggagaggggccgaguuggcaggagucauggcagacgccacauucgcgacaucucccccacacccccucuggcucuguccgcaacauuuccaaacaggagucccgggagagggggagaggggcugcuggucugaggcuaagaagggcagagccuucgacccggagagaggccgcggccccugcccagugggcagcguggaaguuuccauacaaggaggugggaaggagacccccccccccuucacugcccugugcagagaugagccgggggugcaggaugggagcccauggcacuucgcuacgggaugguccagggcucccgguugggggugcaggagagaagagacuggcugggaggagggagagggcgggagcaaaggcgcgggggaguggucagcagggagaggggugggggguaggguggagcccgggcugggaggagucggcucacacauaaaagcugaggcacugaccagccugcaaacuggacauuagcuucuccugugaaagagacuuccagcuuccuccuccuccucuuccuccuccuccuccugccccagcgagccuucugcugagcuguagguaaccagggcuguggagugaggacccccgcugccaucccacuccagccugaggcagggcagcagggggcacggcccacgccugggccucgggcccugcagccgccagcccgcugccucucggacagcaccccccuccccucuuuuccucugccccugcccccaccuggucucugcucccucaccugcuccuucccuuucuguuccuucccuucggcccccuccuugcccagcucaggacuuuuccugggcccucaccugcuccgcaccgcugcaugcuuccuguccugcuuucugccgguccccugacccggaccuccaaguucagagugguggggcuuguugcggaagcgcggcgagggcuagaguggccagcuggcggagugugcucuuagaauuuggaaggggguggcagagggggcggugagaggacuggccaggguccagucaaggagaugaccaaggaggcuuucagauccucggcgcagcugcccacuagucuuuagagagggcaugcaaaguugugcuucugucccacugccugcucagucgcucacauaauuuauugcaucaaaaacuccccugggucugcggagcgaaggcuggggcugcccgccuggaggguuccaccuucugcaggggcagggccaacuugcugugguggcucccggccucccacccccgaguggguuaacccggcccuguggcccugcagccuguggaggggguguguccuaagacuggccuccccuuccagauuguagucuggggaaccuggugucggacuucccagguggccugagcuggucucuccagcucccacggggagaguuugguagcgcaaauagggagauguucuggaggccccuggccuuacugguucgauuugaggccuggaaaggaggcucugggcguguguguguguguuuggggguacccaaggcagacuggaguuggagaacugggugacugggaaaacaagguuucuagagcauggguggcgugguuguguuaaccauuggaguccuugacccaggccuggcucagcugcagacuggaaagguggaaaagccagggggaggggcggggcuggcccagcaggacuggccugcugcuuugagggcgaugguccuccuggacccccccugcucagcuggggguuguggggaggaagggacugguccuccuggaugcacaugcucuguagggguggggcugucugccaucuuggcuggcgcuggaggccugagaaguggcgaugugacgcugggcuggcccugcccccauggugucauaggacggaggccaggucggguguccagccugggccccugcagcuguggaugccgcugagcuccugcaauaaugaccguggagauggucaccccucguguaaaauuacuagugcuucuugcaaauggaaggaacugggccuuuucugugugcuucuggacgcuucauucugcacauggcccugcgcccucaccucggcauuaugaccuguguguuacuuuuguaauaaaaauaauguuuauaggaaagccgugcuuucaauuuucaacugaauuuguagguuggcaaauuugguuugggaggggcaccucuggccuggggcuuggccuggcugccccgcucacgccacuucucucccgcccccagacaccaaugggaaucccaauggggaagucgaugcuggugcuucucaccuucuuggccuucgccucgugcugcauugcugcuuaccgccccagugagacccugugcggcggggagcugguggacacccuccaguucgucuguggggaccgcggcuucuacuucaguaaguagcugggaggggcuuccucagaccuggucaggccccuagagugaccggugaggacgcccaaccucaagccaggggagcacacuccuaggucagcagcccagccgcuugcucugagacuuugaccuucccgccgcguuucugagcacgugcggugucccagggcauccacaccagcugccuuucccaucacacgccuccuucgaagggugggccagaggugcccccuagacgucaggggcacucacaggggucucccugggcaucagaauuucuguugggggccgugaggcuccugcuccugaggcaccgcacgccuagugcagggcuucaggcucuggaggaagagccugccuuucuuccugcaccuuuuggacauucugacaagggacgugcguucggugaaugaucagaauuaaaaucaauaaagugauuuauauaauuaaaaucaauaagacaagugcaguugguggguggcaggggugagcggugcaugcgccuccuugggccccaaggcugccguggggggugcccaccugcugaccucaaggacgcuucagccuuuccucauguuucucucuugguucuccagccugggggcuggcaggugggugcauggcccauuguccuugagaccccacccccagauaggggggcuggguggaugcagaggcaggcauggugccugggcaugccugauggggcaggggaggggccgcuccuuacuggcagaggccgcacggcuuauuccaccugacacucaccacgugacaucuuuaccaccacugcuuacucacgcugugaaaugggcucacaggaugcaaaugcacuucaaagcuucucucugaaaaguuccugcugcuugacucuggaagccccugcccgcccuggccucuccugugcccucucucuugccugccccauuuggggguaggaaguggcacugcagggccuggugccagccaguccuugcccagggagaagcuucccugcaccaggcuuuccugagaggaggggagggccaagcccccacuugggggacccccgugauggggcuccugcucccuccuccggcugauggcaccugcccuuuggcaccccaagguggagcccccagcgaccuuccccuuccagcugagcauugcugugggggagagggggaagacgggaggaaagaagggagugguuccaucacgccuccucacuccucuccucccgucuucuccucuccugcccuugucucccugucucagcagcuccagggguggugugggccccuccagccuccuagguggugccaggccagaguccaagcucagggacagcagucccuccugugggggccccugaacugggcucacaucccacacauuuuccaaaccacucccauugugagccuuugguccugguggugucccucugguugugggaccaagagcuugugcccauuuuucaucugaggaaggaggcagcagaggccacgggcuggucugggucccacucaccuccccucucaccucucuucuuccugggacgccucugccugccagcucucacuucccuccccugacccgcaggguggcugcguccuuccagggccuggccugagggcaggggugguuugcucccccuucagccuccgggggcuggggucagugcggugcuaacacggcucucucugugcugugggacuuccaggcaggcccgcaagccgugugagccgucgcagccguggcaucguugaggagugcuguuuccgcagcugugaccuggcccuccuggagacguacugugcuacccccgccaaguccgagagggacgugucgaccccuccgaccgugcuuccggugaggguccugggccccuuucccacucucuagagacagagaaauagggcuucgggcgcccagcguuuccuguggccucugggaccucuuggccagggacaaggacccgugacuuccuugcuugcuguguggcccgggagcagcucagacgcuggcuccuucugucccucugcccguggacauuagcucaagucacugaucagucacagggguggccugucaggucaggcgggcggcucaggcggaagagcguggagagcaggcaccugcugaccagccccuuccccucccaggacaacuuccccagauaccccgugggcaaguucuuccaauaugacaccuggaagcaguccacccagcgccugcgcaggggccugccugcccuccugcgugcccgccggggucacgugcucgccaaggagcucgaggcguucagggaggccaaacgucaccguccccugauugcucuacccacccaagaccccgcccacgggggcgcccccccagagauggccagcaaucggaagugagcaaaacugccgcaagucugcagcccggcgccaccauccugcagccuccuccugaccacggacguuuccaucagguuccaucccgaaaaucucucgguuccacgucccccuggggcuucuccugacccaguccccgugccccgccuccccgaaacaggcuacucuccucggcccccuccaucgggcugaggaagcacagcagcaucuucaaacauguacaaaaucgauuggcuuuaaacacccuucacauacccuccccccaaauuauccccaauuauccccacacauaaaaaaucaaaacauuaaacuaacccccuucccccccccccacaacaacccucuuaaaacuaauuggcuuuuuagaaacaccccacaaaagcucagaaauuggcuuuaaaaaaaacaaccaccaaaaaaaaucaauuggcuaaaaaaaaaaaguauuaaaaacgaauuggcugagaaacaauuggcaaaauaaaggaauuuggcacuccccaccccccucuuucucuucucccuuggacuuugagucaaauuggccuggacuugagucccugaaccagcaaagagaaaagaaggaccccagaaaucacaggugggcacgucgcugcuaccgccaucucccuucucacgggaauuuucaggguaaacuggccauccgaaaauagcaacaacccagacuggcuccucacucccuuuuccaucacuaaaaaucacagagcagucagagggacccaguaagaccaaaggaggggaggacagagcaugaaaaccaaaauccaugcaaaugaaauguaauuggcacgacccucacccccaaaucuuacaucucaauucccauccuaaaaagcacucauacuuuaugcauccccgcagcuacacacacacaacacacagcacacgcaugaacacagcacacacacgagcacagcacacacacaaacgcacagcacacacagcacacagaugagcacacagcacacacacaaacgcacagcacacacacgcacacacaugcacacacagcacacaaacgcacggcacacacacgcacacacaugcacacacagcacacacacaaacgcacagcacacacaaacgcacagcacacacgcacacacagcacacacacgagcacacagcacacaaacgcacagcacacgcacacacaugcacacacagcacacacacuagcacacagcacacacacaaagacacagcacacacaugcacacacagcacacacacgcgaacacagcacacacgaacacagcacacacagcacacacacaaacacagcacacacaugcacacagcacacgcacacacagcacacacaugaacacagcacacagcacacacaugcacacacagcacacacgcaugcacagcacacaugaacacagcacacacacaaacacacagcacacacaugcacacacagcacacacacucaugcgcagcacauacaugaacacagcucacagcacacaaacacgcagcacacacguugcacacgcaagcacccaccugcacacacacaugcgcacacacacgcacacccccacaaaauuggaugaaaacaauaagcauaucuaagcaacuacgauaucuguauggaucaggccaaagucccgcuaagauucuccaauguuuucauggucugagccccgcuccuguucccaucuccacugccccucggcccugucugugcccugccucucagaggagggggcucagauggugcggccugagugugcggccggcggcauuugggauacacccguagggugggcggggugugucccaggccuaauuccaucuuuccaccaugacagagaugcccuugugaggcuggccuccuuggcgccuguccccacggcccccgcagcgugagccacgaugcuccccauaccccacccauucccgauacaccuuacuuacuguguguuggcccagccagagugaggaaggaguuuggccacauuggagauggcgguagcugagcagacaugcccccacgaguagccugacucccuggugugcuccuggaaggaagaucuuggggacccccccaccggagcacaccuagggaucaucuuugcccgucuccuggggaccccccaagaaauguggaguccucgggggccgugcacugaugcggggagugugggaagucuggcgguuggagggguggguggggggcagugggggcugggcggggggaguucugggguaggaaguggucccgggagauuuuggauggaaaagucaggaggauugacagcagacuugcagaauuacauagagaaauuaggaacccccaaauuucaugucaauugaucuauucccccucuuuguuucuuggggcauuuuuccuuuuuuuuuuuuuuuuguuuuuuuuuuaccccuccuuagcuuuaugcgcucagaaaccaaauuaaaccccccccccauguaacaggggggcagugacaaaagcaagaacgcacgaagccagccuggagaccaccacguccugccccccgccauuuaucgcccugauuggauuuuguuuuucaucugucccuguugcuuggguugaguugaggguggagccuccuggggggcacuggccacugagcccccuuggagaagucagaggggaguggagaaggccacuguccggccuggcuucuggggacaguggcugguccccagaaguccugagggcggagggggggguugggcagggucuccucaggugucaggagggugcucggaggccacaggagggggcuccuggcuggccugaggcuggccggaggggaaggggcuagcagguguguaaacagaggguuccaucaggcuggggcaggguggccgccuuccgcacacuugaggaacccuccccucucccucggugacaucuugcccgccccucagcacccugccuugucuccaggagguccgaagcucugugggaccucuugggggcaagguggggugaggccggggaguagggaggucaggcgggucugagcccacagagcaggagagcugccaggucugcccaucgaccagguugcuugggccccggagcccacgggucuggugaugccauagcagccaccaccgcggcgccuagggcugcggcagggacucggccucugggagguuuaccucgcccccacuugugcccccagcucagccccccugcacgcagcccgacuagcagucuagaggccugaggcuucuggguccuggugacggggcuggcaugaccccgggggucguccaugccaguccgccucagucgcagagggucccucggcaagcgcccugugagugggccauucggaacauuggacagaagcccaaagagccaaauugucacaauuguggaacccacauuggccugagauccaaaacgcuucgaggcaccccaaauuaccugcccauucgucaggacacccacccacccaguguuauauucugccucgccggaguggguguucccgggggcacuugccgaccagccccuugcguccccagguuugcagcucuccccugggccacuaaccauccuggcccgggcugccugucugaccuccgugccuagucguggcucuccaucuugucuccuccccguguccccaaugucuucaguggggggcccccucuuggguccccuccucugccaucaccugaagacccccacgccaaacacugaaugucaccugugccugccgccucgguccaccuugcggcccguguuugacucaacucaacuccuuuaacgcuaauauuuccggcaaaaucccaugcuuggguuuugucuuuaaccuuguaacgcuugcaaucccaauaaagcauuaaaagucaugaucuucugaguguuccacucucugacuuggguacuggacugccagagggagggaaggggcugagcaccuggaagcaggcagagggggauagaagagggaaggggaaggaaggccuuagggguguggacaccucucuccguccccugaucacauacauggagaaaugagagagcuggaagccagacucucagacucacugucgugcaccugaagccagggggucugggacagugucaggcaccaaguucucaaagaugggggugccacgaaggguaggagccuggggggcuuuuucagagaaaaagcaaaguaccaucaguaccaacuccagggaaugccucccccaccaacagccuuagaggacuggggcugggcaaccucuaaaagguucuggaaaccguaucuguggcuggagaugggggcucagggccacucucacccagggacucagcccccuuccaagguugaggcugcccagaugucauuaguaccacugccuccugccagggcucagccuguacccaccugucccaagggugcuggccucuagcuuucaagggucccugagcaugggaggagggguaggcugggcugcugggagccuggcccagccucuucucuccaucccccuccaggaacuuuccagcagccuugggcaguggaucugccugugccccgccugcuguggggauggagggacaggggcgccacagaaggagcccagaagugugcccagggcccugcagccuucagugcugggcaggcgguggggaggggccugacuggguugggggcgugcuugcauccuggcccccagggucugccccuggucaagcccugucccuugauggcugccucugucccuagcauuucuccugugccgggcacuggagggugcugggcugucacccaagccucugaggccuggggacacgucuacacggacagugucacugcccacaccaucugagaaccacuccaagggaagggagagggugggcggugguuuggggaguugccuggaggaggagggauuagccuugaagaugaggagggcuggggguuggagaagagcagauuggauauggggggcaccaugcccuuccugagcuggucccuggcucugcaccucagugcuaggucuaagcuggaggguccagggcccagguggcauugcugacccccagggggucggggcugcucugaggcccuucuguagauguagauggaagccuaguccuguccaccuuccugaggccagguggaguugcuuucccugcaagcccaggcagcucugcccugugccccucccccagcccugcagucccccaggcccacgcagggccggccucauggucucgcuuccucucugggucugcuucagggcccagccuccagccccaugagccugggcccuccugcuccuguccccacuggccccaggucacuuccacacuggcucuccccgcacccugggccugcucagccacucuugcccacagccaggagcuucugugcagcuucuuuccuuucacuugcagccugccugcccucugcuuccccggaccccuugugaccuucccugaccucucugcagaacugggcaaagccacucacccugguucccccggguuuagccuggucucuugacacccacucagggcugcccagccuucauccugcuucacugggcccagccucauuccagggcuucugagacugcagggcccucucuucuccccucucccugcuuugcaaauucucaguucauccuggcagcuccaacucuccaucccuccacccauccauccccccaucccuccacccauccauccccccacccaucccuccacccauccauccccccauccauccacccaucccuccacccaucccuccacucauccauccacucaucccuccacccaucccuccacccauccauccacccauccauccaaccaucccuccacccaucccuccacucauccauccacucaucccuccacccauccccuacccauccagccacccauccauccacccaucccuccacccauccauccacccaucccuccacccauccauccaaccauccaaccacccaucccuccacccauccauccacccaucccuccacccauccacuuacccacucauucaccaacucauccauccacugguccaucugcccaccaaaccauccacucaccauccacccauucaccuauuuauccaucccauccacccacuuaccacucacucacccacucauccauccauuuacucaccccuccauccacccacccacucauccaucuauucuuccacccacucacccacucacucacccacgcacccauucacccaucuauucauccacccacccaaccauccacucacccacccauccaccuauucauccaucccauccacaaacaccccaccuacuacucacucacccacucauucauccauuuacuuaccccuccacccauccacccauucauccaucuauucauccaucccaucuacccacucacccacuuacccagucucacccacucauccauccacccaucuauucguccacccaacaguccacccacccacccauccacucacccauccauccaccuauucauccaucccacccacccacucacccacuuauccacucacucacgcacucauccauccauccacucacccucccaucuacccauccacucaucuauccaucuacccacucgcccacucaucauccacccacucacccacuuacccacaaacucacccacucauccauccauccacucacccucccauccacccacccagucaucuauccaucuacccauucacccacuuacccacucacucacccacucauccauccauccacgcacccuccauccacccacccacucaucuaucuacucaccuguccauccacccacuuaacucucacucacccacucauccauccauccacucacccuccauccacucacccagucaucuaucuauucaucuguccauccacccacucacccacuuaccucucacucgcccacucauccauccauccacucacccuccauccacccacccacucaucuaucuauucaucuauccaucuacccacucacccacuuacccacucacccacucauccauccauccacucacccuccauccacccacccagucaucuaucuauucaucuauccaucuauccacucacccacuuaccucucacucgcccacucauccauccaaccacucacccuccauccacccacccagucaucuauccaucuauccaucuacccauucacccacuuacccgcucacccacucauccauccauccacucacccuccauccacccacccagucaucuaucuauucaucuauucaucuauccaucuacccacucacccacucacccacucauccauccauccacucacccuccauccauccacccacucaucuaucuauccaucuauccaucuacccacucacccacuuacccgcucacccacucauccauccauccacucgcccuccauccaccccccagucaucugucuacucaucuguccaucuacccacuuaacucucacucacccacucauccauccauccacucgcccuccauccaccccccagucaucugucuacucaucuguccaucuacccacuuaccucucacucgcccacucauccauccauccacucacccuccauccacccacccacucaucuaucuauucaucuauccaucuacccacucacccacuuaccucucacuugcccacucauccauccauccacucacccuccauccacccacccagucaucuaucuauucaucuauccaucuauccacucacccacuuaccucucacucgcccacucauccauccaaccacucacccuccauccacccacccagucaucuauccaucuauccgucuacccauucacccacuuacccacucacccacucauccauccauccacucacccuccauccacccacccagucaucuaucuauucaucuauucaucuauccaucuacccacucacccacucauccaucuauccacucgcccuccauccacccccagucaucugucuacucaucuguccaucuacccacuugacucucacucacccacucauccauccauccacucacuccuccauccacccacccacucauccacguauacaaacacauggacaggcacuacccacaugcuggacuuucagccaagagauaagcucagcgucauggagggaagaaagcgaaagguguucggugcucuuuuaagcaagacaggccucauggagaaguuggcgugggggcagagacuggacggagcugaggccucauggagaaguuggcgugggggcagagacuggaaggagcugaggaaggaguaugaagcauccagaaagagcguucuuccucacagggauaaaacaugaguggucugggaguguuugagccacagcaggaagucggggguuuggguuggugggagcugcagcaggaagagguggagggccuguguagggggcugaggucagagcuguaauggggggcagauggccugggcugcauaggccaugccguuuguucaacagacaccaugggacccugaggccauggggugaauuguggcccucagaaaggucugucccgucaugugcagugacucgaaccuguaaucccagcuacccaggaggcugagccaggaggaucacuugagcccaggaguccaagguuauagugagcugcgauggcaccugugaacagacacugcacuccagccuaaccuaacccuaacccuaacccaaccuccacgcagcacccacguggccucguggcacagcucgguucauaguccagcagugguaccuuauuuccuuggugacaagcaacacccucaugaugacccaugaggccaccugacccacacuacccaucaccaccaccgcuaugacaccugcccagccacaguggucccagguuggguugccccugccuagaccccuuccccugcagaccuuugcccaggucaucuuggcgugguugcacccucggcauggagucugccuuggaauuccucugcacaauggcagcccguguggaccugucccacaaacgcucugagaaugaagaggacacacuuccaauggcaccugcuguggccagcuucacuccuccaggauguccugcagaccccucacccagcaugcgucugccgguccaccacugcccuccaccacaccucacauugaguuaguugaggagauccacggacuccaccaggcccuggccccugcugcuguccagccuccuguagagccagccccucuggccaugcuccauaugggaccagagcaguggggccagagucugccucucuccacuuagagcccuccgugaaucccgugggccacuggcaaauccaggcccuggccaggcuuuccagcaccuggccccaucccugguccucccacccaccccuccacucccagucccaggcugcaccugcugcccucuugcccaggcccucugguaucacccuuguccugguaacucacgcacgcccucugcuguacugugccauccugacccccaggagucuggccucccuggucucccuuccuguuuguucuggcauugagccccccaccauccgccagagacacugcuaaccauggucccaagacgccugcuggcaaguccucuccaggaucccuggggcucugucuggggcucccagaccagaggggucagacagaaggcccuggagggugccucgagggacucuggcaccccaccaauggcuaacucccugcuccccggguuagcuuguccccugccccuguguuagcuucccccuugcccccuaccccuggguuagcuugcccccugccccuggguuagcuuguccccugccccccggguuagcuuguccccugccccccggguuagauuggccccugccccuggguuagcuuggccccugccccccggguuagcuuggccccugccccuggguuagcuuggccccugcccccugccccccagguuagcuugcccccugccccccggguuagcuugccggggagacccagcugccaggcauccuugcugagguugcccaccggcccgcucagcaggccucauccuggaggaaccugucccucugggucuggcccccaggguccccgcucuucccagcucccacacaggugcggccaggccagggcuggcacccacaggcugacagccccaccccucaagccuggucuccaccuucucagcugggccccuggcccugcccacuccccucuggcccaggccggggcugcagccccaggcucagaguguagucuccagccugucccccggcucccagccccagccagcccaggccucagccggccugaaaccaaagagaaaaugccuguuuaugccagucaugccgaaagcaaaacaguuugugguuugugacccaaauuuuuugccuuuuuuuuucagaacauaacaaagcccaagacaacucccuccccgcucccagcccuccccccaaggcagacagaaaugaucuguuuacacuggccgcggcacauuccggccgccagcccggcccucuccccagugccgugcccuccgugcugggcuccuccucgguggaaggggcugcugaggccggggagaggggaccgcaccacagaccuggagcgaggguggggcuugcuuccucugggggauggcugaaugagaugugucuuggggguuggggguaccggggugcauguccaucugggaguuggaguggggacuccaugcugccugcacaggcuacacagggaaggauggcaggagagcggccgccugcagccgcucccuccagggaaccccucuccaagucugccuuucaguacccccuucacauagacaggugcuuagacccucagggugacaggaccuauuaccuacccacccccucuacugcacuccauccucucgccuccucccuccuugauuguccaaagccugagacccccugacucagcucggccguggagcacacagagauggggaugccucugcccuugaaagccugcagccccagaguggcggugucaguggggugguggguguggaggaggguggccccagacugcauugagggaggggggugcaggcacauguuggagcccagugguagggggcaggugggaccccaaggugccaugacuggaagcaagaacaggccccuccccaucuucagacuguucccacgugccuggcucucccaggggacagaaaaguggugcaaaccuucaccuuccccaggccuccucggaguccuccucggaguccucggagagccagaauugccccucucuccuuccagccuccuccacugcccucuccugaucgccuccucccagucuucauucuuuguucgcgcacuuggcuaugccugcuccuggugcuggggagccagggcuucagaagaaggaauuccugggccaaggggaccugguggugugagcggggugaggcaaaggcaccuggaggucuggggcugagaaagaccaugcagacaggggugcuccucccgcggggucggacaggagcgugggcauuggcaggacgugggugggaagggcguucuaggcacagggaaccgcaugugcaggcacaggugugcacacauggagggagauggcugcagcucaaagggccucggugcugagccaagaagcugaacuugaccuucagugagcucugggaggcggggaggggcuuuuaaggggagagugagccacucuagccaucaauucuggagagauggucuaagugugggaacuccuggagccugagaggguuuggaggugcacuagcggguggggugggugggguggaagggguggugcugggccgggcgcagggaggcaccccagcugggaggagcucgguguggcccagcagcaucgcacgcaugcacggauggggucauuuccacccugcccccagccccaccaaaugcagacccuggcuccucagcuggggggaguauggggagcagggagcuccuccugccucaggcccugggggcaacccaggucugcccacucucaggcuggcuggcucccccgccuggcugggagcaucacuucgggaaggucuggccgaguaccucugcuucccuuccccugccuugucgucccuggccucccgucuaucaggaacagaugugccucugagcaggaauccuagcuauuugguuuagccagccacucucgggaauuucugauaaggcaaauugguucucugcagagucgguggagguagugggggagaagacaagcagugcccacccccaccuuucuccugccgaggacggggccuaggauacgccccagccuggucccuggccccagcucagcagcacuguggggaggaagacuuucgaggccucuccugaugcuccguggcgcugcaguggcugagggcuggccggccccagcaggugggagcgggcugagaccacagggguuucccccaccccuggaccugggcucagagcuuugugggagggaaagaaaucuacacuggagcccucugugguguugaagcaagcagccgcaacccuccccagcacccagcccucagcggccacaugucccauguuccgggcucugugcgggaccuuccacgacacucugguccuuccugccuucaucaucuguucaauacacauaugccaggcccuguacaaagcccuagaaucaugaagauggauaaaguuccauuccugcccucaaaacaacucuaggaaguggcacaucaacauaaauguaacaaacagcagggcugaggaggggcccggcuagcaccuuguaaauuauucacucagaucuucccuggaucccagaacaucgucuuaucuuguucuauucuguccaugguuuuagccuguggaggccauuuaaaguaucaguuuggucuuccagccacuuagcuuauauuucucagccuuggaccuucaaugugggcuccaugaauggauggguggguugguggauggauaagcagaugggcagauggguagauguauggauagguagaugauggagugggugggugauggaugggugaauagaugugugugugggugaauggauguauggauggauaaauggauguguggauaggugcaagucagcuguaggucaacaagugucuaccuggauucucuucugacaugauccuugugagggaagagagcaaagagacuguaauccauuguaugucugugcuuauagagauucuauguguugauucagguugaauauauccuguuuuuaggauccaacacaucauagagauuaaaagauauuugucgauuaaaugaaauuuauugggaaugauauuaaaaggaauuuuaaaaaugaaauguaaaggucuuguuuaagugaacauauaccuggaaauugucucaagaggaccuagaaaaaucugaacauaucggccgggcucaguggcucacgccuguaaucccagcacuuugggaggucaaggcaggcggaucaugaggucaggaguucgagaccaaccugaucaacuuggugaaacccugucucuacuaaaaauauaaaaauuagccggaugugguggcgcacgccuguaaucccagcuacucaggaagcugaggcaggaggaucgcuugaacccgggaggcggagguugcagugagcugagaucauaccacugcacuccagccugggugacagagcgagacucugucucaaaaaaaaaaaaaaaaagaaaaagaaaaaucugaaaaucugaacauaccaauuaccagguugucaacugaggguuacaagaugcuaccccagaaaaaggcacagggcccagaguguuccacgggaaaguuuuuuaaacacucaagaucaugccuguacuauacaaaauguuucaaguguagaagauggacacgguuucuauucauuuuugguguuagcauaacccugauuaacaaaacucaaacacaauggcacaaaaaaggaaaaaccacaguccaaggucacauguaaagaaagaugcaaaaauugucaauaagagaauuagcaaauuaaauccagcaguguauuaaauuaaaguaauaacacaccaugaccaaguagaguuuguuuccaggaacgcaaggaugacucaacaugaagaaauccauuaauaucaugaugcuaauaagccaaaggaagaaaaaccauaugauaauauugagaagugccaaaaacguauguaauaaaaucuaaaaugcacuaccaguuauaaaccguguugagcaggcuaggacuaaaaagaaacuuccucaacauaagagaagauaccuaguccucaguuuccugcuaucuccucacccacugagaggacuuuucacgacaaccaccaaccuucuuguagccaaauucagggcacccuuuuuuuuuuauuagacuugaccacucagcagccuuuuccugcucacccgcuugcucucacuccccacucggaaacuucucuugguucuccuucuaguauggaguagcaaacuuuaacaaaccagcacuccugcacauaacaacuguaaaccccgaaucacaaacaaacagaaacuaccaaggacucuagaaaguuagcaaaagcagguagauuuugaugggguagucaggguaugguguggguaucuauaauuccaauagaaugccugccauguucaacaccugugaaaaaaagaggggauuaaaagaaguccugccauuauuauggccagaggaagcaggaaaggagcuggaggcaaucaaagucgcuggagagugagaugagacucucaaaaaaggcuagagaagggccuuuuaugugucaaaucugcccugguuucugguauggggcagaaagcaaucugaacugagacugggacuccugucaccucaggugagacucuuugcaacuggcagcuaaucaaguuaauugccugcuaaaacaaaugcaucagugcucuccagacaaauacaggacauuucagagucuccaacaacauaauauucacaaaguccaggaggccaucccaaacuguaugacauaugucagggccagaaaccgguauuuucuucucaagggaagacaauugacugaggccagccaugauguuggaaucaucaaacaaggccucuauuauaacuaugcccaugaagauaaagaaaaauacacuuucagugaaugaaaugacaggaaauuucagcagaccaguagaaaauauuuaaaaauaucuaaauugauguuuugaacugaaaaauacacucucugaaauuaguaaaaaacaaaauacuggaugaaaggaucaguaguguagagaggacagaagaaagucugugaacuugaagacagagcaauagaaguuauucaacucaauacgaaaaugagagagagagaaaaggcuuuaaaaacaugaaaagagacucaaguacaugugaauaguguuaaaaacuuaacagauggccaggugcaguggcucacaccuguauucccagcacuucggguggcugaggcaggcagaucacuugaggucaggaguucaagagcagccuggccaacauggugaaaccccaucucuaccaaaacuacaaaaauuagccaggcaugguggcacgugccuguaaucccagcuacucgggaggcugaggcaggagaagcacuugaacccaggagguggagguugcagggagccaagaucacacuacugcacuccagccugggugacagagugagacuccaucucaaaagaaaaaaaaaccccaaaaauuaauauauaggaaauuggaguuccagaaggggaggagagagcaaauggagcagaaaaaaaaauauuaaagaaauaaugaugaaaaaguucucaaauugauuuuaaaaacauaaacuuauggauucaagaaguucaucaaaaucugaauaggaucaauuugaagaaacaaaaucugaauaggaucaguuugaagaaaaucaugccuaggcucaucaaagucaaauggauaaaaaugaaaauuaaaaaagaaaaucuugaaagaagagaacaaggcaccacauagcagggaauggugaauugaauugccacagacuucuggucagaaaccaugggggcuggaagacaauggaauaacauuccuuaaacccugaaaugugcuaucccuuuggcuccuguggccacuugguccaguuuuacugucccgucauuuuguuuuccuuguugcucucccuuccauuaagcacuggccucauccuggccugggcuuccucuauccuucccuuccuccaacuucacccccuggaugaacucuuccacaccacagcuuugaugauggcauauguccugaagacucccaaacguggaacucuuguuucgcccucuugagauugggcacguagauccaaugccugcucaguuuauccacuagcaugugaagcucuuccucccaucucaaggaauaaccaucccagccccucaguuguugacaccagaauucuggguguuagcaguccccaucucucuuaccuuccaucacaucuaaugaaccugcuaucuggcaagucuuaguccuuacaagccagccuucacuccagaaguuuccacagacagggugucacccugugcuaccugcuguacaucuguucuaucacuucauccucaaaaguagagcuauucuccgcauuuuaauugauggccaacugagaaagacagggaccuguugauggucguuccauuguucuugagugccccagguuagccacugugcugggcauuggccacguagcagacgggcaacugcagacucacagcuggaggcacagacagccaacaaggaguccauugcccugauggcaugaugucaggcugcggagaauagcagggccgugggguugcucaccccagugcccccaaguccuccuguggucaggcaguacccacgccaucuugccucccaaggcugaggccagagauguuugugggccugugucuuccaggcaguucccggccucagcacagucaucucuuccuuccucuaccagguacagcucugggugcaggugaaauggaagcagccucacccuccuccugcccaacccuggccagcucagaaagccacucagagaggcagcccuaggguuugccuccacuccucacugcugaccugaggccaagggcaagcuguucugaggcuuaggacccucuggcaccagcucuagaccccaccuggggucucccuacugccccaggucaggccugagggcuugcuugaggguacaguuuugaacuacgcagguggaggacccagccugcugcccagcucuccugccuccccagacucugggugugaagguagggcuuucgcaucacauuucucccgcucauggggcugggcguaccgagagcccucugugugugucucccuaaaugcuccccaugugucaggggcaggcucugugcuuaccagccccacccgccagguaagaagacugagaccgcagccggcgagugaggggcaggccgggguuacucagggugcgaccaggaggcugcccuguguguguccccucugggccauugcucuggcccuggugccccucccuuccccucuacgccuccuccaccaggcaucucccccacucaggcccaggaaacaccaccuggagcuuggaagaucccucaaggaaggagggcggcuuggaggagggaggccaguauccugugugcggccucccuucucugucucccagaacaggccagucuccgccgcugaacccaccacugggcaguggcgaggaagggcuucuguggugccccagcaggaccccaucagguguggcuggcucagggcugagucgucucuucuuucag

SEQ ID NO: 12619 - RNA, 41521 nt, Homo sapiens
gaaagcaccccacacccucuggugcucaguccuccccuccucccugggguccccuccccucccugccccccaagccuugcaucccccugcaaaccucacaagggggaacuauuucuguccugaaagcagagagggcccuuuucuugggaccucuccgccaucucugccuccacucccagcugcugucagcucuggccuggccccugcaggaagcaaucacuggucucccuguuucccaucuggccccaaggucuguucuugcccuucgaccagagagguuugaaagcacaacucgggcccugcgugcccugcuccccagggcuccacaccucugagcacccgcgcaguaacggaggcucccagccccgccucgccccaggguccccuccaacacucucuggccuugggccuuugcuauacccggggccuggaagggcccccucaucccccaagugucaggcaaaggucucagagcacugucccugcccggcgugcuugguccugacugcuaggccccaaaucauuccuuuucccauuaccucuugguuucucuguagcuggggucacuaccccaaauucuugaauugacugacguguccaacuauuucauguuuucccccucuacacugggagcccuacaagggcagggcccccugggcaagaauagugccagccaggagccccuggagaagauagcuacacaugugccccaggccccagauggcacucagcccugccugucaaugcuggacauagggcaguuuuuauccuggcuuucuacacaaggaggaaagacuaaccaugccagcgggcagcggccggaucacguaugucaguagaacucugaccccugagaagccuggaagccaaaccacaccucuguagcaaucacgccacagacucaggccacggcuaacggcugccaguucaccuauuuuugcccccaacucaagaccaacuggaggaaggcaaauaugucccugacgaaggguggccgccuccagccuccccagcccagagccucagccuccccagcccacugccuccagcaacacacaucugaagccuucucuguugguugguuuuauugguauuuuggaagauuguuuguuuuuuguuaugagauggagccucgcucugucccccaggcuggagugcaguggcgcgaucucggcucacugcaagcuccgccuccuggguucaagccauucuccugucucagccucccgaguagcugggacuacaggcacccgccaccgugccaggcugauuuuuuuguauuuuuaguagagacgggguuucaccauguuagccaugauggucuugaucuccugaccucaugaucuggccaucucggccucccaaagugcugggauuacaggcgugagccacugcaccuggccuuuggaaggucuuuuauaccuuuauugagauaaaauucuuaugacauaaaacuuagcauaaacuguagacuuaguuggugugacuuuagaguagucucagaauugugcaaccaucaccacugccuacuuuuagaacauuuucaacaucccaaagacagaaccccguaggcaccuguuagcagccacuccccacccaguccacgaagccccaggcagccacucaccaaucuacuuuccauuaauuugcccauucuaaacacuugaaaaaaaugguaucacaauggucuuuuggguuuggcuucuuucccucagcaucauacccucaaaguucauccauguuguagcucguaucgguacuucauucauuuuuauggcugaauaauauuccacuguauggauagaccgauauuuuguuuauuuauuuauucauugaugaacauuugaauuguucccacuuuuuagcuauuaaaacuagugcuggcugcgugcaguugcucaugccuguaauccuagcacuuugggaggaugaggcaggcggaucacuugaggccaagaguuugagaccagccuggccaacauggugaaacccccaucucuaauaaaaauacaacaauuagccagacacggucaugcgugccuguaaucucagcuacucaggaggcugaggcaggggaaucucuugaauccggggggcagagguugcagugagccaagaucgcgccacugcacuccagccugggcaacagaccaagacucugucucaaaaaacaaaacaaaacaaaacaaaacaaaccaguacugcuaugaacaugcaugugcauauuguuauacagacauaugcuuucauuucucuuggauacacacacacacacacacacacacacacacacacacacacacacacguauaucuaggacuggaauugcugauuuuuauggaaacucuauauuuagcauuuugagaaacggccagucuguuuuccgaaguggcugcacuauuuugcauucccaccagcaaugaaggaggguuccaauuucuccauaccucugccaacacuuguuauugucugucucuuuuauuuauagccaucuugaugggugcaucgugguaucucgcuguguuuugauuugcauuucccugaugacuaaugauggggacaucuuuucaugagcuuaucggucauauguacaucuucuuuggagcaagcucuauucuaauccuuugcccaucauuaaagguaggugguuugucuucuuguugauaaguuagaguucuuuacauguuuagauacuagucccuuaucaaauagaugauucacaaauguuugcugucauuucuuggguugucuuuccacuuccuugauggugucuuuucacgcacaaauguuuuuagcuuuggccaaguccaauuuaucuauuuuuucuuuuguugccugugcuuuugguaguguauauuaaaaaccauuguuuaacacaaggucaccaagauuuauuccuauguucuuuccuaaggauuuuauuuuuucuuuucuuuuuuuuucuuuuuuuugagacaaagucucucucugucgccaaagcuggagugcaacggcacaaucucagcucacugcaaccccugccuccuggguucaagcgauucuucugccucagccucccgaguagcugggauuacaggcgcccaccaccaugcccagcuaauuuuuguguuuuuagcagagacaugguuucaccauguuggccaggcuggacucaaacuccugaucucaggugauccacucgccucggccucccaaacugcugggauuacaggugugagccacugcgccuggccuuccuaaggauaucauaauuuuagugcuuacauuuaggucuacgauccauuuugaguuaauuuuugugcacagcaugagguagggguccaacuucauucuuuugcacauggauaucuaguugucccagcaccauuuucugaaaagacuauuccuucccccauugaauugucuugguacccuugucaaaaaucaacugauggccggucugaagguagugaguuaucucaauugauuguucacagucaguuacagauggaacaccucguucuacucuuucccgccuucucacugcugcacuugaacagucuuuaaaaaaaucaauugaccauaaaugcaaggauuuguucuuggagucucaacuuuacugcauugaucuguaggucuauccuuaugccaguaccacauugucuugauuacuguagcuuugcaguaaguuugaaucaggaaaugugagcccuccgguuuugcucuucucuuucuagauuguuuuggcuauucugaaacccuuguauuuccuuaugaauuugaggaucagcuuguaaaaagacagaugggauuuugauagagauugugaagcuauagaugaauucgggaguuuggccaucuuaacauuaugucuccugauccaugacugcaggauaucuuuccauuuaauucgauacucuuugauuccuuucaaaaauauuuuguauuuuucaguacacaaguuuuaugcaucuuuuguugcauuuauuucuagguauguucuuuuugccaauauuauaaaugagauugucuucuucacuucauuuuuggaugguucauugcuaguguauagaaauaaaaucgauguuuguauauugaucuuguauccugccacauugcuaugcauguuuauuaguuuuaaggguuuuaguggauuuucuauauauaaugucauauaaucagcaaauagaaaguuuaaugucuuaguccuuuugagcugccacaacagacuaccauaaacugaguggcuuauaaacaacacaaauguauuucccacaguucuggagacugggauguccaagaucaagacacccguagguuuggugucuggucggggccuacuucuggguucauagaugacugucuucucgcugugucccccccauagugaaaggaaggggcccagggucuuucuaaggcuucuuuuauaaggacacuaauccaauauaggaaggcucugcccucauaaccuaaucucccaaaggccucacuuccaaauuccaucaccuggggaguaagaauuucaacacuggggggacacagauauucagacauagcauuuuucuucuuccuuucuaauaugggugcccuugacaucuuuuucuuaccuaauugcccugccagagccuuccagacaguguugaauggaaguggggagcauucaccccaccuuacuccugaucauaggggaagaacuauccggcuuucaccacugagcaccacguuagcugggguauuuuugucagcgcucuuuaucagguggaggcaggucccuucuauuucuagugaguucagugcuuuuuuuuuuuuuuaaucagggaagagugugagcuuguguuugggugccuucccugcgucuguugagaugaucuuacgguuucugucucuuauucuauugauauggcguauuuauuaccuugguugcuuuuuggauguugauaacauccaaacucuucugccaccccuuuuaauagaaagcuguacaacuccccaaccugccugggcgugucugcccaagaugagugcuaguggccgacucccugcuagagugagcacugcauaaacagccucugcuuguccucauuugagugaucuucauguauuccacgagaaaucaaggcacaggggucucauggucucaugaauggcuccaccaacugaaggugugcuccaucggggcugugagucaccucacgccaggcagaaaggucucucugucaaacauggcuucaaggaaccagggaccugguuccucccacaggccaggcccugccccuaagugcaaugggaauauaugcacaugucaccugucccaaaaugcugggagauggcacuucugcagauggggaaacugagggaccagcccgaagucacggggaggggaagacuccuacacacagggaggagaagaacccagccgggcugcaaacgccugcccuuccucaacgugccuccggcugugcccacaucgcuccagcagcucugccuuccucaggcauaagccuucucagggcaggggaggcccagggagcggcgcucccaucccaggccgggcugcugagcaagccccuccccuuucuccccucauccucugacagaguccaccugaauauuuguccuggagccaggauggaagcuccaccaggcccagcuaacaacaggaacccuuucagacgcacuucugggugcguacugugccaguaucacacagacacaagccauguccuugucagccaugggauccccaagguccccaugaggucacaccagugggccacugggaagggcacuucagauguggagcucccaugggccaggcccugcgaagugguccuccuacccccucauagccagucuucccugugagccugcaagugacugugaaugugaguuccacucuggagcuaagacgggcugcugcccccgcaaucagaugucaggcccaugaagcccuccaucaucccacugcagucagaauaaaaugcagccucccucuggccuccaggucccaaggccagccccccugccucccaggcucacaccugccccuaaccuguguccagccccuuuccccuggcucugucuccugcuucccuuguguuccuccaaccucaccugucugucuggagugcuccuccccggcucugccuagcuggcuccuucucaggcaucagggccuggauccacuguggcucuuccaagccucugcacuuggagugccucagccccgugguugaggagugccccaacccugugacccucuagcaagcauccuaggaauuccgucccuccccagcacugauaugaccaucgugcugugacacgugucaucuccgccagaguugcagauccuccaggggaggggucugcugccuggcucccacagccagggccuggaacagugccugacacacagcaggcacccacuaaauauuugaugcauggcugaagaggacaggcaggcuggcugcuggcugggcauggccugcuucugaggcugguggucaaggacacagugugcauggaucugcccccuccucccacuuccugagaguggagccagugucucccuccaccuaccacccccugcugaggacacagcucacaccuuuaacgggaaauguccccaucacuggggacagcagggagcugaugggagagcagguguccaggacauccagagaaauguuuccucacacuggaacccuuuucuauucccuucuaaacaaaaagaauccucgaagacucucaagugaccauauagugucuuuucuuauaaugucacuucgacaggcacaaaauguaaaaccaggcauaaacuacuagugcuugcaguucuuacgcaggcaugaagccaaaaccaguuuacaaauuaaccaccaagaaaaccgguagagcacagaugaugacgauagagcuguuuuguccaaugugagcgcuacuggccacccagggccaugugaauuuaaauuacgaugaaacacaaugaaaaauuugguuccuuguggccacauuuccaguacccaguagucaucugugccaggggguuauccagguacagaacauucccaucguugcagaagguucuaucagcuagcacuggguuggacgacacuugccaagacgagcuggcuagaggaugguucuccggaccuggucccacgugguucccagguaagcccccgcccaggaugcagccccguuguccaucaguuuucuuggagagggcaugggaaaccuucgucagugugucaucuccugcaaaggccuucgcuccuuccucuggggagaaagcacccuucacucucugaaucauuagcccaaagcaguaagugcagcaggccuggccccacaccuuccggaagagccacggugugaggcuggcaucccuggggcacgacacaaccaggauguagacgaaauagaugcaauaucuggagguucuccuauaggugucucuggccuccuggacacuucacacuguucugggagcugcccucucaggccccagugaccuuuucagaugcagacucccacagcaugggucagcaauucuccccuuccgugagacagggauugguuaccuguacuaggaccuugaggccaacacugacuagggggccucaugccugcccagguuccagccccggagagcaaugugagcaaagcuugcugucuuugcaaagccaaccacuguggcaucaacuccuucaggaagcccucccggauuguccaaggugcucaccuccuuuggggagcccucccagauuguccaaggugcuugagggagggaggaauggguuguucucccggcaccggggcugcacuccugggcagacgcugcaugccuguccucaggcgcggcccugcugccacccccuugggggcucggagcgcgacagcagcuuggggacgccucccgcgcccagcacggugcaccugggcccugagguccuggccgaaacgcgccaaguuggggguaggugcagcgaccccauaccccucggcugcgcgcccuggcggcaggaggcggggccgggggcggggcgugagcuggccggggcggggccuauggaggggcgggaccgcggcgcccuauaaguacugcggagcgaggcgcgcgcccggccagagagcgagcgcgcaacggcggcgacggcggcgaccccaccgcgcauccugccaggccuccggcgcccagcgccccacgcgcccccgcgcccccgcgcccccgcgccccuuucuucgcgcccccgccccucggcccgccaggcccccuugccggccacccgccaggccccgcgccggcccgcccgccgcccaggaccggcccgcgccccgcaggccgcccgccgcccgcgccgccaugggaguggagggcugcaccaagugcaucaaguaccugcucuucgucuucaauuucgucuucuggguaagggcugcgccgggggccggggcgggagggggcaggcacacacuccacguugggcaggucccgcggcagcgugcuaggccccgcgggcgcagcgcgggccgcgaaguuguggggccaccugugggcuccaggagcgggguggggggucgcccggggccaccgcgccccccgacauuggggcugagggcugcgagccgaguuucggggccucugugcucgggggcccaccucugcggccgggccggggcuucugggggccgccgggcaguucccgcugugguggugaugggugcgguggucgcgggucgggacccgaguacccggccgccccucagcuaaggaggggccugcgcgggucccuggccgcggauuccggacugcugcuucgcggggacgaggggggggcucgcgggcgggacuccuggcgccccgcccccaugagcucaucaagagccgccgccccuggaugguggggcgggggcgcacacuuugccggagguugggggcgauccgccucacucuuuccccagcccagcucacucuccaaucugcggucaccacccgagaccuuccugggggucgcgccuaaaaggagcgcagacucccgccgggauggcccagaagcuggggugcgcgcacccuggccgucccugccugggagccgaucucccucuccucacccagacacguuccagcggaggccuccucccagaagggcucuggaggccucgcaggaguggggaucccgcgguucugaguuggcacaaggaagagaguggcaccaggggccuggaguggauggcaggguccgggaguggggccgcugcuuugcaagaggggcccccacgcugggcaucuuugggugccagcguggguggaggagggucuuuugcugagaauggcuuucuccugaccgcagucuuugcugcugggaagugacugaugggcuuucgccuuuuguuuccauuuccugucgguguuagaauuggggaggggguggaaaucccuucuuggccuggaaggacuggaguggguguccauggccgcggccuccccguggccacgccccugggcauagacugcaagccccuccccgugccccccaggcugucacccccuucucguggaagacucggcugaugucccaguggaccgaguguuucucaaguugaggcagggagggcaaacuuuuuaaauggccccuggagccagugugugggaccagagacaucuguuucccaucuggacggcugaggaucccagugcggaugauuauuuggagggggaaggacggaggcugaacugaacucucagcugggagaugaguggggcagucacaucccaccuuccccaagccgggcuguucugcacagccugcuugggacgcuggugggagucacuguggccuucggcacugcccuggcagugggggcagcuaggccauuugggaggggcucgccuuccccaggcccggcccugggaccucagccguugcuuagugguggccugcuucagcccaggcaugugggagaggcaccagacacaggaugucccucugccagccccugaagccccguccccugacgaggcgaguguggaccugggggugggggcugagggagacuguggaccugggggugggggcugagggaggguguggaccugggggcaggggccgagggaggguguaggccuggggguaguaggggcugagggagaguguggaccugggaguaggggcugagggaggguguaggccugggggugggggcugagggagaguguggaccuggggguaggggcugagggagaguguggaccuggggguggggguugagggaggguguggaccugggggcaggggcugagggagaguguggaccuaggggcagaggcugaaggggagucacgggaggggacuucuccggagguggauuuuugcucucuggacggugugucagcacugggugagccccuccugccugcccaggcugagaggucucccuggcagcccccugggagugucgccagggcgggccuggaaguuucccaggcagcugggguggagaccugacacaucccaagggugcuuguuauuaaggcucaaggaaaugucucugaggccucaccgcuccucuccccagggccugcucccugcaaagcauugagaacugaguccguccacagucacuguggacccacccauccacuggggcucagugguagccagcaaugccaggcugggugaggugggguuggugggcaccacccugguggaccccccuccacccuggugucgcaggguguguggcugagagcacagugccaugggcuugggccuccuugguggaguccccaacacacugcucugguccugggccucggccuuccccgucugcagugggggcccacagugagccuaccuccuggugguguugguggauuugcugacaugccugaguguugacagggggcuuggugcaggaagggcucagggcguggguguuggccagggguccaaagggaccucugccucagagagcccagcccagacaggcaggaugugcaguggggaaggggcugcgggaacccugcaggguccagaaggacacagugcaguccugugggcucuggggaggcugguggggaggagguugacaauggauaucuggguggggcacuuguuagaaguuccauuuuagagaggaaagaggccuugccugugggagaaggcagcugggguagccugaccucuuucccaggaaggagcccacacacacacgcacaggcacucacacacacgaaugugcacacacacacacucccaccuucacacacacucacacucuugcugucucccuucccaagccaaggugcgagggggaaggucugggcagcaugcaccugcgcccugaccgcuuugggggccagugagaacugggcucccugggugcgcggcgggcccaagcagggaggacauugcagaugcccuggccaagcagcguggaaauccugucccuugggugggucucggagccuccaucagaggcggcuggcaccugagacccaccugcugccaggagcagggcaggagaguuugugucccgggacagggaacuggccugugggagccuugccuuccucaucuguguaauggauauaagagucuucuccucgggggcuggccagggaguccagaagaggugucaccaguccccgcagggagaagagcggugucccccgccugggacuggcugcucccccaagcuaaugcagcugguagccaccucccaguggcagggcagccaaacccggccgggaaagagacugauuagaagccucgcucacggguauuucucgcuuccagacagcacaugacugucauuuggcacgucuuucgccguccuuccgggagaggggcugcaacccuggcaggcgcugugggggagggggcuaggacauccugugccugguuucaccaaguggguguguggacuuucccuggcucccccaggcugucuggcugcacagcuuuggggaaacggccacugggucaagcgggccgagaagaggaagucugugguuugucucugcuacagacuggccccagugaggcuguccagcagugcagggcacagagcaaaagcagggagguaugggccuacuuccccggucgccccuguggcuggcuguggcucugccgggugcugacaagucacucgcccucccugcggucaccagggugcaugcccgaaagcccuccauucuuuccuggguuugaggguccuucuccugcacccaccccagcgcccaguucagcucaacuuucagaaaucugguucacccccaaucccuuucucauaacugcuuccaagcccagacaaggagacagaccccaaaagaucccuaccccuauuuccgcaccugaaaucgcaccacgggaagagcuuugcucauagagucaauaaggcuuagaguccaggcgccugugcgagggagcaggucaucacccuuguacccaccgugguuuuagacaggacccugagguugggguggggcuggggcuggagaggagccaggugcccugccccuugcuugggccccgugucccugugauccaggcugggcgugcuaugggugcugggugauauuccagcccugcagguguccgccuuguucccagcaccccucugggcaagaagaaccaggcucucccagaaaugggcuucagugaucuccacuuccaagucguccccaccugccuuguaggacacagugguaccugguaugcugggcagccuuccaggaaccucuggacuuacucagugucccccagcccuacacaccauucuuuguguuucugggcccaaacuaagccccccaaccugggcugcagagcaagugcugaaucaugagagacccuugaggguccuccagguaggcccccagugcuggaggaguccccucaggcagggggccacgcccaaggguguggaaggucagcuggcagccggaucucacuuuuggggcuguaggcuuccugcacuggccgccaaugccauggccgugggauggccaggauaaggcaucugccccccacccccaccccccgcacaaggucuuugagggcugcgggcucaaggaguuggcgguagggcugggggaccaggggcacagagcuuguaagcgccucucuccaggauguggguggcccagcaggggagcuuugagaguccaggugugagauuccaaaugcuaggggccugagaggagggagccaccagcuuggccagagccugguggaucacgcccccaccacgccuugcccuucucucuggucaugugcucucccaccacguuuggaaaguuacugcuucccucuuccucagccccucgggcucccaguuauggaaguggcgugauucagagaagguaaaggaugggagggagagggcugggugaugggggaccccgcagggcgcccugugcuguuacauggagcuccaggaucagggcaggugggcagccugggguccucacuucucuccccagccaggccaggucccucacagcccugccaggagcaugauauccgcugcggugcagaacuaaucucaaagcucaaacccagguaacaguguagguaaaacagaugacagggcaugagacucaccccaggacaggcgaaggacccaggccgaugggggcccagaacaguccugauccuggagcuccuucccgagugggaccccagggguuuccgaggggcuuagaguagggcuuagaggcuuagaguagggcuagggacuuccuggcuucccugccucgggaacagcugguccuggaaggggcuugguccucggggcacuggugcccaccaccccugaugccugggagacaccagcauccucugagcaugugugcguccuccuggucccgagggaagugacuccucacaucccccagcuggcggggccagagggccagcauccucgccugacaccuauuuuuagaugcugagacaggcggcuuccucggggccaggggcccugugaguggagcuuccgcuuccuggccuaggagagaauuccugcuccucuucccuccaugcugccuuuucgccccuggaggccacaacggggucagaggggcagcugcucaccaccuaggagggccugagagggcccuacgucacccagggaggagucuggccccguccccaaccuccacacccaggccuggcacugccccuucuuggugggcagagagugagggguuggccugcagggacccaggcuggaggggccguucaccuccggcccccagcgucccuuccuggaagcaccuuggugagccccuccccuccuucacccaguaucuccagggguacuuccuccuuuccuuccugccucagggccucacuguccuccuggggagggugucucaggccccagcaccucccaguggcugagccgaaugggcacuucccgguguguuucccauaugugcagucccuaggugucggugagcaggcacagagcccgcagcguggcccugccugguggacccccuccccaagagcaucaagggagggccuggacuagagacacacagaugcccagccuguacguaaaggcgggugagcugauguaccaucguccucgucccccacuggggugccugggcaggacuuggggugaccacuuggcccgucuggguggggguaagguauggguggggcgaccagaucccugcccuuuccugcagcugugggggugugugugcuggccuggagagcucccacccgaaguucuggcuccuggcuguccggggccugcgggggcagcgagcagcuggcauggguaggggagcugaccuaggccugcccgggcagcgccugcugccuuuugcucccuuucagcugcuucuuggaaacagcggacaggcugggcaggaacccagugugcuuggcagccccccuuuuaaagucgauucuguuauuuauuaauucccaggaaggagaaagaaagaaacaauccuucauagaguacaaacacugcuuuuaguagccuugcaaggagcccuccaggaaccccacagguuaccugggcuccauccugagagccacccuccauccccaauccccagcagagcaucuugugggguggggcggcuuguggggcggggcgccuugggaggcggggugucucgggaagcggggcgucucgggaggugggguggcuugugggguggggcauuuccugggguggggcgucucguggggugggacagcuugggggguggggcaucucgggaggcggggcgucuugugggguagggcggcuugugggguggggcaucuugugggguagggcggcuugugggguggggcaucuuguggggugggacggcuugugggguggggcaucucgggagguggggcaucucuggggcccggccacuugggaggcggggcauccugggggcggggcaucucagagggcgccuccggaggcuggaguaucuugggaggugggagcagguggcagagaggcuucccacaggugagcuuugagcagggaggugccuguauggauggcucuguggggagaggggugacaggaguuccagauuccggcacuuaugaaaccucacagugauggagagccgagugcugcugugcaggcuaaguugugugcaugucagcuucugcacuuuuauuuccuuguuuguagacaaggcagagagaagcugagaugggccugaggucgccuuggugaaaggcacucagcagccagggccuugggcugcccucccucaucaccgugaaagcgggacucucuuuuaacugacaucgggcuccauaguuacuccaguccuaacuuugauggauccuaaaagugcacuucuaaggacgcggcuucgguguuucccaugccgcugcuugccccugggaagcguuggcucugccucggaagaaguuagcgccaagauggcagccuggggucuuuggggcccagaagaaacacuggccccggggaguucagucaucagggacuuaggaugugggggcuuuucaaacagcuuuauuuagacgugauugacacacaguaaauacagauguuuaaggguacaacuugguaaguuuugacaaauuuauacccccgugaaaccaucaccaacuccccaggugccccuggggcccuugggaucucugcuuccugccccuccuccccgucccagggcaaccacgggccgucgcugugggugcacacagcaugcauuucuucaacaagcggacucagaaggcacuugcacaucguugcuguucugccucuuugcuucagcaugauuacccagaggcgcacccgugccguggccugcccgucgucuaugcacccgugcuguggcgugcccgucgucuguguggcaugccugucugugcacccgugcuguggcgugcccgucgucuguguggcaugccugucugugcacccgugcuguggcgugcccgucgucugugcacccgugcuguggugugcccgucgucugugcacccgugccguggcgugcccgucgucugugcacccgugcuguggugugcccuucgucuguuccuuuuauugccgggcaggguugcacccacaugugcaagccagcgacggaccccagguucacccguucaccggucagugggcauauggguuguuucaguuuggggcauuuacaagaaacgugcuagaacauuuguguacaagucuugugugaaccuaaguucauuucucuuggguaaauaccugugcguggagcagcugggucauguggugaauguggguuucacugcuuaagcagcaguuuuacauaacugccaaacuguuauucaagguggcuggaccguuuuacagcccccguuguaugcgucccaguugccucccccagcagcauguggugugguuggucuuuuucguggcagccaguccacugggugcgcucggcauguggcugcagcuugaccuggguuuccuggucccuggcaagguggagcaucucuucaugugcuuuuuugcuguguguggaucuugcggggaagggucuguuccuguuuuuugcccaucuuucaaagauuggguugccaguuuucuugcuguugaguuuggaaagcucugcauacguucagggcacagguccuuuaccaggcucugccccaggucuuucggagagcaggugucuuucgcauuccugacucuggggaaccucuagcccugccacaugggguuuguuauggggcaggggcaccugugccuuucccaccacggggcuuggggauuuggugcugccauugcccucccucguagguggcccuaggggggucccuccgccuccguuuccucauccagaaaccggcagugaccaucaccaccauuguugucaccuagcuccagcucaaggucccugcugaaggucggagagcuuggcauggccccguuuguccaugcuagggcugggaagaccaaggcucaggugaggccucugcccagugccuggcacuccuucuugccccauuuuuccacccaggguggcucccgacuacuucugguagccucggggacaguugagguggacaggcuggcgucacccccauuuccggcugucccucccacccccuccuggcccagcuguucugcccuauuaaaagucacaugggcccucggguccuuccugguguuggcccaggcucuuucaggcccugcaggccaggaccagccuucccugcaacccucggcagaggccuggggccggggcuugucuaggggcagccuccccauacggcccuggagucugaacagaagccccuucccagagcacagcaagaagcugcaacguggccugaagucccaccauuagcagguuugggguuuaggcugagcuuugccaucacuaccuuucuguuaggacgguaugcccauuagaugggaucauccccucagcgcccaggcuagaggagggguggucccugcccagccagggagggcuggggguggaugggccucuacagagcagcuuccgagccaggcacgguuccaugaucagcucuguuuuauagagggggacacugaggaaccgggagccuggggaccuuccaguggccccacagcuccuguggcugagucaggguuugucaccaggccucuguggggaugaggcucccccauccaccugccccacucuguccuggaacagcucucaaaacggucucuggaccacaguuucaaaagaaaauaagcaauguuuucaaaggcccuggaggaagccagaguuaccacggcaacucucggccucgccaccuccucccgccaggcugcaucuggagccagcucaggagggcagcagggugaggacagccaggcucucuggggccaccccccagcccccacccuuccugccucuccugcacuguccacggcccucccugugcucccacggguauaaugggcacagaagaaccaggagcugucugccccugcaggauucuggaagccaggggccccuggccucccuggggccuugucaugugaggggcacacguggggucccagcugccacauggcuuccagcgcugcccgcagguguauguugggcccuuggugacucuaaugcaccuuccacucggcacagaagagcuucagucuggggccugggcgggggaaguaggcugccauccucgcuaaaccaaagugugaaaauugaguugaaacucccauaggagggcaggaggcacagcuccucagaagaaggucugagaaaccacagcccagguuguuguuucggguguguggagaaggugcucuggcaguccugcuacagggggaccaucaacagccccuuuggggugagagccccguggcugcuggcaccagcagccccuaugaggcuuauuuuauuuuugagacagggucuugcucugucaccgaggcuggagugcaguggcacaaucauaacucacuguagccucaaccuccugagcucaagcgauccuccugccucagccuccaaaggugcugggauuacaggcgcuugcuaccacgcccagcccccucuggccuuauuguuugccaggcccagcucaggucccggaggaggggagacaggagugugagggaaagggggaagagguauagagcccccagcuccuccacccacccgaacccucaccgaggcccuagacccuagaccggccugaccgggggguccucaggccggggacuugggugcaggccauggugcuggggccugaagcucacgcucugcugagcacagcccccugcccaaccccacccuggggcccugcuucccuggccagggccauuggaacaggaguggggcuguccaggugguguucuuggguccagcccucaguuucucuucugcaguugaccggcagcccugcaucugugguggggucggcgccuggugcuggugaggcaaggccucagcugcugggacaggaccugccuggcacccagcugguggcagagccaagcauuccgacucagcucugggagcagcugccuucugggcuggcauucuccgccagggggguugugcccucguggccccccccgggugccuccucaccuggcugauuucaucuccugucccccugccuccuccuccaggaagcccccagggccuggcccuccuugagaguggcauggaggaggaagaagacucgcccaggcccaugggagucggaugguggccgcacuuguggggcccugaccccauaggcuucuucagcacgcccuggccugggugaucccugccugagggcugugcacggcucaucugccagaccagauuuuaggggauucuuguacuguccuccuggagcagcaggggguaaagccugacccacccagacuguccagcaacaagggccuccugcugugggccagggacccuggaacugaccaauuguguccuagggacgcagaguccccaggcugcuagagggcuguggggcccuguuucaugccugaagcaggaagaaaccccaggagaggucugaaggggacccagcccccacccugucuagcagggaggagccucugcaagaggccgaggggugcugaaguggaggaggauagaggcagcaggacucagggucacuggucauuuauggggaucacacggcugcagugugcccugcauggugcuaggcaccagggacagcagaggacaagccuguguccucucccaccaccagagggcugggcacugccccuagggagagagggggccuuggugugugcagaggggggccuggggcacgugccuggccuggucagaugaucagagugggcugggcugggccuggucuggggcccagucucaagggcagaccccaccuggcuagaguugauugugugcacaccggaugacccggcguugaaggccucuccucucugugagccucauccccaccugccagacucccagcacagccugcuuccugccccagcugcugagcgacagcgcugggccggcuucugcgcgccccuucccccagcccaucuuggaaaccacagcagcguccuuccucccaagucccuucccagggcugacaucccacagcagggauguaucccacaaaccccgcaggcccuggugccuacagcuuggccugguaacaucaaauccuacccucuccuccuggcagcaaagauggggugcccccaccccagaguucucagcacccccagacagaagcagucccccagcgaccucagaacucuuggggcgcugccacacccuugcaggagggggcaguguuccugggaugcucagguccugguaucaccucuggccagauacggaaggugaaacuacagggcauccaauucaccuugaacuucagauaaacaccagauuauuuuuuuguaugucccgugcaauauuugggacacacuuacccuaaagaaguauucuguuuucaucugagaggcagauuuaaccggcgucccgugucuuccuggcaguccugcccuggagucacacuccacaggugcagggcagggccaggcuccaaguagauggcggccaaagcacccgccccaugcuccugacucccggggcucuucagggcauugcgaaaaccagcagcagagcugacaccuggucccugcucgggagccagcaaggcaggaggcugcuuaggccuugcguguggggugggcgcacucccugcugcagugcucuucguacaugugacacuguucccgcucuuucccagcuggcuggaggcgugauccuggguguggcccuguggcuccgccaugacccgcagaccaccaaccuccuguaucuggagcugggagacaagcccgcgcccaacaccuucuauguaggugagugcacauguggccgcagacgcauucagggagggcuucuaggaggaggcagguccuagccuuuuggauggggacauggagggugaaagacagucgggcauggcguguccgggcagggaggcggcccuggaaagggcucugggcacaaggguugagauggaggugggccuguggccugcuggcccuucuggucugagccagggcaggggguggcagcuaggccugggcagggacuguguggagaccuugcuuauuuuaagugugggguuauuucgggggaggcucccugagaaggguggggcuggaugccugggccacacagagcagccgaggcagcuggcgcuguggagcccgggagggagggagggauggagcucaagggauggaacccagugagggguggagacggggcaggggagggguggagagggguggagacgccccagaggcggugugacucagcugccccugcaggcagcugcaccuugcugccuuauuaggcugcgugugggggacugggcugcccucccugcccccaggagcaggagcaggagugauggaggaggaggaggggaggggcaaggccaggaggaggaggagggccaucucacugugcagagagcagcacccuuccuccuggugccccuggcagggcuggugcugguggggcucugggagcauuuguugagaugcuucuggccuugaaaggaggccccugggauggcucuguugcccucacaggcugaggggugggugaggugggcagccuguguguccccaguccucagggcuucccucagccggcaggugcccccaggccuggagcugcagggccaggcccccugccaguuacggaggcugcuuggcuugguugcugaaccagggccccaggaggccgaaauagccccacaccugcgccgucccaccucuuuguccagucaccccagggccaggugagggcccuggccacacagcgugcccguuccuucuuccccaugccccgcucaugggucagagggccggugcugggguccagauggugucaacagggauggucccuguccuccccagagacagaagccuguggcccacggaggguuucugggcccagccgauccuagggagggucccauggcccugcccauagguuccuggccucucucggggccguggugcccucacagguggugucaggaaggacgggaaaggcugcuugucccaggggcucauguggagaccacccccugcacgcagcuggggcgcuccugccuguguccucagaagcacucggcuuagcuuugcccaugugccugggcuguggguggcagagcccggccagcauccuccgaucuccaagggugcaucucuacuggaggccccuccugggccucuugcuccccgcuucccagaucauuaggauauuugggguccagaagggccucccagccauccugggccuuguccuccggggccaccaguccagccagugacaaccacagcauccccggccuggaacgaggcugcccccagcacguuccucguacuccuguccagggacaggaggggcugccccugccaccgaguccccuucuccaggaccuggggccugugggugugaggcagguguucuuggaaggggucacucuccaggcacccggcggccaaggcuuguggcuggagcagcucccgcuguggggucggcgucgggccccguguggccggagaggagcugaagggucacuuagcuucgggcuggggcgaggacaggggacaccccagagagguaugccaggccuccuuccugcgccccacucucggcagaagcagaggucacaggcugugcugaggccccauggugcugcccccaugaugccagggugaggcuggcguuggaagcaggugucugaccugcauggugucaccguggccacaucagagcuccagccccagagccgcccacccucgguccuuggcugugguuucccugggcuggaggagccugccguuguguuggccacacgaccacaggaccugccacccccgacgugggcucugccugggcccccacuggacagggaccccuuggagcuccucuggccaccaaguccucgcccauuccagaaucggccuucuggagccucuugcugucccugaugcgggcugggccuugccaagggcuuuuuuuccugcgccgggaacaggguggauuugcugggcucacuccccucagagacgcugcgggugcgguggguuaggcccaagggcguuaagagaggaggcugggguggggcuggggccuggcagggggucuggcagcccugggccucccaccuccugucaggaccaaaaaaggcaacgcgccucuccugaccuguaccccggagugaacccaaccuugcaacccaggagugucagggccugaggggagggagaccuggcuccugggugccgugcccguaaggagguggccaccugcagggcauuccuggcagaggcuucaucuggccagguaggaggcuggguggccgagccccaaaucuggguguguucucugccuggcgguggguccugccccaggcaccuucuccucugggcuggcugggcagggacaaugggccuggcugcgaggagggggccugggcugccuucugcauugccucggugacgggagauggccccugccugcugagggauaggggagugggcaggcagugagagacacugacagcugucccgcggguacagggcccugucuggguggccaggcccaugucucgggcccacagugcgccccccacccuuggacggcgccuucucccuccccaggugcaugcugcccagccagggagcgugggggaguucgggagggcuggccuacacgcccugguccagcugucccagguggggugcugggcuucagcccucagcccagggccuaggaauccaacuugauccuccccacacagcagccagguucaaaugcaggucccguaacggaagugcugcugugcagcccagauuggggggcaggagccagcagggcccccccacccucuucucgcaccacacuggggaggcagcauugguuccaguuccgguuccugggcugcccucucaaccccggccuacaguggggcccacccugugccuucugaugccacucccaccccacgccaagucccagaggcuuugggagcgggugaaggcgguggguggcggguggcaggugcaggcggugggugguggguguggcagguggcgggccccaccgcaggugucaucccugcgaagcaccugucgccagcacucagagcgcucaugaggugcccaguccccauguggccuccuuagucuccguccugugucauggaagagguaacugaggcacagaaaacucaccaggccaggcugggaugugaggucccuugcugcucaucccuggcagucagcaacccuacaucuucccagcugggcggcccgugguggguucggcacccaggacccuccggggucuugggcuguggcgaguguguaggcacccaccuggugucucucuccccgcaaggcaucuacauccucaucgcugugggcgcugucaugauguucguuggcuuccugggcugcuacggggccauccaggaaucccagugccugcuggggacgguaaggcagggaggcgggccugugccugggccggggaggggcugggggcugcgucuggcccugaggagggggcagagcuggugcucagggcggagccuagaauucugggggagguggcuccugugcccugcuuuucccguuugguuuuuaaauuaaaucccaccgugcuuggucuccaucguggccaguuccuacgugaccgcuuuucuuugucaaaaaauagccacaaauauaacagggagcaagccucagcucugaggccagccucggcgucccgggcacaccgcccccugugggaagcccaggccuggcugugccauccagggccuggccaguccaggaagagggagccuaugcccgugucuccagugggggaaacugaggcagaucccauggcucccccuuccguggggagcaggaacaaggggguggggaagaucagucaggggucaugcugcugcacacgccucccugggggcugcagacauccuggacucaccagccugugaccccaaaccacacgccccgccccauccaccccguccuguggagccuggugccgcguggggacauccugggcuuugacggcuccucccugcgcugaguuuuagccucugugccccagggcuccacacaagccgcucacuccuggucaggucgugggcugguggcucccacuagccccucacagacacgccugcugggcaccuggguguguguccuugggccccgccuacagccugcccucuuuccucccucuggccacugcccggcuccaguucuucaccugccuggucauccuguuugccugugagguggccgccggcaucuggggcuuugucaacaaggaccaggugagccugggugugcagggacaggguggggugggugacgggggcacccuccucuccugucgcggguggggguugggcugacucauggcuugugggagcucuuugggcucuuccugggucccacuugccaggaggaucuccaggggcuuuauggaggaggcagcauuggggcugagcaccaggccagccucccgugucccagcacucccggggcagcugagagugcagaguccuuguccucuggggucuagccucgaagccacccugcccagggagagccugggaaaagugcguccgccuggggcggggcggggugggggcaaggagggggagguucccccugugcaugugaccgcaccccucccccagaucgccaaggaugugaagcaguucuaugaccaggcccuacagcaggccgugguggaugaugacgccaacaacgccaaggcuguggugaagaccuuccacgagacggugcggccccggggggcgagggcggggagcagggccccgggaacccggcggggugugucucguccuggaugaauccugccuacgcccagaccucaggagcaggaggugcccuugggaccuccaggaccccuggucucaacugguccucgggugggaaccuagugggccaggguggcccagggugcggaaagcucugagcagcgcagcugaggaggaagaaggcuggccccuggaugcauucugcaguggggagcgcugcguaccccuggccaccuccccauggguucccuagagccaccgucccccugggcacauccagggcugaccuugcaccccugcucucugcagcuugacugcuguggcuccagcacacugacugcuuugaccaccucagugcucaagaacaauuugugucccucgggcagcaacaucaucagcaaccucuucaaggugcgcgaggccgguggggccgcgccugaccccccgcaugucccgccccugggugggguccuaggggugggcaggucacacggcagccccacagggagcgaccacacuggguggcauggccccugucagggcugcucugcugggaggguuggggugggaccgcaucuggcccacgaggaaggcaggcgcccugugcugcgcauuccgggugaagaagguggaggcucuggggggugggaacucaccugcacccccagcuccacgugugcacucguggguguggacgccccugacagccuguagcuggcagggccugcaggccauauagugcccuguggaaguuuccugcugaggccucaguggaagucgucaucagugaugcuuuaggggucuagugacaccaaugaccgugaucucaguggaaaagggcacagugugucccaggcauuucgcguuuauguuaaaacggguggaagauagcaagccggcagaggccgggccgcugcacccgccuguuccgagguggguaggggguggggggcuguucccaggauuccccucuacgcuuucuguggugaccacggauuacugcgugacaacgggaagccgggagccgaggcccggucccugaccacgcgugccuggccaccccugcaggaggacugccaccagaagaucgaugaccucuucuccgggaagcuguaccucaucggcauugcugccaucguggucgcugugaucauggugagcgggcgggggcggagggccugcucucugggcugccccuuccgcggggccuugugcugacugcgccccccaccacccuccugcagaucuucgagaugauccugagcauggugcugugcuguggcauccggaacagcuccguguacugaggccccgcagcucuggccacagggaccucugcagugcccccuaagugacccggacacuuccgagggggccaucaccgccuguguauauaacguuuccgguauuacucugcuacacguagccuuuuuacuuuugggguuuuguuuuuguucugaacuuuccuguuaccuuuucagggcugacgucacauguagguggcguguaugaguggagacgggccugggucuuggggacuggagggcagggguccuucugcccuggggucccagggugcucugccugcucagccaggccucuccugggagccacucgcccagagacucagcuuggccaacuuggggggcuguguccacccagcccgcccguccugugggcugcacagcucaccuuguucccuccugccccgguucgagagccgagucugugggcacucucugccuucaugcaccuguccuuucuaacacgucgccuucaacuguaaucacaacauccugacuccgucauuuaauaaagaaggaacaucaggcaugcuaccaggccugugcagucccucagugccaguggugucugagaccuagggguuggccggagggcaggggaaucugacaucgguggggcuuggcucuguggacucugugggguccagggugagggugggugggucgggaucccugguguucaccaaaggagucacucuguaaaauuuggggaguuauuuauucugagccaaauaugagcaccgguggccugugacacagccccagguccugagaacuugugcccaaggcggucuggcuacuuaauuguauacauuuuagggacauaggacauugaucauuacaucuaagauguacguugguuuagucggaaaggugggacgauuugaaggggagggacuuucaggucauaggcggauuaaaagauguucugauuaauaauugguugauuuuaucuaaagaccugaaaucaauagaauggacuaucuggguuaagaggaguuguggagaccaagauuauuaugcagaugaagccgccagauuguaaauguuucuuaucagacuuaaaaagguaccagaaucuuaguuaauucucuccuggaucaggaaauagaccuggaaagggagggggauucucuauagaauguagauuuucccaagagacagcuuugcagggccauuucaaaauacaucagagaaauauauuuugggguaaaauacuucgguuucuuucagggccugcugucacguugguaucuuauuacuacagagucuguuuugugagucuuaaggucuuuuuauuuuuagacagaguuuugcucuugucacccagguuggagugcaauggcgugaucucagcucacugcagccuccccuccaccucccagguucaagcgauucuccugccucagccuccugaguagcugggacaacaggcaugcaccaccccacccagcuaauuuuguauuuuuaguagagacgguguuucgccacgguggccaggcuagucucgaacuccugaccucacgugacacaccagguuuugggauuacaggugugagccaccacaccggacuaaggucucuguuuuaaugugaaugcuggucagcugugccuaugaggcauguucggccacccacagucaucauggccucaacgagcuuuucagguuuacuuuagaaugcauuuggccaagaggugcccauucaguugguugggguugcuuagaauuuuacuuuggguuuaaaccagggagcaacuccagguagcaagggcccuuuuugggagcguucucucuauucucuuuugggagaggcccuguguugccugcagccacuuccacccugccccuugggcacacaaggggcacacaguguaagcaggugggcaggaggggucgggcagccagggaaugcagugagaugggcuugggguaggggcugggugcgcugcaggacuccucuuccuccugagggaugguaaaggauggacacacugcccccucccgagcauuugagggucucugcccugcccaucuguuaccuguaaauguuccuuugaggagcugauggcucaggccugagccacaucucagagggucuggaggggaagaaagaccucauccuacuagggagcccccccagcccaccagcgagcggugguugggggcagacaggcuguggggcuaaggagccccugcacucccccguccuuuucccuuugucugagcaccuccagccagugggcuuggucuagacucuccuaucuuuccccacaucgugggguggggcuugcucuggguuaggcuacuuuucccuaguuguggggaggggggugcuggcacauuucacuguucccuggaggaaaugagugccugggaauucauaucuagggcucccagcagccucuuugcaggccaauuuggaaacuguccccagcccugcauuuuaggggguuacagagucucucagcaggcccuccuccccugcugcucccaacuugcaagccugcacugguugggagaacauaaugguccaaggagcccccucucuacuuuccgcuguguucccuguggggagggaagagcaguuuaagaaauaaggaaucccaaaggcgcacagcagaccgggggccgaggaguggguccugcuuccccuccuuuuuucuaggcugagccacagcagguccuugaauccuauuucccagcggaugccaggacagcaggcccugggggaguucucucucgagccuuucagagggaccagaggucuagcagccaaggagaacucagaauccuugaguguguggggcaggaacucucccagcugagaaggggcacaaggugccaaccaucuagggcccaguggccaaggaagacgcggcuugucgcagggagaaucugggcccugguccucccuuucagggcgggcagcugaccugcccccugcugcggacaggcgaggccaggcugcuggcucgcaagcauggcggagcccaaaccuucccugcugccgcccgcccagccacggcugacuuggaagcuugaggagcguucagcagccuccauccugcccgggaggaccggggaccuggaagggccuggcccucgcuucccugcagcgcccuagggggacgucucagugccucccggagcccggaccaaugcaccagagcugagggcccaagggugugaggguggccgggcaguggccccgaggacggcgccccacaaguuugcggccagggcccagcaaaccccuaggggugggaaagcgucggcccagcuagcggguccagcagggcugcccccuucaccguggcccagcggucacgaccccacguccucaucgcgggcugggacugccucugcgucuggccugagcgggaccgugggauccuggggagccccgccucggugcacugacagagcccagaaggagugacgguuaccgcuuccggucaggaccggaagugccgggaacggcauucguccuccgugcgagaugacgcacuuccugccugaggcggccgcuguucucgcggcuuccggcagguggcgcugagaccacgggaagccagccuggcugucgguuagcccucgagcauucugggaauugcaggccuggccccuccucuuccuguucuuggucaauuccggucuuguuuccccaacaaaugccgucguuuccggggcugcuuccgagccggacccaagggccggggcguggaggaguagaggggcgagcgcaugcgcacaggacuacacgucccgacaggcgucgggagcggcggcccaguuccuugugggagcuguaguucugcaggcgcggaagccguggugcucggccggcagagcacucgguuucccagagggcugagcgcgccgcacggaggugcggcgccgaccaagauggagacugccgagcagccuugagccgguagguuuguggugagggaggacgggccgcgcgggccggccgagccuccgggaggucaccgagcgcagcuuuaauaccugagcucgaaggccccgcugugcucgccgacccccguaccucgcggccgggcccuugggacccacagcauccuugugaggcccggaggccuguccagcccgacuggacagugccgaggggcaccgagagccagcuuggcaccgagaguucguuuguucucuggcggggaggucuugcuggcacauauaguggagaaaggccgggcucugcguucauguggagaaagagacggcuuccuucagccuacggacaugaaggagucaacucuaccuuccacucguugccggcuuucgccgagaaccccgagaaacggacuaccggagucccuaucuugcagcccgauccccgcuacccgucggagugccccgcugaccaggcugcuucuggccgcggcggcguuccgcugcagaggacgggagugcgaaucugggaagcaggguucugguugaacuccagcuucgucugcaacauacugugugacuugggcaaauuauuucccccgccccguuccugccagcuuuaaaacggucaucaguggggggugcugcguauccccuuucacugggguggcuucuucacugaggagagucgcgccucagaggaacugagguccugccuguguucgaccugguggggggcacuaagagccccugauaguaccccugaccccauccuuauugggugcacaagacacaggucacucugggcgggcaaggaguuuugguagcaggagaggagucgguggauggauggcugaggacagugcagaaggguguggcugggccgucuuuuuuugccuggaaauucaaguucugaggcacccagucacuccagcacuaaaugggugcaggaggcagcacuugucugcccagcuggaaaggcaggguaugugcugaguguuacagguggaaggccacuggaggucgcuccaggagccgcggggauuuaccucugccuaacagggcugcucaaggugauggucgacaccccacuuuccugagagcuugacccucagaugccagggccuuggcugcagauuccuugggagcucccggggaucuuccagcaaauaggagcaaaucuuuuccccguggaucaggaaggugcacgcucuuuguggaauacgacugcucaccccgcacagcaagcagcuuauaaguggcccuccugccugauuucagcccuggguucaagcccuggguggcugcuuacuaccaaaaucgcucaguagcuccaagccugccugcagaggguuggcaccauuaaaugagguaacgagucaaaagucccuacccuggguccuagccugucaggggcuccgaaaacccaggcucaggucgguccugcccggcaccuguuucacacauguacacuccggucugagguugguccucucccccaccccacccaccugcaguugagcagcugaacagaggccaugccggggcacuccgaggccugagacgaccacgccugugccgcugaggaccuucaucagggcuccguccacuuggcccgcuuggcuguccaaucacacuccagugucaaccacuggcacccagcagccaagagaggugagaggagggcuuggagggggaggcgggacuccacccugugugggacaguucugucaguugacccuccacuuguccaggggcaguggaucugcagggggaacucauucucaauacuguuccuccugagaaacaaauuuucugggcuguuuugguuuagguguggcguggcccuggggacgcauggcugaggcaggaacaggugagccgucccccagcguggagggcgaacacgggacggaguaugacacgcugccuuccgacacagucucccucagugacucggacucugaccucagcuugcccgguggugcugaaguggaagcacuguccccgauggggcugccuggggaggaggauucagguccugaugagccgcccucacccccgucaggccuccucccagccacggugcagccauuccaucugagaggcaugagcuccaccuucucccagcgcagccgugacaucuuugacugccuggagggggcggccagacgggcuccauccucuguggcccacaccagcaugagugacaacggaggcuucaagcggccccuagcgcccucaggccggucuccaguggaaggccugggcagggcccaucggagcccugccucaccaagggugccuccgguccccgacuacguggcacaccccgagcgcuggaccaaguacagccuggaagaugugaccgaggucagcgagcagagcaaucaggccaccgcccuggccuuccugggcucccagagccuggcugcccccacugacugcguguccuccuucaaccaggaucccuccagcuguggggaggggagggucaucuucaccaaaccaguccgaggggucgaagccagacacgagaggaagaggguccuggggaaggugggagagccaggcaggggcggccuugggaauccugccacagacaggggcgagggcccuguggagcuggcccaucuggccgggcccgggagcccagaggcugaggaguggggcagccaccauggaggccugcaggagguggaggcacugucagggucuguccacagugggucugugccaggucucccgccgguggaaacuguuggcuuccauggcagcaggaagcggagucgagaccacuuccggaacaagagcagcagccccgaggacccaggugcugaggucugagagggagauggcccagccugaccccacuggccacugccauccugcugccuucccaguggggcuggucagggggcagccuggccacugccuagcuggaaugggaggaagccugcagguggcaccgguggcccuggcugcaguucugggcagcauccucccaagcagagaccuugcugaagcuccugggguguggggugugggcuggaagcacuggcucccugguagggacaauaaagguuuugggucuuucugagacuuugugucuaucugggcccugcuuacccaaagggcucaguuggcagcaagagcuccccacaccugacccucggugccggaccacucgaggguggcugacaccugcaucccucaccagcacaucacccaggugacagugagaauuggaaaccccaggccuccucuagggcuuguggcucaguggcagguguccagugagugcccucaaugggccugaguggguacagaaucugcccucccccaaccaaagcccacaugaugccaucagccccaggccuagugcagaccacagcuugggaagcgaaagggagaugacaaaauggguguggacagaggaggcuggggugagugggcaguuggggggccugggcagguguuugagccugggguccaguuuuaucugggccacgugggguacaguguuuuccaggcuccacugaagauaaagcagccacuggugccagcaggggcuuugucuuggggccauaaacaccagugugugcuguacuggccaucgggugucagggggacagcugacagaugcaguggaugcccagcccugucuuccaggagccagucaccugagccccaaaggaccuuuugggucuuaagugacagaaauucuaaccaccaguguuucaaaaaaagaugagucucuugucaggcaacacaagucagggcaggggugggugcagaccccagagcagcuucgcagucuggaugggggugcucccccgucacgccacagggccagcuuuuccacagugcaggcuggucaguuuccagguagggaugcgguggggcacguuuucugcccggggaguugugccugucaggggagacagccccaugacacugcugugccuccggggaggccaggagggacaaggagcgguuccuuugggugagggucuguggugaggcaccaggagggccauugucugcuggggggcuggugcccccugggggguuccgcuggaggucggcaaaggucagugcacaacgugcaggguggccagcugaggagagguggccccacacguggcaggccaagcagcucagguguccgagggaggcuggccagccccggguuguucccagccaucuaaaccaccucuguggucagcagccaccagcuggcuucccucgccacagugcugagagccugcugggaaggaaggccccccugagcggugggaaccagcaaggcaggcccaggaaggggagagguagcuggcucagaggcaagggccaggacgccguggcucucagagugaguccccacaggccagccuggggaagauggggagcccagagacaaccaggccucugccugcacuccugggacuaggaaagcagcccccuugaggccgaggggcccguuugcuugcugagcaggacaguccaauagggcccacgccaggcagagccucaagagucugagugaagcacauucggcccuggccaaggcagggacuccgucagagggcacccacaccacccugaagagccgcguccagccaaggccuccugagacucccgggccaggcagggaaggcagagcacacagcacagccuacggccccccagccgcugcagagugggugcccaugcccacccucaucccacgcuccccaaacaggcuuacuccgggggccgccacccugggccagcacgucagccacggaggacacgagcaccgagcaguaguugaucuggagaagggaaacacguccgggaagcuccagggcucucucaggacagcaggggacaggcagccuccccaucuccccucuccugccagggcccccgcugcccugugacuccucccucugagagcugccgcucacaggcaggggugagugaggcucccgugaggcguguagagugaaaggcgaggggucuucaaugugagaccccucauuuaaggcuguagccucccaaguggcagggugggaggaggcacagguggggacggccugucuuccccagaacgcuccucugcccacuggggugcuccuguccuggcucuggccugccucaucucugugagugaccgggcagggcuguggacccaucccaguagccccacgcagccacccgccucccaucagggagaggagcucuggggcucgcuugccugugacuccagacacuugaugcgcuuuucuugcucucucagacccccgagguacuuggcaaugaaguccacucugcggcaggagcagguggucaggcuguggauggccacgcggugcucugcguguggggagccuccccauccccccaggccucccugugugcccgaguuuggggugcccuggcccuuucccuuccucccucaugcccagaucugguggcaccaggaccccucaaagugcaccuggugcaguacagagcgcucuaugccuucccaguagggcuagggugccaucccugccugggcgcaccacccagaaagacggugcagggcaggcagucggggacaggccccuggagccagggcuggagggaagccagggguggguagucccaacccugagaccacagcagggagggcgccacggucacugugcacgcucccuuuuugccuggccaggcgucccagcaggguccugcacaggucaggcuggaaagcuaggccccugggcucggccagagcccugccccuaccccuucagcuucaguucgccagcucagauccucugucacuggcgccaauggcacauccccgcuuaaagacagcccgauacccaccagugaucaggacaggcccccgcaccugugggcgguuuuccgcagcaccucccccucgcugucccuccuccgcuucuccaucuugcucaggaaguucuccuucuggacugucucccaggugacgaccuucugguccagggggucuggcaggucucucucugggaaagccagguggcagccagcauuacuagagcaugugggcgucaguggcagagcccaggccuggucccggggcgaggugggccaggcagaaggagugaguggggcccagccagggauggagggcaagcauggcccugugcaaggacggccaagcugcggguggacgggcucagcugugccagccugcacagagcccagcugaggacccacagggcugaggagggguccaggucucuccagaccugccuccagcgcacagccccgcccugggacccgccaccucggccucacccaggugcucccgcuugugcucggccucacccaggugcucccgcuugugcucagccuccuucuugaagacccggcggagcgucaggcucagguggcugagcaggaugaagggcggggccagggcggggcgcucgugguacuccacaaucagguuguagcgcuggaacuuccagaacaugucugcguugcccugcaccaccuggaacguguagcugcaggggcacagcugagccgucaccuaccggcuccccacgaccacuugggggacgcaucccccugcacccugauugcuguuggggagcccuuuuugaaacugaggcccagcacugcuucugcguugccucuggggugugucacgagggguccacucuccuugggucuuccccuguccacucugcucuccuggacaagcccagaguucuugccacagcaccggucccccaaagacccaggcccugcuuccugggacugggaggguggcccacagaguucccggucuugggcaggcaaagcccugcaguccaggcuaugccaccuucuaucugcccugaggcaccaagccucacccucugcagcacaccagguggguugcaaaggaggcgguguuggggaaugacccucugcucccuccgcuccagggcucucuccuccagggguuggguggagucaccugaacauggcgaugagcagguucaugagcagcacauuggugaccaacaggaaggugaccagcaggaggaugaccagccaguuggcauagaggcuggggcaggauggugaguccuccagcagcaguggguggguggagcaguucacacgggcuucuggaaagcaagggugcuguggggaccagaccgggggcagccacaagggcggccuuaggcaaaugccccgagauagagcgcugaguccugguguugaacccaggggacggggugcugguugggugacccacugucccaguucacccagggcggccuggguuuuagcagugaaagccccaucacagcaaaccagaaccagacggguggugagccccacccugggcccccucugccaugucugcugagcuuccaccaggggcuggagucagccaagaucacaggcccuggaaguagagccaagaccccuggagggauggaaggugggggacagaggggucacgggacccagguuucuccugguuguuggauguguuaaaaccuccaccccuccuccgaaaaaagccucugcuguugaagguuuggggagagcugccgaggaaagggagauggggcccaggacuucucagagccucuacagcacuaaugccugugauuaaaccccaagcuggcaaguaauuccgccaccuuuccaaaauguauugagccagcaggcuccagacugggcuugcugcaagcucugagggcaccgaucccgcacugggccacucaagucaagaacauucuucaggcggcacacucugggagcuugcaggcugagcucccucggcccugggcagggacacccuggagggguggcagaucucacuccagucccuuaaaaccagacccucacaccugcuucucccuuguagggcucaacccuggacccucaccccaccccagccugcggggcaggaggagggaggagggaggaaggagccgcagugggcgucagggugcucagggucccagccagaggccagagugugcccuggccguccaggaccacauauccccuccauauccgaaugggagcuccgcucucuccucccuccccagccugcacgcuggcgugugucugugugagccuguacaugugauuggaugugccuggcacacaugcucaugugugagucugcgugugagcacacuggcacacacgggcacauucaaguguaucuuagugccugccagcuccagguugcccugcgguggguucuggggggucuccuuguucccagguuccugccucugugccuggguccugagcuggagggguccguucucccuccuagggugaauuccugccuuguuucucccgagugaguuagugugacgcguuggcccgugugugaguuauugagugucugugugugcacuggcagucagugagcgccagcccuccccacgcucccacccuaggccugccccuccucuguccgcccuggccaccuccagcccaugaaucuguuccugggcagacugaugacccccucuccucccugcacucuggaggagcgggccggggccagccuggagagccuguuugugaagccguaaaucugucugauaaaggcagcucugaggaaugagacccccacacccuccccgacucugugauuugggaaggcgccaccaggccgggcuggaaauuaaauugucccuggggccuggagacccagagaacaagcucgucaccacagcucaaccccagcuccggcucggcacgagugcagaguggggcaggggucuguucugggcucugaggagaccugcaggcuguacaggaacugucugagccucagucucccucucagcccagcauguguuagugaauaacucccugccuagcagcaugaggggcugggucacagugaguggcugggguucaaccugaagggcccagauacuugcucggcagcugaacggagcccaaggaauugcagcucagggaggggaagugacaagucugagacucucagugggcggccggggcuggcccuguugcaggcguuucagcacggggcucugagauccccgcagcaccgcagaccucccugaggcagcacucggagcaggggccccucgggagucuguuucccugccuucucccgucgagaaggaggcuauggccaggccugucuccucauacgagucgcugagacuggcccaccagagaugcagccacucaagaaagaggggacccccaacccugcccuggcuggaggcgcccgucuagagcuccuccugccccgaggggcccugcggacgggcagugcuggaggccguauggugagggcgagguggggucgcaggcaggcagggucugguuaaacuaauggccuggaaaaugaaugccugugaugagcaaacaccaaaaugucaggaggggcugcgggggcugagaaaacagcccaaggaaaugagccgcgcugggagaggcgguuuccaucacggcgucgcccccgccuguccccggaggccuguguuugcuccggucuggccgucauccccucaacaaauauuuaucgaggguccugagcgccacuccacagaggucggggucaggccugggcagcacguugugccaugacugccccgugccgggcagccccagccgccugacaccgccugagcaguuucccugcaccuucucugccgggucuccaagucugcggcaccccucgagggccccaggggcgggcuggcugcugguccaccuucccagaggggugcgucccuuuccagguuggggcuccucacugagucccagccaucccaggggccugcacaggucccugccccaccccagagcuccccaccaacccaucacuacagaggcccccauggccaagcggcucugacccccgcccccuccccacugcacuggcuuaugaaaaaguuuccagagccuccaccagccccagccagcua

SEQ ID NO: 12620 - RNA, 41521 nt, Homo sapiens
uagcuggcuggggcugguggaggcucuggaaacuuuuucauaagccagugcaguggggagggggcgggggucagagccgcuuggccaugggggccucuguagugauggguugguggggagcucugggguggggcagggaccugugcaggccccugggauggcugggacucagugaggagccccaaccuggaaagggacgcaccccucugggaagguggaccagcagccagcccgccccuggggcccucgaggggugccgcagacuuggagacccggcagagaaggugcagggaaacugcucaggcggugucaggcggcuggggcugcccggcacggggcagucauggcacaacgugcugcccaggccugaccccgaccucuguggaguggcgcucaggacccucgauaaauauuuguugaggggaugacggccagaccggagcaaacacaggccuccggggacaggcgggggcgacgccgugauggaaaccgccucucccagcgcggcucauuuccuugggcuguuuucucagcccccgcagccccuccugacauuuugguguuugcucaucacaggcauucauuuuccaggccauuaguuuaaccagacccugccugccugcgaccccaccucgcccucaccauacggccuccagcacugcccguccgcagggccccucggggcaggaggagcucuagacgggcgccuccagccagggcaggguuggggguccccucuuucuugaguggcugcaucucuggugggccagucucagcgacucguaugaggagacaggccuggccauagccuccuucucgacgggagaaggcagggaaacagacucccgaggggccccugcuccgagugcugccucagggaggucugcggugcugcggggaucucagagccccgugcugaaacgccugcaacagggccagccccggccgcccacugagagucucagacuugucacuuccccucccugagcugcaauuccuugggcuccguucagcugccgagcaaguaucugggcccuucagguugaaccccagccacucacugugacccagccccucaugcugcuaggcagggaguuauucacuaacacaugcugggcugagagggagacugaggcucagacaguuccuguacagccugcaggucuccucagagcccagaacagaccccugccccacucugcacucgugccgagccggagcugggguugagcuguggugacgagcuuguucucugggucuccaggccccagggacaauuuaauuuccagcccggccugguggcgccuucccaaaucacagagucggggagggugugggggucucauuccucagagcugccuuuaucagacagauuuacggcuucacaaacaggcucuccaggcuggccccggcccgcuccuccagagugcagggaggagagggggucaucagucugcccaggaacagauucaugggcuggagguggccagggcggacagaggaggggcaggccuagggugggagcguggggagggcuggcgcucacugacugccagugcacacacagacacucaauaacucacacacgggccaacgcgucacacuaacucacucgggagaaacaaggcaggaauucacccuaggagggagaacggaccccuccagcucaggacccaggcacagaggcaggaaccugggaacaaggagaccccccagaacccaccgcagggcaaccuggagcuggcaggcacuaagauacacuugaaugugcccgugugugccagugugcucacacgcagacucacacaugagcaugugugccaggcacauccaaucacauguacaggcucacacagacacacgccagcgugcaggcuggggagggaggagagagcggagcucccauucggauauggaggggauaugugguccuggacggccagggcacacucuggccucuggcugggacccugagcacccugacgcccacugcggcuccuuccucccuccucccuccuccugccccgcaggcugggguggggugaggguccaggguugagcccuacaagggagaagcaggugugagggucugguuuuaagggacuggagugagaucugccaccccuccagggugucccugcccagggccgagggagcucagccugcaagcucccagagugugccgccugaagaauguucuugacuugaguggcccagugcgggaucggugcccucagagcuugcagcaagcccagucuggagccugcuggcucaauacauuuuggaaagguggcggaauuacuugccagcuugggguuuaaucacaggcauuagugcuguagaggcucugagaaguccugggccccaucucccuuuccucggcagcucuccccaaaccuucaacagcagaggcuuuuuucggaggagggguggagguuuuaacacauccaacaaccaggagaaaccugggucccgugaccccucugucccccaccuuccaucccuccaggggucuuggcucuacuuccagggccugugaucuuggcugacuccagccccugguggaagcucagcagacauggcagagggggcccaggguggggcucaccacccgucugguucugguuugcugugauggggcuuucacugcuaaaacccaggccgcccugggugaacugggacagugggucacccaaccagcaccccguccccuggguucaacaccaggacucagcgcucuaucucggggcauuugccuaaggccgcccuuguggcugcccccggucugguccccacagcacccuugcuuuccagaagcccgugugaacugcuccacccacccacugcugcuggaggacucaccauccugccccagccucuaugccaacuggcuggucauccuccugcuggucaccuuccuguuggucaccaaugugcugcucaugaaccugcucaucgccauguucaggugacuccacccaaccccuggaggagagagcccuggagcggagggagcagagggucauuccccaacaccgccuccuuugcaacccaccuggugugcugcagagggugaggcuuggugccucagggcagauagaagguggcauagccuggacugcagggcuuugccugcccaagaccgggaacucugugggccacccucccagucccaggaagcagggccugggucuuugggggaccggugcuguggcaagaacucugggcuuguccaggagagcagaguggacaggggaagacccaaggagaguggaccccucgugacacaccccagaggcaacgcagaagcagugcugggccucaguuucaaaaagggcuccccaacagcaaucagggugcagggggaugcgucccccaaguggucguggggagccgguaggugacggcucagcugugccccugcagcuacacguuccagguggugcagggcaacgcagacauguucuggaaguuccagcgcuacaaccugauuguggaguaccacgagcgccccgcccuggccccgcccuucauccugcucagccaccugagccugacgcuccgccgggucuucaagaaggaggcugagcacaagcgggagcaccugggugaggccgagcacaagcgggagcaccugggugaggccgagguggcgggucccagggcggggcugugcgcuggaggcaggucuggagagaccuggaccccuccucagcccuguggguccucagcugggcucugugcaggcuggcacagcugagcccguccacccgcagcuuggccguccuugcacagggccaugcuugcccuccaucccuggcugggccccacucacuccuucugccuggcccaccucgccccgggaccaggccugggcucugccacugacgcccacaugcucuaguaaugcuggcugccaccuggcuuucccagagagagaccugccagacccccuggaccagaaggucgucaccugggagacaguccagaaggagaacuuccugagcaagauggagaagcggaggagggacagcgagggggaggugcugcggaaaaccgcccacaggugcgggggccuguccugaucacugguggguaucgggcugucuuuaagcggggaugugccauuggcgccagugacagaggaucugagcuggcgaacugaagcugaagggguaggggcagggcucuggccgagcccaggggccuagcuuuccagccugaccugugcaggacccugcugggacgccuggccaggcaaaaagggagcgugcacagugaccguggcgcccucccugcuguggucucaggguugggacuacccaccccuggcuucccuccagcccuggcuccaggggccuguccccgacugccugcccugcaccgucuuucuggguggugcgcccaggcagggauggcacccuagcccuacugggaaggcauagagcgcucuguacugcaccaggugcacuuugagggguccuggugccaccagaucugggcaugagggaggaagggaaagggccagggcaccccaaacucgggcacacagggaggccuggggggauggggaggcuccccacacgcagagcaccgcguggccauccacagccugaccaccugcuccugccgcagaguggacuucauugccaaguaccucgggggucugagagagcaagaaaagcgcaucaagugucuggagucacaggcaagcgagccccagagcuccucucccugaugggaggcggguggcugcguggggcuacugggauggguccacagcccugcccggucacucacagagaugaggcaggccagagccaggacaggagcaccccagugggcagaggagcguucuggggaagacaggccguccccaccugugccuccucccacccugccacuugggaggcuacagccuuaaaugaggggucucacauugaagaccccucgccuuucacucuacacgccucacgggagccucacucaccccugccugugagcggcagcucucagagggaggagucacagggcagcgggggcccuggcaggagaggggagauggggaggcugccuguccccugcuguccugagagagcccuggagcuucccggacguguuucccuucuccagaucaacuacugcucggugcucguguccuccguggcugacgugcuggcccaggguggcggcccccggaguaagccuguuuggggagcgugggaugagggugggcaugggcacccacucugcagcggcuggggggccguaggcugugcugugugcucugccuucccugccuggcccgggagucucaggaggccuuggcuggacgcggcucuucaggguggugugggugcccucugacggagucccugccuuggccagggccgaaugugcuucacucagacucuugaggcucugccuggcgugggcccuauuggacuguccugcucagcaagcaaacgggccccucggccucaagggggcugcuuuccuagucccaggagugcaggcagaggccugguugucucugggcuccccaucuuccccaggcuggccuguggggacucacucugagagccacggcguccuggcccuugccucugagccagcuaccucuccccuuccugggccugccuugcugguucccaccgcucaggggggccuuccuucccagcaggcucucagcacuguggcgagggaagccagcugguggcugcugaccacagaggugguuuagauggcugggaacaacccggggcuggccagccucccucggacaccugagcugcuuggccugccacguguggggccaccucuccucagcuggccacccugcacguugugcacugaccuuugccgaccuccagcggaaccccccagggggcaccagccccccagcagacaauggcccuccuggugccucaccacagacccucacccaaaggaaccgcuccuugucccuccuggccuccccggaggcacagcagugucauggggcugucuccccugacaggcacaacuccccgggcagaaaacgugccccaccgcaucccuaccuggaaacugaccagccugcacuguggaaaagcuggcccuguggcgugacgggggagcacccccauccagacugcgaagcugcucuggggucugcacccaccccugcccugacuuguguugccugacaagagacucaucuuuuuuugaaacacuggugguuagaauuucugucacuuaagacccaaaagguccuuuggggcucaggugacuggcuccuggaagacagggcugggcauccacugcaucugucagcugucccccugacacccgauggccaguacagcacacacugguguuuauggccccaagacaaagccccugcuggcaccaguggcugcuuuaucuucaguggagccuggaaaacacuguaccccacguggcccagauaaaacuggaccccaggcucaaacaccugcccaggccccccaacugcccacucaccccagccuccucuguccacacccauuuugucaucucccuuucgcuucccaagcuguggucugcacuaggccuggggcugauggcaucaugugggcuuugguugggggagggcagauucuguacccacucaggcccauugagggcacucacuggacaccugccacugagccacaagcccuagaggaggccugggguuuccaauucucacugucaccugggugaugugcuggugagggaugcaggugucagccacccucgagugguccggcaccgagggucagguguggggagcucuugcugccaacugagcccuuuggguaagcagggcccagauagacacaaagucucagaaagacccaaaaccuuuauugucccuaccagggagccagugcuuccagcccacaccccacaccccaggagcuucagcaaggucucugcuugggaggaugcugcccagaacugcagccagggccaccggugccaccugcaggcuuccucccauuccagcuaggcaguggccaggcugcccccugaccagccccacugggaaggcagcaggauggcaguggccaguggggucaggcugggccaucucccucucagaccucagcaccuggguccucggggcugcugcucuuguuccggaaguggucucgacuccgcuuccugcugccauggaagccaacaguuuccaccggcgggagaccuggcacagacccacuguggacagacccugacagugccuccaccuccugcaggccuccaugguggcugccccacuccucagccucugggcucccgggcccggccagaugggccagcuccacagggcccucgccccugucuguggcaggauucccaaggccgccccugccuggcucucccaccuuccccaggacccucuuccucucgugucuggcuucgaccccucggacugguuuggugaagaugacccuccccuccccacagcuggagggauccugguugaaggaggacacgcagucagugggggcagccaggcucugggagcccaggaaggccagggcgguggccugauugcucugcucgcugaccucggucacaucuuccaggcuguacuugguccagcgcucggggugugccacguagucggggaccggaggcacccuuggugaggcagggcuccgaugggcccugcccaggccuuccacuggagaccggccugagggcgcuaggggccgcuugaagccuccguugucacucaugcuggugugggccacagaggauggagcccgucuggccgcccccuccaggcagucaaagaugucacggcugcgcugggagaagguggagcucaugccucucagauggaauggcugcaccguggcugggaggaggccugacgggggugagggcggcucaucaggaccugaauccuccuccccaggcagccccaucggggacagugcuuccacuucagcaccaccgggcaagcugaggucagaguccgagucacugagggagacugugucggaaggcagcgugucauacuccgucccguguucgcccuccacgcugggggacggcucaccuguuccugccucagccaugcguccccagggccacgccacaccuaaaccaaaacagcccagaaaauuuguuucucaggaggaacaguauugagaaugaguucccccugcagauccacugccccuggacaaguggagggucaacugacagaacugucccacacaggguggagucccgccucccccuccaagcccuccucucaccucucuuggcugcugggugccagugguugacacuggagugugauuggacagccaagcgggccaaguggacggagcccugaugaagguccucagcggcacaggcguggucgucucaggccucggagugccccggcauggccucuguucagcugcucaacugcagguggguggggugggggagaggaccaaccucagaccggaguguacaugugugaaacaggugccgggcaggaccgaccugagccuggguuuucggagccccugacaggcuaggacccaggguagggacuuuugacucguuaccucauuuaauggugccaacccucugcaggcaggcuuggagcuacugagcgauuuugguaguaagcagccacccagggcuugaacccagggcugaaaucaggcaggagggccacuuauaagcugcuugcugugcggggugagcagucguauuccacaaagagcgugcaccuuccugauccacggggaaaagauuugcuccuauuugcuggaagauccccgggagcucccaaggaaucugcagccaaggcccuggcaucugagggucaagcucucaggaaaguggggugucgaccaucaccuugagcagcccuguuaggcagagguaaauccccgcggcuccuggagcgaccuccaguggccuuccaccuguaacacucagcacauacccugccuuuccagcugggcagacaagugcugccuccugcacccauuuagugcuggagugacugggugccucagaacuugaauuuccaggcaaaaaaagacggcccagccacacccuucugcacuguccucagccauccauccaccgacuccucuccugcuaccaaaacuccuugcccgcccagagugaccugugucuugugcacccaauaaggauggggucagggguacuaucaggggcucuuagugccccccaccaggucgaacacaggcaggaccucaguuccucugaggcgcgacucuccucagugaagaagccaccccagugaaaggggauacgcagcaccccccacugaugaccguuuuaaagcuggcaggaacggggcgggggaaauaauuugcccaagucacacaguauguugcagacgaagcuggaguucaaccagaacccugcuucccagauucgcacucccguccucugcagcggaacgccgccgcggccagaagcagccuggucagcggggcacuccgacggguagcggggaucgggcugcaagauagggacuccgguaguccguuucucgggguucucggcgaaagccggcaacgaguggaagguagaguugacuccuucauguccguaggcugaaggaagccgucucuuucuccacaugaacgcagagcccggccuuucuccacuauaugugccagcaagaccuccccgccagagaacaaacgaacucucggugccaagcuggcucucggugccccucggcacuguccagucgggcuggacaggccuccgggccucacaaggaugcugugggucccaagggcccggccgcgagguacgggggucggcgagcacagcggggccuucgagcucagguauuaaagcugcgcucggugaccucccggaggcucggccggcccgcgcggcccguccucccucaccacaaaccuaccggcucaaggcugcucggcagucuccaucuuggucggcgccgcaccuccgugcggcgcgcucagcccucugggaaaccgagugcucugccggccgagcaccacggcuuccgcgccugcagaacuacagcucccacaaggaacugggccgccgcucccgacgccugucgggacguguaguccugugcgcaugcgcucgccccucuacuccuccacgccccggcccuuggguccggcucggaagcagccccggaaacgacggcauuuguuggggaaacaagaccggaauugaccaagaacaggaagaggaggggccaggccugcaauucccagaaugcucgagggcuaaccgacagccaggcuggcuucccguggucucagcgccaccugccggaagccgcgagaacagcggccgccucaggcaggaagugcgucaucucgcacggaggacgaaugccguucccggcacuuccgguccugaccggaagcgguaaccgucacuccuucugggcucugucagugcaccgaggcggggcuccccaggaucccacggucccgcucaggccagacgcagaggcagucccagcccgcgaugaggacguggggucgugaccgcugggccacggugaagggggcagcccugcuggacccgcuagcugggccgacgcuuucccaccccuagggguuugcugggcccuggccgcaaacuuguggggcgccguccucggggccacugcccggccacccucacacccuugggcccucagcucuggugcauugguccgggcuccgggaggcacugagacgucccccuagggcgcugcagggaagcgagggccaggcccuuccagguccccgguccucccgggcaggauggaggcugcugaacgcuccucaagcuuccaagucagccguggcugggcgggcggcagcagggaagguuugggcuccgccaugcuugcgagccagcagccuggccucgccuguccgcagcagggggcaggucagcugcccgcccugaaagggaggaccagggcccagauucucccugcgacaagccgcgucuuccuuggccacugggcccuagaugguuggcaccuugugccccuucucagcugggagaguuccugccccacacacucaaggauucugaguucuccuuggcugcuagaccucuggucccucugaaaggcucgagagagaacucccccagggccugcuguccuggcauccgcugggaaauaggauucaaggaccugcuguggcucagccuagaaaaaaggaggggaagcaggacccacuccucggcccccggucugcugugcgccuuugggauuccuuauuucuuaaacugcucuucccuccccacagggaacacagcggaaaguagagagggggcuccuuggaccauuauguucucccaaccagugcaggcuugcaaguugggagcagcaggggaggagggccugcugagagacucuguaacccccuaaaaugcagggcuggggacaguuuccaaauuggccugcaaagaggcugcugggagcccuagauaugaauucccaggcacucauuuccuccagggaacagugaaaugugccagcaccccccuccccacaacuagggaaaaguagccuaacccagagcaagccccaccccacgauguggggaaagauaggagagucuagaccaagcccacuggcuggaggugcucagacaaagggaaaaggacgggggagugcaggggcuccuuagccccacagccugucugcccccaaccaccgcucgcuggugggcugggggggcucccuaguaggaugaggucuuucuuccccuccagacccucugagauguggcucaggccugagccaucagcuccucaaaggaacauuuacagguaacagaugggcagggcagagacccucaaaugcucgggagggggcaguguguccauccuuuaccaucccucaggaggaagaggaguccugcagcgcacccagccccuaccccaagcccaucucacugcauucccuggcugcccgaccccuccugcccaccugcuuacacugugugccccuugugugcccaaggggcaggguggaaguggcugcaggcaacacagggccucucccaaaagagaauagagagaacgcucccaaaaagggcccuugcuaccuggaguugcucccugguuuaaacccaaaguaaaauucuaagcaaccccaaccaacugaaugggcaccucuuggccaaaugcauucuaaaguaaaccugaaaagcucguugaggccaugaugacuguggguggccgaacaugccucauaggcacagcugaccagcauucacauuaaaacagagaccuuaguccggugugguggcucacaccuguaaucccaaaaccuggugugucacgugaggucaggaguucgagacuagccuggccaccguggcgaaacaccgucucuacuaaaaauacaaaauuagcugggugggguggugcaugccuguugucccagcuacucaggaggcugaggcaggagaaucgcuugaaccugggagguggaggggaggcugcagugagcugagaucacgccauugcacuccaaccugggugacaagagcaaaacucugucuaaaaauaaaaagaccuuaagacucacaaaacagacucuguaguaauaagauaccaacgugacagcaggcccugaaagaaaccgaaguauuuuaccccaaaauauauuucucugauguauuuugaaauggcccugcaaagcugucucuugggaaaaucuacauucuauagagaaucccccucccuuuccaggucuauuuccugauccaggagagaauuaacuaagauucugguaccuuuuuaagucugauaagaaacauuuacaaucuggcggcuucaucugcauaauaaucuuggucuccacaacuccucuuaacccagauaguccauucuauugauuucaggucuuuagauaaaaucaaccaauuauuaaucagaacaucuuuuaauccgccuaugaccugaaagucccuccccuucaaaucgucccaccuuuccgacuaaaccaacguacaucuuagauguaaugaucaauguccuaugucccuaaaauguauacaauuaaguagccagaccgccuugggcacaaguucucaggaccuggggcugugucacaggccaccggugcucauauuuggcucagaauaaauaacuccccaaauuuuacagagugacuccuuuggugaacaccagggaucccgacccacccacccucacccuggaccccacagaguccacagagccaagccccaccgaugucagauuccccugcccuccggccaaccccuaggucucagacaccacuggcacugagggacugcacaggccugguagcaugccugauguuccuucuuuauuaaaugacggagucaggauguugugauuacaguugaaggcgacguguuagaaaggacaggugcaugaaggcagagagugcccacagacucggcucucgaaccggggcaggagggaacaaggugagcugugcagcccacaggacgggcgggcuggguggacacagccccccaaguuggccaagcugagucucugggcgaguggcucccaggagaggccuggcugagcaggcagagcacccugggaccccagggcagaaggaccccugcccuccaguccccaagacccaggcccgucuccacucauacacgccaccuacaugugacgucagcccugaaaagguaacaggaaaguucagaacaaaaacaaaaccccaaaaguaaaaaggcuacguguagcagaguaauaccggaaacguuauauacacaggcggugauggcccccucggaaguguccgggucacuuagggggcacugcagaggucccuguggccagagcugcggggccucaguacacggagcuguuccggaugccacagcacagcaccaugcucaggaucaucucgaagaucugcaggagggugguggggggcgcagucagcacaaggccccgcggaaggggcagcccagagagcaggcccuccgcccccgcccgcucaccaugaucacagcgaccacgauggcagcaaugccgaugagguacagcuucccggagaagaggucaucgaucuucugguggcaguccuccugcagggguggccaggcacgcguggucagggaccgggccucggcucccggcuucccguugucacgcaguaauccguggucaccacagaaagcguagaggggaauccugggaacagccccccacccccuacccaccucggaacaggcgggugcagcggcccggccucugccggcuugcuaucuuccacccguuuuaacauaaacgcgaaaugccugggacacacugugcccuuuuccacugagaucacggucauuggugucacuagaccccuaaagcaucacugaugacgacuuccacugaggccucagcaggaaacuuccacagggcacuauauggccugcaggcccugccagcuacaggcugucaggggcguccacacccacgagugcacacguggagcugggggugcaggugaguucccaccccccagagccuccaccuucuucacccggaaugcgcagcacagggcgccugccuuccucgugggccagaugcggucccaccccaacccucccagcagagcagcccugacaggggccaugccacccaguguggucgcucccuguggggcugccgugugaccugcccaccccuaggaccccacccaggggcgggacaugcggggggucaggcgcggccccaccggccucgcgcaccuugaagagguugcugaugauguugcugcccgagggacacaaauuguucuugagcacugagguggucaaagcagucagugugcuggagccacagcagucaagcugcagagagcaggggugcaaggucagcccuggaugugcccagggggacgguggcucuagggaacccauggggagguggccagggguacgcagcgcuccccacugcagaaugcauccaggggccagccuucuuccuccucagcugcgcugcucagagcuuuccgcacccugggccacccuggcccacuagguucccacccgaggaccaguugagaccagggguccuggaggucccaagggcaccuccugcuccugaggucugggcguaggcaggauucauccaggacgagacacaccccgccggguucccggggcccugcuccccgcccucgccccccggggccgcaccgucucguggaaggucuucaccacagccuuggcguuguuggcgucaucauccaccacggccugcuguagggccuggucauagaacugcuucacauccuuggcgaucugggggaggggugcggucacaugcacagggggaaccucccccuccuugcccccaccccgccccgccccaggcggacgcacuuuucccaggcucucccugggcaggguggcuucgaggcuagaccccagaggacaaggacucugcacucucagcugccccgggagugcugggacacgggaggcuggccuggugcucagccccaaugcugccuccuccauaaagccccuggagauccuccuggcaagugggacccaggaagagcccaaagagcucccacaagccaugagucagcccaacccccacccgcgacaggagaggagggugcccccgucacccaccccacccugucccugcacacccaggcucaccugguccuuguugacaaagccccagaugccggcggccaccucacaggcaaacaggaugaccaggcaggugaagaacuggagccgggcaguggccagagggaggaaagagggcaggcuguaggcggggcccaaggacacacacccaggugcccagcaggcgugucugugaggggcuagugggagccaccagcccacgaccugaccaggagugagcggcuuguguggagcccuggggcacagaggcuaaaacucagcgcagggaggagccgucaaagcccaggauguccccacgcggcaccaggcuccacaggacgggguggauggggcggggcgugugguuuggggucacaggcuggugaguccaggaugucugcagcccccagggaggcgugugcagcagcaugaccccugacugaucuuccccacccccuuguuccugcuccccacggaagggggagccaugggaucugccucaguuucccccacuggagacacgggcauaggcucccucuuccuggacuggccaggcccuggauggcacagccaggccugggcuucccacagggggcggugugcccgggacgccgaggcuggccucagagcugaggcuugcucccuguuauauuuguggcuauuuuuugacaaagaaaagcggucacguaggaacuggccacgauggagaccaagcacggugggauuuaauuuaaaaaccaaacgggaaaagcagggcacaggagccaccucccccagaauucuaggcuccgcccugagcaccagcucugcccccuccucagggccagacgcagcccccagccccuccccggcccaggcacaggcccgccucccugccuuaccguccccagcaggcacugggauuccuggauggccccguagcagcccaggaagccaacgaacaucaugacagcgcccacagcgaugaggauguagaugccuugcggggagagagacaccaggugggugccuacacacucgccacagcccaagaccccggaggguccugggugccgaacccaccacgggccgcccagcugggaagauguaggguugcugacugccagggaugagcagcaagggaccucacaucccagccuggccuggugaguuuucugugccucaguuaccucuuccaugacacaggacggagacuaaggaggccacauggggacugggcaccucaugagcgcucugagugcuggcgacaggugcuucgcagggaugacaccugcgguggggcccgccaccugccacacccaccacccaccgccugcaccugccacccgccacccaccgccuucacccgcucccaaagccucugggacuuggcguggggugggaguggcaucagaaggcacagggugggccccacuguaggccgggguugagagggcagcccaggaaccggaacuggaaccaaugcugccuccccaguguggugcgagaagagggugggggggcccugcuggcuccugccccccaaucugggcugcacagcagcacuuccguuacgggaccugcauuugaaccuggcugcuguguggggaggaucaaguuggauuccuaggcccugggcugagggcugaagcccagcaccccaccugggacagcuggaccagggcguguaggccagcccucccgaacucccccacgcucccuggcugggcagcaugcaccuggggagggagaaggcgccguccaaggguggggggcgcacugugggcccgagacaugggccuggccacccagacagggcccuguacccgcgggacagcugucagugucucucacugccugcccacuccccuaucccucagcaggcaggggccaucucccgucaccgaggcaaugcagaaggcagcccaggcccccuccucgcagccaggcccauugucccugcccagccagcccagaggagaaggugccuggggcaggacccaccgccaggcagagaacacacccagauuuggggcucggccacccagccuccuaccuggccagaugaagccucugccaggaaugcccugcagguggccaccuccuuacgggcacggcacccaggagccaggucucccuccccucaggcccugacacuccuggguugcaagguuggguucacuccgggguacaggucaggagaggcgcguugccuuuuuugguccugacaggaggugggaggcccagggcugccagacccccugccaggccccagccccaccccagccuccucucuuaacgcccuugggccuaacccaccgcacccgcagcgucucugaggggagugagcccagcaaauccacccuguucccggcgcaggaaaaaaagcccuuggcaaggcccagcccgcaucagggacagcaagaggcuccagaaggccgauucuggaaugggcgaggacuugguggccagaggagcuccaaggggucccuguccagugggggcccaggcagagcccacgucggggguggcagguccuguggucguguggccaacacaacggcaggcuccuccagcccagggaaaccacagccaaggaccgagggugggcggcucuggggcuggagcucugauguggccacggugacaccaugcaggucagacaccugcuuccaacgccagccucacccuggcaucaugggggcagcaccauggggccucagcacagccugugaccucugcuucugccgagaguggggcgcaggaaggaggccuggcauaccucucugggguguccccuguccucgccccagcccgaagcuaagugacccuucagcuccucuccggccacacggggcccgacgccgaccccacagcgggagcugcuccagccacaagccuuggccgccgggugccuggagagugaccccuuccaagaacaccugccucacacccacaggccccagguccuggagaaggggacucgguggcaggggcagccccuccugucccuggacaggaguacgaggaacgugcugggggcagccucguuccaggccggggaugcugugguugucacuggcuggacugguggccccggaggacaaggcccaggauggcugggaggcccuucuggaccccaaauauccuaaugaucugggaagcggggagcaagaggcccaggaggggccuccaguagagaugcacccuuggagaucggaggaugcuggccgggcucugccacccacagcccaggcacaugggcaaagcuaagccgagugcuucugaggacacaggcaggagcgccccagcugcgugcaggggguggucuccacaugagccccugggacaagcagccuuucccguccuuccugacaccaccugugagggcaccacggccccgagagaggccaggaaccuaugggcagggccaugggacccucccuaggaucggcugggcccagaaacccuccgugggccacaggcuucugucucuggggaggacagggaccaucccuguugacaccaucuggaccccagcaccggcccucugacccaugagcggggcauggggaagaaggaacgggcacgcuguguggccagggcccucaccuggcccuggggugacuggacaaagaggugggacggcgcagguguggggcuauuucggccuccuggggcccugguucagcaaccaagccaagcagccuccguaacuggcagggggccuggcccugcagcuccaggccugggggcaccugccggcugagggaagcccugaggacuggggacacacaggcugcccaccucacccaccccucagccugugagggcaacagagccaucccaggggccuccuuucaaggccagaagcaucucaacaaaugcucccagagccccaccagcaccagcccugccaggggcaccaggaggaagggugcugcucucugcacagugagauggcccuccuccuccuccuggccuugccccuccccuccuccuccuccaucacuccugcuccugcuccugggggcagggagggcagcccagucccccacacgcagccuaauaaggcagcaaggugcagcugccugcaggggcagcugagucacaccgccucuggggcgucuccaccccucuccaccccuccccugccccgucuccaccccucacuggguuccaucccuugagcuccaucccucccucccucccgggcuccacagcgccagcugccucggcugcucuguguggcccaggcauccagccccacccuucucagggagccucccccgaaauaaccccacacuuaaaauaagcaaggucuccacacagucccugcccaggccuagcugccacccccugcccuggcucagaccagaagggccagcaggccacaggcccaccuccaucucaacccuugugcccagagcccuuuccagggccgccucccugcccggacacgccaugcccgacugucuuucacccuccauguccccauccaaaaggcuaggaccugccuccuccuagaagcccucccugaaugcgucugcggccacaugugcacucaccuacauagaagguguugggcgcgggcuugucucccagcuccagauacaggagguugguggucugcgggucauggcggagccacagggccacacccaggaucacgccuccagccagcugggaaagagcgggaacagugucacauguacgaagagcacugcagcagggagugcgcccaccccacacgcaaggccuaagcagccuccugccuugcuggcucccgagcagggaccaggugucagcucugcugcugguuuucgcaaugcccugaagagccccgggagucaggagcauggggcgggugcuuuggccgccaucuacuuggagccuggcccugcccugcaccuguggagugugacuccagggcaggacugccaggaagacacgggacgccgguuaaaucugccucucagaugaaaacagaauacuucuuuaggguaagugugucccaaauauugcacgggacauacaaaaaaauaaucugguguuuaucugaaguucaaggugaauuggaugcccuguaguuucaccuuccguaucuggccagaggugauaccaggaccugagcaucccaggaacacugcccccuccugcaaggguguggcagcgccccaagaguucugaggucgcugggggacugcuucugucugggggugcugagaacucuggggugggggcaccccaucuuugcugccaggaggagaggguaggauuugauguuaccaggccaagcuguaggcaccagggccugcgggguuugugggauacaucccugcugugggaugucagcccugggaagggacuugggaggaaggacgcugcugugguuuccaagaugggcugggggaaggggcgcgcagaagccggcccagcgcugucgcucagcagcuggggcaggaagcaggcugugcugggagucuggcagguggggaugaggcucacagagaggagaggccuucaacgccgggucauccggugugcacacaaucaacucuagccagguggggucugcccuugagacugggccccagaccaggcccagcccagcccacucugaucaucugaccaggccaggcacgugccccaggccccccucugcacacaccaaggcccccucucucccuaggggcagugcccagcccucugguggugggagaggacacaggcuuguccucugcugucccuggugccuagcaccaugcagggcacacugcagccgugugauccccauaaaugaccagugacccugaguccugcugccucuauccuccuccacuucagcaccccucggccucuugcagaggcuccucccugcuagacagggugggggcuggguccccuucagaccucuccugggguuucuuccugcuucaggcaugaaacagggccccacagcccucuagcagccuggggacucugcgucccuaggacacaauuggucaguuccagggucccuggcccacagcaggaggcccuuguugcuggacagucugggugggucaggcuuuacccccugcugcuccaggaggacaguacaagaauccccuaaaaucuggucuggcagaugagccgugcacagcccucaggcagggaucacccaggccagggcgugcugaagaagccuauggggucagggccccacaagugcggccaccauccgacucccaugggccugggcgagucuucuuccuccuccaugccacucucaaggagggccaggcccugggggcuuccuggaggaggaggcagggggacaggagaugaaaucagccaggugaggaggcacccggggggggccacgagggcacaaccccccuggcggagaaugccagcccagaaggcagcugcucccagagcugagucggaaugcuuggcucugccaccagcugggugccaggcagguccugucccagcagcugaggccuugccucaccagcaccaggcgccgaccccaccacagaugcagggcugccggucaacugcagaagagaaacugagggcuggacccaagaacaccaccuggacagccccacuccuguuccaauggcccuggccagggaagcagggccccagggugggguugggcagggggcugugcucagcagagcgugagcuucaggccccagcaccauggccugcacccaaguccccggccugaggaccccccggucaggccggucuagggucuagggccucggugaggguucggguggguggaggagcugggggcucuauaccucuucccccuuucccucacacuccugucuccccuccuccgggaccugagcugggccuggcaaacaauaaggccagagggggcugggcgugguagcaagcgccuguaaucccagcaccuuuggaggcugaggcaggaggaucgcuugagcucaggagguugaggcuacagugaguuaugauugugccacugcacuccagccucggugacagagcaagacccugucucaaaaauaaaauaagccucauaggggcugcuggugccagcagccacggggcucucaccccaaaggggcuguugauggucccccuguagcaggacugccagagcaccuucuccacacacccgaaacaacaaccugggcugugguuucucagaccuucuucugaggagcugugccuccugcccuccuaugggaguuucaacucaauuuucacacuuugguuuagcgaggauggcagccuacuucccccgcccaggccccagacugaagcucuucugugccgaguggaaggugcauuagagucaccaagggcccaacauacaccugcgggcagcgcuggaagccauguggcagcugggaccccacgugugccccucacaugacaaggccccagggaggccaggggccccuggcuuccagaauccugcaggggcagacagcuccugguucuucugugcccauuauacccgugggagcacagggagggccguggacagugcaggagaggcaggaagggugggggcugggggguggccccagagagccuggcuguccucacccugcugcccuccugagcuggcuccagaugcagccuggcgggaggagguggcgaggccgagaguugccgugguaacucuggcuuccuccagggccuuugaaaacauugcuuauuuucuuuugaaacugugguccagagaccguuuugagagcuguuccaggacagaguggggcagguggaugggggagccucauccccacagaggccuggugacaaacccugacucagccacaggagcuguggggccacuggaagguccccaggcucccgguuccucagugucccccucuauaaaacagagcugaucauggaaccgugccuggcucggaagcugcucuguagaggcccauccacccccagcccucccuggcugggcagggaccaccccuccucuagccugggcgcugaggggaugaucccaucuaaugggcauaccguccuaacagaaagguagugauggcaaagcucagccuaaaccccaaaccugcuaauggugggacuucaggccacguugcagcuucuugcugugcucugggaaggggcuucuguucagacuccagggccguauggggaggcugccccuagacaagccccggccccaggccucugccgaggguugcagggaaggcugguccuggccugcagggccugaaagagccugggccaacaccaggaaggacccgagggcccaugugacuuuuaauagggcagaacagcugggccaggagggggugggagggacagccggaaaugggggugacgccagccuguccaccucaacuguccccgaggcuaccagaaguagucgggagccacccuggguggaaaaauggggcaagaaggagugccaggcacugggcagaggccucaccugagccuuggucuucccagcccuagcauggacaaacggggccaugccaagcucuccgaccuucagcagggaccuugagcuggagcuaggugacaacaaugguggugauggucacugccgguuucuggaugaggaaacggaggcggagggaccccccuagggccaccuacgagggagggcaauggcagcaccaaauccccaagccccguggugggaaaggcacaggugccccugccccauaacaaaccccauguggcagggcuagagguuccccagagucaggaaugcgaaagacaccugcucuccgaaagaccuggggcagagccugguaaaggaccugugcccugaacguaugcagagcuuuccaaacucaacagcaagaaaacuggcaacccaaucuuugaaagaugggcaaaaaacaggaacagacccuuccccgcaagauccacacacagcaaaaaagcacaugaagagaugcuccaccuugccagggaccaggaaacccaggucaagcugcagccacaugccgagcgcacccaguggacuggcugccacgaaaaagaccaaccacaccacaugcugcugggggaggcaacugggacgcauacaacgggggcuguaaaacgguccagccaccuugaauaacaguuuggcaguuauguaaaacugcugcuuaagcagugaaacccacauucaccacaugacccagcugcuccacgcacagguauuuacccaagagaaaugaacuuagguucacacaagacuuguacacaaauguucuagcacguuucuuguaaaugccccaaacugaaacaacccauaugcccacugaccggugaacgggugaaccugggguccgucgcuggcuugcacaugugggugcaacccugcccggcaauaaaaggaacagacgaagggcacaccacagcacgggugcacagacgacgggcacgccacggcacgggugcacagacgacgggcacaccacagcacgggugcacagacgacgggcacgccacagcacgggugcacagacaggcaugccacacagacgacgggcacgccacagcacgggugcacagacaggcaugccacacagacgacgggcacgccacagcacgggugcauagacgacgggcaggccacggcacgggugcgccucuggguaaucaugcugaagcaaagaggcagaacagcaacgaugugcaagugccuucugaguccgcuuguugaagaaaugcaugcugugugcacccacagcgacggcccgugguugcccugggacggggaggaggggcaggaagcagagaucccaagggccccaggggcaccuggggaguuggugaugguuucacggggguauaaauuugucaaaacuuaccaaguuguacccuuaaacaucuguauuuacugugugucaaucacgucuaaauaaagcuguuugaaaagcccccacauccuaagucccugaugacugaacuccccggggccaguguuucuucugggccccaaagaccccaggcugccaucuuggcgcuaacuucuuccgaggcagagccaacgcuucccaggggcaagcagcggcaugggaaacaccgaagccgcguccuuagaagugcacuuuuaggauccaucaaaguuaggacuggaguaacuauggagcccgaugucaguuaaaagagagucccgcuuucacggugaugagggagggcagcccaaggcccuggcugcugagugccuuucaccaaggcgaccucaggcccaucucagcuucucucugccuugucuacaaacaaggaaauaaaagugcagaagcugacaugcacacaacuuagccugcacagcagcacucggcucuccaucacugugagguuucauaagugccggaaucuggaacuccugucaccccucuccccacagagccauccauacaggcaccucccugcucaaagcucaccugugggaagccucucugccaccugcucccaccucccaagauacuccagccuccggaggcgcccucugagaugccccgcccccaggaugccccgccucccaaguggccgggccccagagaugccccaccucccgagaugccccaccccacaagccgucccaccccacaagaugccccaccccacaagccgcccuaccccacaagaugccccaccccacaagccgcccuaccccacaagacgccccgccucccgagaugccccaccccccaagcugucccaccccacgagacgccccaccccaggaaaugccccaccccacaagccaccccaccucccgagacgccccgcuucccgagacaccccgccucccaaggcgccccgccccacaagccgccccaccccacaagaugcucugcuggggauuggggauggaggguggcucucaggauggagcccagguaaccugugggguuccuggagggcuccuugcaaggcuacuaaaagcaguguuuguacucuaugaaggauuguuucuuucuuucuccuuccugggaauuaauaaauaacagaaucgacuuuaaaaggggggcugccaagcacacuggguuccugcccagccuguccgcuguuuccaagaagcagcugaaagggagcaaaaggcagcaggcgcugcccgggcaggccuaggucagcuccccuacccaugccagcugcucgcugcccccgcaggccccggacagccaggagccagaacuucgggugggagcucuccaggccagcacacacacccccacagcugcaggaaagggcagggaucuggucgccccacccauaccuuacccccacccagacgggccaaguggucaccccaaguccugcccaggcaccccagugggggacgaggacgaugguacaucagcucacccgccuuuacguacaggcugggcaucugugugucucuaguccaggcccucccuugaugcucuuggggaggggguccaccaggcagggccacgcugcgggcucugugccugcucaccgacaccuagggacugcacauaugggaaacacaccgggaagugcccauucggcucagccacugggaggugcuggggccugagacacccuccccaggaggacagugaggcccugaggcaggaaggaaaggaggaaguaccccuggagauacugggugaaggaggggaggggcucaccaaggugcuuccaggaagggacgcugggggccggaggugaacggccccuccagccugggucccugcaggccaaccccucacucucugcccaccaagaaggggcagugccaggccuggguguggagguuggggacggggccagacuccucccugggugacguagggcccucucaggcccuccuagguggugagcagcugccccucugaccccguuguggccuccaggggcgaaaaggcagcauggagggaagaggagcaggaauucucuccuaggccaggaagcggaagcuccacucacagggccccuggccccgaggaagccgccugucucagcaucuaaaaauaggugucaggcgaggaugcuggcccucuggccccgccagcugggggaugugaggagucacuucccucgggaccaggaggacgcacacaugcucagaggaugcuggugucucccaggcaucagggguggugggcaccagugccccgaggaccaagccccuuccaggaccagcuguucccgaggcagggaagccaggaagucccuagcccuacucuaagccucuaagcccuacucuaagccccucggaaaccccuggggucccacucgggaaggagcuccaggaucaggacuguucugggcccccaucggccuggguccuucgccuguccuggggugagucucaugcccugucaucuguuuuaccuacacuguuaccuggguuugagcuuugagauuaguucugcaccgcagcggauaucaugcuccuggcagggcugugagggaccuggccuggcuggggagagaagugaggaccccaggcugcccaccugcccugauccuggagcuccauguaacagcacagggcgcccugcggggucccccaucacccagcccucucccucccauccuuuaccuucucugaaucacgccacuuccauaacugggagcccgaggggcugaggaagagggaagcaguaacuuuccaaacguggugggagagcacaugaccagagagaagggcaaggcguggugggggcgugauccaccaggcucuggccaagcugguggcucccuccucucaggccccuagcauuuggaaucucacaccuggacucucaaagcuccccugcugggccacccacauccuggagagaggcgcuuacaagcucugugccccuggucccccagcccuaccgccaacuccuugagcccgcagcccucaaagaccuugugcgggggguggggguggggggcagaugccuuauccuggccaucccacggccauggcauuggcggccagugcaggaagccuacagccccaaaagugagauccggcugccagcugaccuuccacacccuugggcguggcccccugccugaggggacuccuccagcacugggggccuaccuggaggacccucaagggucucucaugauucagcacuugcucugcagcccagguuggggggcuuaguuugggcccagaaacacaaagaaugguguguagggcugggggacacugaguaaguccagagguuccuggaaggcugcccagcauaccagguaccacuguguccuacaaggcagguggggacgacuuggaaguggagaucacugaagcccauuucugggagagccugguucuucuugcccagaggggugcugggaacaaggcggacaccugcagggcuggaauaucacccagcacccauagcacgcccagccuggaucacagggacacggggcccaagcaaggggcagggcaccuggcuccucuccagccccagccccaccccaaccucaggguccugucuaaaaccacgguggguacaagggugaugaccugcucccucgcacaggcgccuggacucuaagccuuauugacucuaugagcaaagcucuucccguggugcgauuucaggugcggaaauagggguagggaucuuuuggggucugucuccuugucugggcuuggaagcaguuaugagaaagggauugggggugaaccagauuucugaaaguugagcugaacugggcgcuggggugggugcaggagaaggacccucaaacccaggaaagaauggagggcuuucgggcaugcacccuggugaccgcagggagggcgagugacuugucagcacccggcagagccacagccagccacaggggcgaccggggaaguaggcccauaccucccugcuuuugcucugugcccugcacugcuggacagccucacuggggccagucuguagcagagacaaaccacagacuuccucuucucggcccgcuugacccaguggccguuuccccaaagcugugcagccagacagccugggggagccagggaaaguccacacacccacuuggugaaaccaggcacaggauguccuagcccccucccccacagcgccugccaggguugcagccccucucccggaaggacggcgaaagacgugccaaaugacagucaugugcugucuggaagcgagaaauacccgugagcgaggcuucuaaucagucucuuucccggccggguuuggcugcccugccacugggagguggcuaccagcugcauuagcuugggggagcagccagucccaggcgggggacaccgcucuucucccugcggggacuggugacaccucuucuggacucccuggccagcccccgaggagaagacucuuauauccauuacacagaugaggaaggcaaggcucccacaggccaguucccugucccgggacacaaacucuccugcccugcuccuggcagcaggugggucucaggugccagccgccucugauggaggcuccgagacccacccaagggacaggauuuccacgcugcuuggccagggcaucugcaauguccucccugcuugggcccgccgcgcacccagggagcccaguucucacuggcccccaaagcggucagggcgcaggugcaugcugcccagaccuucccccucgcaccuuggcuugggaagggagacagcaagagugugagugugugugaaggugggagugugugugugugcacauucgugugugugagugccugugcgugugugugugggcuccuuccugggaaagaggucaggcuaccccagcugccuucucccacaggcaaggccucuuuccucucuaaaauggaacuucuaacaagugccccacccagauauccauugucaaccuccuccccaccagccuccccagagcccacaggacugcacuguguccuucuggacccugcaggguucccgcagccccuuccccacugcacauccugccugucugggcugggcucucugaggcagaggucccuuuggaccccuggccaacacccacgcccugagcccuuccugcaccaagcccccugucaacacucaggcaugucagcaaauccaccaacaccaccaggagguaggcucacugugggcccccacugcagacggggaaggccgaggcccaggaccagagcaguguguuggggacuccaccaaggaggcccaagcccauggcacugugcucucagccacacacccugcgacaccaggguggagggggguccaccaggguggugcccaccaaccccaccucacccagccuggcauugcuggcuaccacugagccccaguggauggguggguccacagugacuguggacggacucaguucucaaugcuuugcagggagcaggcccuggggagaggagcggugaggccucagagacauuuccuugagccuuaauaacaagcacccuugggaugugucaggucuccaccccagcugccugggaaacuuccaggcccgcccuggcgacacucccagggggcugccagggagaccucucagccugggcaggcaggaggggcucacccagugcugacacaccguccagagagcaaaaauccaccuccggagaaguccccucccgugacuccccuucagccucugccccuagguccacacucucccucagccccugcccccagguccacacccucccucaacccccacccccagguccacacucucccucagccccuacccccagguccacacucucccucagcccccacccccaggccuacacccucccucagccccuacucccagguccacacucucccucagccccuacuacccccaggccuacacccucccucggccccugcccccagguccacacccucccucagcccccacccccagguccacagucucccucagcccccacccccagguccacacucgccucgucaggggacggggcuucaggggcuggcagagggacauccugugucuggugccucucccacaugccugggcugaagcaggccaccacuaagcaacggcugaggucccagggccgggccuggggaaggcgagccccucccaaauggccuagcugcccccacugccagggcagugccgaaggccacagugacucccaccagcgucccaagcaggcugugcagaacagcccggcuuggggaaggugggaugugacugccccacucaucucccagcugagaguucaguucagccuccguccuucccccuccaaauaaucauccgcacugggauccucagccguccagaugggaaacagaugucucuggucccacacacuggcuccaggggccauuuaaaaaguuugcccucccugccucaacuugagaaacacucgguccacugggacaucagccgagucuuccacgagaagggggugacagccuggggggcacggggaggggcuugcagucuaugcccaggggcguggccacggggaggccgcggccauggacacccacuccaguccuuccaggccaagaagggauuuccacccccuccccaauucuaacaccgacaggaaauggaaacaaaaggcgaaagcccaucagucacuucccagcagcaaagacugcggucaggagaaagccauucucagcaaaagacccuccuccacccacgcuggcacccaaagaugcccagcgugggggccccucuugcaaagcagcggccccacucccggacccugccauccacuccaggccccuggugccacucucuuccuugugccaacucagaaccgcgggauccccacuccugcgaggccuccagagcccuucugggaggaggccuccgcuggaacgugucugggugaggagagggagaucggcucccaggcagggacggccagggugcgcgcaccccagcuucugggccaucccggcgggagucugcgcuccuuuuaggcgcgacccccaggaaggucucggguggugaccgcagauuggagagugagcugggcuggggaaagagugaggcggaucgcccccaaccuccggcaaagugugcgcccccgccccaccauccaggggcggcggcucuugaugagcucaugggggcggggcgccaggagucccgcccgcgagccccccccucguccccgcgaagcagcaguccggaauccgcggccagggacccgcgcaggccccuccuuagcugaggggcggccggguacucgggucccgacccgcgaccaccgcacccaucaccaccacagcgggaacugcccggcggcccccagaagccccggcccggccgcagaggugggcccccgagcacagaggccccgaaacucggcucgcagcccucagccccaaugucggggggcgcgguggccccgggcgaccccccaccccgcuccuggagcccacagguggccccacaacuucgcggcccgcgcugcgcccgcggggccuagcacgcugccgcgggaccugcccaacguggagugugugccugcccccucccgccccggcccccggcgcagcccuuacccagaagacgaaauugaagacgaagagcagguacuugaugcacuuggugcagcccuccacucccauggcggcgcgggcggcgggcggccugcggggcgcgggccgguccugggcggcgggcgggccggcgcggggccuggcggguggccggcaagggggccuggcgggccgaggggcgggggcgcgaagaaaggggcgcgggggcgcgggggcgcgggggcgcguggggcgcugggcgccggaggccuggcaggaugcgcgguggggucgccgccgucgccgccguugcgcgcucgcucucuggccgggcgcgcgccucgcuccgcaguacuuauagggcgccgcggucccgccccuccauaggccccgccccggccagcucacgccccgcccccggccccgccuccugccgccagggcgcgcagccgagggguauggggucgcugcaccuacccccaacuuggcgcguuucggccaggaccucagggcccaggugcaccgugcugggcgcgggaggcguccccaagcugcugucgcgcuccgagcccccaaggggguggcagcagggccgcgccugaggacaggcaugcagcgucugcccaggagugcagccccggugccgggagaacaacccauuccucccucccucaagcaccuuggacaaucugggagggcuccccaaaggaggugagcaccuuggacaauccgggagggcuuccugaaggaguugaugccacagugguuggcuuugcaaagacagcaagcuuugcucacauugcucuccggggcuggaaccugggcaggcaugaggcccccuagucaguguuggccucaagguccuaguacagguaaccaaucccugucucacggaaggggagaauugcugacccaugcugugggagucugcaucugaaaaggucacuggggccugagagggcagcucccagaacagugugaaguguccaggaggccagagacaccuauaggagaaccuccagauauugcaucuauuucgucuacauccugguugugucgugccccagggaugccagccucacaccguggcucuuccggaagguguggggccaggccugcugcacuuacugcuuugggcuaaugauucagagagugaagggugcuuucuccccagaggaaggagcgaaggccuuugcaggagaugacacacugacgaagguuucccaugcccucuccaagaaaacugauggacaacggggcugcauccugggcgggggcuuaccugggaaccacgugggaccagguccggagaaccauccucuagccagcucgucuuggcaagugucguccaacccagugcuagcugauagaaccuucugcaacgaugggaauguucuguaccuggauaacccccuggcacagaugacuacuggguacuggaaauguggccacaaggaaccaaauuuuucauuguguuucaucguaauuuaaauucacauggcccuggguggccaguagcgcucacauuggacaaaacagcucuaucgucaucaucugugcucuaccgguuuucuuggugguuaauuuguaaacugguuuuggcuucaugccugcguaagaacugcaagcacuaguaguuuaugccugguuuuacauuuugugccugucgaagugacauuauaagaaaagacacuauauggucacuugagagucuucgaggauucuuuuuguuuagaagggaauagaaaaggguuccagugugaggaaacauuucucuggauguccuggacaccugcucucccaucagcucccugcuguccccagugauggggacauuucccguuaaaggugugagcuguguccucagcagggggugguagguggagggagacacuggcuccacucucaggaagugggaggagggggcagauccaugcacacuguguccuugaccaccagccucagaagcaggccaugcccagccagcagccagccugccuguccucuucagccaugcaucaaauauuuagugggugccugcugugugucaggcacuguuccaggcccuggcugugggagccaggcagcagaccccuccccuggaggaucugcaacucuggcggagaugacacgugucacagcacgauggucauaucagugcuggggagggacggaauuccuaggaugcuugcuagagggucacaggguuggggcacuccucaaccacggggcugaggcacuccaagugcagaggcuuggaagagccacaguggauccaggcccugaugccugagaaggagccagcuaggcagagccggggaggagcacuccagacagacaggugagguuggaggaacacaagggaagcaggagacagagccaggggaaaggggcuggacacagguuaggggcaggugugagccugggaggcaggggggcuggccuugggaccuggaggccagagggaggcugcauuuuauucugacugcagugggaugauggagggcuucaugggccugacaucugauugcgggggcagcagcccgucuuagcuccagaguggaacucacauucacagucacuugcaggcucacagggaagacuggcuaugaggggguaggaggaccacuucgcagggccuggcccaugggagcuccacaucugaagugcccuucccaguggcccacuggugugaccucauggggaccuuggggaucccauggcugacaaggacauggcuugugucugugugauacuggcacaguacgcacccagaagugcgucugaaaggguuccuguuguuagcugggccugguggagcuuccauccuggcuccaggacaaauauucagguggacucugucagaggaugaggggagaaaggggaggggcuugcucagcagcccggccugggaugggagcgccgcucccugggccuccccugcccugagaaggcuuaugccugaggaaggcagagcugcuggagcgaugugggcacagccggaggcacguugaggaagggcaggcguuugcagcccggcuggguucuucuccucccuguguguaggagucuuccccuccccgugacuucgggcuggucccucaguuuccccaucugcagaagugccaucucccagcauuuugggacaggugacaugugcauauauucccauugcacuuaggggcagggccuggccugugggaggaaccaggucccugguuccuugaagccauguuugacagagagaccuuucugccuggcgugaggugacucacagccccgauggagcacaccuucaguugguggagccauucaugagaccaugagaccccugugccuugauuucucguggaauacaugaagaucacucaaaugaggacaagcagaggcuguuuaugcagugcucacucuagcagggagucggccacuagcacucaucuugggcagacacgcccaggcagguuggggaguuguacagcuuucuauuaaaagggguggcagaagaguuuggauguuaucaacauccaaaaagcaaccaagguaauaaauacgccauaucaauagaauaagagacagaaaccguaagaucaucucaacagacgcagggaaggcacccaaacacaagcucacacucuucccugauuaaaaaaaaaaaaaagcacugaacucacuagaaauagaagggaccugccuccaccugauaaagagcgcugacaaaaauaccccagcuaacguggugcucaguggugaaagccggauaguucuuccccuaugaucaggaguaagguggggugaaugcuccccacuuccauucaacacugucuggaaggcucuggcagggcaauuagguaagaaaaagaugucaagggcacccauauuagaaaggaagaagaaaaaugcuaugucugaauaucuguguccccccaguguugaaauucuuacuccccaggugauggaauuuggaagugaggccuuugggagauuagguuaugagggcagagccuuccuauauuggauuaguguccuuauaaaagaagccuuagaaagacccugggccccuuccuuucacuaugggggggacacagcgagaagacagucaucuaugaacccagaaguaggccccgaccagacaccaaaccuacgggugucuugaucuuggacaucccagucuccagaacugugggaaauacauuuguguuguuuauaagccacucaguuuaugguagucuguuguggcagcucaaaaggacuaagacauuaaacuuucuauuugcugauuauaugacauuauauauagaaaauccacuaaaacccuuaaaacuaauaaacaugcauagcaauguggcaggauacaagaucaauauacaaacaucgauuuuauuucuauacacuagcaaugaaccauccaaaaaugaagugaagaagacaaucucauuuauaauauuggcaaaaagaacauaccuagaaauaaaugcaacaaaagaugcauaaaacuuguguacugaaaaauacaaaauauuuuugaaaggaaucaaagaguaucgaauuaaauggaaagauauccugcagucauggaucaggagacauaauguuaagauggccaaacucccgaauucaucuauagcuucacaaucucuaucaaaaucccaucugucuuuuuacaagcugauccucaaauucauaaggaaauacaaggguuucagaauagccaaaacaaucuagaaagagaagagcaaaaccggagggcucacauuuccugauucaaacuuacugcaaagcuacaguaaucaagacaaugugguacuggcauaaggauagaccuacagaucaaugcaguaaaguugagacuccaagaacaaauccuugcauuuauggucaauugauuuuuuuaaagacuguucaagugcagcagugagaaggcgggaaagaguagaacgagguguuccaucuguaacugacugugaacaaucaauugagauaacucacuaccuucagaccggccaucaguugauuuuugacaaggguaccaagacaauucaaugggggaaggaauagucuuuucagaaaauggugcugggacaacuagauauccaugugcaaaagaaugaaguuggaccccuaccucaugcugugcacaaaaauuaacucaaaauggaucguagaccuaaauguaagcacuaaaauuaugauauccuuaggaaggccaggcgcaguggcucacaccuguaaucccagcaguuugggaggccgaggcgaguggaucaccugagaucaggaguuugaguccagccuggccaacauggugaaaccaugucucugcuaaaaacacaaaaauuagcugggcaugguggugggcgccuguaaucccagcuacucgggaggcugaggcagaagaaucgcuugaacccaggaggcagggguugcagugagcugagauugugccguugcacuccagcuuuggcgacagagagagacuuugucucaaaaaaaagaaaaaaaaagaaaagaaaaaauaaaauccuuaggaaagaacauaggaauaaaucuuggugaccuuguguuaaacaaugguuuuuaauauacacuaccaaaagcacaggcaacaaaagaaaaaauagauaaauuggacuuggccaaagcuaaaaacauuugugcgugaaaagacaccaucaaggaaguggaaagacaacccaagaaaugacagcaaacauuugugaaucaucuauuugauaagggacuaguaucuaaacauguaaagaacucuaacuuaucaacaagaagacaaaccaccuaccuuuaaugaugggcaaaggauuagaauagagcuugcuccaaagaagauguacauaugaccgauaagcucaugaaaagauguccccaucauuagucaucagggaaaugcaaaucaaaacacagcgagauaccacgaugcacccaucaagauggcuauaaauaaaagagacagacaauaacaaguguuggcagagguauggagaaauuggaacccuccuucauugcuggugggaaugcaaaauagugcagccacuucggaaaacagacuggccguuucucaaaaugcuaaauauagaguuuccauaaaaaucagcaauuccaguccuagauauacguguguguguguguguguguguguguguguguguguguguguguguauccaagagaaaugaaagcauaugucuguauaacaauaugcacaugcauguucauagcaguacugguuuguuuuguuuuguuuuguuuuguuuuuugagacagagucuuggucuguugcccaggcuggagugcaguggcgcgaucuuggcucacugcaaccucugccccccggauucaagagauuccccugccucagccuccugaguagcugagauuacaggcacgcaugaccgugucuggcuaauuguuguauuuuuauuagagauggggguuucaccauguuggccaggcuggucucaaacucuuggccucaagugauccgccugccucauccucccaaagugcuaggauuacaggcaugagcaacugcacgcagccagcacuaguuuuaauagcuaaaaagugggaacaauucaaauguucaucaaugaauaaauaaauaaacaaaauaucggucuauccauacaguggaauauuauucagccauaaaaaugaaugaaguaccgauacgagcuacaacauggaugaacuuugaggguaugaugcugagggaaagaagccaaacccaaaagaccauugugauaccauuuuuuucaaguguuuagaaugggcaaauuaauggaaaguagauuggugaguggcugccuggggcuucguggacuggguggggaguggcugcuaacaggugccuacgggguucugucuuugggauguugaaaauguucuaaaaguaggcaguggugaugguugcacaauucugagacuacucuaaagucacaccaacuaagucuacaguuuaugcuaaguuuuaugucauaagaauuuuaucucaauaaagguauaaaagaccuuccaaaggccaggugcaguggcucacgccuguaaucccagcacuuugggaggccgagauggccagaucaugaggucaggagaucaagaccaucauggcuaacauggugaaaccccgucucuacuaaaaauacaaaaaaaucagccuggcacgguggcgggugccuguagucccagcuacucgggaggcugagacaggagaauggcuugaacccaggaggcggagcuugcagugagccgagaucgcgccacugcacuccagccugggggacagagcgaggcuccaucucauaacaaaaaacaaacaaucuuccaaaauaccaauaaaaccaaccaacagagaaggcuucagauguguguugcuggaggcagugggcuggggaggcugaggcucugggcuggggaggcuggaggcggccacccuucgucagggacauauuugccuuccuccaguuggucuugaguugggggcaaaaauaggugaacuggcagccguuagccguggccugagucuguggcgugauugcuacagaggugugguuuggcuuccaggcuucucaggggucagaguucuacugacauacgugauccggccgcugcccgcuggcaugguuagucuuuccuccuuguguagaaagccaggauaaaaacugcccuauguccagcauugacaggcagggcugagugccaucuggggccuggggcacauguguagcuaucuucuccaggggcuccuggcuggcacuauucuugcccagggggcccugcccuuguagggcucccaguguagagggggaaaacaugaaauaguuggacacgucagucaauucaagaauuugggguagugaccccagcuacagagaaaccaagagguaaugggaaaaggaaugauuuggggccuagcagucaggaccaagcacgccgggcagggacagugcucugagaccuuugccugacacuugggggaugagggggcccuuccaggccccggguauagcaaaggcccaaggccagagaguguuggaggggacccuggggcgaggcggggcugggagccuccguuacugcgcgggugcucagagguguggagcccuggggagcagggcacgcagggcccgaguugugcuuucaaaccucucuggucgaagggcaagaacagaccuuggggccagaugggaaacagggagaccagugauugcuuccugcaggggccaggccagagcugacagcagcugggaguggaggcagagauggcggagaggucccaagaaaagggcccucucugcuuucaggacagaaauaguucccccuugugagguuugcagggggaugcaaggcuuggggggcagggaggggaggggaccccagggaggaggggaggacugagcaccagaggguguggggugcuuuc

SEQ ID NO: 12621 - RNA, 29470 nt, Homo sapiens
gaaggagaaagaaagaaacaauccuucauagaguacaaacacugcuuuuaguagccuugcaaggagcccuccaggaaccccacagguuaccugggcuccauccugagagccacccuccauccccaauccccagcagagcaucuugugggguggggcggcuuguggggcggggcgccuugggaggcggggugucucgggaagcggggcgucucgggaggugggguggcuugugggguggggcauuuccugggguggggcgucucguggggugggacagcuugggggguggggcaucucgggaggcggggcgucuugugggguagggcggcuugugggguggggcaucuugugggguagggcggcuugugggguggggcaucuuguggggugggacggcuugugggguggggcaucucgggagguggggcaucucuggggcccggccacuugggaggcggggcauccugggggcggggcaucucagagggcgccuccggaggcuggaguaucuugggaggugggagcagguggcagagaggcuucccacaggugagcuuugagcagggaggugccuguauggauggcucuguggggagaggggugacaggaguuccagauuccggcacuuaugaaaccucacagugauggagagccgagugcugcugugcaggcuaaguugugugcaugucagcuucugcacuuuuauuuccuuguuuguagacaaggcagagagaagcugagaugggccugaggucgccuuggugaaaggcacucagcagccagggccuugggcugcccucccucaucaccgugaaagcgggacucucuuuuaacugacaucgggcuccauaguuacuccaguccuaacuuugauggauccuaaaagugcacuucuaaggacgcggcuucgguguuucccaugccgcugcuugccccugggaagcguuggcucugccucggaagaaguuagcgccaagauggcagccuggggucuuuggggcccagaagaaacacuggccccggggaguucagucaucagggacuuaggaugugggggcuuuucaaacagcuuuauuuagacgugauugacacacaguaaauacagauguuuaaggguacaacuugguaaguuuugacaaauuuauacccccgugaaaccaucaccaacuccccaggugccccuggggcccuugggaucucugcuuccugccccuccuccccgucccagggcaaccacgggccgucgcugugggugcacacagcaugcauuucuucaacaagcggacucagaaggcacuugcacaucguugcuguucugccucuuugcuucagcaugauuacccagaggcgcacccgugccguggccugcccgucgucuaugcacccgugcuguggcgugcccgucgucuguguggcaugccugucugugcacccgugcuguggcgugcccgucgucuguguggcaugccugucugugcacccgugcuguggcgugcccgucgucugugcacccgugcuguggugugcccgucgucugugcacccgugccguggcgugcccgucgucugugcacccgugcuguggugugcccuucgucuguuccuuuuauugccgggcaggguugcacccacaugugcaagccagcgacggaccccagguucacccguucaccggucagugggcauauggguuguuucaguuuggggcauuuacaagaaacgugcuagaacauuuguguacaagucuugugugaaccuaaguucauuucucuuggguaaauaccugugcguggagcagcugggucauguggugaauguggguuucacugcuuaagcagcaguuuuacauaacugccaaacuguuauucaagguggcuggaccguuuuacagcccccguuguaugcgucccaguugccucccccagcagcauguggugugguuggucuuuuucguggcagccaguccacugggugcgcucggcauguggcugcagcuugaccuggguuuccuggucccuggcaagguggagcaucucuucaugugcuuuuuugcuguguguggaucuugcggggaagggucuguuccuguuuuuugcccaucuuucaaagauuggguugccaguuuucuugcuguugaguuuggaaagcucugcauacguucagggcacagguccuuuaccaggcucugccccaggucuuucggagagcaggugucuuucgcauuccugacucuggggaaccucuagcccugccacaugggguuuguuauggggcaggggcaccugugccuuucccaccacggggcuuggggauuuggugcugccauugcccucccucguagguggcccuaggggggucccuccgccuccguuuccucauccagaaaccggcagugaccaucaccaccauuguugucaccuagcuccagcucaaggucccugcugaaggucggagagcuuggcauggccccguuuguccaugcuagggcugggaagaccaaggcucaggugaggccucugcccagugccuggcacuccuucuugccccauuuuuccacccaggguggcucccgacuacuucugguagccucggggacaguugagguggacaggcuggcgucacccccauuuccggcugucccucccacccccuccuggcccagcuguucugcccuauuaaaagucacaugggcccucggguccuuccugguguuggcccaggcucuuucaggcccugcaggccaggaccagccuucccugcaacccucggcagaggccuggggccggggcuugucuaggggcagccuccccauacggcccuggagucugaacagaagccccuucccagagcacagcaagaagcugcaacguggccugaagucccaccauuagcagguuugggguuuaggcugagcuuugccaucacuaccuuucuguuaggacgguaugcccauuagaugggaucauccccucagcgcccaggcuagaggagggguggucccugcccagccagggagggcuggggguggaugggccucuacagagcagcuuccgagccaggcacgguuccaugaucagcucuguuuuauagagggggacacugaggaaccgggagccuggggaccuuccaguggccccacagcuccuguggcugagucaggguuugucaccaggccucuguggggaugaggcucccccauccaccugccccacucuguccuggaacagcucucaaaacggucucuggaccacaguuucaaaagaaaauaagcaauguuuucaaaggcccuggaggaagccagaguuaccacggcaacucucggccucgccaccuccucccgccaggcugcaucuggagccagcucaggagggcagcagggugaggacagccaggcucucuggggccaccccccagcccccacccuuccugccucuccugcacuguccacggcccucccugugcucccacggguauaaugggcacagaagaaccaggagcugucugccccugcaggauucuggaagccaggggccccuggccucccuggggccuugucaugugaggggcacacguggggucccagcugccacauggcuuccagcgcugcccgcagguguauguugggcccuuggugacucuaaugcaccuuccacucggcacagaagagcuucagucuggggccugggcgggggaaguaggcugccauccucgcuaaaccaaagugugaaaauugaguugaaacucccauaggagggcaggaggcacagcuccucagaagaaggucugagaaaccacagcccagguuguuguuucggguguguggagaaggugcucuggcaguccugcuacagggggaccaucaacagccccuuuggggugagagccccguggcugcuggcaccagcagccccuaugaggcuuauuuuauuuuugagacagggucuugcucugucaccgaggcuggagugcaguggcacaaucauaacucacuguagccucaaccuccugagcucaagcgauccuccugccucagccuccaaaggugcugggauuacaggcgcuugcuaccacgcccagcccccucuggccuuauuguuugccaggcccagcucaggucccggaggaggggagacaggagugugagggaaagggggaagagguauagagcccccagcuccuccacccacccgaacccucaccgaggcccuagacccuagaccggccugaccgggggguccucaggccggggacuugggugcaggccauggugcuggggccugaagcucacgcucugcugagcacagcccccugcccaaccccacccuggggcccugcuucccuggccagggccauuggaacaggaguggggcuguccaggugguguucuuggguccagcccucaguuucucuucugcaguugaccggcagcccugcaucugugguggggucggcgccuggugcuggugaggcaaggccucagcugcugggacaggaccugccuggcacccagcugguggcagagccaagcauuccgacucagcucugggagcagcugccuucugggcuggcauucuccgccagggggguugugcccucguggccccccccgggugccuccucaccuggcugauuucaucuccugucccccugccuccuccuccaggaagcccccagggccuggcccuccuugagaguggcauggaggaggaagaagacucgcccaggcccaugggagucggaugguggccgcacuuguggggcccugaccccauaggcuucuucagcacgcccuggccugggugaucccugccugagggcugugcacggcucaucugccagaccagauuuuaggggauucuuguacuguccuccuggagcagcaggggguaaagccugacccacccagacuguccagcaacaagggccuccugcugugggccagggacccuggaacugaccaauuguguccuagggacgcagaguccccaggcugcuagagggcuguggggcccuguuucaugccugaagcaggaagaaaccccaggagaggucugaaggggacccagcccccacccugucuagcagggaggagccucugcaagaggccgaggggugcugaaguggaggaggauagaggcagcaggacucagggucacuggucauuuauggggaucacacggcugcagugugcccugcauggugcuaggcaccagggacagcagaggacaagccuguguccucucccaccaccagagggcugggcacugccccuagggagagagggggccuuggugugugcagaggggggccuggggcacgugccuggccuggucagaugaucagagugggcugggcugggccuggucuggggcccagucucaagggcagaccccaccuggcuagaguugauugugugcacaccggaugacccggcguugaaggccucuccucucugugagccucauccccaccugccagacucccagcacagccugcuuccugccccagcugcugagcgacagcgcugggccggcuucugcgcgccccuucccccagcccaucuuggaaaccacagcagcguccuuccucccaagucccuucccagggcugacaucccacagcagggauguaucccacaaaccccgcaggcccuggugccuacagcuuggccugguaacaucaaauccuacccucuccuccuggcagcaaagauggggugcccccaccccagaguucucagcacccccagacagaagcagucccccagcgaccucagaacucuuggggcgcugccacacccuugcaggagggggcaguguuccugggaugcucagguccugguaucaccucuggccagauacggaaggugaaacuacagggcauccaauucaccuugaacuucagauaaacaccagauuauuuuuuuguaugucccgugcaauauuugggacacacuuacccuaaagaaguauucuguuuucaucugagaggcagauuuaaccggcgucccgugucuuccuggcaguccugcccuggagucacacuccacaggugcagggcagggccaggcuccaaguagauggcggccaaagcacccgccccaugcuccugacucccggggcucuucagggcauugcgaaaaccagcagcagagcugacaccuggucccugcucgggagccagcaaggcaggaggcugcuuaggccuugcguguggggugggcgcacucccugcugcagugcucuucguacaugugacacuguucccgcucuuucccagcuggcuggaggcgugauccuggguguggcccuguggcuccgccaugacccgcagaccaccaaccuccuguaucuggagcugggagacaagcccgcgcccaacaccuucuauguaggugagugcacauguggccgcagacgcauucagggagggcuucuaggaggaggcagguccuagccuuuuggauggggacauggagggugaaagacagucgggcauggcguguccgggcagggaggcggcccuggaaagggcucugggcacaaggguugagauggaggugggccuguggccugcuggcccuucuggucugagccagggcaggggguggcagcuaggccugggcagggacuguguggagaccuugcuuauuuuaagugugggguuauuucgggggaggcucccugagaaggguggggcuggaugccugggccacacagagcagccgaggcagcuggcgcuguggagcccgggagggagggagggauggagcucaagggauggaacccagugagggguggagacggggcaggggagggguggagagggguggagacgccccagaggcggugugacucagcugccccugcaggcagcugcaccuugcugccuuauuaggcugcgugugggggacugggcugcccucccugcccccaggagcaggagcaggagugauggaggaggaggaggggaggggcaaggccaggaggaggaggagggccaucucacugugcagagagcagcacccuuccuccuggugccccuggcagggcuggugcugguggggcucugggagcauuuguugagaugcuucuggccuugaaaggaggccccugggauggcucuguugcccucacaggcugaggggugggugaggugggcagccuguguguccccaguccucagggcuucccucagccggcaggugcccccaggccuggagcugcagggccaggcccccugccaguuacggaggcugcuuggcuugguugcugaaccagggccccaggaggccgaaauagccccacaccugcgccgucccaccucuuuguccagucaccccagggccaggugagggcccuggccacacagcgugcccguuccuucuuccccaugccccgcucaugggucagagggccggugcugggguccagauggugucaacagggauggucccuguccuccccagagacagaagccuguggcccacggaggguuucugggcccagccgauccuagggagggucccauggcccugcccauagguuccuggccucucucggggccguggugcccucacagguggugucaggaaggacgggaaaggcugcuugucccaggggcucauguggagaccacccccugcacgcagcuggggcgcuccugccuguguccucagaagcacucggcuuagcuuugcccaugugccugggcuguggguggcagagcccggccagcauccuccgaucuccaagggugcaucucuacuggaggccccuccugggccucuugcuccccgcuucccagaucauuaggauauuugggguccagaagggccucccagccauccugggccuuguccuccggggccaccaguccagccagugacaaccacagcauccccggccuggaacgaggcugcccccagcacguuccucguacuccuguccagggacaggaggggcugccccugccaccgaguccccuucuccaggaccuggggccugugggugugaggcagguguucuuggaaggggucacucuccaggcacccggcggccaaggcuuguggcuggagcagcucccgcuguggggucggcgucgggccccguguggccggagaggagcugaagggucacuuagcuucgggcuggggcgaggacaggggacaccccagagagguaugccaggccuccuuccugcgccccacucucggcagaagcagaggucacaggcugugcugaggccccauggugcugcccccaugaugccagggugaggcuggcguuggaagcaggugucugaccugcauggugucaccguggccacaucagagcuccagccccagagccgcccacccucgguccuuggcugugguuucccugggcuggaggagccugccguuguguuggccacacgaccacaggaccugccacccccgacgugggcucugccugggcccccacuggacagggaccccuuggagcuccucuggccaccaaguccucgcccauuccagaaucggccuucuggagccucuugcugucccugaugcgggcugggccuugccaagggcuuuuuuuccugcgccgggaacaggguggauuugcugggcucacuccccucagagacgcugcgggugcgguggguuaggcccaagggcguuaagagaggaggcugggguggggcuggggccuggcagggggucuggcagcccugggccucccaccuccugucaggaccaaaaaaggcaacgcgccucuccugaccuguaccccggagugaacccaaccuugcaacccaggagugucagggccugaggggagggagaccuggcuccugggugccgugcccguaaggagguggccaccugcagggcauuccuggcagaggcuucaucuggccagguaggaggcuggguggccgagccccaaaucuggguguguucucugccuggcgguggguccugccccaggcaccuucuccucugggcuggcugggcagggacaaugggccuggcugcgaggagggggccugggcugccuucugcauugccucggugacgggagauggccccugccugcugagggauaggggagugggcaggcagugagagacacugacagcugucccgcggguacagggcccugucuggguggccaggcccaugucucgggcccacagugcgccccccacccuuggacggcgccuucucccuccccaggugcaugcugcccagccagggagcgugggggaguucgggagggcuggccuacacgcccugguccagcugucccagguggggugcugggcuucagcccucagcccagggccuaggaauccaacuugauccuccccacacagcagccagguucaaaugcaggucccguaacggaagugcugcugugcagcccagauuggggggcaggagccagcagggcccccccacccucuucucgcaccacacuggggaggcagcauugguuccaguuccgguuccugggcugcccucucaaccccggccuacaguggggcccacccugugccuucugaugccacucccaccccacgccaagucccagaggcuuugggagcgggugaaggcgguggguggcggguggcaggugcaggcggugggugguggguguggcagguggcgggccccaccgcaggugucaucccugcgaagcaccugucgccagcacucagagcgcucaugaggugcccaguccccauguggccuccuuagucuccguccugugucauggaagagguaacugaggcacagaaaacucaccaggccaggcugggaugugaggucccuugcugcucaucccuggcagucagcaacccuacaucuucccagcugggcggcccgugguggguucggcacccaggacccuccggggucuugggcuguggcgaguguguaggcacccaccuggugucucucuccccgcaaggcaucuacauccucaucgcugugggcgcugucaugauguucguuggcuuccugggcugcuacggggccauccaggaaucccagugccugcuggggacgguaaggcagggaggcgggccugugccugggccggggaggggcugggggcugcgucuggcccugaggagggggcagagcuggugcucagggcggagccuagaauucugggggagguggcuccugugcccugcuuuucccguuugguuuuuaaauuaaaucccaccgugcuuggucuccaucguggccaguuccuacgugaccgcuuuucuuugucaaaaaauagccacaaauauaacagggagcaagccucagcucugaggccagccucggcgucccgggcacaccgcccccugugggaagcccaggccuggcugugccauccagggccuggccaguccaggaagagggagccuaugcccgugucuccagugggggaaacugaggcagaucccauggcucccccuuccguggggagcaggaacaaggggguggggaagaucagucaggggucaugcugcugcacacgccucccugggggcugcagacauccuggacucaccagccugugaccccaaaccacacgccccgccccauccaccccguccuguggagccuggugccgcguggggacauccugggcuuugacggcuccucccugcgcugaguuuuagccucugugccccagggcuccacacaagccgcucacuccuggucaggucgugggcugguggcucccacuagccccucacagacacgccugcugggcaccuggguguguguccuugggccccgccuacagccugcccucuuuccucccucuggccacugcccggcuccaguucuucaccugccuggucauccuguuugccugugagguggccgccggcaucuggggcuuugucaacaaggaccaggugagccugggugugcagggacaggguggggugggugacgggggcacccuccucuccugucgcggguggggguugggcugacucauggcuugugggagcucuuugggcucuuccugggucccacuugccaggaggaucuccaggggcuuuauggaggaggcagcauuggggcugagcaccaggccagccucccgugucccagcacucccggggcagcugagagugcagaguccuuguccucuggggucuagccucgaagccacccugcccagggagagccugggaaaagugcguccgccuggggcggggcggggugggggcaaggagggggagguucccccugugcaugugaccgcaccccucccccagaucgccaaggaugugaagcaguucuaugaccaggcccuacagcaggccgugguggaugaugacgccaacaacgccaaggcuguggugaagaccuuccacgagacggugcggccccggggggcgagggcggggagcagggccccgggaacccggcggggugugucucguccuggaugaauccugccuacgcccagaccucaggagcaggaggugcccuugggaccuccaggaccccuggucucaacugguccucgggugggaaccuagugggccaggguggcccagggugcggaaagcucugagcagcgcagcugaggaggaagaaggcuggccccuggaugcauucugcaguggggagcgcugcguaccccuggccaccuccccauggguucccuagagccaccgucccccugggcacauccagggcugaccuugcaccccugcucucugcagcuugacugcuguggcuccagcacacugacugcuuugaccaccucagugcucaagaacaauuugugucccucgggcagcaacaucaucagcaaccucuucaaggugcgcgaggccgguggggccgcgccugaccccccgcaugucccgccccugggugggguccuaggggugggcaggucacacggcagccccacagggagcgaccacacuggguggcauggccccugucagggcugcucugcugggaggguuggggugggaccgcaucuggcccacgaggaaggcaggcgcccugugcugcgcauuccgggugaagaagguggaggcucuggggggugggaacucaccugcacccccagcuccacgugugcacucguggguguggacgccccugacagccuguagcuggcagggccugcaggccauauagugcccuguggaaguuuccugcugaggccucaguggaagucgucaucagugaugcuuuaggggucuagugacaccaaugaccgugaucucaguggaaaagggcacagugugucccaggcauuucgcguuuauguuaaaacggguggaagauagcaagccggcagaggccgggccgcugcacccgccuguuccgagguggguaggggguggggggcuguucccaggauuccccucuacgcuuucuguggugaccacggauuacugcgugacaacgggaagccgggagccgaggcccggucccugaccacgcgugccuggccaccccugcaggaggacugccaccagaagaucgaugaccucuucuccgggaagcuguaccucaucggcauugcugccaucguggucgcugugaucauggugagcgggcgggggcggagggccugcucucugggcugccccuuccgcggggccuugugcugacugcgccccccaccacccuccugcagaucuucgagaugauccugagcauggugcugugcuguggcauccggaacagcuccguguacugaggccccgcagcucuggccacagggaccucugcagugcccccuaagugacccggacacuuccgagggggccaucaccgccuguguauauaacguuuccgguauuacucugcuacacguagccuuuuuacuuuugggguuuuguuuuuguucugaacuuuccuguuaccuuuucagggcugacgucacauguagguggcguguaugaguggagacgggccugggucuuggggacuggagggcagggguccuucugcccuggggucccagggugcucugccugcucagccaggccucuccugggagccacucgcccagagacucagcuuggccaacuuggggggcuguguccacccagcccgcccguccugugggcugcacagcucaccuuguucccuccugccccgguucgagagccgagucugugggcacucucugccuucaugcaccuguccuuucuaacacgucgccuucaacuguaaucacaacauccugacuccgucauuuaauaaagaaggaacaucaggcaugcuaccaggccugugcagucccucagugccaguggugucugagaccuagggguuggccggagggcaggggaaucugacaucgguggggcuuggcucuguggacucugugggguccagggugagggugggugggucgggaucccugguguucaccaaaggagucacucuguaaaauuuggggaguuauuuauucugagccaaauaugagcaccgguggccugugacacagccccagguccugagaacuugugcccaaggcggucuggcuacuuaauuguauacauuuuagggacauaggacauugaucauuacaucuaagauguacguugguuuagucggaaaggugggacgauuugaaggggagggacuuucaggucauaggcggauuaaaagauguucugauuaauaauugguugauuuuaucuaaagaccugaaaucaauagaauggacuaucuggguuaagaggaguuguggagaccaagauuauuaugcagaugaagccgccagauuguaaauguuucuuaucagacuuaaaaagguaccagaaucuuaguuaauucucuccuggaucaggaaauagaccuggaaagggagggggauucucuauagaauguagauuuucccaagagacagcuuugcagggccauuucaaaauacaucagagaaauauauuuugggguaaaauacuucgguuucuuucagggccugcugucacguugguaucuuauuacuacagagucuguuuugugagucuuaaggucuuuuuauuuuuagacagaguuuugcucuugucacccagguuggagugcaauggcgugaucucagcucacugcagccuccccuccaccucccagguucaagcgauucuccugccucagccuccugaguagcugggacaacaggcaugcaccaccccacccagcuaauuuuguauuuuuaguagagacgguguuucgccacgguggccaggcuagucucgaacuccugaccucacgugacacaccagguuuugggauuacaggugugagccaccacaccggacuaaggucucuguuuuaaugugaaugcuggucagcugugccuaugaggcauguucggccacccacagucaucauggccucaacgagcuuuucagguuuacuuuagaaugcauuuggccaagaggugcccauucaguugguugggguugcuuagaauuuuacuuuggguuuaaaccagggagcaacuccagguagcaagggcccuuuuugggagcguucucucuauucucuuuugggagaggcccuguguugccugcagccacuuccacccugccccuugggcacacaaggggcacacaguguaagcaggugggcaggaggggucgggcagccagggaaugcagugagaugggcuugggguaggggcugggugcgcugcaggacuccucuuccuccugagggaugguaaaggauggacacacugcccccucccgagcauuugagggucucugcccugcccaucuguuaccuguaaauguuccuuugaggagcugauggcucaggccugagccacaucucagagggucuggaggggaagaaagaccucauccuacuagggagcccccccagcccaccagcgagcggugguugggggcagacaggcuguggggcuaaggagccccugcacucccccguccuuuucccuuugucugagcaccuccagccagugggcuuggucuagacucuccuaucuuuccccacaucgugggguggggcuugcucuggguuaggcuacuuuucccuaguuguggggaggggggugcuggcacauuucacuguucccuggaggaaaugagugccugggaauucauaucuagggcucccagcagccucuuugcaggccaauuuggaaacuguccccagcccugcauuuuaggggguuacagagucucucagcaggcccuccuccccugcugcucccaacuugcaagccugcacugguugggagaacauaaugguccaaggagcccccucucuacuuuccgcuguguucccuguggggagggaagagcaguuuaagaaauaaggaaucccaaaggcgcacagcagaccgggggccgaggaguggguccugcuuccccuccuuuuuucuaggcugagccacagcagguccuugaauccuauuucccagcggaugccaggacagcaggcccugggggaguucucucucgagccuuucagagggaccagaggucuagcagccaaggagaacucagaauccuugaguguguggggcaggaacucucccagcugagaaggggcacaaggugccaaccaucuagggcccaguggccaaggaagacgcggcuugucgcagggagaaucugggcccugguccucccuuucagggcgggcagcugaccugcccccugcugcggacaggcgaggccaggcugcuggcucgcaagcauggcggagcccaaaccuucccugcugccgcccgcccagccacggcugacuuggaagcuugaggagcguucagcagccuccauccugcccgggaggaccggggaccuggaagggccuggcccucgcuucccugcagcgcccuagggggacgucucagugccucccggagcccggaccaaugcaccagagcugagggcccaagggugugaggguggccgggcaguggccccgaggacggcgccccacaaguuugcggccagggcccagcaaaccccuaggggugggaaagcgucggcccagcuagcggguccagcagggcugcccccuucaccguggcccagcggucacgaccccacguccucaucgcgggcugggacugccucugcgucuggccugagcgggaccgugggauccuggggagccccgccucggugcacugacagagcccagaaggagugacgguuaccgcuuccggucaggaccggaagugccgggaacggcauucguccuccgugcgagaugacgcacuuccugccugaggcggccgcuguucucgcggcuuccggcagguggcgcugagaccacgggaagccagccuggcugucgguuagcccucgagcauucugggaauugcaggccuggccccuccucuuccuguucuuggucaauuccggucuuguuuccccaacaaaugccgucguuuccggggcugcuuccgagccggacccaagggccggggcguggaggaguagaggggcgagcgcaugcgcacaggacuacacgucccgacaggcgucgggagcggcggcccaguuccuugugggagcuguaguucugcaggcgcggaagccguggugcucggccggcagagcacucgguuucccagagggcugagcgcgccgcacggaggugcggcgccgaccaagauggagacugccgagcagccuugagccgguagguuuguggugagggaggacgggccgcgcgggccggccgagccuccgggaggucaccgagcgcagcuuuaauaccugagcucgaaggccccgcugugcucgccgacccccguaccucgcggccgggcccuugggacccacagcauccuugugaggcccggaggccuguccagcccgacuggacagugccgaggggcaccgagagccagcuuggcaccgagaguucguuuguucucuggcggggaggucuugcuggcacauauaguggagaaaggccgggcucugcguucauguggagaaagagacggcuuccuucagccuacggacaugaaggagucaacucuaccuuccacucguugccggcuuucgccgagaaccccgagaaacggacuaccggagucccuaucuugcagcccgauccccgcuacccgucggagugccccgcugaccaggcugcuucuggccgcggcggcguuccgcugcagaggacgggagugcgaaucugggaagcaggguucugguugaacuccagcuucgucugcaacauacugugugacuugggcaaauuauuucccccgccccguuccugccagcuuuaaaacggucaucaguggggggugcugcguauccccuuucacugggguggcuucuucacugaggagagucgcgccucagaggaacugagguccugccuguguucgaccugguggggggcacuaagagccccugauaguaccccugaccccauccuuauugggugcacaagacacaggucacucugggcgggcaaggaguuuugguagcaggagaggagucgguggauggauggcugaggacagugcagaaggguguggcugggccgucuuuuuuugccuggaaauucaaguucugaggcacccagucacuccagcacuaaaugggugcaggaggcagcacuugucugcccagcuggaaaggcaggguaugugcugaguguuacagguggaaggccacuggaggucgcuccaggagccgcggggauuuaccucugccuaacagggcugcucaaggugauggucgacaccccacuuuccugagagcuugacccucagaugccagggccuuggcugcagauuccuugggagcucccggggaucuuccagcaaauaggagcaaaucuuuuccccguggaucaggaaggugcacgcucuuuguggaauacgacugcucaccccgcacagcaagcagcuuauaaguggcccuccugccugauuucagcccuggguucaagcccuggguggcugcuuacuaccaaaaucgcucaguagcuccaagccugccugcagaggguuggcaccauuaaaugagguaacgagucaaaagucccuacccuggguccuagccugucaggggcuccgaaaacccaggcucaggucgguccugcccggcaccuguuucacacauguacacuccggucugagguugguccucucccccaccccacccaccugcaguugagcagcugaacagaggccaugccggggcacuccgaggccugagacgaccacgccugugccgcugaggaccuucaucagggcuccguccacuuggcccgcuuggcuguccaaucacacuccagugucaaccacuggcacccagcagccaagagaggugagaggagggcuuggagggggaggcgggacuccacccugugugggacaguucugucaguugacccuccacuuguccaggggcaguggaucugcagggggaacucauucucaauacuguuccuccugagaaacaaauuuucugggcuguuuugguuuagguguggcguggcccuggggacgcauggcugaggcaggaacaggugagccgucccccagcguggagggcgaacacgggacggaguaugacacgcugccuuccgacacagucucccucagugacucggacucugaccucagcuugcccgguggugcugaaguggaagcacuguccccgauggggcugccuggggaggaggauucagguccugaugagccgcccucacccccgucaggccuccucccagccacggugcagccauuccaucugagaggcaugagcuccaccuucucccagcgcagccgugacaucuuugacugccuggagggggcggccagacgggcuccauccucuguggcccacaccagcaugagugacaacggaggcuucaagcggccccuagcgcccucaggccggucuccaguggaaggccugggcagggcccaucggagcccugccucaccaagggugccuccgguccccgacuacguggcacaccccgagcgcuggaccaaguacagccuggaagaugugaccgaggucagcgagcagagcaaucaggccaccgcccuggccuuccugggcucccagagccuggcugcccccacugacugcguguccuccuucaaccaggaucccuccagcuguggggaggggagggucaucuucaccaaaccaguccgaggggucgaagccagacacgagaggaagaggguccuggggaaggugggagagccaggcaggggcggccuugggaauccugccacagacaggggcgagggcccuguggagcuggcccaucuggccgggcccgggagcccagaggcugaggaguggggcagccaccauggaggccugcaggagguggaggcacugucagggucuguccacagugggucugugccaggucucccgccgguggaaacuguuggcuuccauggcagcaggaagcggagucgagaccacuuccggaacaagagcagcagccccgaggacccaggugcugaggucugagagggagauggcccagccugaccccacuggccacugccauccugcugccuucccaguggggcuggucagggggcagccuggccacugccuagcuggaaugggaggaagccugcagguggcaccgguggcccuggcugcaguucugggcagcauccucccaagcagagaccuugcugaagcuccugggguguggggugugggcuggaagcacuggcucccugguagggacaauaaagguuuugggucuuucugagacuuugugucuaucugggcccugcuuacccaaagggcucaguuggcagcaagagcuccccacaccugacccucggugccggaccacucgaggguggcugacaccugcaucccucaccagcacaucacccaggugacagugagaauuggaaaccccaggccuccucuagggcuuguggcucaguggcagguguccagugagugcccucaaugggccugaguggguacagaaucugcccucccccaaccaaagcccacaugaugccaucagccccaggccuagugcagaccacagcuugggaagcgaaagggagaugacaaaauggguguggacagaggaggcuggggugagugggcaguuggggggccugggcagguguuugagccugggguccaguuuuaucugggccacgugggguacaguguuuuccaggcuccacugaagauaaagcagccacuggugccagcaggggcuuugucuuggggccauaaacaccagugugugcuguacuggccaucgggugucagggggacagcugacagaugcaguggaugcccagcccugucuuccaggagccagucaccugagccccaaaggaccuuuugggucuuaagugacagaaauucuaaccaccaguguuucaaaaaaagaugagucucuugucaggcaacacaagucagggcaggggugggugcagaccccagagcagcuucgcagucuggaugggggugcucccccgucacgccacagggccagcuuuuccacagugcaggcuggucaguuuccagguagggaugcgguggggcacguuuucugcccggggaguugugccugucaggggagacagccccaugacacugcugugccuccggggaggccaggagggacaaggagcgguuccuuugggugagggucuguggugaggcaccaggagggccauugucugcuggggggcuggugcccccugggggguuccgcuggaggucggcaaaggucagugcacaacgugcaggguggccagcugaggagagguggccccacacguggcaggccaagcagcucagguguccgagggaggcuggccagccccggguuguucccagccaucuaaaccaccucuguggucagcagccaccagcuggcuucccucgccacagugcugagagccugcugggaaggaaggccccccugagcggugggaaccagcaaggcaggcccaggaaggggagagguagcuggcucagaggcaagggccaggacgccguggcucucagagugaguccccacaggccagccuggggaagauggggagcccagagacaaccaggccucugccugcacuccugggacuaggaaagcagcccccuugaggccgaggggcccguuugcuugcugagcaggacaguccaauagggcccacgccaggcagagccucaagagucugagugaagcacauucggcccuggccaaggcagggacuccgucagagggcacccacaccacccugaagagccgcguccagccaaggccuccugagacucccgggccaggcagggaaggcagagcacacagcacagccuacggccccccagccgcugcagagugggugcccaugcccacccucaucccacgcuccccaaacaggcuuacuccgggggccgccacccugggccagcacgucagccacggaggacacgagcaccgagcaguaguugaucuggagaagggaaacacguccgggaagcuccagggcucucucaggacagcaggggacaggcagccuccccaucuccccucuccugccagggcccccgcugcccugugacuccucccucugagagcugccgcucacaggcaggggugagugaggcucccgugaggcguguagagugaaaggcgaggggucuucaaugugagaccccucauuuaaggcuguagccucccaaguggcagggugggaggaggcacagguggggacggccugucuuccccagaacgcuccucugcccacuggggugcuccuguccuggcucuggccugccucaucucugugagugaccgggcagggcuguggacccaucccaguagccccacgcagccacccgccucccaucagggagaggagcucuggggcucgcuugccugugacuccagacacuugaugcgcuuuucuugcucucucagacccccgagguacuuggcaaugaaguccacucugcggcaggagcagguggucaggcuguggauggccacgcggugcucugcguguggggagccuccccauccccccaggccucccugugugcccgaguuuggggugcccuggcccuuucccuuccucccucaugcccagaucugguggcaccaggaccccucaaagugcaccuggugcaguacagagcgcucuaugccuucccaguagggcuagggugccaucccugccugggcgcaccacccagaaagacggugcagggcaggcagucggggacaggccccuggagccagggcuggagggaagccagggguggguagucccaacccugagaccacagcagggagggcgccacggucacugugcacgcucccuuuuugccuggccaggcgucccagcaggguccugcacaggucaggcuggaaagcuaggccccugggcucggccagagcccugccccuaccccuucagcuucaguucgccagcucagauccucugucacuggcgccaauggcacauccccgcuuaaagacagcccgauacccaccagugaucaggacaggcccccgcaccugugggcgguuuuccgcagcaccucccccucgcugucccuccuccgcuucuccaucuugcucaggaaguucuccuucuggacugucucccaggugacgaccuucugguccagggggucuggcaggucucucucugggaaagccagguggcagccagcauuacuagagcaugugggcgucaguggcagagcccaggccuggucccggggcgaggugggccaggcagaaggagugaguggggcccagccagggauggagggcaagcauggcccugugcaaggacggccaagcugcggguggacgggcucagcugugccagccugcacagagcccagcugaggacccacagggcugaggagggguccaggucucuccagaccugccuccagcgcacagccccgcccugggacccgccaccucggccucacccaggugcucccgcuugugcucggccucacccaggugcucccgcuugugcucagccuccuucuugaagacccggcggagcgucaggcucagguggcugagcaggaugaagggcggggccagggcggggcgcucgugguacuccacaaucagguuguagcgcuggaacuuccagaacaugucugcguugcccugcaccaccuggaacguguagcugcaggggcacagcugagccgucaccuaccggcuccccacgaccacuugggggacgcaucccccugcacccugauugcuguuggggagcccuuuuugaaacugaggcccagcacugcuucugcguugccucuggggugugucacgagggguccacucuccuugggucuuccccuguccacucugcucuccuggacaagcccagaguucuugccacagcaccggucccccaaagacccaggcccugcuuccugggacugggaggguggcccacagaguucccggucuugggcaggcaaagcccugcaguccaggcuaugccaccuucuaucugcccugaggcaccaagccucacccucugcagcacaccagguggguugcaaaggaggcgguguuggggaaugacccucugcucccuccgcuccagggcucucuccuccagggguuggguggagucaccugaacauggcgaugagcagguucaugagcagcacauuggugaccaacaggaaggugaccagcaggaggaugaccagccaguuggcauagaggcuggggcaggauggugaguccuccagcagcaguggguggguggagcaguucacacgggcuucuggaaagcaagggugcuguggggaccagaccgggggcagccacaagggcggccuuaggcaaaugccccgagauagagcgcugaguccugguguugaacccaggggacggggugcugguugggugacccacugucccaguucacccagggcggccuggguuuuagcagugaaagccccaucacagcaaaccagaaccagacggguggugagccccacccugggcccccucugccaugucugcugagcuuccaccaggggcuggagucagccaagaucacaggcccuggaaguagagccaagaccccuggagggauggaaggugggggacagaggggucacgggacccagguuucuccugguuguuggauguguuaaaaccuccaccccuccuccgaaaaaagccucugcuguugaagguuuggggagagcugccgaggaaagggagauggggcccaggacuucucagagccucuacagcacuaaugccugugauuaaaccccaagcuggcaaguaauuccgccaccuuuccaaaauguauugagccagcaggcuccagacugggcuugcugcaagcucugagggcaccgaucccgcacugggccacucaagucaagaacauucuucaggcggcacacucugggagcuugcaggcugagcucccucggcccugggcagggacacccuggagggguggcagaucucacuccagucccuuaaaaccagacccucacaccugcuucucccuuguagggcucaacccuggacccucaccccaccccagccugcggggcaggaggagggaggagggaggaaggagccgcagugggcgucagggugcucagggucccagccagaggccagagugugcccuggccguccaggaccacauauccccuccauauccgaaugggagcuccgcucucuccucccuccccagccugcacgcuggcgugugucugugugagccuguacaugugauuggaugugccuggcacacaugcucaugugugagucugcgugugagcacacuggcacacacgggcacauucaaguguaucuuagugccugccagcuccagguugcccugcgguggguucuggggggucuccuuguucccagguuccugccucugugccuggguccugagcuggagggguccguucucccuccuagggugaauuccugccuuguuucucccgagugaguuagugugacgcguuggcccgugugugaguuauugagugucugugugugcacuggcagucagugagcgccagcccuccccacgcucccacccuaggccugccccuccucuguccgcccuggccaccuccagcccaugaaucuguuccugggcagacugaugacccccucuccucccugcacucuggaggagcgggccggggccagccuggagagccuguuugugaagccguaaaucugucugauaaaggcagcucugaggaaugagacccccacacccuccccgacucugugauuugggaaggcgccaccaggccgggcuggaaauuaaauugucccuggggccuggagacccagagaacaagcucgucaccacagcucaaccccagcuccggcucggcacgagugcagaguggggcaggggucuguucugggcucugaggagaccugcaggcuguacaggaacugucugagccucagucucccucucagcccagcauguguuagugaauaacucccugccuagcagcaugaggggcugggucacagugaguggcugggguucaaccugaagggcccagauacuugcucggcagcugaacggagcccaaggaauugcagcucagggaggggaagugacaagucugagacucucagugggcggccggggcuggcccuguugcaggcguuucagcacggggcucugagauccccgcagcaccgcagaccucccugaggcagcacucggagcaggggccccucgggagucuguuucccugccuucucccgucgagaaggaggcuauggccaggccugucuccucauacgagucgcugagacuggcccaccagagaugcagccacucaagaaagaggggacccccaacccugcccuggcuggaggcgcccgucuagagcuccuccugccccgaggggcccugcggacgggcagugcuggaggccguauggugagggcgagguggggucgcaggcaggcagggucugguuaaacuaauggccuggaaaaugaaugccugugaugagcaaacaccaaaaugucaggaggggcugcgggggcugagaaaacagcccaaggaaaugagccgcgcugggagaggcgguuuccaucacggcgucgcccccgccuguccccggaggccuguguuugcuccggucuggccgucauccccucaacaaauauuuaucgaggguccugagcgccacuccacagaggucggggucaggccugggcagcacguugugccaugacugccccgugccgggcagccccagccgccugacaccgccugagcaguuucccugcaccuucucugccgggucuccaagucugcggcaccccucgagggccccaggggcgggcuggcugcugguccaccuucccagaggggugcgucccuuuccagguuggggcuccucacugagucccagccaucccaggggccugcacaggucccugccccaccccagagcuccccaccaacccaucacuacagaggcccccauggccaagcggcucugacccccgcccccuccccacugcacuggcuuaugaaaaaguuuccagagccuccaccagccccagccagcuacaggggucggccuggggacacccauaggcaugggcaggccacacacacacauugggguggguccccaggagcagccagggugccuuuaggagcggccaaauggcgaaggggccuugccagcaggacggcguaggggcucuggugggugcccuaggccaagcagggcccugugggagggcagaggccaggggcugugaggagagcuggagggcccagaccccggaugauggcugggacagccuuugggcccacucugugcccuuagugccugccuaucccuuccccaccgauagaccacccccagagcaagacuugcugcuuggccuccccaagcaggaggcagcccuggcugccuuggggucuccuugugucuccuucccagcccaaggccccaggucccaggucggggcuccgugacuggagcugccucuaccucaggaaccaggccuggcccuuugggguguggggggccuggggaccaggccucagccacuucucccaucucugcuccaggcuggggucuccauggccccaacagaccucucuggagagccucaugcccagggcuugugcacacagggcuccaauuucucccugccccugcccccgcuggcugugugcaaaccaucaaucucguccagugggaucuggccgaagaucugcagguagggccgguagagcacccggcggaagauccacuccaggcggccgucaugggggugcagcagcgccuggguggugacaccguaggccacgagccacacgcucagaaagaagaggaagaagaagacguccuucaucuccacggggcaggggcagagagagggacgucagcggccagccggguggggcccaggcaggggauugcugucccuccagggccagggccagggcccccgggggcucaccaugcgcucuaccacgaugaucuuggggcccagcugcuuguguauggcaaagauauggaucagccgcagcgugaacaccaugaaguccauggcgaggacugugcggccagccucaaacgccgacggcagcauccuggaggaugggaggcugaugcggcugcggggcccagagaggggcagaggcuuccccaggggcacacagcaugcuggcugcgggcagggccagggccaggccaggacuccuugggcccugaguggcuucaucuuuuguuuauuuauuuuuaagagacagggucuugcucugucacucaggcuggagugcaguggcaugaucacggcuugcugcugccucaacuucccuggcucaagugacccacccaccucagccuccugaguagcugggaccacaagugccaccgccacacccaaccugaguggcuucaucuggaagccugcccacaagccgcccugaggccacacggccucugggccccacagaccugcaggugacacccacgaugaacaggaagauggccaccaugucacacuuguuccaguugucccccacauacagugugaacuucuucaccagguguguguccucgucugugaagaagcccugggagggaggugggcaguccacugacagcuguccagccgcccucgcuggggacagcccuaccuggacaagcuuggaucuguaaggaucaggguuccaucuaugaccagggccgaggcuaccagugggacuagggguccacugaagcuauuccagggcugucuggggacagaaggugaggucagucuccacuuggggccagggccucuuugugcccagggucuagggaucaguuuaugcagugucuggacucaguccgugauacaggucaggguucagacucugacgagggagaccauggucaugcucagucuggagcagggcucagggcucggucuuugaccaggaucauggccgcuggugacugggaagaugggaggcccccaugcuguucuuguuuuacaguuggggagccccacccugcgagggcaggacccagcuuagguugcccaaccugaagcugcagaguggaggggaccuaggcuaguguggccaccgaccugccggauuuccuccagcaccagcguaaagacccagaaguagagggugaccucgggcccugaggggcccugggggggcggccugaaguccaccagcaggacguaggugaacaggaagaggaaggcgaaguacaugaccacguuccccaggaacacagucacgggagcgccccagaauuuccgccagcgugugagcaggaagacagcacgugggccucggucacccugagcccucggcgccuccaccagcuccuccacccugugccgcagagaaguucgcaguggugaggcuggcgcccagccgggugccccaccagaguccagccucccagccaccacccgccaguccccuccacccugccuggcccugugccucgcaccggcucugcaggccauacagcgggcucuucuccguguccaggcuguccagguccugcagguccuccaggccuguccucaggggagcuuccucacugcgagcacaggagagcucagggcccgcaggaagggcucccagaggcgccugccuggcuccaggcgcuuggccaucaaagugcccacugggaugcaggggcuguggggagugggacccgcagggaggcuggacuugggggcuacagagucaggcuaccaccagcaccugcgaggcccaggcccuccccguagcuccggcacucgcacugcugccuguccuggccgggcagcucacaggccucacccaccugaaggugaugagguugguauagacgagggcggggcagaggaaggcuccuagcagccgcaggaugggcgugccugcggccauguccccccaccagauccuggucaggaaggccugaggugaaggcaa

SEQ ID NO: 12622 - RNA, 29470 nt, Homo sapiens
uugccuucaccucaggccuuccugaccaggaucugguggggggacauggccgcaggcacgcccauccugcggcugcuaggagccuuccucugccccgcccucgucuauaccaaccucaucaccuucaggugggugaggccugugagcugcccggccaggacaggcagcagugcgagugccggagcuacggggagggccugggccucgcaggugcuggugguagccugacucuguagcccccaaguccagccucccugcgggucccacuccccacagccccugcaucccagugggcacuuugauggccaagcgccuggagccaggcaggcgccucugggagcccuuccugcgggcccugagcucuccugugcucgcagugaggaagcuccccugaggacaggccuggaggaccugcaggaccuggacagccuggacacggagaagagcccgcuguauggccugcagagccggugcgaggcacagggccaggcaggguggaggggacuggcgggugguggcugggaggcuggacucugguggggcacccggcugggcgccagccucaccacugcgaacuucucugcggcacaggguggaggagcugguggaggcgccgagggcucagggugaccgaggcccacgugcugucuuccugcucacacgcuggcggaaauucuggggcgcucccgugacuguguuccuggggaacguggucauguacuucgccuuccucuuccuguucaccuacguccugcugguggacuucaggccgcccccccagggccccucagggcccgaggucacccucuacuucugggucuuuacgcuggugcuggaggaaauccggcaggucgguggccacacuagccuagguccccuccacucugcagcuucagguugggcaaccuaagcuggguccugcccucgcaggguggggcuccccaacuguaaaacaagaacagcaugggggccucccaucuucccagucaccagcggccaugauccuggucaaagaccgagcccugagcccugcuccagacugagcaugaccauggucucccucgucagagucugaacccugaccuguaucacggacugaguccagacacugcauaaacugaucccuagacccugggcacaaagaggcccuggccccaaguggagacugaccucaccuucuguccccagacagcccuggaauagcuucaguggaccccuagucccacugguagccucggcccuggucauagauggaacccugauccuuacagauccaagcuuguccagguagggcuguccccagcgagggcggcuggacagcugucaguggacugcccaccucccucccagggcuucuucacagacgaggacacacaccuggugaagaaguucacacuguaugugggggacaacuggaacaagugugacaugguggccaucuuccuguucaucgugggugucaccugcaggucuguggggcccagaggccguguggccucagggcggcuugugggcaggcuuccagaugaagccacucagguuggguguggcgguggcacuuguggucccagcuacucaggaggcugaggugggugggucacuugagccagggaaguugaggcagcagcaagccgugaucaugccacugcacuccagccugagugacagagcaagacccugucucuuaaaaauaaauaaacaaaagaugaagccacucagggcccaaggaguccuggccuggcccuggcccugcccgcagccagcaugcugugugccccuggggaagccucugccccucucugggccccgcagccgcaucagccucccauccuccaggaugcugccgucggcguuugaggcuggccgcacaguccucgccauggacuucaugguguucacgcugcggcugauccauaucuuugccauacacaagcagcugggccccaagaucaucgugguagagcgcauggugagcccccgggggcccuggcccuggcccuggagggacagcaauccccugccugggccccacccggcuggccgcugacgucccucucucugccccugccccguggagaugaaggacgucuucuucuuccucuucuuucugagcguguggcucguggccuacggugucaccacccaggcgcugcugcacccccaugacggccgccuggaguggaucuuccgccgggugcucuaccggcccuaccugcagaucuucggccagaucccacuggacgagauugaugguuugcacacagccagcgggggcaggggcagggagaaauuggagcccugugugcacaagcccugggcaugaggcucuccagagaggucuguuggggccauggagaccccagccuggagcagagaugggagaaguggcugaggccugguccccaggccccccacaccccaaagggccaggccugguuccugagguagaggcagcuccagucacggagccccgaccugggaccuggggccuugggcugggaaggagacacaaggagaccccaaggcagccagggcugccuccugcuuggggaggccaagcagcaagucuugcucuggggguggucuaucgguggggaagggauaggcaggcacuaagggcacagagugggcccaaaggcugucccagccaucauccggggucugggcccuccagcucuccucacagccccuggccucugcccucccacagggcccugcuuggccuagggcacccaccagagccccuacgccguccugcuggcaaggccccuucgccauuuggccgcuccuaaaggcacccuggcugcuccuggggacccaccccaauguguguguguggccugcccaugccuauggguguccccaggccgaccccuguagcuggcuggggcugguggaggcucuggaaacuuuuucauaagccagugcaguggggagggggcgggggucagagccgcuuggccaugggggccucuguagugauggguugguggggagcucugggguggggcagggaccugugcaggccccugggauggcugggacucagugaggagccccaaccuggaaagggacgcaccccucugggaagguggaccagcagccagcccgccccuggggcccucgaggggugccgcagacuuggagacccggcagagaaggugcagggaaacugcucaggcggugucaggcggcuggggcugcccggcacggggcagucauggcacaacgugcugcccaggccugaccccgaccucuguggaguggcgcucaggacccucgauaaauauuuguugaggggaugacggccagaccggagcaaacacaggccuccggggacaggcgggggcgacgccgugauggaaaccgccucucccagcgcggcucauuuccuugggcuguuuucucagcccccgcagccccuccugacauuuugguguuugcucaucacaggcauucauuuuccaggccauuaguuuaaccagacccugccugccugcgaccccaccucgcccucaccauacggccuccagcacugcccguccgcagggccccucggggcaggaggagcucuagacgggcgccuccagccagggcaggguuggggguccccucuuucuugaguggcugcaucucuggugggccagucucagcgacucguaugaggagacaggccuggccauagccuccuucucgacgggagaaggcagggaaacagacucccgaggggccccugcuccgagugcugccucagggaggucugcggugcugcggggaucucagagccccgugcugaaacgccugcaacagggccagccccggccgcccacugagagucucagacuugucacuuccccucccugagcugcaauuccuugggcuccguucagcugccgagcaaguaucugggcccuucagguugaaccccagccacucacugugacccagccccucaugcugcuaggcagggaguuauucacuaacacaugcugggcugagagggagacugaggcucagacaguuccuguacagccugcaggucuccucagagcccagaacagaccccugccccacucugcacucgugccgagccggagcugggguugagcuguggugacgagcuuguucucugggucuccaggccccagggacaauuuaauuuccagcccggccugguggcgccuucccaaaucacagagucggggagggugugggggucucauuccucagagcugccuuuaucagacagauuuacggcuucacaaacaggcucuccaggcuggccccggcccgcuccuccagagugcagggaggagagggggucaucagucugcccaggaacagauucaugggcuggagguggccagggcggacagaggaggggcaggccuagggugggagcguggggagggcuggcgcucacugacugccagugcacacacagacacucaauaacucacacacgggccaacgcgucacacuaacucacucgggagaaacaaggcaggaauucacccuaggagggagaacggaccccuccagcucaggacccaggcacagaggcaggaaccugggaacaaggagaccccccagaacccaccgcagggcaaccuggagcuggcaggcacuaagauacacuugaaugugcccgugugugccagugugcucacacgcagacucacacaugagcaugugugccaggcacauccaaucacauguacaggcucacacagacacacgccagcgugcaggcuggggagggaggagagagcggagcucccauucggauauggaggggauaugugguccuggacggccagggcacacucuggccucuggcugggacccugagcacccugacgcccacugcggcuccuuccucccuccucccuccuccugccccgcaggcugggguggggugaggguccaggguugagcccuacaagggagaagcaggugugagggucugguuuuaagggacuggagugagaucugccaccccuccagggugucccugcccagggccgagggagcucagccugcaagcucccagagugugccgccugaagaauguucuugacuugaguggcccagugcgggaucggugcccucagagcuugcagcaagcccagucuggagccugcuggcucaauacauuuuggaaagguggcggaauuacuugccagcuugggguuuaaucacaggcauuagugcuguagaggcucugagaaguccugggccccaucucccuuuccucggcagcucuccccaaaccuucaacagcagaggcuuuuuucggaggagggguggagguuuuaacacauccaacaaccaggagaaaccugggucccgugaccccucugucccccaccuuccaucccuccaggggucuuggcucuacuuccagggccugugaucuuggcugacuccagccccugguggaagcucagcagacauggcagagggggcccaggguggggcucaccacccgucugguucugguuugcugugauggggcuuucacugcuaaaacccaggccgcccugggugaacugggacagugggucacccaaccagcaccccguccccuggguucaacaccaggacucagcgcucuaucucggggcauuugccuaaggccgcccuuguggcugcccccggucugguccccacagcacccuugcuuuccagaagcccgugugaacugcuccacccacccacugcugcuggaggacucaccauccugccccagccucuaugccaacuggcuggucauccuccugcuggucaccuuccuguuggucaccaaugugcugcucaugaaccugcucaucgccauguucaggugacuccacccaaccccuggaggagagagcccuggagcggagggagcagagggucauuccccaacaccgccuccuuugcaacccaccuggugugcugcagagggugaggcuuggugccucagggcagauagaagguggcauagccuggacugcagggcuuugccugcccaagaccgggaacucugugggccacccucccagucccaggaagcagggccugggucuuugggggaccggugcuguggcaagaacucugggcuuguccaggagagcagaguggacaggggaagacccaaggagaguggaccccucgugacacaccccagaggcaacgcagaagcagugcugggccucaguuucaaaaagggcuccccaacagcaaucagggugcagggggaugcgucccccaaguggucguggggagccgguaggugacggcucagcugugccccugcagcuacacguuccagguggugcagggcaacgcagacauguucuggaaguuccagcgcuacaaccugauuguggaguaccacgagcgccccgcccuggccccgcccuucauccugcucagccaccugagccugacgcuccgccgggucuucaagaaggaggcugagcacaagcgggagcaccugggugaggccgagcacaagcgggagcaccugggugaggccgagguggcgggucccagggcggggcugugcgcuggaggcaggucuggagagaccuggaccccuccucagcccuguggguccucagcugggcucugugcaggcuggcacagcugagcccguccacccgcagcuuggccguccuugcacagggccaugcuugcccuccaucccuggcugggccccacucacuccuucugccuggcccaccucgccccgggaccaggccugggcucugccacugacgcccacaugcucuaguaaugcuggcugccaccuggcuuucccagagagagaccugccagacccccuggaccagaaggucgucaccugggagacaguccagaaggagaacuuccugagcaagauggagaagcggaggagggacagcgagggggaggugcugcggaaaaccgcccacaggugcgggggccuguccugaucacugguggguaucgggcugucuuuaagcggggaugugccauuggcgccagugacagaggaucugagcuggcgaacugaagcugaagggguaggggcagggcucuggccgagcccaggggccuagcuuuccagccugaccugugcaggacccugcugggacgccuggccaggcaaaaagggagcgugcacagugaccguggcgcccucccugcuguggucucaggguugggacuacccaccccuggcuucccuccagcccuggcuccaggggccuguccccgacugccugcccugcaccgucuuucuggguggugcgcccaggcagggauggcacccuagcccuacugggaaggcauagagcgcucuguacugcaccaggugcacuuugagggguccuggugccaccagaucugggcaugagggaggaagggaaagggccagggcaccccaaacucgggcacacagggaggccuggggggauggggaggcuccccacacgcagagcaccgcguggccauccacagccugaccaccugcuccugccgcagaguggacuucauugccaaguaccucgggggucugagagagcaagaaaagcgcaucaagugucuggagucacaggcaagcgagccccagagcuccucucccugaugggaggcggguggcugcguggggcuacugggauggguccacagcccugcccggucacucacagagaugaggcaggccagagccaggacaggagcaccccagugggcagaggagcguucuggggaagacaggccguccccaccugugccuccucccacccugccacuugggaggcuacagccuuaaaugaggggucucacauugaagaccccucgccuuucacucuacacgccucacgggagccucacucaccccugccugugagcggcagcucucagagggaggagucacagggcagcgggggcccuggcaggagaggggagauggggaggcugccuguccccugcuguccugagagagcccuggagcuucccggacguguuucccuucuccagaucaacuacugcucggugcucguguccuccguggcugacgugcuggcccaggguggcggcccccggaguaagccuguuuggggagcgugggaugagggugggcaugggcacccacucugcagcggcuggggggccguaggcugugcugugugcucugccuucccugccuggcccgggagucucaggaggccuuggcuggacgcggcucuucaggguggugugggugcccucugacggagucccugccuuggccagggccgaaugugcuucacucagacucuugaggcucugccuggcgugggcccuauuggacuguccugcucagcaagcaaacgggccccucggccucaagggggcugcuuuccuagucccaggagugcaggcagaggccugguugucucugggcuccccaucuuccccaggcuggccuguggggacucacucugagagccacggcguccuggcccuugccucugagccagcuaccucuccccuuccugggccugccuugcugguucccaccgcucaggggggccuuccuucccagcaggcucucagcacuguggcgagggaagccagcugguggcugcugaccacagaggugguuuagauggcugggaacaacccggggcuggccagccucccucggacaccugagcugcuuggccugccacguguggggccaccucuccucagcuggccacccugcacguugugcacugaccuuugccgaccuccagcggaaccccccagggggcaccagccccccagcagacaauggcccuccuggugccucaccacagacccucacccaaaggaaccgcuccuugucccuccuggccuccccggaggcacagcagugucauggggcugucuccccugacaggcacaacuccccgggcagaaaacgugccccaccgcaucccuaccuggaaacugaccagccugcacuguggaaaagcuggcccuguggcgugacgggggagcacccccauccagacugcgaagcugcucuggggucugcacccaccccugcccugacuuguguugccugacaagagacucaucuuuuuuugaaacacuggugguuagaauuucugucacuuaagacccaaaagguccuuuggggcucaggugacuggcuccuggaagacagggcugggcauccacugcaucugucagcugucccccugacacccgauggccaguacagcacacacugguguuuauggccccaagacaaagccccugcuggcaccaguggcugcuuuaucuucaguggagccuggaaaacacuguaccccacguggcccagauaaaacuggaccccaggcucaaacaccugcccaggccccccaacugcccacucaccccagccuccucuguccacacccauuuugucaucucccuuucgcuucccaagcuguggucugcacuaggccuggggcugauggcaucaugugggcuuugguugggggagggcagauucuguacccacucaggcccauugagggcacucacuggacaccugccacugagccacaagcccuagaggaggccugggguuuccaauucucacugucaccugggugaugugcuggugagggaugcaggugucagccacccucgagugguccggcaccgagggucagguguggggagcucuugcugccaacugagcccuuuggguaagcagggcccagauagacacaaagucucagaaagacccaaaaccuuuauugucccuaccagggagccagugcuuccagcccacaccccacaccccaggagcuucagcaaggucucugcuugggaggaugcugcccagaacugcagccagggccaccggugccaccugcaggcuuccucccauuccagcuaggcaguggccaggcugcccccugaccagccccacugggaaggcagcaggauggcaguggccaguggggucaggcugggccaucucccucucagaccucagcaccuggguccucggggcugcugcucuuguuccggaaguggucucgacuccgcuuccugcugccauggaagccaacaguuuccaccggcgggagaccuggcacagacccacuguggacagacccugacagugccuccaccuccugcaggccuccaugguggcugccccacuccucagccucugggcucccgggcccggccagaugggccagcuccacagggcccucgccccugucuguggcaggauucccaaggccgccccugccuggcucucccaccuuccccaggacccucuuccucucgugucuggcuucgaccccucggacugguuuggugaagaugacccuccccuccccacagcuggagggauccugguugaaggaggacacgcagucagugggggcagccaggcucugggagcccaggaaggccagggcgguggccugauugcucugcucgcugaccucggucacaucuuccaggcuguacuugguccagcgcucggggugugccacguagucggggaccggaggcacccuuggugaggcagggcuccgaugggcccugcccaggccuuccacuggagaccggccugagggcgcuaggggccgcuugaagccuccguugucacucaugcuggugugggccacagaggauggagcccgucuggccgcccccuccaggcagucaaagaugucacggcugcgcugggagaagguggagcucaugccucucagauggaauggcugcaccguggcugggaggaggccugacgggggugagggcggcucaucaggaccugaauccuccuccccaggcagccccaucggggacagugcuuccacuucagcaccaccgggcaagcugaggucagaguccgagucacugagggagacugugucggaaggcagcgugucauacuccgucccguguucgcccuccacgcugggggacggcucaccuguuccugccucagccaugcguccccagggccacgccacaccuaaaccaaaacagcccagaaaauuuguuucucaggaggaacaguauugagaaugaguucccccugcagauccacugccccuggacaaguggagggucaacugacagaacugucccacacaggguggagucccgccucccccuccaagcccuccucucaccucucuuggcugcugggugccagugguugacacuggagugugauuggacagccaagcgggccaaguggacggagcccugaugaagguccucagcggcacaggcguggucgucucaggccucggagugccccggcauggccucuguucagcugcucaacugcagguggguggggugggggagaggaccaaccucagaccggaguguacaugugugaaacaggugccgggcaggaccgaccugagccuggguuuucggagccccugacaggcuaggacccaggguagggacuuuugacucguuaccucauuuaauggugccaacccucugcaggcaggcuuggagcuacugagcgauuuugguaguaagcagccacccagggcuugaacccagggcugaaaucaggcaggagggccacuuauaagcugcuugcugugcggggugagcagucguauuccacaaagagcgugcaccuuccugauccacggggaaaagauuugcuccuauuugcuggaagauccccgggagcucccaaggaaucugcagccaaggcccuggcaucugagggucaagcucucaggaaaguggggugucgaccaucaccuugagcagcccuguuaggcagagguaaauccccgcggcuccuggagcgaccuccaguggccuuccaccuguaacacucagcacauacccugccuuuccagcugggcagacaagugcugccuccugcacccauuuagugcuggagugacugggugccucagaacuugaauuuccaggcaaaaaaagacggcccagccacacccuucugcacuguccucagccauccauccaccgacuccucuccugcuaccaaaacuccuugcccgcccagagugaccugugucuugugcacccaauaaggauggggucagggguacuaucaggggcucuuagugccccccaccaggucgaacacaggcaggaccucaguuccucugaggcgcgacucuccucagugaagaagccaccccagugaaaggggauacgcagcaccccccacugaugaccguuuuaaagcuggcaggaacggggcgggggaaauaauuugcccaagucacacaguauguugcagacgaagcuggaguucaaccagaacccugcuucccagauucgcacucccguccucugcagcggaacgccgccgcggccagaagcagccuggucagcggggcacuccgacggguagcggggaucgggcugcaagauagggacuccgguaguccguuucucgggguucucggcgaaagccggcaacgaguggaagguagaguugacuccuucauguccguaggcugaaggaagccgucucuuucuccacaugaacgcagagcccggccuuucuccacuauaugugccagcaagaccuccccgccagagaacaaacgaacucucggugccaagcuggcucucggugccccucggcacuguccagucgggcuggacaggccuccgggccucacaaggaugcugugggucccaagggcccggccgcgagguacgggggucggcgagcacagcggggccuucgagcucagguauuaaagcugcgcucggugaccucccggaggcucggccggcccgcgcggcccguccucccucaccacaaaccuaccggcucaaggcugcucggcagucuccaucuuggucggcgccgcaccuccgugcggcgcgcucagcccucugggaaaccgagugcucugccggccgagcaccacggcuuccgcgccugcagaacuacagcucccacaaggaacugggccgccgcucccgacgccugucgggacguguaguccugugcgcaugcgcucgccccucuacuccuccacgccccggcccuuggguccggcucggaagcagccccggaaacgacggcauuuguuggggaaacaagaccggaauugaccaagaacaggaagaggaggggccaggccugcaauucccagaaugcucgagggcuaaccgacagccaggcuggcuucccguggucucagcgccaccugccggaagccgcgagaacagcggccgccucaggcaggaagugcgucaucucgcacggaggacgaaugccguucccggcacuuccgguccugaccggaagcgguaaccgucacuccuucugggcucugucagugcaccgaggcggggcuccccaggaucccacggucccgcucaggccagacgcagaggcagucccagcccgcgaugaggacguggggucgugaccgcugggccacggugaagggggcagcccugcuggacccgcuagcugggccgacgcuuucccaccccuagggguuugcugggcccuggccgcaaacuuguggggcgccguccucggggccacugcccggccacccucacacccuugggcccucagcucuggugcauugguccgggcuccgggaggcacugagacgucccccuagggcgcugcagggaagcgagggccaggcccuuccagguccccgguccucccgggcaggauggaggcugcugaacgcuccucaagcuuccaagucagccguggcugggcgggcggcagcagggaagguuugggcuccgccaugcuugcgagccagcagccuggccucgccuguccgcagcagggggcaggucagcugcccgcccugaaagggaggaccagggcccagauucucccugcgacaagccgcgucuuccuuggccacugggcccuagaugguuggcaccuugugccccuucucagcugggagaguuccugccccacacacucaaggauucugaguucuccuuggcugcuagaccucuggucccucugaaaggcucgagagagaacucccccagggccugcuguccuggcauccgcugggaaauaggauucaaggaccugcuguggcucagccuagaaaaaaggaggggaagcaggacccacuccucggcccccggucugcugugcgccuuugggauuccuuauuucuuaaacugcucuucccuccccacagggaacacagcggaaaguagagagggggcuccuuggaccauuauguucucccaaccagugcaggcuugcaaguugggagcagcaggggaggagggccugcugagagacucuguaacccccuaaaaugcagggcuggggacaguuuccaaauuggccugcaaagaggcugcugggagcccuagauaugaauucccaggcacucauuuccuccagggaacagugaaaugugccagcaccccccuccccacaacuagggaaaaguagccuaacccagagcaagccccaccccacgauguggggaaagauaggagagucuagaccaagcccacuggcuggaggugcucagacaaagggaaaaggacgggggagugcaggggcuccuuagccccacagccugucugcccccaaccaccgcucgcuggugggcugggggggcucccuaguaggaugaggucuuucuuccccuccagacccucugagauguggcucaggccugagccaucagcuccucaaaggaacauuuacagguaacagaugggcagggcagagacccucaaaugcucgggagggggcaguguguccauccuuuaccaucccucaggaggaagaggaguccugcagcgcacccagccccuaccccaagcccaucucacugcauucccuggcugcccgaccccuccugcccaccugcuuacacugugugccccuugugugcccaaggggcaggguggaaguggcugcaggcaacacagggccucucccaaaagagaauagagagaacgcucccaaaaagggcccuugcuaccuggaguugcucccugguuuaaacccaaaguaaaauucuaagcaaccccaaccaacugaaugggcaccucuuggccaaaugcauucuaaaguaaaccugaaaagcucguugaggccaugaugacuguggguggccgaacaugccucauaggcacagcugaccagcauucacauuaaaacagagaccuuaguccggugugguggcucacaccuguaaucccaaaaccuggugugucacgugaggucaggaguucgagacuagccuggccaccguggcgaaacaccgucucuacuaaaaauacaaaauuagcugggugggguggugcaugccuguugucccagcuacucaggaggcugaggcaggagaaucgcuugaaccugggagguggaggggaggcugcagugagcugagaucacgccauugcacuccaaccugggugacaagagcaaaacucugucuaaaaauaaaaagaccuuaagacucacaaaacagacucuguaguaauaagauaccaacgugacagcaggcccugaaagaaaccgaaguauuuuaccccaaaauauauuucucugauguauuuugaaauggcccugcaaagcugucucuugggaaaaucuacauucuauagagaaucccccucccuuuccaggucuauuuccugauccaggagagaauuaacuaagauucugguaccuuuuuaagucugauaagaaacauuuacaaucuggcggcuucaucugcauaauaaucuuggucuccacaacuccucuuaacccagauaguccauucuauugauuucaggucuuuagauaaaaucaaccaauuauuaaucagaacaucuuuuaauccgccuaugaccugaaagucccuccccuucaaaucgucccaccuuuccgacuaaaccaacguacaucuuagauguaaugaucaauguccuaugucccuaaaauguauacaauuaaguagccagaccgccuugggcacaaguucucaggaccuggggcugugucacaggccaccggugcucauauuuggcucagaauaaauaacuccccaaauuuuacagagugacuccuuuggugaacaccagggaucccgacccacccacccucacccuggaccccacagaguccacagagccaagccccaccgaugucagauuccccugcccuccggccaaccccuaggucucagacaccacuggcacugagggacugcacaggccugguagcaugccugauguuccuucuuuauuaaaugacggagucaggauguugugauuacaguugaaggcgacguguuagaaaggacaggugcaugaaggcagagagugcccacagacucggcucucgaaccggggcaggagggaacaaggugagcugugcagcccacaggacgggcgggcuggguggacacagccccccaaguuggccaagcugagucucugggcgaguggcucccaggagaggccuggcugagcaggcagagcacccugggaccccagggcagaaggaccccugcccuccaguccccaagacccaggcccgucuccacucauacacgccaccuacaugugacgucagcccugaaaagguaacaggaaaguucagaacaaaaacaaaaccccaaaaguaaaaaggcuacguguagcagaguaauaccggaaacguuauauacacaggcggugauggcccccucggaaguguccgggucacuuagggggcacugcagaggucccuguggccagagcugcggggccucaguacacggagcuguuccggaugccacagcacagcaccaugcucaggaucaucucgaagaucugcaggagggugguggggggcgcagucagcacaaggccccgcggaaggggcagcccagagagcaggcccuccgcccccgcccgcucaccaugaucacagcgaccacgauggcagcaaugccgaugagguacagcuucccggagaagaggucaucgaucuucugguggcaguccuccugcagggguggccaggcacgcguggucagggaccgggccucggcucccggcuucccguugucacgcaguaauccguggucaccacagaaagcguagaggggaauccugggaacagccccccacccccuacccaccucggaacaggcgggugcagcggcccggccucugccggcuugcuaucuuccacccguuuuaacauaaacgcgaaaugccugggacacacugugcccuuuuccacugagaucacggucauuggugucacuagaccccuaaagcaucacugaugacgacuuccacugaggccucagcaggaaacuuccacagggcacuauauggccugcaggcccugccagcuacaggcugucaggggcguccacacccacgagugcacacguggagcugggggugcaggugaguucccaccccccagagccuccaccuucuucacccggaaugcgcagcacagggcgccugccuuccucgugggccagaugcggucccaccccaacccucccagcagagcagcccugacaggggccaugccacccaguguggucgcucccuguggggcugccgugugaccugcccaccccuaggaccccacccaggggcgggacaugcggggggucaggcgcggccccaccggccucgcgcaccuugaagagguugcugaugauguugcugcccgagggacacaaauuguucuugagcacugagguggucaaagcagucagugugcuggagccacagcagucaagcugcagagagcaggggugcaaggucagcccuggaugugcccagggggacgguggcucuagggaacccauggggagguggccagggguacgcagcgcuccccacugcagaaugcauccaggggccagccuucuuccuccucagcugcgcugcucagagcuuuccgcacccugggccacccuggcccacuagguucccacccgaggaccaguugagaccagggguccuggaggucccaagggcaccuccugcuccugaggucugggcguaggcaggauucauccaggacgagacacaccccgccggguucccggggcccugcuccccgcccucgccccccggggccgcaccgucucguggaaggucuucaccacagccuuggcguuguuggcgucaucauccaccacggccugcuguagggccuggucauagaacugcuucacauccuuggcgaucugggggaggggugcggucacaugcacagggggaaccucccccuccuugcccccaccccgccccgccccaggcggacgcacuuuucccaggcucucccugggcaggguggcuucgaggcuagaccccagaggacaaggacucugcacucucagcugccccgggagugcugggacacgggaggcuggccuggugcucagccccaaugcugccuccuccauaaagccccuggagauccuccuggcaagugggacccaggaagagcccaaagagcucccacaagccaugagucagcccaacccccacccgcgacaggagaggagggugcccccgucacccaccccacccugucccugcacacccaggcucaccugguccuuguugacaaagccccagaugccggcggccaccucacaggcaaacaggaugaccaggcaggugaagaacuggagccgggcaguggccagagggaggaaagagggcaggcuguaggcggggcccaaggacacacacccaggugcccagcaggcgugucugugaggggcuagugggagccaccagcccacgaccugaccaggagugagcggcuuguguggagcccuggggcacagaggcuaaaacucagcgcagggaggagccgucaaagcccaggauguccccacgcggcaccaggcuccacaggacgggguggauggggcggggcgugugguuuggggucacaggcuggugaguccaggaugucugcagcccccagggaggcgugugcagcagcaugaccccugacugaucuuccccacccccuuguuccugcuccccacggaagggggagccaugggaucugccucaguuucccccacuggagacacgggcauaggcucccucuuccuggacuggccaggcccuggauggcacagccaggccugggcuucccacagggggcggugugcccgggacgccgaggcuggccucagagcugaggcuugcucccuguuauauuuguggcuauuuuuugacaaagaaaagcggucacguaggaacuggccacgauggagaccaagcacggugggauuuaauuuaaaaaccaaacgggaaaagcagggcacaggagccaccucccccagaauucuaggcuccgcccugagcaccagcucugcccccuccucagggccagacgcagcccccagccccuccccggcccaggcacaggcccgccucccugccuuaccguccccagcaggcacugggauuccuggauggccccguagcagcccaggaagccaacgaacaucaugacagcgcccacagcgaugaggauguagaugccuugcggggagagagacaccaggugggugccuacacacucgccacagcccaagaccccggaggguccugggugccgaacccaccacgggccgcccagcugggaagauguaggguugcugacugccagggaugagcagcaagggaccucacaucccagccuggccuggugaguuuucugugccucaguuaccucuuccaugacacaggacggagacuaaggaggccacauggggacugggcaccucaugagcgcucugagugcuggcgacaggugcuucgcagggaugacaccugcgguggggcccgccaccugccacacccaccacccaccgccugcaccugccacccgccacccaccgccuucacccgcucccaaagccucugggacuuggcguggggugggaguggcaucagaaggcacagggugggccccacuguaggccgggguugagagggcagcccaggaaccggaacuggaaccaaugcugccuccccaguguggugcgagaagagggugggggggcccugcuggcuccugccccccaaucugggcugcacagcagcacuuccguuacgggaccugcauuugaaccuggcugcuguguggggaggaucaaguuggauuccuaggcccugggcugagggcugaagcccagcaccccaccugggacagcuggaccagggcguguaggccagcccucccgaacucccccacgcucccuggcugggcagcaugcaccuggggagggagaaggcgccguccaaggguggggggcgcacugugggcccgagacaugggccuggccacccagacagggcccuguacccgcgggacagcugucagugucucucacugccugcccacuccccuaucccucagcaggcaggggccaucucccgucaccgaggcaaugcagaaggcagcccaggcccccuccucgcagccaggcccauugucccugcccagccagcccagaggagaaggugccuggggcaggacccaccgccaggcagagaacacacccagauuuggggcucggccacccagccuccuaccuggccagaugaagccucugccaggaaugcccugcagguggccaccuccuuacgggcacggcacccaggagccaggucucccuccccucaggcccugacacuccuggguugcaagguuggguucacuccgggguacaggucaggagaggcgcguugccuuuuuugguccugacaggaggugggaggcccagggcugccagacccccugccaggccccagccccaccccagccuccucucuuaacgcccuugggccuaacccaccgcacccgcagcgucucugaggggagugagcccagcaaauccacccuguucccggcgcaggaaaaaaagcccuuggcaaggcccagcccgcaucagggacagcaagaggcuccagaaggccgauucuggaaugggcgaggacuugguggccagaggagcuccaaggggucccuguccagugggggcccaggcagagcccacgucggggguggcagguccuguggucguguggccaacacaacggcaggcuccuccagcccagggaaaccacagccaaggaccgagggugggcggcucuggggcuggagcucugauguggccacggugacaccaugcaggucagacaccugcuuccaacgccagccucacccuggcaucaugggggcagcaccauggggccucagcacagccugugaccucugcuucugccgagaguggggcgcaggaaggaggccuggcauaccucucugggguguccccuguccucgccccagcccgaagcuaagugacccuucagcuccucuccggccacacggggcccgacgccgaccccacagcgggagcugcuccagccacaagccuuggccgccgggugccuggagagugaccccuuccaagaacaccugccucacacccacaggccccagguccuggagaaggggacucgguggcaggggcagccccuccugucccuggacaggaguacgaggaacgugcugggggcagccucguuccaggccggggaugcugugguugucacuggcuggacugguggccccggaggacaaggcccaggauggcugggaggcccuucuggaccccaaauauccuaaugaucugggaagcggggagcaagaggcccaggaggggccuccaguagagaugcacccuuggagaucggaggaugcuggccgggcucugccacccacagcccaggcacaugggcaaagcuaagccgagugcuucugaggacacaggcaggagcgccccagcugcgugcaggggguggucuccacaugagccccugggacaagcagccuuucccguccuuccugacaccaccugugagggcaccacggccccgagagaggccaggaaccuaugggcagggccaugggacccucccuaggaucggcugggcccagaaacccuccgugggccacaggcuucugucucuggggaggacagggaccaucccuguugacaccaucuggaccccagcaccggcccucugacccaugagcggggcauggggaagaaggaacgggcacgcuguguggccagggcccucaccuggcccuggggugacuggacaaagaggugggacggcgcagguguggggcuauuucggccuccuggggcccugguucagcaaccaagccaagcagccuccguaacuggcagggggccuggcccugcagcuccaggccugggggcaccugccggcugagggaagcccugaggacuggggacacacaggcugcccaccucacccaccccucagccugugagggcaacagagccaucccaggggccuccuuucaaggccagaagcaucucaacaaaugcucccagagccccaccagcaccagcccugccaggggcaccaggaggaagggugcugcucucugcacagugagauggcccuccuccuccuccuggccuugccccuccccuccuccuccuccaucacuccugcuccugcuccugggggcagggagggcagcccagucccccacacgcagccuaauaaggcagcaaggugcagcugccugcaggggcagcugagucacaccgccucuggggcgucuccaccccucuccaccccuccccugccccgucuccaccccucacuggguuccaucccuugagcuccaucccucccucccucccgggcuccacagcgccagcugccucggcugcucuguguggcccaggcauccagccccacccuucucagggagccucccccgaaauaaccccacacuuaaaauaagcaaggucuccacacagucccugcccaggccuagcugccacccccugcccuggcucagaccagaagggccagcaggccacaggcccaccuccaucucaacccuugugcccagagcccuuuccagggccgccucccugcccggacacgccaugcccgacugucuuucacccuccauguccccauccaaaaggcuaggaccugccuccuccuagaagcccucccugaaugcgucugcggccacaugugcacucaccuacauagaagguguugggcgcgggcuugucucccagcuccagauacaggagguugguggucugcgggucauggcggagccacagggccacacccaggaucacgccuccagccagcugggaaagagcgggaacagugucacauguacgaagagcacugcagcagggagugcgcccaccccacacgcaaggccuaagcagccuccugccuugcuggcucccgagcagggaccaggugucagcucugcugcugguuuucgcaaugcccugaagagccccgggagucaggagcauggggcgggugcuuuggccgccaucuacuuggagccuggcccugcccugcaccuguggagugugacuccagggcaggacugccaggaagacacgggacgccgguuaaaucugccucucagaugaaaacagaauacuucuuuaggguaagugugucccaaauauugcacgggacauacaaaaaaauaaucugguguuuaucugaaguucaaggugaauuggaugcccuguaguuucaccuuccguaucuggccagaggugauaccaggaccugagcaucccaggaacacugcccccuccugcaaggguguggcagcgccccaagaguucugaggucgcugggggacugcuucugucugggggugcugagaacucuggggugggggcaccccaucuuugcugccaggaggagaggguaggauuugauguuaccaggccaagcuguaggcaccagggccugcgggguuugugggauacaucccugcugugggaugucagcccugggaagggacuugggaggaaggacgcugcugugguuuccaagaugggcugggggaaggggcgcgcagaagccggcccagcgcugucgcucagcagcuggggcaggaagcaggcugugcugggagucuggcagguggggaugaggcucacagagaggagaggccuucaacgccgggucauccggugugcacacaaucaacucuagccagguggggucugcccuugagacugggccccagaccaggcccagcccagcccacucugaucaucugaccaggccaggcacgugccccaggccccccucugcacacaccaaggcccccucucucccuaggggcagugcccagcccucugguggugggagaggacacaggcuuguccucugcugucccuggugccuagcaccaugcagggcacacugcagccgugugauccccauaaaugaccagugacccugaguccugcugccucuauccuccuccacuucagcaccccucggccucuugcagaggcuccucccugcuagacagggugggggcuggguccccuucagaccucuccugggguuucuuccugcuucaggcaugaaacagggccccacagcccucuagcagccuggggacucugcgucccuaggacacaauuggucaguuccagggucccuggcccacagcaggaggcccuuguugcuggacagucugggugggucaggcuuuacccccugcugcuccaggaggacaguacaagaauccccuaaaaucuggucuggcagaugagccgugcacagcccucaggcagggaucacccaggccagggcgugcugaagaagccuauggggucagggccccacaagugcggccaccauccgacucccaugggccugggcgagucuucuuccuccuccaugccacucucaaggagggccaggcccugggggcuuccuggaggaggaggcagggggacaggagaugaaaucagccaggugaggaggcacccggggggggccacgagggcacaaccccccuggcggagaaugccagcccagaaggcagcugcucccagagcugagucggaaugcuuggcucugccaccagcugggugccaggcagguccugucccagcagcugaggccuugccucaccagcaccaggcgccgaccccaccacagaugcagggcugccggucaacugcagaagagaaacugagggcuggacccaagaacaccaccuggacagccccacuccuguuccaauggcccuggccagggaagcagggccccagggugggguugggcagggggcugugcucagcagagcgugagcuucaggccccagcaccauggccugcacccaaguccccggccugaggaccccccggucaggccggucuagggucuagggccucggugaggguucggguggguggaggagcugggggcucuauaccucuucccccuuucccucacacuccugucuccccuccuccgggaccugagcugggccuggcaaacaauaaggccagagggggcugggcgugguagcaagcgccuguaaucccagcaccuuuggaggcugaggcaggaggaucgcuugagcucaggagguugaggcuacagugaguuaugauugugccacugcacuccagccucggugacagagcaagacccugucucaaaaauaaaauaagccucauaggggcugcuggugccagcagccacggggcucucaccccaaaggggcuguugauggucccccuguagcaggacugccagagcaccuucuccacacacccgaaacaacaaccugggcugugguuucucagaccuucuucugaggagcugugccuccugcccuccuaugggaguuucaacucaauuuucacacuuugguuuagcgaggauggcagccuacuucccccgcccaggccccagacugaagcucuucugugccgaguggaaggugcauuagagucaccaagggcccaacauacaccugcgggcagcgcuggaagccauguggcagcugggaccccacgugugccccucacaugacaaggccccagggaggccaggggccccuggcuuccagaauccugcaggggcagacagcuccugguucuucugugcccauuauacccgugggagcacagggagggccguggacagugcaggagaggcaggaagggugggggcugggggguggccccagagagccuggcuguccucacccugcugcccuccugagcuggcuccagaugcagccuggcgggaggagguggcgaggccgagaguugccgugguaacucuggcuuccuccagggccuuugaaaacauugcuuauuuucuuuugaaacugugguccagagaccguuuugagagcuguuccaggacagaguggggcagguggaugggggagccucauccccacagaggccuggugacaaacccugacucagccacaggagcuguggggccacuggaagguccccaggcucccgguuccucagugucccccucuauaaaacagagcugaucauggaaccgugccuggcucggaagcugcucuguagaggcccauccacccccagcccucccuggcugggcagggaccaccccuccucuagccugggcgcugaggggaugaucccaucuaaugggcauaccguccuaacagaaagguagugauggcaaagcucagccuaaaccccaaaccugcuaauggugggacuucaggccacguugcagcuucuugcugugcucugggaaggggcuucuguucagacuccagggccguauggggaggcugccccuagacaagccccggccccaggccucugccgaggguugcagggaaggcugguccuggccugcagggccugaaagagccugggccaacaccaggaaggacccgagggcccaugugacuuuuaauagggcagaacagcugggccaggagggggugggagggacagccggaaaugggggugacgccagccuguccaccucaacuguccccgaggcuaccagaaguagucgggagccacccuggguggaaaaauggggcaagaaggagugccaggcacugggcagaggccucaccugagccuuggucuucccagcccuagcauggacaaacggggccaugccaagcucuccgaccuucagcagggaccuugagcuggagcuaggugacaacaaugguggugauggucacugccgguuucuggaugaggaaacggaggcggagggaccccccuagggccaccuacgagggagggcaauggcagcaccaaauccccaagccccguggugggaaaggcacaggugccccugccccauaacaaaccccauguggcagggcuagagguuccccagagucaggaaugcgaaagacaccugcucuccgaaagaccuggggcagagccugguaaaggaccugugcccugaacguaugcagagcuuuccaaacucaacagcaagaaaacuggcaacccaaucuuugaaagaugggcaaaaaacaggaacagacccuuccccgcaagauccacacacagcaaaaaagcacaugaagagaugcuccaccuugccagggaccaggaaacccaggucaagcugcagccacaugccgagcgcacccaguggacuggcugccacgaaaaagaccaaccacaccacaugcugcugggggaggcaacugggacgcauacaacgggggcuguaaaacgguccagccaccuugaauaacaguuuggcaguuauguaaaacugcugcuuaagcagugaaacccacauucaccacaugacccagcugcuccacgcacagguauuuacccaagagaaaugaacuuagguucacacaagacuuguacacaaauguucuagcacguuucuuguaaaugccccaaacugaaacaacccauaugcccacugaccggugaacgggugaaccugggguccgucgcuggcuugcacaugugggugcaacccugcccggcaauaaaaggaacagacgaagggcacaccacagcacgggugcacagacgacgggcacgccacggcacgggugcacagacgacgggcacaccacagcacgggugcacagacgacgggcacgccacagcacgggugcacagacaggcaugccacacagacgacgggcacgccacagcacgggugcacagacaggcaugccacacagacgacgggcacgccacagcacgggugcauagacgacgggcaggccacggcacgggugcgccucuggguaaucaugcugaagcaaagaggcagaacagcaacgaugugcaagugccuucugaguccgcuuguugaagaaaugcaugcugugugcacccacagcgacggcccgugguugcccugggacggggaggaggggcaggaagcagagaucccaagggccccaggggcaccuggggaguuggugaugguuucacggggguauaaauuugucaaaacuuaccaaguuguacccuuaaacaucuguauuuacugugugucaaucacgucuaaauaaagcuguuugaaaagcccccacauccuaagucccugaugacugaacuccccggggccaguguuucuucugggccccaaagaccccaggcugccaucuuggcgcuaacuucuuccgaggcagagccaacgcuucccaggggcaagcagcggcaugggaaacaccgaagccgcguccuuagaagugcacuuuuaggauccaucaaaguuaggacuggaguaacuauggagcccgaugucaguuaaaagagagucccgcuuucacggugaugagggagggcagcccaaggcccuggcugcugagugccuuucaccaaggcgaccucaggcccaucucagcuucucucugccuugucuacaaacaaggaaauaaaagugcagaagcugacaugcacacaacuuagccugcacagcagcacucggcucuccaucacugugagguuucauaagugccggaaucuggaacuccugucaccccucuccccacagagccauccauacaggcaccucccugcucaaagcucaccugugggaagccucucugccaccugcucccaccucccaagauacuccagccuccggaggcgcccucugagaugccccgcccccaggaugccccgccucccaaguggccgggccccagagaugccccaccucccgagaugccccaccccacaagccgucccaccccacaagaugccccaccccacaagccgcccuaccccacaagaugccccaccccacaagccgcccuaccccacaagacgccccgccucccgagaugccccaccccccaagcugucccaccccacgagacgccccaccccaggaaaugccccaccccacaagccaccccaccucccgagacgccccgcuucccgagacaccccgccucccaaggcgccccgccccacaagccgccccaccccacaagaugcucugcuggggauuggggauggaggguggcucucaggauggagcccagguaaccugugggguuccuggagggcuccuugcaaggcuacuaaaagcaguguuuguacucuaugaaggauuguuucuuucuuucuccuuc

SEQ ID NO: 12623 - RNA, 46859 nt, Homo sapiens
gccuacagcuuggccugguaacaucaaauccuacccucuccuccuggcagcaaagauggggugcccccaccccagaguucucagcacccccagacagaagcagucccccagcgaccucagaacucuuggggcgcugccacacccuugcaggagggggcaguguuccugggaugcucagguccugguaucaccucuggccagauacggaaggugaaacuacagggcauccaauucaccuugaacuucagauaaacaccagauuauuuuuuuguaugucccgugcaauauuugggacacacuuacccuaaagaaguauucuguuuucaucugagaggcagauuuaaccggcgucccgugucuuccuggcaguccugcccuggagucacacuccacaggugcagggcagggccaggcuccaaguagauggcggccaaagcacccgccccaugcuccugacucccggggcucuucagggcauugcgaaaaccagcagcagagcugacaccuggucccugcucgggagccagcaaggcaggaggcugcuuaggccuugcguguggggugggcgcacucccugcugcagugcucuucguacaugugacacuguucccgcucuuucccagcuggcuggaggcgugauccuggguguggcccuguggcuccgccaugacccgcagaccaccaaccuccuguaucuggagcugggagacaagcccgcgcccaacaccuucuauguaggugagugcacauguggccgcagacgcauucagggagggcuucuaggaggaggcagguccuagccuuuuggauggggacauggagggugaaagacagucgggcauggcguguccgggcagggaggcggcccuggaaagggcucugggcacaaggguugagauggaggugggccuguggccugcuggcccuucuggucugagccagggcaggggguggcagcuaggccugggcagggacuguguggagaccuugcuuauuuuaagugugggguuauuucgggggaggcucccugagaaggguggggcuggaugccugggccacacagagcagccgaggcagcuggcgcuguggagcccgggagggagggagggauggagcucaagggauggaacccagugagggguggagacggggcaggggagggguggagagggguggagacgccccagaggcggugugacucagcugccccugcaggcagcugcaccuugcugccuuauuaggcugcgugugggggacugggcugcccucccugcccccaggagcaggagcaggagugauggaggaggaggaggggaggggcaaggccaggaggaggaggagggccaucucacugugcagagagcagcacccuuccuccuggugccccuggcagggcuggugcugguggggcucugggagcauuuguugagaugcuucuggccuugaaaggaggccccugggauggcucuguugcccucacaggcugaggggugggugaggugggcagccuguguguccccaguccucagggcuucccucagccggcaggugcccccaggccuggagcugcagggccaggcccccugccaguuacggaggcugcuuggcuugguugcugaaccagggccccaggaggccgaaauagccccacaccugcgccgucccaccucuuuguccagucaccccagggccaggugagggcccuggccacacagcgugcccguuccuucuuccccaugccccgcucaugggucagagggccggugcugggguccagauggugucaacagggauggucccuguccuccccagagacagaagccuguggcccacggaggguuucugggcccagccgauccuagggagggucccauggcccugcccauagguuccuggccucucucggggccguggugcccucacagguggugucaggaaggacgggaaaggcugcuugucccaggggcucauguggagaccacccccugcacgcagcuggggcgcuccugccuguguccucagaagcacucggcuuagcuuugcccaugugccugggcuguggguggcagagcccggccagcauccuccgaucuccaagggugcaucucuacuggaggccccuccugggccucuugcuccccgcuucccagaucauuaggauauuugggguccagaagggccucccagccauccugggccuuguccuccggggccaccaguccagccagugacaaccacagcauccccggccuggaacgaggcugcccccagcacguuccucguacuccuguccagggacaggaggggcugccccugccaccgaguccccuucuccaggaccuggggccugugggugugaggcagguguucuuggaaggggucacucuccaggcacccggcggccaaggcuuguggcuggagcagcucccgcuguggggucggcgucgggccccguguggccggagaggagcugaagggucacuuagcuucgggcuggggcgaggacaggggacaccccagagagguaugccaggccuccuuccugcgccccacucucggcagaagcagaggucacaggcugugcugaggccccauggugcugcccccaugaugccagggugaggcuggcguuggaagcaggugucugaccugcauggugucaccguggccacaucagagcuccagccccagagccgcccacccucgguccuuggcugugguuucccugggcuggaggagccugccguuguguuggccacacgaccacaggaccugccacccccgacgugggcucugccugggcccccacuggacagggaccccuuggagcuccucuggccaccaaguccucgcccauuccagaaucggccuucuggagccucuugcugucccugaugcgggcugggccuugccaagggcuuuuuuuccugcgccgggaacaggguggauuugcugggcucacuccccucagagacgcugcgggugcgguggguuaggcccaagggcguuaagagaggaggcugggguggggcuggggccuggcagggggucuggcagcccugggccucccaccuccugucaggaccaaaaaaggcaacgcgccucuccugaccuguaccccggagugaacccaaccuugcaacccaggagugucagggccugaggggagggagaccuggcuccugggugccgugcccguaaggagguggccaccugcagggcauuccuggcagaggcuucaucuggccagguaggaggcuggguggccgagccccaaaucuggguguguucucugccuggcgguggguccugccccaggcaccuucuccucugggcuggcugggcagggacaaugggccuggcugcgaggagggggccugggcugccuucugcauugccucggugacgggagauggccccugccugcugagggauaggggagugggcaggcagugagagacacugacagcugucccgcggguacagggcccugucuggguggccaggcccaugucucgggcccacagugcgccccccacccuuggacggcgccuucucccuccccaggugcaugcugcccagccagggagcgugggggaguucgggagggcuggccuacacgcccugguccagcugucccagguggggugcugggcuucagcccucagcccagggccuaggaauccaacuugauccuccccacacagcagccagguucaaaugcaggucccguaacggaagugcugcugugcagcccagauuggggggcaggagccagcagggcccccccacccucuucucgcaccacacuggggaggcagcauugguuccaguuccgguuccugggcugcccucucaaccccggccuacaguggggcccacccugugccuucugaugccacucccaccccacgccaagucccagaggcuuugggagcgggugaaggcgguggguggcggguggcaggugcaggcggugggugguggguguggcagguggcgggccccaccgcaggugucaucccugcgaagcaccugucgccagcacucagagcgcucaugaggugcccaguccccauguggccuccuuagucuccguccugugucauggaagagguaacugaggcacagaaaacucaccaggccaggcugggaugugaggucccuugcugcucaucccuggcagucagcaacccuacaucuucccagcugggcggcccgugguggguucggcacccaggacccuccggggucuugggcuguggcgaguguguaggcacccaccuggugucucucuccccgcaaggcaucuacauccucaucgcugugggcgcugucaugauguucguuggcuuccugggcugcuacggggccauccaggaaucccagugccugcuggggacgguaaggcagggaggcgggccugugccugggccggggaggggcugggggcugcgucuggcccugaggagggggcagagcuggugcucagggcggagccuagaauucugggggagguggcuccugugcccugcuuuucccguuugguuuuuaaauuaaaucccaccgugcuuggucuccaucguggccaguuccuacgugaccgcuuuucuuugucaaaaaauagccacaaauauaacagggagcaagccucagcucugaggccagccucggcgucccgggcacaccgcccccugugggaagcccaggccuggcugugccauccagggccuggccaguccaggaagagggagccuaugcccgugucuccagugggggaaacugaggcagaucccauggcucccccuuccguggggagcaggaacaaggggguggggaagaucagucaggggucaugcugcugcacacgccucccugggggcugcagacauccuggacucaccagccugugaccccaaaccacacgccccgccccauccaccccguccuguggagccuggugccgcguggggacauccugggcuuugacggcuccucccugcgcugaguuuuagccucugugccccagggcuccacacaagccgcucacuccuggucaggucgugggcugguggcucccacuagccccucacagacacgccugcugggcaccuggguguguguccuugggccccgccuacagccugcccucuuuccucccucuggccacugcccggcuccaguucuucaccugccuggucauccuguuugccugugagguggccgccggcaucuggggcuuugucaacaaggaccaggugagccugggugugcagggacaggguggggugggugacgggggcacccuccucuccugucgcggguggggguugggcugacucauggcuugugggagcucuuugggcucuuccugggucccacuugccaggaggaucuccaggggcuuuauggaggaggcagcauuggggcugagcaccaggccagccucccgugucccagcacucccggggcagcugagagugcagaguccuuguccucuggggucuagccucgaagccacccugcccagggagagccugggaaaagugcguccgccuggggcggggcggggugggggcaaggagggggagguucccccugugcaugugaccgcaccccucccccagaucgccaaggaugugaagcaguucuaugaccaggcccuacagcaggccgugguggaugaugacgccaacaacgccaaggcuguggugaagaccuuccacgagacggugcggccccggggggcgagggcggggagcagggccccgggaacccggcggggugugucucguccuggaugaauccugccuacgcccagaccucaggagcaggaggugcccuugggaccuccaggaccccuggucucaacugguccucgggugggaaccuagugggccaggguggcccagggugcggaaagcucugagcagcgcagcugaggaggaagaaggcuggccccuggaugcauucugcaguggggagcgcugcguaccccuggccaccuccccauggguucccuagagccaccgucccccugggcacauccagggcugaccuugcaccccugcucucugcagcuugacugcuguggcuccagcacacugacugcuuugaccaccucagugcucaagaacaauuugugucccucgggcagcaacaucaucagcaaccucuucaaggugcgcgaggccgguggggccgcgccugaccccccgcaugucccgccccugggugggguccuaggggugggcaggucacacggcagccccacagggagcgaccacacuggguggcauggccccugucagggcugcucugcugggaggguuggggugggaccgcaucuggcccacgaggaaggcaggcgcccugugcugcgcauuccgggugaagaagguggaggcucuggggggugggaacucaccugcacccccagcuccacgugugcacucguggguguggacgccccugacagccuguagcuggcagggccugcaggccauauagugcccuguggaaguuuccugcugaggccucaguggaagucgucaucagugaugcuuuaggggucuagugacaccaaugaccgugaucucaguggaaaagggcacagugugucccaggcauuucgcguuuauguuaaaacggguggaagauagcaagccggcagaggccgggccgcugcacccgccuguuccgagguggguaggggguggggggcuguucccaggauuccccucuacgcuuucuguggugaccacggauuacugcgugacaacgggaagccgggagccgaggcccggucccugaccacgcgugccuggccaccccugcaggaggacugccaccagaagaucgaugaccucuucuccgggaagcuguaccucaucggcauugcugccaucguggucgcugugaucauggugagcgggcgggggcggagggccugcucucugggcugccccuuccgcggggccuugugcugacugcgccccccaccacccuccugcagaucuucgagaugauccugagcauggugcugugcuguggcauccggaacagcuccguguacugaggccccgcagcucuggccacagggaccucugcagugcccccuaagugacccggacacuuccgagggggccaucaccgccuguguauauaacguuuccgguauuacucugcuacacguagccuuuuuacuuuugggguuuuguuuuuguucugaacuuuccuguuaccuuuucagggcugacgucacauguagguggcguguaugaguggagacgggccugggucuuggggacuggagggcagggguccuucugcccuggggucccagggugcucugccugcucagccaggccucuccugggagccacucgcccagagacucagcuuggccaacuuggggggcuguguccacccagcccgcccguccugugggcugcacagcucaccuuguucccuccugccccgguucgagagccgagucugugggcacucucugccuucaugcaccuguccuuucuaacacgucgccuucaacuguaaucacaacauccugacuccgucauuuaauaaagaaggaacaucaggcaugcuaccaggccugugcagucccucagugccaguggugucugagaccuagggguuggccggagggcaggggaaucugacaucgguggggcuuggcucuguggacucugugggguccagggugagggugggugggucgggaucccugguguucaccaaaggagucacucuguaaaauuuggggaguuauuuauucugagccaaauaugagcaccgguggccugugacacagccccagguccugagaacuugugcccaaggcggucuggcuacuuaauuguauacauuuuagggacauaggacauugaucauuacaucuaagauguacguugguuuagucggaaaggugggacgauuugaaggggagggacuuucaggucauaggcggauuaaaagauguucugauuaauaauugguugauuuuaucuaaagaccugaaaucaauagaauggacuaucuggguuaagaggaguuguggagaccaagauuauuaugcagaugaagccgccagauuguaaauguuucuuaucagacuuaaaaagguaccagaaucuuaguuaauucucuccuggaucaggaaauagaccuggaaagggagggggauucucuauagaauguagauuuucccaagagacagcuuugcagggccauuucaaaauacaucagagaaauauauuuugggguaaaauacuucgguuucuuucagggccugcugucacguugguaucuuauuacuacagagucuguuuugugagucuuaaggucuuuuuauuuuuagacagaguuuugcucuugucacccagguuggagugcaauggcgugaucucagcucacugcagccuccccuccaccucccagguucaagcgauucuccugccucagccuccugaguagcugggacaacaggcaugcaccaccccacccagcuaauuuuguauuuuuaguagagacgguguuucgccacgguggccaggcuagucucgaacuccugaccucacgugacacaccagguuuugggauuacaggugugagccaccacaccggacuaaggucucuguuuuaaugugaaugcuggucagcugugccuaugaggcauguucggccacccacagucaucauggccucaacgagcuuuucagguuuacuuuagaaugcauuuggccaagaggugcccauucaguugguugggguugcuuagaauuuuacuuuggguuuaaaccagggagcaacuccagguagcaagggcccuuuuugggagcguucucucuauucucuuuugggagaggcccuguguugccugcagccacuuccacccugccccuugggcacacaaggggcacacaguguaagcaggugggcaggaggggucgggcagccagggaaugcagugagaugggcuugggguaggggcugggugcgcugcaggacuccucuuccuccugagggaugguaaaggauggacacacugcccccucccgagcauuugagggucucugcccugcccaucuguuaccuguaaauguuccuuugaggagcugauggcucaggccugagccacaucucagagggucuggaggggaagaaagaccucauccuacuagggagcccccccagcccaccagcgagcggugguugggggcagacaggcuguggggcuaaggagccccugcacucccccguccuuuucccuuugucugagcaccuccagccagugggcuuggucuagacucuccuaucuuuccccacaucgugggguggggcuugcucuggguuaggcuacuuuucccuaguuguggggaggggggugcuggcacauuucacuguucccuggaggaaaugagugccugggaauucauaucuagggcucccagcagccucuuugcaggccaauuuggaaacuguccccagcccugcauuuuaggggguuacagagucucucagcaggcccuccuccccugcugcucccaacuugcaagccugcacugguugggagaacauaaugguccaaggagcccccucucuacuuuccgcuguguucccuguggggagggaagagcaguuuaagaaauaaggaaucccaaaggcgcacagcagaccgggggccgaggaguggguccugcuuccccuccuuuuuucuaggcugagccacagcagguccuugaauccuauuucccagcggaugccaggacagcaggcccugggggaguucucucucgagccuuucagagggaccagaggucuagcagccaaggagaacucagaauccuugaguguguggggcaggaacucucccagcugagaaggggcacaaggugccaaccaucuagggcccaguggccaaggaagacgcggcuugucgcagggagaaucugggcccugguccucccuuucagggcgggcagcugaccugcccccugcugcggacaggcgaggccaggcugcuggcucgcaagcauggcggagcccaaaccuucccugcugccgcccgcccagccacggcugacuuggaagcuugaggagcguucagcagccuccauccugcccgggaggaccggggaccuggaagggccuggcccucgcuucccugcagcgcccuagggggacgucucagugccucccggagcccggaccaaugcaccagagcugagggcccaagggugugaggguggccgggcaguggccccgaggacggcgccccacaaguuugcggccagggcccagcaaaccccuaggggugggaaagcgucggcccagcuagcggguccagcagggcugcccccuucaccguggcccagcggucacgaccccacguccucaucgcgggcugggacugccucugcgucuggccugagcgggaccgugggauccuggggagccccgccucggugcacugacagagcccagaaggagugacgguuaccgcuuccggucaggaccggaagugccgggaacggcauucguccuccgugcgagaugacgcacuuccugccugaggcggccgcuguucucgcggcuuccggcagguggcgcugagaccacgggaagccagccuggcugucgguuagcccucgagcauucugggaauugcaggccuggccccuccucuuccuguucuuggucaauuccggucuuguuuccccaacaaaugccgucguuuccggggcugcuuccgagccggacccaagggccggggcguggaggaguagaggggcgagcgcaugcgcacaggacuacacgucccgacaggcgucgggagcggcggcccaguuccuugugggagcuguaguucugcaggcgcggaagccguggugcucggccggcagagcacucgguuucccagagggcugagcgcgccgcacggaggugcggcgccgaccaagauggagacugccgagcagccuugagccgguagguuuguggugagggaggacgggccgcgcgggccggccgagccuccgggaggucaccgagcgcagcuuuaauaccugagcucgaaggccccgcugugcucgccgacccccguaccucgcggccgggcccuugggacccacagcauccuugugaggcccggaggccuguccagcccgacuggacagugccgaggggcaccgagagccagcuuggcaccgagaguucguuuguucucuggcggggaggucuugcuggcacauauaguggagaaaggccgggcucugcguucauguggagaaagagacggcuuccuucagccuacggacaugaaggagucaacucuaccuuccacucguugccggcuuucgccgagaaccccgagaaacggacuaccggagucccuaucuugcagcccgauccccgcuacccgucggagugccccgcugaccaggcugcuucuggccgcggcggcguuccgcugcagaggacgggagugcgaaucugggaagcaggguucugguugaacuccagcuucgucugcaacauacugugugacuugggcaaauuauuucccccgccccguuccugccagcuuuaaaacggucaucaguggggggugcugcguauccccuuucacugggguggcuucuucacugaggagagucgcgccucagaggaacugagguccugccuguguucgaccugguggggggcacuaagagccccugauaguaccccugaccccauccuuauugggugcacaagacacaggucacucugggcgggcaaggaguuuugguagcaggagaggagucgguggauggauggcugaggacagugcagaaggguguggcugggccgucuuuuuuugccuggaaauucaaguucugaggcacccagucacuccagcacuaaaugggugcaggaggcagcacuugucugcccagcuggaaaggcaggguaugugcugaguguuacagguggaaggccacuggaggucgcuccaggagccgcggggauuuaccucugccuaacagggcugcucaaggugauggucgacaccccacuuuccugagagcuugacccucagaugccagggccuuggcugcagauuccuugggagcucccggggaucuuccagcaaauaggagcaaaucuuuuccccguggaucaggaaggugcacgcucuuuguggaauacgacugcucaccccgcacagcaagcagcuuauaaguggcccuccugccugauuucagcccuggguucaagcccuggguggcugcuuacuaccaaaaucgcucaguagcuccaagccugccugcagaggguuggcaccauuaaaugagguaacgagucaaaagucccuacccuggguccuagccugucaggggcuccgaaaacccaggcucaggucgguccugcccggcaccuguuucacacauguacacuccggucugagguugguccucucccccaccccacccaccugcaguugagcagcugaacagaggccaugccggggcacuccgaggccugagacgaccacgccugugccgcugaggaccuucaucagggcuccguccacuuggcccgcuuggcuguccaaucacacuccagugucaaccacuggcacccagcagccaagagaggugagaggagggcuuggagggggaggcgggacuccacccugugugggacaguucugucaguugacccuccacuuguccaggggcaguggaucugcagggggaacucauucucaauacuguuccuccugagaaacaaauuuucugggcuguuuugguuuagguguggcguggcccuggggacgcauggcugaggcaggaacaggugagccgucccccagcguggagggcgaacacgggacggaguaugacacgcugccuuccgacacagucucccucagugacucggacucugaccucagcuugcccgguggugcugaaguggaagcacuguccccgauggggcugccuggggaggaggauucagguccugaugagccgcccucacccccgucaggccuccucccagccacggugcagccauuccaucugagaggcaugagcuccaccuucucccagcgcagccgugacaucuuugacugccuggagggggcggccagacgggcuccauccucuguggcccacaccagcaugagugacaacggaggcuucaagcggccccuagcgcccucaggccggucuccaguggaaggccugggcagggcccaucggagcccugccucaccaagggugccuccgguccccgacuacguggcacaccccgagcgcuggaccaaguacagccuggaagaugugaccgaggucagcgagcagagcaaucaggccaccgcccuggccuuccugggcucccagagccuggcugcccccacugacugcguguccuccuucaaccaggaucccuccagcuguggggaggggagggucaucuucaccaaaccaguccgaggggucgaagccagacacgagaggaagaggguccuggggaaggugggagagccaggcaggggcggccuugggaauccugccacagacaggggcgagggcccuguggagcuggcccaucuggccgggcccgggagcccagaggcugaggaguggggcagccaccauggaggccugcaggagguggaggcacugucagggucuguccacagugggucugugccaggucucccgccgguggaaacuguuggcuuccauggcagcaggaagcggagucgagaccacuuccggaacaagagcagcagccccgaggacccaggugcugaggucugagagggagauggcccagccugaccccacuggccacugccauccugcugccuucccaguggggcuggucagggggcagccuggccacugccuagcuggaaugggaggaagccugcagguggcaccgguggcccuggcugcaguucugggcagcauccucccaagcagagaccuugcugaagcuccugggguguggggugugggcuggaagcacuggcucccugguagggacaauaaagguuuugggucuuucugagacuuugugucuaucugggcccugcuuacccaaagggcucaguuggcagcaagagcuccccacaccugacccucggugccggaccacucgaggguggcugacaccugcaucccucaccagcacaucacccaggugacagugagaauuggaaaccccaggccuccucuagggcuuguggcucaguggcagguguccagugagugcccucaaugggccugaguggguacagaaucugcccucccccaaccaaagcccacaugaugccaucagccccaggccuagugcagaccacagcuugggaagcgaaagggagaugacaaaauggguguggacagaggaggcuggggugagugggcaguuggggggccugggcagguguuugagccugggguccaguuuuaucugggccacgugggguacaguguuuuccaggcuccacugaagauaaagcagccacuggugccagcaggggcuuugucuuggggccauaaacaccagugugugcuguacuggccaucgggugucagggggacagcugacagaugcaguggaugcccagcccugucuuccaggagccagucaccugagccccaaaggaccuuuugggucuuaagugacagaaauucuaaccaccaguguuucaaaaaaagaugagucucuugucaggcaacacaagucagggcaggggugggugcagaccccagagcagcuucgcagucuggaugggggugcucccccgucacgccacagggccagcuuuuccacagugcaggcuggucaguuuccagguagggaugcgguggggcacguuuucugcccggggaguugugccugucaggggagacagccccaugacacugcugugccuccggggaggccaggagggacaaggagcgguuccuuugggugagggucuguggugaggcaccaggagggccauugucugcuggggggcuggugcccccugggggguuccgcuggaggucggcaaaggucagugcacaacgugcaggguggccagcugaggagagguggccccacacguggcaggccaagcagcucagguguccgagggaggcuggccagccccggguuguucccagccaucuaaaccaccucuguggucagcagccaccagcuggcuucccucgccacagugcugagagccugcugggaaggaaggccccccugagcggugggaaccagcaaggcaggcccaggaaggggagagguagcuggcucagaggcaagggccaggacgccguggcucucagagugaguccccacaggccagccuggggaagauggggagcccagagacaaccaggccucugccugcacuccugggacuaggaaagcagcccccuugaggccgaggggcccguuugcuugcugagcaggacaguccaauagggcccacgccaggcagagccucaagagucugagugaagcacauucggcccuggccaaggcagggacuccgucagagggcacccacaccacccugaagagccgcguccagccaaggccuccugagacucccgggccaggcagggaaggcagagcacacagcacagccuacggccccccagccgcugcagagugggugcccaugcccacccucaucccacgcuccccaaacaggcuuacuccgggggccgccacccugggccagcacgucagccacggaggacacgagcaccgagcaguaguugaucuggagaagggaaacacguccgggaagcuccagggcucucucaggacagcaggggacaggcagccuccccaucuccccucuccugccagggcccccgcugcccugugacuccucccucugagagcugccgcucacaggcaggggugagugaggcucccgugaggcguguagagugaaaggcgaggggucuucaaugugagaccccucauuuaaggcuguagccucccaaguggcagggugggaggaggcacagguggggacggccugucuuccccagaacgcuccucugcccacuggggugcuccuguccuggcucuggccugccucaucucugugagugaccgggcagggcuguggacccaucccaguagccccacgcagccacccgccucccaucagggagaggagcucuggggcucgcuugccugugacuccagacacuugaugcgcuuuucuugcucucucagacccccgagguacuuggcaaugaaguccacucugcggcaggagcagguggucaggcuguggauggccacgcggugcucugcguguggggagccuccccauccccccaggccucccugugugcccgaguuuggggugcccuggcccuuucccuuccucccucaugcccagaucugguggcaccaggaccccucaaagugcaccuggugcaguacagagcgcucuaugccuucccaguagggcuagggugccaucccugccugggcgcaccacccagaaagacggugcagggcaggcagucggggacaggccccuggagccagggcuggagggaagccagggguggguagucccaacccugagaccacagcagggagggcgccacggucacugugcacgcucccuuuuugccuggccaggcgucccagcaggguccugcacaggucaggcuggaaagcuaggccccugggcucggccagagcccugccccuaccccuucagcuucaguucgccagcucagauccucugucacuggcgccaauggcacauccccgcuuaaagacagcccgauacccaccagugaucaggacaggcccccgcaccugugggcgguuuuccgcagcaccucccccucgcugucccuccuccgcuucuccaucuugcucaggaaguucuccuucuggacugucucccaggugacgaccuucugguccagggggucuggcaggucucucucugggaaagccagguggcagccagcauuacuagagcaugugggcgucaguggcagagcccaggccuggucccggggcgaggugggccaggcagaaggagugaguggggcccagccagggauggagggcaagcauggcccugugcaaggacggccaagcugcggguggacgggcucagcugugccagccugcacagagcccagcugaggacccacagggcugaggagggguccaggucucuccagaccugccuccagcgcacagccccgcccugggacccgccaccucggccucacccaggugcucccgcuugugcucggccucacccaggugcucccgcuugugcucagccuccuucuugaagacccggcggagcgucaggcucagguggcugagcaggaugaagggcggggccagggcggggcgcucgugguacuccacaaucagguuguagcgcuggaacuuccagaacaugucugcguugcccugcaccaccuggaacguguagcugcaggggcacagcugagccgucaccuaccggcuccccacgaccacuugggggacgcaucccccugcacccugauugcuguuggggagcccuuuuugaaacugaggcccagcacugcuucugcguugccucuggggugugucacgagggguccacucuccuugggucuuccccuguccacucugcucuccuggacaagcccagaguucuugccacagcaccggucccccaaagacccaggcccugcuuccugggacugggaggguggcccacagaguucccggucuugggcaggcaaagcccugcaguccaggcuaugccaccuucuaucugcccugaggcaccaagccucacccucugcagcacaccagguggguugcaaaggaggcgguguuggggaaugacccucugcucccuccgcuccagggcucucuccuccagggguuggguggagucaccugaacauggcgaugagcagguucaugagcagcacauuggugaccaacaggaaggugaccagcaggaggaugaccagccaguuggcauagaggcuggggcaggauggugaguccuccagcagcaguggguggguggagcaguucacacgggcuucuggaaagcaagggugcuguggggaccagaccgggggcagccacaagggcggccuuaggcaaaugccccgagauagagcgcugaguccugguguugaacccaggggacggggugcugguugggugacccacugucccaguucacccagggcggccuggguuuuagcagugaaagccccaucacagcaaaccagaaccagacggguggugagccccacccugggcccccucugccaugucugcugagcuuccaccaggggcuggagucagccaagaucacaggcccuggaaguagagccaagaccccuggagggauggaaggugggggacagaggggucacgggacccagguuucuccugguuguuggauguguuaaaaccuccaccccuccuccgaaaaaagccucugcuguugaagguuuggggagagcugccgaggaaagggagauggggcccaggacuucucagagccucuacagcacuaaugccugugauuaaaccccaagcuggcaaguaauuccgccaccuuuccaaaauguauugagccagcaggcuccagacugggcuugcugcaagcucugagggcaccgaucccgcacugggccacucaagucaagaacauucuucaggcggcacacucugggagcuugcaggcugagcucccucggcccugggcagggacacccuggagggguggcagaucucacuccagucccuuaaaaccagacccucacaccugcuucucccuuguagggcucaacccuggacccucaccccaccccagccugcggggcaggaggagggaggagggaggaaggagccgcagugggcgucagggugcucagggucccagccagaggccagagugugcccuggccguccaggaccacauauccccuccauauccgaaugggagcuccgcucucuccucccuccccagccugcacgcuggcgugugucugugugagccuguacaugugauuggaugugccuggcacacaugcucaugugugagucugcgugugagcacacuggcacacacgggcacauucaaguguaucuuagugccugccagcuccagguugcccugcgguggguucuggggggucuccuuguucccagguuccugccucugugccuggguccugagcuggagggguccguucucccuccuagggugaauuccugccuuguuucucccgagugaguuagugugacgcguuggcccgugugugaguuauugagugucugugugugcacuggcagucagugagcgccagcccuccccacgcucccacccuaggccugccccuccucuguccgcccuggccaccuccagcccaugaaucuguuccugggcagacugaugacccccucuccucccugcacucuggaggagcgggccggggccagccuggagagccuguuugugaagccguaaaucugucugauaaaggcagcucugaggaaugagacccccacacccuccccgacucugugauuugggaaggcgccaccaggccgggcuggaaauuaaauugucccuggggccuggagacccagagaacaagcucgucaccacagcucaaccccagcuccggcucggcacgagugcagaguggggcaggggucuguucugggcucugaggagaccugcaggcuguacaggaacugucugagccucagucucccucucagcccagcauguguuagugaauaacucccugccuagcagcaugaggggcugggucacagugaguggcugggguucaaccugaagggcccagauacuugcucggcagcugaacggagcccaaggaauugcagcucagggaggggaagugacaagucugagacucucagugggcggccggggcuggcccuguugcaggcguuucagcacggggcucugagauccccgcagcaccgcagaccucccugaggcagcacucggagcaggggccccucgggagucuguuucccugccuucucccgucgagaaggaggcuauggccaggccugucuccucauacgagucgcugagacuggcccaccagagaugcagccacucaagaaagaggggacccccaacccugcccuggcuggaggcgcccgucuagagcuccuccugccccgaggggcccugcggacgggcagugcuggaggccguauggugagggcgagguggggucgcaggcaggcagggucugguuaaacuaauggccuggaaaaugaaugccugugaugagcaaacaccaaaaugucaggaggggcugcgggggcugagaaaacagcccaaggaaaugagccgcgcugggagaggcgguuuccaucacggcgucgcccccgccuguccccggaggccuguguuugcuccggucuggccgucauccccucaacaaauauuuaucgaggguccugagcgccacuccacagaggucggggucaggccugggcagcacguugugccaugacugccccgugccgggcagccccagccgccugacaccgccugagcaguuucccugcaccuucucugccgggucuccaagucugcggcaccccucgagggccccaggggcgggcuggcugcugguccaccuucccagaggggugcgucccuuuccagguuggggcuccucacugagucccagccaucccaggggccugcacaggucccugccccaccccagagcuccccaccaacccaucacuacagaggcccccauggccaagcggcucugacccccgcccccuccccacugcacuggcuuaugaaaaaguuuccagagccuccaccagccccagccagcuacaggggucggccuggggacacccauaggcaugggcaggccacacacacacauugggguggguccccaggagcagccagggugccuuuaggagcggccaaauggcgaaggggccuugccagcaggacggcguaggggcucuggugggugcccuaggccaagcagggcccugugggagggcagaggccaggggcugugaggagagcuggagggcccagaccccggaugauggcugggacagccuuugggcccacucugugcccuuagugccugccuaucccuuccccaccgauagaccacccccagagcaagacuugcugcuuggccuccccaagcaggaggcagcccuggcugccuuggggucuccuugugucuccuucccagcccaaggccccaggucccaggucggggcuccgugacuggagcugccucuaccucaggaaccaggccuggcccuuugggguguggggggccuggggaccaggccucagccacuucucccaucucugcuccaggcuggggucuccauggccccaacagaccucucuggagagccucaugcccagggcuugugcacacagggcuccaauuucucccugccccugcccccgcuggcugugugcaaaccaucaaucucguccagugggaucuggccgaagaucugcagguagggccgguagagcacccggcggaagauccacuccaggcggccgucaugggggugcagcagcgccuggguggugacaccguaggccacgagccacacgcucagaaagaagaggaagaagaagacguccuucaucuccacggggcaggggcagagagagggacgucagcggccagccggguggggcccaggcaggggauugcugucccuccagggccagggccagggcccccgggggcucaccaugcgcucuaccacgaugaucuuggggcccagcugcuuguguauggcaaagauauggaucagccgcagcgugaacaccaugaaguccauggcgaggacugugcggccagccucaaacgccgacggcagcauccuggaggaugggaggcugaugcggcugcggggcccagagaggggcagaggcuuccccaggggcacacagcaugcuggcugcgggcagggccagggccaggccaggacuccuugggcccugaguggcuucaucuuuuguuuauuuauuuuuaagagacagggucuugcucugucacucaggcuggagugcaguggcaugaucacggcuugcugcugccucaacuucccuggcucaagugacccacccaccucagccuccugaguagcugggaccacaagugccaccgccacacccaaccugaguggcuucaucuggaagccugcccacaagccgcccugaggccacacggccucugggccccacagaccugcaggugacacccacgaugaacaggaagauggccaccaugucacacuuguuccaguugucccccacauacagugugaacuucuucaccagguguguguccucgucugugaagaagcccugggagggaggugggcaguccacugacagcuguccagccgcccucgcuggggacagcccuaccuggacaagcuuggaucuguaaggaucaggguuccaucuaugaccagggccgaggcuaccagugggacuagggguccacugaagcuauuccagggcugucuggggacagaaggugaggucagucuccacuuggggccagggccucuuugugcccagggucuagggaucaguuuaugcagugucuggacucaguccgugauacaggucaggguucagacucugacgagggagaccauggucaugcucagucuggagcagggcucagggcucggucuuugaccaggaucauggccgcuggugacugggaagaugggaggcccccaugcuguucuuguuuuacaguuggggagccccacccugcgagggcaggacccagcuuagguugcccaaccugaagcugcagaguggaggggaccuaggcuaguguggccaccgaccugccggauuuccuccagcaccagcguaaagacccagaaguagagggugaccucgggcccugaggggcccugggggggcggccugaaguccaccagcaggacguaggugaacaggaagaggaaggcgaaguacaugaccacguuccccaggaacacagucacgggagcgccccagaauuuccgccagcgugugagcaggaagacagcacgugggccucggucacccugagcccucggcgccuccaccagcuccuccacccugugccgcagagaaguucgcaguggugaggcuggcgcccagccgggugccccaccagaguccagccucccagccaccacccgccaguccccuccacccugccuggcccugugccucgcaccggcucugcaggccauacagcgggcucuucuccguguccaggcuguccagguccugcagguccuccaggccuguccucaggggagcuuccucacugcgagcacaggagagcucagggcccgcaggaagggcucccagaggcgccugccuggcuccaggcgcuuggccaucaaagugcccacugggaugcaggggcuguggggagugggacccgcagggaggcuggacuugggggcuacagagucaggcuaccaccagcaccugcgaggcccaggcccuccccguagcuccggcacucgcacugcugccuguccuggccgggcagcucacaggccucacccaccugaaggugaugagguugguauagacgagggcggggcagaggaaggcuccuagcagccgcaggaugggcgugccugcggccauguccccccaccagauccuggucaggaaggccugaggugaaggcaaaacugucggcuccaacucugcaccuuugcccaggcugcgcccugccccaggaaugcccuucccccaggugccuggcccacgugagcugaaggggugcccagcccagcccucccucccggagcccccguccuggugggcaugugcuccuugggccacucaucccagggguguggguugagcugcuguacccuucacuagggaaaagauugggcuuggggguuggggaggacugagaggaggaagugccacuuccacugaggccagaggcaggaggagugugccugguggaggaagccaggugggcgccuuccaggaacagaagccccaccccgcccccucugugcugaggacgggagugacagggcagcugcaggcugggaagucaacucaagcugggcccagcucgcccgcccaccccacccccuggcagcucuccucgaggacagcuggcacucaccugaacgccgucgugggcaaagaaggccuuggcgucagccucgguggccaggugcaggcagguggucuugcuccagcagcgguuccggcgcaccagcagggcgaaggcgcgggccucacuguugcuguagcacucggagaagaggucugcccccggaggcccuggccgcuaggacgagacgccgaugcccggcccggcccccgacgccccuccuccauccccugcccagaccugggcucugcagccgcacccugcguucaacacgcagggcccagccaggccuucugcccccuccggccugcuccgggcccuuccugaaccuccguccuucuccggcucugucccucccccagcaggacaaagggaaccucugccacgcuaaaugucccucguccugcggcagggcccaguguaugcccggggugugaggcuguaucguccucaccacgugcacagcggucccacacucagggucuggggccgccuccaccccaggcagagccgucuguccucuccuauggaggaggccccugagggcaccuggagccccacggcgguaacaggcagcccuggcgaggcccaggacccuucguccgaccccuccgucacauccucccccgcgcgcgggcccggccccagccgccggucacucaccaagggccagccgcucguauuucgccucgcgcguggcucgggccgccucggccuccgucuccaggugcgacaucucuuugaggauuuugcaggcggccagugcggcugccacaccuuccuggcccuacgagaccuggucucaggaggccgccccuccccugcccccgcgcugggcccgcggccugggcucaccauggcccagaaguagguggccaucucguggcgguucugcagcacggcccacaggaacaggucccgccagggguucucgcucuucugguucagguccagcagccacuucuggcccgugggccgcuuggccgggcccuucuccuggaggacacgggcgucggccuccugcugcggccccagccucgcccuccauccccacggagcccccgcucaccgcccuccugcgguccccuggccggccguccugguagaagccucggcaggcguccugcaggaaguccuugaguacgcgggagaccucgugcagggagaaggccgguggccccgcggguggcucccgggccugcugggugcccaggccggccagcgucagccgggccuccuccugcuuccgcugcagcaggucgaagagcaggcucuugcgugacacggagcgguagagcuccugcagccgcccauacgucaggaagucggccacgucugcgccguuguccacaaagaggcgcacaaacucgggcuuguugcugaccagggcguccaccaucaccuccuccaggucacaggacuuggcggccaugggcacccgagggaagggggacaagagagugagcgagagacaggaggaggggguccaaggaaggagagagcagggagcauggggauccauccccagggccaggucacgcagacccucucgcucuccugcaccccagccugcccccugcauuggggcgggcacagaggggccagucgugagcaaaugcugagggugucacaacccccuugggcuuuggggacagccggcacccagccagcucugccugggccagugagcgaggcagaagcccgggcagaaccguggccuggucuugccccggaccuugggacagcugggcagaacgggcucagccaagcagcccacagggugcaggagcaggcagcgugggcagcucgggcagugccaugauggggagguggguaggcagggcugggaggcaccuuccacuccacguccccauugaagaucucacucuuggcgauguccacgcggucccaggccacggccagcuugagcucauccagauaguccugaggcuccuggcuguggcucuugcaggcugugggcagagcaggcaggcacuggugaggguggagcugagggccucacagagccggggcacaggguccccaaaggugcgcugccuagagacgcggaaacgggaacuucacgcugggacuugagggggcacaugcgccaccucugagcaccagcaggaggcacgagacuuuguacaaaccgcaggagaaagcgugcugcccuggucugcgucgggacggcccgucugcucccaugugaggcaacuuccucggcugcaacggggguaccccagcuaacaccugggccucgaggccacuuccuggcacugaagguccaggacacccuuccuggauguugucgggggagcaagcugggccacguuuccuccacgggcaagggcauuuggccaugacuuggugaggucaccagggucacucaaggggggccugcagcaccugggcugggugcgccugcuggaaaccgcuguccucaccagacucgcacgugaggcucaccagccucagccuccacaaccauggaccccguaagacuacggugccucucucaggccacugggaccaaacugagacuggugagaagaggcgggggaguuccuaaacggggagguuucuuugaccuccuuguccuggugagguuucuaaacccagagccacccgcaguccagacacccuucccagagcguccccucaagguguccccagccccugcuuagcagugccucucccugcuggggcugugucugccugccagcguccagcccuucagcacgcguucgucuccagcaaaaagcacaucaaaugcucaucaaaauuuuccaucagcgggugaacagacgcaucaaccacggucuguccacaggcuggaaccugacuccgccuuacaaaaggaaugaagcauggaauggcauacgcuucaacacggaggaaccgucaaacccucccgcugccugcagggaaccauggacacgaaaugcccgucagcaaaucuauagagacaggaagcagaucgaugguucccaggggcugggggaaauggggagugagugccaagggguaugggcucuuucuggggcgaugaaggcuucuggaauuagauaaaagugauggucgccccaccucacgaauauacuaaaaaccacugaauuggcuagugcgguggcucacgccuguaaccucagcacuuugggaggccgaggcaggcggaucacgaggucaggagaucgagaccauccuggcuaacacggugaaaccccgucucuacuaaaaauacaaaaacaaaauuagccgggcaugguggggugcaccuguaaucccagcuacuuggaaggcugaggcaggagaaucacuucaacucgggagguggagcuugcagugagccgagaucgcagcacugcacuccagccugggcgacagugcgagacuccgucucaaaaaaccgaaaaccaaaacaaacaaaaaacaacccccccaccaaaaaaauaccacugaauugagagcuuuaaguauaguuuuaaguugugguaaaaaacacgucauaaaacuugccaaauacagacagcuucaugaaucaugugucaucuuuccugggaaggggcaggcggccgagcgucacaaacauuggccaggcugccaaaccccaaagcggcucugagcaugaagccccccaauggcgccugccuugcccacccugcccgcccucaccuuucaccagcgccuucaggaugaccguguccagcuccucggagcccuccugcucgaagucauacacggugagcaggugcuggugugaggugauguucugcagcugggcaccagaacagagcccccauggggccgccucagccaggacgggggcagaggcaggccgugguagacaccagcguaggcacaggcagcguccccaggugagccuugcagccugcaugcccaccgcccaccgggcccggccugggaccacccgcagaccaaggggcugccugggucucucugcucccugugggccugaagcgagaguggguggggggcccagcagccugaggugggaggagugggcuggaggcugcauugcaggaacucucccagaggaccagccccacccccggaggaggggucgggaggacaggggagggggcagcacauaccagcuugguccagcgcacgauguccucccaagagaaaugcuugcuggggaacuucuccuuaaacugcuucucggccaccuugggcaccaggagguggggcugguucacuagggcagcaagcacaucggcgaugccccccgagccuaccaggaucagccacggggcagccugcuccacggcccuggagauccucugagacggggagggaggggagagcggaccccagauuagcccgacgacaucuggaugcaggugucaggggugcccccaucccuucagcccugucccaggggugcccagaacccaccgcaccccuccacaaggcuucggccagccagggggccucagccaggccccuaccuccaagguguugggaucaccauugaccagcaagcagaggacagggaucucgaugcugccagugccuguggacagggcacccgugaggccugaggacccuccgccuggggugaccacccggaucucaggcucucaggccaccacauuuucuggccaaaagcuggcucuuccgaauaaagugugggcuucgucugggccacgugacacaggcugcuuauuacagccccugccauaugagggccgagggcuccaaugcuaaccuacacuacccagcacgcgcacuuuguggcaacagcuggcauauggcuguuaaaacacaaagugacguggaagaaacggagcacccagcccuacaggugcacugccacacugcacgcgcucaugcugagcauggcagaggcagcaucucgaccaucgagggagcucugcugggugggcugcgccugaccacucagcaaacugaagagguacaggagggagucuucagguuucucccccaaacagaagcuggaaaugagaugucuauaugugaagcccccagagaggccuggaccugccccugucuucugugagggagugaacugccuggaggugccuuagaaucacccacagggaacugggcucgcaggcgggccccugacuuugaaaggugccuccugauugaaucuggaggauaaaucaggccuggccaaacggugcccgggccagcagggcuuccgcagagcagagccagacccuccgccugugucccuagaguuugacgagacuuuguguuuucaauucuaaagagugcucaguugaccgggcacaguggcucaugccuguaaucccagcacuuugggaggccaaagcaggcagaucaccugagaucaggaguucaagaccagccuggccaacauggugcaaccccgucucuacugggaaaaaaaaaaaaaaaaaaagagccgggcaugguggcacaugccuauaaucccagcuacccgggaggcugaggcaggagaauuguuggaaccugggagguggaggcugcagugagccgagauugcacuccugcacuccagccugggggaugggggacagagugagauucugccucaaaaaaaaaaaaaaaaaacagagggcucaguuggccuugccaagaaauuacaauucuguuucuaaauauuguauauuguucauagauguuauaaauaauuauaugcuuuguuuaugaauauuauuuacacacuagcguuuucuuaguaaguccagcuuuugaacgugcgacuggccagaggugcccauuucucgggugacgcugcccucuggcggcagcauaccucacgccuggcggcgggaaguagcccucuuucaacucacgaucucauuuugccucuuagagucccggagccucugaccacggcaaggcccagugaaaacagaacugcaccugcucuggugggaaugucacuguccagucagagccacucuguccagcugugccuccuucaccacucugcccagacagcuccuccucccaggcccccacggcccaggcccccacggcccaggucucggugcucaggcaugcggggugcguucugccugggaagcccucccccuucucccuggcggucacccccacucucccacaggcgggucccuggauccccacugggucccaaggcuucccuggguggcuggggcgggucucacccccguagcccgcccucugcuccgagaugugcuucuccagccucagccgcagcuccgucagcccaucgcccuuccccggggggccuggcuccaccaggaugaagugggagagguugcuguccagugaacagagggggcccuggcugccgccgucauccucaggguaguggacaggaaaauccuccugcgcccaugcagggagacgaggcugagcccucgagaggcagcuugggcuggucccgcugcgggauccucccugccaggccgugcacaccacgccauggggccccgcacaaggcuucugcccgagccuugguuuccccacccuucagacaaaaggagggacgaacagcuggggcccggggacccuccuucgacagucaggggcaggggcgguggggagcggguucuuuuagacagaaccauggagacagcccaggcugccgggagcaccuccuucccgacucuagggcuggcguccaaacauccaccaggggcugcccgggccucccucgguagugccuuagacagaccccagcaugggggacggaagcugcuugcccaggcuuggaaagggcucggggccugggcccgugugguacaggagggggugagggcccgcgccacagucuacgcuggccguucccuaugcgguacugccaccugccggccgugugcuggcucugcccgcucccugcucuuccuccagcucgaguccuguccucccagagcucugcccgcugcccaaacccuucugagccccugccuccaggcccccagcggucguggugcugggagcuggacgugcaccugggccuccuccagaaugcggcggugcaggacgcggcccagcgaggccaugccgacagcaaccacacggaccuugguggacgugcuggccagcgaguggucgcgcacggccugcccgacaugccuggccaggcccacgcggagggcacuggucaggauccaggcuccuguggggauggaagagggccucguugugccgcacgccccaggucuucccuagcuggccccacgcccuaaccccuaggcccaaucagcagccaguuaccugggagccaggggugggugcuggggaaugccucacggugggguggggaagccgaggcccagagagggcaaggcacccacccaaggcugcucagcagcagaacuggcugggcccagaaccugugaaguggcacccccaccccaccuggagcgcacaaacugggguccaguccccccaccgugcucccuccgggacacauccgacacaacucuguccagcugccucugcugggugagaaucccaggauguuuucccaaaugacaaagcccucggcccuugucuggcuggaagaucucuuuggguuugccacagucauuuagugagggauccugaaaccucaaguccuuuucuccuggguguuguauaggccaagcugccucaaaaaacagcccagccauuggacucuggccccugcagcuggcggcccgacugcuuccccaaggggucccacccuguauacacccgggugcucuggucccaggugagugggagcagggacaucucauggcggcccaugggcccugcuaguggagggggcagcucuaaggaagggccaggcccagcugggggagguccugguccaguacguaggcacugcugcaccuguggguacugcagaggacgggcugagaguuucgggaaauguucucgugauggccuggagagucagggggucuggcugccguguggggugggagcauugccugugccggguggggggacagucagggggucuggcugcccuguggggugggagcacugccugugccggguugcggggacagucagggggucgggcugcccuguggggugggagcgcugccugugccggguggggccucaccugugcucugagccgccuucaccagccccuugcgcagcacaucccgcagccaggacuucauggcgaaaggcugcuccucacccaccagggacaccaccagguugggggccggcaggugccacucagcaagcagcaggucaaagagcacagacggggccacuccgcucggcacccguacaaacugcaaggcaggucugcagcucagggcuuucggggcacggggcaugggagcugcugggcauuggggggggcuggacacaagggggcacuggggaggugcugagcauggggggacacugggcacugggaggugcugggcaucaagggggcuggacacaggggguaccggggaggugcugggcauugggggcagguagcaggaggagaguggcccccaauaucccuucugggacagggccaguccucccuugaccugcugugugaccugggcaguccugaccccucucugggcuggcaucccccucagugagccgagggcgcuggacagagguggggcccuggaugcacuugaccuugcaccuccaaaucucucggggggacuucaggggucccgguuauugcagggagguaggaggccggccagagccacuccuuccagcucuggaacucugccugucugggggcucugaauauggccccaggggagcagaccccaggggugaggaggacccuggcacucagcuuccagggaaggaaauggggccucauggguuccaggucaaggcggacaucaccugaggccuggggccugcccuuaccuugccucgcuucuucccagacccuccaaaguugaccucgccccugugcaagcccagcucccgccggucuucagcauccccggggcuuccgggacgggggccuuggacauccugcaugguggccucuagagcugcagggauacccuggcccuugagggcugagaaggcccauccccaccucccuccccucagggggcuggcucugcuuuccccugggaagccccucuccagccaacaugcacaaggagaccuggggacugcccccaggcaucucugccccagggaccuucucuccagccaggcccugcccagcgacccccugcagcuccgacacucgcuguagcaccgccccaaccaagcuccuucccaggugaggaugggauguguggggcuccgcugucagcgccugguuccucuacucaccccacucagggcaccucagguuggccacaccugcagacauuucuccagaggccuuuuguggggaugaccuggaaacuccgaaagacucagcagaggccuugcaguccccuggccacacagcccacccgcucccaggacagggauguggagacccugggugcaccuggguagaggugaaaaggugagacaggugcccucagcucaagugcaggaggcgguguggacgagagaccaccuuccuugcccaggagguccaggaggcccaggacacacagagagaggaggccuugccccggcccacacagcaucagcagcagagcuauucccguggcgcucccacaucagcaagcggggguagaagaggccgcgugcgccucagcccuauucccucaacccucauggggcucaugucucccagcugcccggugaggucgggcaucucagccccucucuauguggcagggauccaaggaucggcacuggccccucagcgcccuggcuccgccccugcccacagccucaucugucagcugcccagccccagccuggcugaccucggucuggcuuggucccaccucccuccgauugcuccucugaaaacucaauauuggaagcuggugcuugaggacaagcccuggcaggccgagggcaccugcuccucugucugcccuccuggaaccacgcgucgggucacaggccgcugggcagaggucuccgugggcccccagccacccuacccuguccgaccuggggcuaccuggcagcuccugaucccacagggcugucccuugguucuccugugcccaccuuguacccaggcgcucugggcuguguccaccacagaagcccuuugugagaagacaauggaccguucuguaaaaaccuucauuuccuagagaggggcccaccugugaccccaggaggggauacaggaguuggggggaacuucagagaugagagggaguguguccugggaccccuggggcuggcuuuggggcagaggcuaaggccaaggcccuccccauuaggccucuggagccagcacaguuacugcauccccaaacagguauguccaagucccaaaccccaggaccugggaaugugaccuuuggaaacaggcccuuugcagauguauuaagauguaaguaaagaugaggccaugcuggagcagggggagcccugauucccagguucugauagagaaaggggacauuuggacguagagacagacgcgcagggaaaaacacccuuuaagacacaggggaggggugaaggcagugguugggugauguggccacaagccaagggacaccuggagccccgaagcuggaagaggcaggaaggaucccccucgagggcuuggccuugccgacaguuugacuuaggacucagcacugguggccuccagaaccaugagagaaucaauugccauuguuuuaagaugcccagcucaggcugguugucuuggcugcccagggccccccugugaggcccaagucaaccccggcacgacuucuggugacugccagccccaggcaggacccacccacgggccucagcccccuccuccggccaggccuguggaggcgcccugaugcccucagcaccacgugggccucagcugucccugcagggugaugcaaauccucccgcacuucugccuccagagcaggaaccagcccgcggaccgcagagaggcaggauuugaauacggccucccgcgcugguggagacgccuggugguuuucuguguugggagcuggugucuguggccaggccccaggugggggcuggaggcugggacaaggcuuggcauugcuguugugucccggggcugccaaaacaaagggccacacucucgggggcucaaaacaacaaauggaugaucucauaguucuagagcccagacgucccaaauccaggcaucggcagggccgugcucccccuggaagcucucagagcggguccuucccacccuuuccagguuccugaggcgccagguguuccuggcuguggccgcguggcuccagcuucugccuugguugccgcauggucugccucgccugucuguguccucugcaaucauugauugcccaggcccgcccuaccccagcguggcuucaucuucauggugcgccaucugcaaggaccccacuuccaaacgaggucauauucuaagguucccaguggacaguauccaaccauuagugucgccccaucugggaggacaccacuuaaugcagaacaggcagggaggugggaugugugcuuguagcccugggcgggaguccucacccugggcggggguccucaggcuggccuucacucccaccaggcccugccacaccuggucacccgcuggggucaauccuggcuacguguggacaugugcccugcagcuggggaugcauggccaggcguguccccagcacaggguguagggggcuugggguuuggccaugacccucagccugggggacgggacugggcuggacaacacuguuauccucgccuuccccaugacucuuaggccauagaugggggacuccuucuucucuucccuucgucccugguggggaagcuaauggagggccugggccuugggagggguccuacagggcucccuggcccuugaauugcuuuccagugagccucagcuuugccucuuggaaguucugggauaggacauccgggaguacccuucagccuggagcucggcagugccucccugacucuaugcaagacccccgggacgaccagcagccaucagagguggaagcagccacaaccaaagcucuggcccuucccagggcccacagcaccuccuuccucccgaggacgggacagagcugggcacccagcagcugaggucagggaagccgaguagcagcguggggcagccucaccuuccugguggccgcaaccaccccuugccccaugcccaggcucggugccccccgcccccgccggccagcccagggacuaaggaggcauuuggccaggugcuaggcaccaggcaaaugggcccagagggaggugaugcaaacagcugggauuugcaugagcaggugcccaggucuucugcaccccucccugugcaucccaggguggggcagggagcccgggacagccaggggccaucgugaccccuggccagaaguccaccccagaacucccaagaggcaaaacugaggcagccccccagacggugaaggcgcuggggcucccagggcagcggggcaccuguagccgcagccaagagccaaauguggcuuccugggcuccccaagaccagcucagggcagagcuggaugaccaggcccuggggucccagccccgcucauccccaccaggcuguguaacuuugggcaggucccucagccucccugggccugccucauuugugagauuugggggaacggccagucacaaggggagggugccagaaaggucccugcgugcagcaggcuggaagucagcuguguguccuuguguccucccuaugaggaugccccaucucccugggcugcaguggaggacacggcucagggaagugguggcaagaggacacaguagugaccuggugaccccagaccccucccacugccccacucccuucgcccucagcuucugagccgcaccugccuuugcaggcugcuggccagacacugccccugaagucucagauccagagcccguggggcuggcccuccugcccagacccucuuccagcacugggcagccccuuccagaaugccccaccucaccccaguggggccggcccuucacagcccagggaagcggggauccucccugcuaaagauaaggaaacugaggcaagaggcagggguguggccaaagccgcacuguccugguccccacuccucucaugcccaccugcccuucccaccugggaggaggagguacaauccugcuccuucuccccaccugggcugucagcggugugagggucccuaccugucugccuucuccccagcacccugacacgcggcugcuggccaaggcgcggguggagccgucugccuaccuugcagggugugccugugggcccaacucucaagccucuccuccuccucuuccccgcccacaacuccuggcaccugggcagccaaugccagcccuagggagcuggccaugaaccaacacagggcaccaccucaccugcuccacacggccgagcccacaggccugcugucuccaaagccacccagacaccaagggcuggccguccucaggugugauuggcaccaaggcccugggggcauguccgauuugacugggagaggagacccuguguggacguggcuucuaggccacuuagauugcugucguugccuccuuuggcgaugucuggcgggguggcccgggaccgaugcagcugaaauccacccugaaaugugaugggacagggcucuucaccucaguuuccacaguaaguaggaacaggagcugccucaagagcacacgucucaugccggggugcugggcccagcuguccuguggaggacagggaggcagagggacugucuccucccugcuguggcccugcgaggccguggggcaucggcccccauggugucucaucugugcuggaaaggcugcacagccgugggccagcugugagugauguccauucaccggucagcaccagggaugcucugugaggacugucccugcauccggagucaggacagggugccagugggacagagugugccucuggaaucccgcaguccugggauuggauccugcauagcuguugagcuacuuagccacuugggccucaguaccuuggagugucaaacagggacucuaauagccuggcuucugggagguugcagguaacacaugaggagaacagagccugggggauaccucugugugccccuucccaaagagacuccaaggacccccuguucggggccccucaaaccauaaacuccaggaauggugggggacaguaucugggacuugcucucugggacccugguggccucucuagucuggccugucagccaccagagggcgcuaaaggaccaugggcagagucugaggcaguggugguaacgggugaaggugaugguggugguggugaugaugguggcaguagugguggugguggugaugaugauauugauggucaugauggugguggugacaaugaucauggggaccgugcugauggcgguguuugugaugaugguggcggugguggugaugguggugggcaugaggguaguugggguggugauggcauuaccguugaugaggguggugaugauagugauggugaugguggugggaaugaugacgaagaugaugaugauaguggugcaaauggcagugguggugguagugacugugguguuguugaugguauuagugcugauaaagguggugaugaugaugaugguggugggugacgaagguggugguggugaugauugugguggggauaaugguggugauggugguuauugcagugguaguguugaucaugguggugguagugaugguggucaugauguuggugguguugguguugguauugguguuggugauggugaugguggugguaauaaucaugggaugaugauaguagucauggugguagugacaauggugacaguggaggggauggugguggugauaaugauugugguggugauggugauaguguugguacuggugguggugaugaugguuguggugguggugaugauaguggaggugguaguaaugaugaugguggugguagcugguagugguggcagugguggugauggugaugauuguggugauggugaugggguaguggugguuauggugguguugguuguuauggugguagugaugaucauggugguggugacuauagucacuggugaugcugguguucauggugauggugaugaugauagugguggugguuguggcagugcugcugcugauggugguggugaugaugagggugaugaugacaaugaguaugaugauggugguggugaugaucgugguugugguguguugauggugguguuuauuguggcggugaugaugauaguguuaauaauuguggugauguuggugaugguggugauggagacgaugauggugaugauuguacuggugguguuggugauggugugguacgaugguggugcugauggucaugaugguggugggggugauaaugauccuggugguggccauggugguguuuuugauaacgugauaauguuggagaugguggugauugugguggugauaaugguggucauggugauggugauaucagugugggugauguagugguggggaugguucagauguuggugauggugguggugauggcagugauaguuaggaugauggugaugaugaugauggcaugggugcuugauaugguuuggcucuguguucccuuccaaguuguaaucaccauaauccccaugugucaaaggcgggaccagguggagguaaucggaucaugggggugguuuccuccaugcuguucucaugauagugagugaguucucaugagaucugaugguuuuauaagcaucuggcauuuccccucacuccauccugcugcccugugaagaaggugccucuaagucuauggaguuggggggcacaguccuucaucuauccugguccuucccuccaccucugucuccuggacacccaaaaaaacugcagaaguucuuccccagccaacucugguucagugccaggucauguuccuccccgccuacaaccuuccauggcucccuauuacccugacaauaaaacccaaagaagccuuggagccuuggcuucuggugaucugcuaggaucacuuuuccuuggaacuccugcuggcucccucuugccacucagauacuggcagaaccuggagugggugcuggcuugcacucacuccauccugcugcccugugaagaaggugacuugcuuccccuucaucuccgucaugauuguaaguuugcugaggccaccccagccauacugaacugugagucaacucaaccucuuuccucgguaaauuacucagucucaggcaguucuaauacaguggugauacuagugguggugguggugguggugguggcugguugugguaauuacagugguaguggugauggugguaguaaugaugaugauagugcugguggugauguugguggcagcggugagggugguggcggugauggugacgguguugauggugguggugguuuuggugguggugauguugguggcagugaugagggugguggcagugauggugacaguguugauggugguggugguuuuggugguggugauggaggcgguguugguguugguggugguuuugguggcggugauggugaugguguuggugguggugguuuuggugguggugauggugguguugauggugguggugguuuugguggcggugauggugaugguguugauggugguggugguuuuggugguggugauggaggugguguuggugguggugguuuuggugauggugacgguauuggugguggugguuuuggugguggugauggaggugguagugaugaugguggucauguuuaugguagugaugacagggaugaugcuggucgugguaauagugguuaugguagcaggccauguuauaacgcuagcagcuuugcucuggaugggaaggcuccagguacucccaaaguaggcaccuaugggcugcucuguaaaugucccuuuguccccuagcauggcugaaacccucauccugagaggagaagcagauaucagcuuccucaguaaaugcagguugguguugagcucagaaacccagaacuuggcucugagcaaaugggacucagaccagggaccccacaagcccucaggccugagacccuaaaauccuaguucugagagcgaggggccuaucuugggggcccugggcaaggcggaggguccacuagacccugaaaguccagccuaagcucacauccacuccucuagccugugucguugcccuacagcagguucugccagugucugugguaugugaauaaugaggagguucccccagauccucuaagccuaugggguugggaggcacaguccuuccucuauccugguccugcccuccaccuccaucuccuggacacccaaaagacuacagaaguucuuccccagccaccccugguucaguaccaggucauguuccucccugccuacaaccuuccauggcucccuauuacccugacaauaaaacccaaagaagccuuggaaccuuggcuucuggugcucuaccaggagcacucuuccuuggagcuccugcuggcccccucuucccacucagaucucagcucucauguccuuccucagagacccccucacccuagaccacaucagcacagggugccucccucggucucuuccccugugaucugguguuaguuuucaguaugccucacccucugaaaggucuuucauuuacuuuuuugcuugucuguguccccugcaugagacuauggccugagcauucccugccaccucccuggggcccagaacacgcagguacagaccacauguucuaaagucaaugaaugaaugagugaaucaaugggugaguguccaggcgugucucugugugagcacugccaucaaggcagagacggaggugucuaggggaggcugcauuuuugcaaggagcaacuuccuggcccacacucacgcccuggguggaagggcagacacugggccggggcuccacugucugcccgcucuagccaugggcacugcugccaggggaggaggugcccaggcgcucaccugcguccaugcgugcugucaugagggacaucccagcugccgacagagcagccucugccugcccucuacagcggguuuccuccagcggccucugucuucuuugcuacaguuggccccgggcaggcuuuacguuggaacuuccuuuggaggagaggccacgccaguagagcaggacuccaacagggcccagccccugcccccacggggccucuaucccugggacagcagauccccuuuggaucuccagcaaccccaauggcugacugcagaggcucagcucucuccugccaagcccugccaugcgaggcugggcccacaggcucagaagcugaccccaguguccaggagagcgugagccgucccugaccgggguccucgggccucugcugagagagaaggagcugcaggcuggcuccccaccugcaccacaggcagccuccccccaggcacauccuugggugccauguggcauuuuauuuacagaaagauuugcaacccacuucuucuuugucuuagaggggagaaaccaccacccagaguagggcccgcuggcccaggguccccaugccaguguggugggcgcccccaacccagcaucucccucugaaccacacacagucuagccccaggugggagggaagcagcccggagccccucagacaggaaagcugauggugggggcgucaggucugaccccucggggggcagcccgaagccaugcaguggggcagcagggccaugggcaagcucugccaguggugccuguguccaaggccuccgggcagauccugagugcccagcaguggagaccaggaguccgggaaccaguggagccgcacguccguccccacuccauuaaguucccuggcccgggcagcgccugcagcgugccacugcugucucggcaccauccuugcagcaucaccuuuugccuguccuucuacucugggagggcaaccuugaccccaucacaagaugugaacagagguagaggccguaggggccagcgaggccaaaugaccugcccauagcaaugccgccaugaggcaaggcccacgcccucuccccugcuguccuguccuggagcuuccacagcugcaggaagacgucccccuacccugcuccccgcagagggugcuuggcgaucagacagcagaucugcaaaggaagguguagccuucuuagugugcgcaagggcugcccggccaacuccaccauugagggcagaugcuggcuguggagaggccgagcgcugcccgggcccaguggcugggguagggggcuccaugcacuguccaugagggcauguccaucuggcauaugugcaccugugugagugugcuguguguggagcgggcacugggccaguggucaaggcugcaguaggacuuucagugauuccagauccugucuggaaauggggaucaugagaauuccuuccacugaagggugcguaaggccugagccagugugccuggaacguccugaggaccagcggggccggggccaagaccuggacagggccuggguaauugcgagaagcaaggaccagcgugugccugugugugucacugugcgcacauggugugugugugugcaugcauauguguggacaccgugggcauuucuguguggauguuguguguguguagcugcacugugugugcggacagcaggugugccugugggugugucugugugacacuguauaugaguguauguagacauuguguguggcuguguguggacacagugugugaguguauauguguguguagguggacuguaugugucuguguggaucuguguggaugcuguguguguguauguagacacuguguguggcuguguguguggacgcagugugcgcgugcauguuuguguaggugcacugugugugucuguguggaugcugugugugaguguauguagacacuguguguggcuguguguguggaggcuguguguguagguguaccaugugucuguguggacgguguauguguguguaugugcaccaugugugucuguguggacgcugugagugcaugugugugcguggacacugugugugcgucuguguggacacugugugacugcauguguguggcugcacuguguguguguggacacugugugugcaaaugcugugugugugugaauguguguagguacaccgugugugucuguguggaugcuguuugugagaguguguguguguguaggugcacugugugcggacacuguguguccggcuguguguguguguguggacacugugugagugcauguguguauagccgcacuguguguguguguguggaugcugugucugugagaaugcuguguaugagugugugugaguguauguguagguacgcugugucuguguggacgcuguaugugaaaguguauguguguguguguaggugcacuguguguguguggacacugcaugugugucuguguggaaacugugagugcauguauguguagcugcacugugugugugucugugugucuguguggacacugugugugugugucuguggugugcaggugcuggaaggcaggcucugcaggugcagcuggagcuucaaagugugagcauugggccaggaggaccacagccuggcugauccaggggagagaagucguuucugagguucuggaaaugacagccauugggaagcaccacaccgccacucauccaugaacucaaccauccgaucacccaucaguucaugcagucauuggauacagauuuuugcuauucauuuaucuacuuacuuuuguagagauguggucucacuaugcugcccagacuggccucaaacacuuggacuugagcaauccucccaccucggccucccacagcacuggauuacaggcaugagccaccacagccggccuggggagagauuuauugagcgacuucuaugugccaggcacugugucagggggagacacagacaacaagcaaggggauacgugagaaagaaggaagaucaaucgaugauuaagauggcuauggagaaaaauaaagcaggggaggcccagcggcugcaagauuuuauuuuuaaaugggcgggucgaggaagaauucauggagaggcugccaucugugcaaauaacuggacgaagggcggcccaucugcuggucuauccacccacucacucacccacccacucaugcacacauccaccagcacauaugcaccuccucacccaucaccacccacccagccauccagccuuccaccagccugcccaccugucauucacccaugcacccauggcaauccaucccuccauccguccaucuguccauucgucuguccauccauccacccgucugucugucgauucauccaucuauccguccaucugucuguccauccauccauccauccauccauccauccauccauccacccauccaccaaucuauccaugcauccaucugucuguucauccaucuguccaugugcaucuguccaucuguccaucuauccauccauccauccaccaaucuguguauccauguaucaaacuguccaucuguccacccacccacccauccauccaucuguccaucucucuacccgucuguccaucacuucacccaccuguuuucuccucucuccaguuacccacucaccacuuacuaacuucuccacagugccuagucucuccaggauggcgagucagucucuggucucaggaugcccacacucuggggaacaggcagcagguagccaugggggauuggccagagcaccccaagagcguaggcaguucucgugguuucuccccagccagcguaucucccagaagaggucacuauccucgaggccaggagccucaccuuccgcuccccugaccucccccacaccguaacccagcaaggcugggaauucaguaggugcccaauaaaucccggcaggcuggcugagucaucccaccuccuccuccccuacugaucacccauucagcuccuggccccauugcccaaacccugccagccuuugggugaucugcucagccgccaccucacauccacucucagcucggggccagcucugggcuccagcccgugaugggccauggugggcuucagagggugagccccccacaccauuguaccagucuggcaagacggaugagugcccuggucaguaguggcccaccuuggccuggaaggauguagggacaggcugcccacccccauuugcccuccuucucugaguggcuaggacagccaccaccacucuccagggaggggaggggcuggccugucacacgucccggacaggccugccugggcccaggaaagggcuauguguguagguggcaggcugcugcccugggcaggggccccgccagggcuggggaggccucagaccuuuagauuguggggcugguccccagcacucccacugggggugggaagcuuggcg

SEQ ID NO: 12624 - RNA, 46859 nt, Homo sapiens
cgccaagcuucccacccccagugggagugcuggggaccagccccacaaucuaaaggucugaggccuccccagcccuggcggggccccugcccagggcagcagccugccaccuacacacauagcccuuuccugggcccaggcaggccuguccgggacgugugacaggccagccccuccccucccuggagaguggugguggcuguccuagccacucagagaaggagggcaaaugggggugggcagccugucccuacauccuuccaggccaaggugggccacuacugaccagggcacucauccgucuugccagacugguacaaugguguggggggcucacccucugaagcccaccauggcccaucacgggcuggagcccagagcuggccccgagcugagaguggaugugagguggcggcugagcagaucacccaaaggcuggcaggguuugggcaauggggccaggagcugaaugggugaucaguaggggaggaggaggugggaugacucagccagccugccgggauuuauugggcaccuacugaauucccagccuugcuggguuacggugugggggaggucaggggagcggaaggugaggcuccuggccucgaggauagugaccucuucugggagauacgcuggcuggggagaaaccacgagaacugccuacgcucuuggggugcucuggccaaucccccauggcuaccugcugccuguuccccagagugugggcauccugagaccagagacugacucgccauccuggagagacuaggcacuguggagaaguuaguaaguggugaguggguaacuggagagaggagaaaacaggugggugaagugauggacagacggguagagagauggacagauggauggauggguggguggguggacagauggacaguuugauacauggauacacagauugguggauggauggauggauagauggacagauggacagaugcacauggacagauggaugaacagacagauggaugcauggauagauugguggauggguggauggauggauggauggauggauggauggauggauggacagacagauggacggauagauggaugaaucgacagacagacggguggauggauggacagacgaauggacagauggacggauggagggauggauugccaugggugcaugggugaaugacaggugggcaggcugguggaaggcuggauggcuggguggguggugaugggugaggaggugcauaugugcugguggaugugugcaugagugggugggugagugaguggguggauagaccagcagaugggccgcccuucguccaguuauuugcacagauggcagccucuccaugaauucuuccucgacccgcccauuuaaaaauaaaaucuugcagccgcugggccuccccugcuuuauuuuucuccauagccaucuuaaucaucgauugaucuuccuucuuucucacguauccccuugcuuguugucugugucucccccugacacagugccuggcacauagaagucgcucaauaaaucucuccccaggccggcugugguggcucaugccuguaauccagugcugugggaggccgaggugggaggauugcucaaguccaaguguuugaggccagucugggcagcauagugagaccacaucucuacaaaaguaaguagauaaaugaauagcaaaaaucuguauccaaugacugcaugaacugaugggugaucggaugguugaguucauggaugaguggcgguguggugcuucccaauggcugucauuuccagaaccucagaaacgacuucucuccccuggaucagccaggcugugguccuccuggcccaaugcucacacuuugaagcuccagcugcaccugcagagccugccuuccagcaccugcacaccacagacacacacacacaguguccacacagacacacagacacacacacagugcagcuacacauacaugcacucacaguuuccacacagacacacaugcaguguccacacacacacagugcaccuacacacacacacauacacuuucacauacagcguccacacagacacagcguaccuacacauacacucacacacacucauacacagcauucucacagacacagcauccacacacacacacacagugcggcuauacacacaugcacucacacaguguccacacacacacacacagccggacacacaguguccgcacacagugcaccuacacacacacacacucucacaaacagcauccacacagacacacacgguguaccuacacacauucacacacacacagcauuugcacacacaguguccacacacacacagugcagccacacacaugcagucacacaguguccacacagacgcacacacaguguccacgcacacacaugcacucacagcguccacacagacacacauggugcacauacacacacauacaccguccacacagacacaugguacaccuacacacacagccuccacacacacagccacacacagugucuacauacacucacacacagcauccacacagacacacacagugcaccuacacaaacaugcacgcgcacacugcguccacacacacagccacacacagugucuacauacacacacacagcauccacacagauccacacagacacauacaguccaccuacacacacauauacacucacacacuguguccacacacagccacacacaaugucuacauacacucauauacagugucacacagacacacccacaggcacaccugcuguccgcacacacagugcagcuacacacacacaacauccacacagaaaugcccacgguguccacacauaugcaugcacacacacacaccaugugcgcacagugacacacacaggcacacgcugguccuugcuucucgcaauuacccaggcccuguccaggucuuggccccggccccgcugguccucaggacguuccaggcacacuggcucaggccuuacgcacccuucaguggaaggaauucucaugauccccauuuccagacaggaucuggaaucacugaaaguccuacugcagccuugaccacuggcccagugcccgcuccacacacagcacacucacacaggugcacauaugccagauggacaugcccucauggacagugcauggagcccccuaccccagccacugggcccgggcagcgcucggccucuccacagccagcaucugcccucaaugguggaguuggccgggcagcccuugcgcacacuaagaaggcuacaccuuccuuugcagaucugcugucugaucgccaagcacccucugcggggagcaggguagggggacgucuuccugcagcuguggaagcuccaggacaggacagcaggggagagggcgugggccuugccucauggcggcauugcuaugggcaggucauuuggccucgcuggccccuacggccucuaccucuguucacaucuugugauggggucaagguugcccucccagaguagaaggacaggcaaaaggugaugcugcaaggauggugccgagacagcaguggcacgcugcaggcgcugcccgggccagggaacuuaauggaguggggacggacgugcggcuccacugguucccggacuccuggucuccacugcugggcacucaggaucugcccggaggccuuggacacaggcaccacuggcagagcuugcccauggcccugcugccccacugcauggcuucgggcugccccccgaggggucagaccugacgcccccaccaucagcuuuccugucugaggggcuccgggcugcuucccucccaccuggggcuagacugugugugguucagagggagaugcuggguugggggcgcccaccacacuggcauggggacccugggccagcgggcccuacucuggguggugguuucuccccucuaagacaaagaagaaguggguugcaaaucuuucuguaaauaaaaugccacauggcacccaaggaugugccuggggggaggcugccuguggugcagguggggagccagccugcagcuccuucucucucagcagaggcccgaggaccccggucagggacggcucacgcucuccuggacacuggggucagcuucugagccugugggcccagccucgcauggcagggcuuggcaggagagagcugagccucugcagucagccauugggguugcuggagauccaaaggggaucugcugucccagggauagaggccccgugggggcaggggcugggcccuguuggaguccugcucuacuggcguggccucuccuccaaaggaaguuccaacguaaagccugcccggggccaacuguagcaaagaagacagaggccgcuggaggaaacccgcuguagagggcaggcagaggcugcucugucggcagcugggaugucccucaugacagcacgcauggacgcaggugagcgccugggcaccuccuccccuggcagcagugcccauggcuagagcgggcagacaguggagccccggcccagugucugcccuuccacccagggcgugagugugggccaggaaguugcuccuugcaaaaaugcagccuccccuagacaccuccgucucugccuugauggcagugcucacacagagacacgccuggacacucacccauugauucacucauucauucauugacuuuagaacauguggucuguaccugcguguucugggccccagggagguggcagggaaugcucaggccauagucucaugcaggggacacagacaagcaaaaaaguaaaugaaagaccuuucagagggugaggcauacugaaaacuaacaccagaucacaggggaagagaccgagggaggcacccugugcugauguggucuagggugagggggucucugaggaaggacaugagagcugagaucugagugggaagagggggccagcaggagcuccaaggaagagugcuccugguagagcaccagaagccaagguuccaaggcuucuuuggguuuuauugucaggguaauagggagccauggaagguuguaggcagggaggaacaugaccugguacugaaccagggguggcuggggaagaacuucuguagucuuuuggguguccaggagauggagguggagggcaggaccaggauagaggaaggacugugccucccaaccccauaggcuuagaggaucugggggaaccuccucauuauucacauaccacagacacuggcagaaccugcuguagggcaacgacacaggcuagaggaguggaugugagcuuaggcuggacuuucagggucuaguggacccuccgccuugcccagggcccccaagauaggccccucgcucucagaacuaggauuuuagggucucaggccugagggcuuguggggucccuggucugagucccauuugcucagagccaaguucuggguuucugagcucaacaccaaccugcauuuacugaggaagcugauaucugcuucuccucucaggaugaggguuucagccaugcuaggggacaaagggacauuuacagagcagcccauaggugccuacuuugggaguaccuggagccuucccauccagagcaaagcugcuagcguuauaacauggccugcuaccauaaccacuauuaccacgaccagcaucaucccugucaucacuaccauaaacaugaccaccaucaucacuaccaccuccaucaccaccaccaaaaccaccaccaccaauaccgucaccaucaccaaaaccaccaccaccaacaccaccuccaucaccaccaccaaaaccaccaccaccaucaacaccaucaccaucaccgccaccaaaaccaccaccaccaucaacaccaccaucaccaccaccaaaaccaccaccaccaacaccaucaccaucaccgccaccaaaaccaccaccaacaccaacaccgccuccaucaccaccaccaaaaccaccaccaccaucaacacugucaccaucacugccaccacccucaucacugccaccaacaucaccaccaccaaaaccaccaccaccaucaacaccgucaccaucaccgccaccacccucaccgcugccaccaacaucaccaccagcacuaucaucaucauuacuaccaccaucaccacuaccacuguaauuaccacaaccagccaccaccaccaccaccaccaccacuaguaucaccacuguauuagaacugccugagacugaguaauuuaccgaggaaagagguugaguugacucacaguucaguauggcugggguggccucagcaaacuuacaaucaugacggagaugaaggggaagcaagucaccuucuucacagggcagcaggauggagugagugcaagccagcacccacuccagguucugccaguaucugaguggcaagagggagccagcaggaguuccaaggaaaagugauccuagcagaucaccagaagccaaggcuccaaggcuucuuuggguuuuauugucaggguaauagggagccauggaagguuguaggcggggaggaacaugaccuggcacugaaccagaguuggcuggggaagaacuucugcaguuuuuuuggguguccaggagacagagguggagggaaggaccaggauagaugaaggacugugccccccaacuccauagacuuagaggcaccuucuucacagggcagcaggauggagugaggggaaaugccagaugcuuauaaaaccaucagaucucaugagaacucacucacuaucaugagaacagcauggaggaaaccacccccaugauccgauuaccuccaccuggucccgccuuugacacauggggauuauggugauuacaacuuggaagggaacacagagccaaaccauaucaagcacccaugccaucaucaucaucaccaucauccuaacuaucacugccaucaccaccaccaucaccaacaucugaaccauccccaccacuacaucacccacacugauaucaccaucaccaugaccaccauuaucaccaccacaaucaccaccaucuccaacauuaucacguuaucaaaaacaccaccauggccaccaccaggaucauuaucacccccaccaccaucaugaccaucagcaccaccaucguaccacaccaucaccaacaccaccaguacaaucaucaccaucaucgucuccaucaccaccaucaccaacaucaccacaauuauuaacacuaucaucaucaccgccacaauaaacaccaccaucaacacaccacaaccacgaucaucaccaccaccaucaucauacucauugucaucaucacccucaucaucaccaccaccaucagcagcagcacugccacaaccaccaccacuaucaucaucaccaucaccaugaacaccagcaucaccagugacuauagucaccaccaccaugaucaucacuaccaccauaacaaccaacaccaccauaaccaccacuaccccaucaccaucaccacaaucaucaccaucaccaccacugccaccacuaccagcuaccaccaccaucaucauuacuaccaccuccacuaucaucaccaccaccacaaccaucaucaccaccaccaguaccaacacuaucaccaucaccaccacaaucauuaucaccaccaccauccccuccacugucaccauugucacuaccaccaugacuacuaucaucaucccaugauuauuaccaccaccaucaccaucaccaacaccaauaccaacaccaacaccaccaacaucaugaccaccaucacuaccaccaccaugaucaacacuaccacugcaauaaccaccaucaccaccauuauccccaccacaaucaucaccaccaccaccuucgucacccaccaccaucaucaucaucaccaccuuuaucagcacuaauaccaucaacaacaccacagucacuaccaccaccacugccauuugcaccacuaucaucaucaucuucgucaucauucccaccaccaucaccaucacuaucaucaccacccucaucaacgguaaugccaucaccaccccaacuacccucaugcccaccaccaucaccaccaccgccaccaucaucacaaacaccgccaucagcacgguccccaugaucauugucaccaccaccaucaugaccaucaauaucaucaucaccaccaccaccacuacugccaccaucaucaccaccaccaccaucaccuucacccguuaccaccacugccucagacucugcccaugguccuuuagcgcccucugguggcugacaggccagacuagagaggccaccagggucccagagagcaagucccagauacugucccccaccauuccuggaguuuaugguuugaggggccccgaacaggggguccuuggagucucuuugggaaggggcacacagagguaucccccaggcucuguucuccucauguguuaccugcaaccucccagaagccaggcuauuagagucccuguuugacacuccaagguacugaggcccaaguggcuaaguagcucaacagcuaugcaggauccaaucccaggacugcgggauuccagaggcacacucugucccacuggcacccuguccugacuccggaugcagggacaguccucacagagcaucccuggugcugaccggugaauggacaucacucacagcuggcccacggcugugcagccuuuccagcacagaugagacaccaugggggccgaugccccacggccucgcagggccacagcagggaggagacagucccucugccucccuguccuccacaggacagcugggcccagcaccccggcaugagacgugugcucuugaggcagcuccuguuccuacuuacuguggaaacugaggugaagagcccugucccaucacauuucaggguggauuucagcugcaucggucccgggccaccccgccagacaucgccaaaggaggcaacgacagcaaucuaaguggccuagaagccacguccacacagggucuccucucccagucaaaucggacaugcccccagggccuuggugccaaucacaccugaggacggccagcccuuggugucuggguggcuuuggagacagcaggccugugggcucggccguguggagcaggugagguggugcccuguguugguucauggccagcucccuagggcuggcauuggcugcccaggugccaggaguugugggcggggaagaggaggaggagaggcuugagaguugggcccacaggcacacccugcaagguaggcagacggcuccacccgcgccuuggccagcagccgcgugucagggugcuggggagaaggcagacagguagggacccucacaccgcugacagcccagguggggagaaggagcaggauuguaccuccuccucccaggugggaagggcaggugggcaugagaggaguggggaccaggacagugcggcuuuggccacaccccugccucuugccucaguuuccuuaucuuuagcagggaggauccccgcuucccugggcugugaagggccggccccacuggggugagguggggcauucuggaaggggcugcccagugcuggaagagggucugggcaggagggccagccccacgggcucuggaucugagacuucaggggcagugucuggccagcagccugcaaaggcaggugcggcucagaagcugagggcgaagggaguggggcagugggaggggucuggggucaccaggucacuacuguguccucuugccaccacuucccugagccguguccuccacugcagcccagggagauggggcauccucauagggaggacacaaggacacacagcugacuuccagccugcugcacgcagggaccuuucuggcacccuccccuugugacuggccguucccccaaaucucacaaaugaggcaggcccagggaggcugagggaccugcccaaaguuacacagccugguggggaugagcggggcugggaccccagggccuggucauccagcucugcccugagcuggucuuggggagcccaggaagccacauuuggcucuuggcugcggcuacaggugccccgcugcccugggagccccagcgccuucaccgucuggggggcugccucaguuuugccucuugggaguucugggguggacuucuggccaggggucacgauggccccuggcugucccgggcucccugccccacccugggaugcacagggaggggugcagaagaccugggcaccugcucaugcaaaucccagcuguuugcaucaccucccucugggcccauuugccuggugccuagcaccuggccaaaugccuccuuagucccugggcuggccggcgggggcggggggcaccgagccugggcauggggcaaggggugguugcggccaccaggaaggugaggcugccccacgcugcuacucggcuucccugaccucagcugcugggugcccagcucugucccguccucgggaggaaggaggugcugugggcccugggaagggccagagcuuugguuguggcugcuuccaccucugauggcugcuggucgucccgggggucuugcauagagucagggaggcacugccgagcuccaggcugaaggguacucccggauguccuaucccagaacuuccaagaggcaaagcugaggcucacuggaaagcaauucaagggccagggagcccuguaggaccccucccaaggcccaggcccuccauuagcuuccccaccagggacgaagggaagagaagaaggagucccccaucuauggccuaagagucauggggaaggcgaggauaacaguguuguccagcccagucccgucccccaggcugagggucauggccaaaccccaagcccccuacacccugugcuggggacacgccuggccaugcauccccagcugcagggcacauguccacacguagccaggauugaccccagcgggugaccagguguggcagggccuggugggagugaaggccagccugaggacccccgcccagggugaggacucccgcccagggcuacaagcacacaucccaccucccugccuguucugcauuaagugguguccucccagauggggcgacacuaaugguuggauacuguccacugggaaccuuagaauaugaccucguuuggaagugggguccuugcagauggcgcaccaugaagaugaagccacgcugggguagggcgggccugggcaaucaaugauugcagaggacacagacaggcgaggcagaccaugcggcaaccaaggcagaagcuggagccacgcggccacagccaggaacaccuggcgccucaggaaccuggaaagggugggaaggacccgcucugagagcuuccagggggagcacggcccugccgaugccuggauuugggacgucugggcucuagaacuaugagaucauccauuuguuguuuugagcccccgagaguguggcccuuuguuuuggcagccccgggacacaacagcaaugccaagccuugucccagccuccagcccccaccuggggccuggccacagacaccagcucccaacacagaaaaccaccaggcgucuccaccagcgcgggaggccguauucaaauccugccucucugcgguccgcgggcugguuccugcucuggaggcagaagugcgggaggauuugcaucacccugcagggacagcugaggcccacguggugcugagggcaucagggcgccuccacaggccuggccggaggagggggcugaggcccguggguggguccugccuggggcuggcagucaccagaagucgugccgggguugacuugggccucacaggggggcccugggcagccaagacaaccagccugagcugggcaucuuaaaacaauggcaauugauucucucaugguucuggaggccaccagugcugaguccuaagucaaacugucggcaaggccaagcccucgagggggauccuuccugccucuuccagcuucggggcuccaggugucccuuggcuuguggccacaucacccaaccacugccuucaccccuccccugugucuuaaaggguguuuuucccugcgcgucugucucuacguccaaauguccccuuucucuaucagaaccugggaaucagggcucccccugcuccagcauggccucaucuuuacuuacaucuuaauacaucugcaaagggccuguuuccaaaggucacauucccagguccugggguuugggacuuggacauaccuguuuggggaugcaguaacugugcuggcuccagaggccuaauggggagggccuuggccuuagccucugccccaaagccagccccaggggucccaggacacacucccucucaucucugaaguuccccccaacuccuguauccccuccuggggucacaggugggccccucucuaggaaaugaagguuuuuacagaacgguccauugucuucucacaaagggcuucugugguggacacagcccagagcgccuggguacaaggugggcacaggagaaccaagggacagcccugugggaucaggagcugccagguagccccaggucggacaggguaggguggcugggggcccacggagaccucugcccagcggccugugacccgacgcgugguuccaggagggcagacagaggagcaggugcccucggccugccagggcuuguccucaagcaccagcuuccaauauugaguuuucagaggagcaaucggagggaggugggaccaagccagaccgaggucagccaggcuggggcugggcagcugacagaugaggcugugggcaggggcggagccagggcgcugaggggccagugccgauccuuggaucccugccacauagagaggggcugagaugcccgaccucaccgggcagcugggagacaugagccccaugaggguugagggaauagggcugaggcgcacgcggccucuucuacccccgcuugcugaugugggagcgccacgggaauagcucugcugcugaugcugugugggccggggcaaggccuccucucucuguguguccugggccuccuggaccuccugggcaaggaagguggucucucguccacaccgccuccugcacuugagcugagggcaccugucucaccuuuucaccucuacccaggugcacccagggucuccacaucccuguccugggagcgggugggcuguguggccaggggacugcaaggccucugcugagucuuucggaguuuccaggucauccccacaaaaggccucuggagaaaugucugcagguguggccaaccugaggugcccugaguggggugaguagaggaaccaggcgcugacagcggagccccacacaucccauccucaccugggaaggagcuugguuggggcggugcuacagcgagugucggagcugcagggggucgcugggcagggccuggcuggagagaaggucccuggggcagagaugccugggggcaguccccaggucuccuugugcauguuggcuggagaggggcuucccaggggaaagcagagccagcccccugaggggagggagguggggaugggccuucucagcccucaagggccaggguaucccugcagcucuagaggccaccaugcaggauguccaaggcccccgucccggaagccccggggaugcugaagaccggcgggagcugggcuugcacaggggcgaggucaacuuuggagggucugggaagaagcgaggcaagguaagggcaggccccaggccucaggugauguccgccuugaccuggaacccaugaggccccauuuccuucccuggaagcugagugccaggguccuccucaccccuggggucugcuccccuggggccauauucagagcccccagacaggcagaguuccagagcuggaaggaguggcucuggccggccuccuaccucccugcaauaaccgggaccccugaaguccccccgagagauuuggaggugcaaggucaagugcauccagggccccaccucuguccagcgcccucggcucacugagggggaugccagcccagagaggggucaggacugcccaggucacacagcaggucaagggaggacuggcccugucccagaagggauauugggggccacucuccuccugcuaccugcccccaaugcccagcaccuccccgguacccccuguguccagcccccuugaugcccagcaccucccagugcccaguguccccccaugcucagcaccuccccagugcccccuuguguccagccccccccaaugcccagcagcucccaugccccgugccccgaaagcccugagcugcagaccugccuugcaguuuguacgggugccgagcggaguggccccgucugugcucuuugaccugcugcuugcugaguggcaccugccggcccccaaccugguggugucccuggugggugaggagcagccuuucgccaugaaguccuggcugcgggaugugcugcgcaaggggcuggugaaggcggcucagagcacaggugaggccccacccggcacaggcagcgcucccaccccacagggcagcccgacccccugacuguccccgcaacccggcacaggcagugcucccaccccacagggcagccagacccccugacuguccccccacccggcacaggcaaugcucccaccccacacggcagccagacccccugacucuccaggccaucacgagaacauuucccgaaacucucagcccguccucugcaguacccacaggugcagcagugccuacguacuggaccaggaccucccccagcugggccuggcccuuccuuagagcugcccccuccacuagcagggcccaugggccgccaugagaugucccugcucccacucaccugggaccagagcacccggguguauacagggugggaccccuuggggaagcagucgggccgccagcugcaggggccagaguccaauggcugggcuguuuuuugaggcagcuuggccuauacaacacccaggagaaaaggacuugagguuucaggaucccucacuaaaugacuguggcaaacccaaagagaucuuccagccagacaagggccgagggcuuugucauuugggaaaacauccugggauucucacccagcagaggcagcuggacagaguugugucggaugugucccggagggagcacgguggggggacuggaccccaguuugugcgcuccagguggggugggggugccacuucacagguucugggcccagccaguucugcugcugagcagccuugggugggugccuugcccucucugggccucggcuuccccaccccaccgugaggcauuccccagcacccaccccuggcucccagguaacuggcugcugauugggccuagggguuagggcguggggccagcuagggaagaccuggggcgugcggcacaacgaggcccucuuccauccccacaggagccuggauccugaccagugcccuccgcgugggccuggccaggcaugucgggcaggccgugcgcgaccacucgcuggccagcacguccaccaagguccgugugguugcugucggcauggccucgcugggccgcguccugcaccgccgcauucuggaggaggcccaggugcacguccagcucccagcaccacgaccgcugggggccuggaggcaggggcucagaaggguuugggcagcgggcagagcucugggaggacaggacucgagcuggaggaagagcagggagcgggcagagccagcacacggccggcagguggcaguaccgcauagggaacggccagcguagacuguggcgcgggcccucacccccuccuguaccacacgggcccaggccccgagcccuuuccaagccugggcaagcagcuuccgucccccaugcuggggucugucuaaggcacuaccgagggaggcccgggcagccccugguggauguuuggacgccagcccuagagucgggaaggaggugcucccggcagccugggcugucuccaugguucugucuaaaagaacccgcuccccaccgccccugccccugacugucgaaggaggguccccgggccccagcuguucgucccuccuuuugucugaaggguggggaaaccaaggcucgggcagaagccuugugcggggccccauggcguggugugcacggccuggcagggaggaucccgcagcgggaccagcccaagcugccucucgagggcucagccucgucucccugcaugggcgcaggaggauuuuccuguccacuacccugaggaugacggcggcagccagggcccccucuguucacuggacagcaaccucucccacuucauccugguggagccaggccccccggggaagggcgaugggcugacggagcugcggcugaggcuggagaagcacaucucggagcagagggcgggcuacgggggugagacccgccccagccacccagggaagccuugggacccaguggggauccagggacccgccugugggagagugggggugaccgccagggagaagggggagggcuucccaggcagaacgcaccccgcaugccugagcaccgagaccugggccgugggggccugggccgugggggccugggaggaggagcugucugggcagaguggugaaggaggcacagcuggacagaguggcucugacuggacagugacauucccaccagagcaggugcaguucuguuuucacugggccuugccguggucagaggcuccgggacucuaagaggcaaaaugagaucgugaguugaaagagggcuacuucccgccgccaggcgugagguaugcugccgccagagggcagcgucacccgagaaaugggcaccucuggccagucgcacguucaaaagcuggacuuacuaagaaaacgcuaguguguaaauaauauucauaaacaaagcauauaauuauuuauaacaucuaugaacaauauacaauauuuagaaacagaauuguaauuucuuggcaaggccaacugagcccucuguuuuuuuuuuuuuuuuuugaggcagaaucucacucugucccccaucccccaggcuggagugcaggagugcaaucucggcucacugcagccuccaccucccagguuccaacaauucuccugccucagccucccggguagcugggauuauaggcaugugccaccaugcccggcucuuuuuuuuuuuuuuuuuuucccaguagagacgggguugcaccauguuggccaggcuggucuugaacuccugaucucaggugaucugccugcuuuggccucccaaagugcugggauuacaggcaugagccacugugcccggucaacugagcacucuuuagaauugaaaacacaaagucucgucaaacucuagggacacaggcggagggucuggcucugcucugcggaagcccugcuggcccgggcaccguuuggccaggccugauuuauccuccagauucaaucaggaggcaccuuucaaagucaggggcccgccugcgagcccaguucccugugggugauucuaaggcaccuccaggcaguucacucccucacagaagacaggggcagguccaggccucucugggggcuucacauauagacaucucauuuccagcuucuguuugggggagaaaccugaagacucccuccuguaccucuucaguuugcugaguggucaggcgcagcccacccagcagagcucccucgauggucgagaugcugccucugccaugcucagcaugagcgcgugcaguguggcagugcaccuguagggcugggugcuccguuucuuccacgucacuuuguguuuuaacagccauaugccagcuguugccacaaagugcgcgugcuggguaguguagguuagcauuggagcccucggcccucauauggcaggggcuguaauaagcagccugugucacguggcccagacgaagcccacacuuuauucggaagagccagcuuuuggccagaaaaugugguggccugagagccugagauccggguggucaccccaggcggaggguccucaggccucacgggugcccuguccacaggcacuggcagcaucgagaucccuguccucugcuugcuggucaauggugaucccaacaccuuggagguaggggccuggcugaggcccccuggcuggccgaagccuuguggaggggugcgguggguucugggcaccccugggacagggcugaagggaugggggcaccccugacaccugcauccagaugucgucgggcuaaucugggguccgcucuccccucccuccccgucucagaggaucuccagggccguggagcaggcugccccguggcugauccugguaggcucggggggcaucgccgaugugcuugcugcccuagugaaccagccccaccuccuggugcccaagguggccgagaagcaguuuaaggagaaguuccccagcaagcauuucucuugggaggacaucgugcgcuggaccaagcugguaugugcugcccccuccccuguccucccgaccccuccuccggggguggggcugguccucugggagaguuccugcaaugcagccuccagcccacuccucccaccucaggcugcugggccccccacccacucucgcuucaggcccacagggagcagagagacccaggcagccccuuggucugcggguggucccaggccgggcccggugggcggugggcaugcaggcugcaaggcucaccuggggacgcugccugugccuacgcuggugucuaccacggccugccucugcccccguccuggcugaggcggccccaugggggcucuguucuggugcccagcugcagaacaucaccucacaccagcaccugcucaccguguaugacuucgagcaggagggcuccgaggagcuggacacggucauccugaaggcgcuggugaaaggugagggcgggcagggugggcaaggcaggcgccauuggggggcuucaugcucagagccgcuuugggguuuggcagccuggccaauguuugugacgcucggccgccugccccuucccaggaaagaugacacaugauucaugaagcugucuguauuuggcaaguuuuaugacguguuuuuuaccacaacuuaaaacuauacuuaaagcucucaauucagugguauuuuuuugguggggggguuguuuuuuguuuguuuugguuuucgguuuuuugagacggagucucgcacugucgcccaggcuggagugcagugcugcgaucucggcucacugcaagcuccaccucccgaguugaagugauucuccugccucagccuuccaaguagcugggauuacaggugcaccccaccaugcccggcuaauuuuguuuuuguauuuuuaguagagacgggguuucaccguguuagccaggauggucucgaucuccugaccucgugauccgccugccucggccucccaaagugcugagguuacaggcgugagccaccgcacuagccaauucagugguuuuuaguauauucgugagguggggcgaccaucacuuuuaucuaauuccagaagccuucaucgccccagaaagagcccauaccccuuggcacucacuccccauuucccccagccccugggaaccaucgaucugcuuccugucucuauagauuugcugacgggcauuucguguccaugguucccugcaggcagcgggaggguuugacgguuccuccguguugaagcguaugccauuccaugcuucauuccuuuuguaaggcggagucagguuccagccuguggacagaccgugguugaugcgucuguucacccgcugauggaaaauuuugaugagcauuugaugugcuuuuugcuggagacgaacgcgugcugaagggcuggacgcuggcaggcagacacagccccagcagggagaggcacugcuaagcaggggcuggggacaccuugaggggacgcucugggaagggugucuggacugcggguggcucuggguuuagaaaccucaccaggacaaggaggucaaagaaaccuccccguuuaggaacucccccgccucuucucaccagucucaguuuggucccaguggccugagagaggcaccguagucuuacgggguccaugguuguggaggcugaggcuggugagccucacgugcgagucuggugaggacagcgguuuccagcaggcgcacccagcccaggugcugcaggccccccuugagugacccuggugaccucaccaagucauggccaaaugcccuugcccguggaggaaacguggcccagcuugcucccccgacaacauccaggaaggguguccuggaccuucagugccaggaaguggccucgaggcccagguguuagcugggguacccccguugcagccgaggaaguugccucacaugggagcagacgggccgucccgacgcagaccagggcagcacgcuuucuccugcgguuuguacaaagucucgugccuccugcuggugcucagagguggcgcaugugcccccucaagucccagcgugaaguucccguuuccgcgucucuaggcagcgcaccuuuggggacccugugccccggcucugugaggcccucagcuccacccucaccagugccugccugcucugcccacagccugcaagagccacagccaggagccucaggacuaucuggaugagcucaagcuggccguggccugggaccgcguggacaucgccaagagugagaucuucaauggggacguggaguggaaggugccucccagcccugccuacccaccuccccaucauggcacugcccgagcugcccacgcugccugcuccugcacccugugggcugcuuggcugagcccguucugcccagcugucccaagguccggggcaagaccaggccacgguucugcccgggcuucugccucgcucacuggcccaggcagagcuggcugggugccggcuguccccaaagcccaaggggguugugacacccucagcauuugcucacgacuggccccucugugcccgccccaaugcagggggcaggcuggggugcaggagagcgagagggucugcgugaccuggcccuggggauggauccccaugcucccugcucucuccuuccuuggacccccuccuccugucucucgcucacucucuugucccccuucccucgggugcccauggccgccaaguccugugaccuggaggaggugaugguggacgcccuggucagcaacaagcccgaguuugugcgccucuuuguggacaacggcgcagacguggccgacuuccugacguaugggcggcugcaggagcucuaccgcuccgugucacgcaagagccugcucuucgaccugcugcagcggaagcaggaggaggcccggcugacgcuggccggccugggcacccagcaggcccgggagccacccgcggggccaccggccuucucccugcacgaggucucccgcguacucaaggacuuccugcaggacgccugccgaggcuucuaccaggacggccggccaggggaccgcaggagggcggugagcgggggcuccguggggauggagggcgaggcuggggccgcagcaggaggccgacgcccguguccuccaggagaagggcccggccaagcggcccacgggccagaaguggcugcuggaccugaaccagaagagcgagaaccccuggcgggaccuguuccugugggccgugcugcagaaccgccacgagauggccaccuacuucugggccauggugagcccaggccgcgggcccagcgcgggggcaggggaggggcggccuccugagaccaggucucguagggccaggaagguguggcagccgcacuggccgccugcaaaauccucaaagagaugucgcaccuggagacggaggccgaggcggcccgagccacgcgcgaggcgaaauacgagcggcuggcccuuggugagugaccggcggcuggggccgggcccgcgcgcgggggaggaugugacggaggggucggacgaaggguccugggccucgccagggcugccuguuaccgccguggggcuccaggugcccucaggggccuccuccauaggagaggacagacggcucugccugggguggaggcggccccagacccugagugugggaccgcugugcacguggugaggacgauacagccucacaccccgggcauacacugggcccugccgcaggacgagggacauuuagcguggcagagguucccuuuguccugcugggggagggacagagccggagaaggacggagguucaggaagggcccggagcaggccggagggggcagaaggccuggcugggcccugcguguugaacgcagggugcggcugcagagcccaggucugggcaggggauggaggaggggcgucgggggccgggccgggcaucggcgucucguccuagcggccagggccuccgggggcagaccucuucuccgagugcuacagcaacagugaggcccgcgccuucgcccugcuggugcgccggaaccgcugcuggagcaagaccaccugccugcaccuggccaccgaggcugacgccaaggccuucuuugcccacgacggcguucaggugagugccagcuguccucgaggagagcugccaggggguggggugggcgggcgagcugggcccagcuugaguugacuucccagccugcagcugcccugucacucccguccucagcacagagggggcgggguggggcuucuguuccuggaaggcgcccaccuggcuuccuccaccaggcacacuccuccugccucuggccucaguggaaguggcacuuccuccucucaguccuccccaacccccaagcccaaucuuuucccuagugaaggguacagcagcucaacccacaccccugggaugaguggcccaaggagcacaugcccaccaggacgggggcuccgggagggagggcugggcugggcaccccuucagcucacgugggccaggcaccugggggaagggcauuccuggggcagggcgcagccugggcaaaggugcagaguuggagccgacaguuuugccuucaccucaggccuuccugaccaggaucugguggggggacauggccgcaggcacgcccauccugcggcugcuaggagccuuccucugccccgcccucgucuauaccaaccucaucaccuucaggugggugaggccugugagcugcccggccaggacaggcagcagugcgagugccggagcuacggggagggccugggccucgcaggugcuggugguagccugacucuguagcccccaaguccagccucccugcgggucccacuccccacagccccugcaucccagugggcacuuugauggccaagcgccuggagccaggcaggcgccucugggagcccuuccugcgggcccugagcucuccugugcucgcagugaggaagcuccccugaggacaggccuggaggaccugcaggaccuggacagccuggacacggagaagagcccgcuguauggccugcagagccggugcgaggcacagggccaggcaggguggaggggacuggcgggugguggcugggaggcuggacucugguggggcacccggcugggcgccagccucaccacugcgaacuucucugcggcacaggguggaggagcugguggaggcgccgagggcucagggugaccgaggcccacgugcugucuuccugcucacacgcuggcggaaauucuggggcgcucccgugacuguguuccuggggaacguggucauguacuucgccuuccucuuccuguucaccuacguccugcugguggacuucaggccgcccccccagggccccucagggcccgaggucacccucuacuucugggucuuuacgcuggugcuggaggaaauccggcaggucgguggccacacuagccuagguccccuccacucugcagcuucagguugggcaaccuaagcuggguccugcccucgcaggguggggcuccccaacuguaaaacaagaacagcaugggggccucccaucuucccagucaccagcggccaugauccuggucaaagaccgagcccugagcccugcuccagacugagcaugaccauggucucccucgucagagucugaacccugaccuguaucacggacugaguccagacacugcauaaacugaucccuagacccugggcacaaagaggcccuggccccaaguggagacugaccucaccuucuguccccagacagcccuggaauagcuucaguggaccccuagucccacugguagccucggcccuggucauagauggaacccugauccuuacagauccaagcuuguccagguagggcuguccccagcgagggcggcuggacagcugucaguggacugcccaccucccucccagggcuucuucacagacgaggacacacaccuggugaagaaguucacacuguaugugggggacaacuggaacaagugugacaugguggccaucuuccuguucaucgugggugucaccugcaggucuguggggcccagaggccguguggccucagggcggcuugugggcaggcuuccagaugaagccacucagguuggguguggcgguggcacuuguggucccagcuacucaggaggcugaggugggugggucacuugagccagggaaguugaggcagcagcaagccgugaucaugccacugcacuccagccugagugacagagcaagacccugucucuuaaaaauaaauaaacaaaagaugaagccacucagggcccaaggaguccuggccuggcccuggcccugcccgcagccagcaugcugugugccccuggggaagccucugccccucucugggccccgcagccgcaucagccucccauccuccaggaugcugccgucggcguuugaggcuggccgcacaguccucgccauggacuucaugguguucacgcugcggcugauccauaucuuugccauacacaagcagcugggccccaagaucaucgugguagagcgcauggugagcccccgggggcccuggcccuggcccuggagggacagcaauccccugccugggccccacccggcuggccgcugacgucccucucucugccccugccccguggagaugaaggacgucuucuucuuccucuucuuucugagcguguggcucguggccuacggugucaccacccaggcgcugcugcacccccaugacggccgccuggaguggaucuuccgccgggugcucuaccggcccuaccugcagaucuucggccagaucccacuggacgagauugaugguuugcacacagccagcgggggcaggggcagggagaaauuggagcccugugugcacaagcccugggcaugaggcucuccagagaggucuguuggggccauggagaccccagccuggagcagagaugggagaaguggcugaggccugguccccaggccccccacaccccaaagggccaggccugguuccugagguagaggcagcuccagucacggagccccgaccugggaccuggggccuugggcugggaaggagacacaaggagaccccaaggcagccagggcugccuccugcuuggggaggccaagcagcaagucuugcucuggggguggucuaucgguggggaagggauaggcaggcacuaagggcacagagugggcccaaaggcugucccagccaucauccggggucugggcccuccagcucuccucacagccccuggccucugcccucccacagggcccugcuuggccuagggcacccaccagagccccuacgccguccugcuggcaaggccccuucgccauuuggccgcuccuaaaggcacccuggcugcuccuggggacccaccccaauguguguguguggccugcccaugccuauggguguccccaggccgaccccuguagcuggcuggggcugguggaggcucuggaaacuuuuucauaagccagugcaguggggagggggcgggggucagagccgcuuggccaugggggccucuguagugauggguugguggggagcucugggguggggcagggaccugugcaggccccugggauggcugggacucagugaggagccccaaccuggaaagggacgcaccccucugggaagguggaccagcagccagcccgccccuggggcccucgaggggugccgcagacuuggagacccggcagagaaggugcagggaaacugcucaggcggugucaggcggcuggggcugcccggcacggggcagucauggcacaacgugcugcccaggccugaccccgaccucuguggaguggcgcucaggacccucgauaaauauuuguugaggggaugacggccagaccggagcaaacacaggccuccggggacaggcgggggcgacgccgugauggaaaccgccucucccagcgcggcucauuuccuugggcuguuuucucagcccccgcagccccuccugacauuuugguguuugcucaucacaggcauucauuuuccaggccauuaguuuaaccagacccugccugccugcgaccccaccucgcccucaccauacggccuccagcacugcccguccgcagggccccucggggcaggaggagcucuagacgggcgccuccagccagggcaggguuggggguccccucuuucuugaguggcugcaucucuggugggccagucucagcgacucguaugaggagacaggccuggccauagccuccuucucgacgggagaaggcagggaaacagacucccgaggggccccugcuccgagugcugccucagggaggucugcggugcugcggggaucucagagccccgugcugaaacgccugcaacagggccagccccggccgcccacugagagucucagacuugucacuuccccucccugagcugcaauuccuugggcuccguucagcugccgagcaaguaucugggcccuucagguugaaccccagccacucacugugacccagccccucaugcugcuaggcagggaguuauucacuaacacaugcugggcugagagggagacugaggcucagacaguuccuguacagccugcaggucuccucagagcccagaacagaccccugccccacucugcacucgugccgagccggagcugggguugagcuguggugacgagcuuguucucugggucuccaggccccagggacaauuuaauuuccagcccggccugguggcgccuucccaaaucacagagucggggagggugugggggucucauuccucagagcugccuuuaucagacagauuuacggcuucacaaacaggcucuccaggcuggccccggcccgcuccuccagagugcagggaggagagggggucaucagucugcccaggaacagauucaugggcuggagguggccagggcggacagaggaggggcaggccuagggugggagcguggggagggcuggcgcucacugacugccagugcacacacagacacucaauaacucacacacgggccaacgcgucacacuaacucacucgggagaaacaaggcaggaauucacccuaggagggagaacggaccccuccagcucaggacccaggcacagaggcaggaaccugggaacaaggagaccccccagaacccaccgcagggcaaccuggagcuggcaggcacuaagauacacuugaaugugcccgugugugccagugugcucacacgcagacucacacaugagcaugugugccaggcacauccaaucacauguacaggcucacacagacacacgccagcgugcaggcuggggagggaggagagagcggagcucccauucggauauggaggggauaugugguccuggacggccagggcacacucuggccucuggcugggacccugagcacccugacgcccacugcggcuccuuccucccuccucccuccuccugccccgcaggcugggguggggugaggguccaggguugagcccuacaagggagaagcaggugugagggucugguuuuaagggacuggagugagaucugccaccccuccagggugucccugcccagggccgagggagcucagccugcaagcucccagagugugccgccugaagaauguucuugacuugaguggcccagugcgggaucggugcccucagagcuugcagcaagcccagucuggagccugcuggcucaauacauuuuggaaagguggcggaauuacuugccagcuugggguuuaaucacaggcauuagugcuguagaggcucugagaaguccugggccccaucucccuuuccucggcagcucuccccaaaccuucaacagcagaggcuuuuuucggaggagggguggagguuuuaacacauccaacaaccaggagaaaccugggucccgugaccccucugucccccaccuuccaucccuccaggggucuuggcucuacuuccagggccugugaucuuggcugacuccagccccugguggaagcucagcagacauggcagagggggcccaggguggggcucaccacccgucugguucugguuugcugugauggggcuuucacugcuaaaacccaggccgcccugggugaacugggacagugggucacccaaccagcaccccguccccuggguucaacaccaggacucagcgcucuaucucggggcauuugccuaaggccgcccuuguggcugcccccggucugguccccacagcacccuugcuuuccagaagcccgugugaacugcuccacccacccacugcugcuggaggacucaccauccugccccagccucuaugccaacuggcuggucauccuccugcuggucaccuuccuguuggucaccaaugugcugcucaugaaccugcucaucgccauguucaggugacuccacccaaccccuggaggagagagcccuggagcggagggagcagagggucauuccccaacaccgccuccuuugcaacccaccuggugugcugcagagggugaggcuuggugccucagggcagauagaagguggcauagccuggacugcagggcuuugccugcccaagaccgggaacucugugggccacccucccagucccaggaagcagggccugggucuuugggggaccggugcuguggcaagaacucugggcuuguccaggagagcagaguggacaggggaagacccaaggagaguggaccccucgugacacaccccagaggcaacgcagaagcagugcugggccucaguuucaaaaagggcuccccaacagcaaucagggugcagggggaugcgucccccaaguggucguggggagccgguaggugacggcucagcugugccccugcagcuacacguuccagguggugcagggcaacgcagacauguucuggaaguuccagcgcuacaaccugauuguggaguaccacgagcgccccgcccuggccccgcccuucauccugcucagccaccugagccugacgcuccgccgggucuucaagaaggaggcugagcacaagcgggagcaccugggugaggccgagcacaagcgggagcaccugggugaggccgagguggcgggucccagggcggggcugugcgcuggaggcaggucuggagagaccuggaccccuccucagcccuguggguccucagcugggcucugugcaggcuggcacagcugagcccguccacccgcagcuuggccguccuugcacagggccaugcuugcccuccaucccuggcugggccccacucacuccuucugccuggcccaccucgccccgggaccaggccugggcucugccacugacgcccacaugcucuaguaaugcuggcugccaccuggcuuucccagagagagaccugccagacccccuggaccagaaggucgucaccugggagacaguccagaaggagaacuuccugagcaagauggagaagcggaggagggacagcgagggggaggugcugcggaaaaccgcccacaggugcgggggccuguccugaucacugguggguaucgggcugucuuuaagcggggaugugccauuggcgccagugacagaggaucugagcuggcgaacugaagcugaagggguaggggcagggcucuggccgagcccaggggccuagcuuuccagccugaccugugcaggacccugcugggacgccuggccaggcaaaaagggagcgugcacagugaccguggcgcccucccugcuguggucucaggguugggacuacccaccccuggcuucccuccagcccuggcuccaggggccuguccccgacugccugcccugcaccgucuuucuggguggugcgcccaggcagggauggcacccuagcccuacugggaaggcauagagcgcucuguacugcaccaggugcacuuugagggguccuggugccaccagaucugggcaugagggaggaagggaaagggccagggcaccccaaacucgggcacacagggaggccuggggggauggggaggcuccccacacgcagagcaccgcguggccauccacagccugaccaccugcuccugccgcagaguggacuucauugccaaguaccucgggggucugagagagcaagaaaagcgcaucaagugucuggagucacaggcaagcgagccccagagcuccucucccugaugggaggcggguggcugcguggggcuacugggauggguccacagcccugcccggucacucacagagaugaggcaggccagagccaggacaggagcaccccagugggcagaggagcguucuggggaagacaggccguccccaccugugccuccucccacccugccacuugggaggcuacagccuuaaaugaggggucucacauugaagaccccucgccuuucacucuacacgccucacgggagccucacucaccccugccugugagcggcagcucucagagggaggagucacagggcagcgggggcccuggcaggagaggggagauggggaggcugccuguccccugcuguccugagagagcccuggagcuucccggacguguuucccuucuccagaucaacuacugcucggugcucguguccuccguggcugacgugcuggcccaggguggcggcccccggaguaagccuguuuggggagcgugggaugagggugggcaugggcacccacucugcagcggcuggggggccguaggcugugcugugugcucugccuucccugccuggcccgggagucucaggaggccuuggcuggacgcggcucuucaggguggugugggugcccucugacggagucccugccuuggccagggccgaaugugcuucacucagacucuugaggcucugccuggcgugggcccuauuggacuguccugcucagcaagcaaacgggccccucggccucaagggggcugcuuuccuagucccaggagugcaggcagaggccugguugucucugggcuccccaucuuccccaggcuggccuguggggacucacucugagagccacggcguccuggcccuugccucugagccagcuaccucuccccuuccugggccugccuugcugguucccaccgcucaggggggccuuccuucccagcaggcucucagcacuguggcgagggaagccagcugguggcugcugaccacagaggugguuuagauggcugggaacaacccggggcuggccagccucccucggacaccugagcugcuuggccugccacguguggggccaccucuccucagcuggccacccugcacguugugcacugaccuuugccgaccuccagcggaaccccccagggggcaccagccccccagcagacaauggcccuccuggugccucaccacagacccucacccaaaggaaccgcuccuugucccuccuggccuccccggaggcacagcagugucauggggcugucuccccugacaggcacaacuccccgggcagaaaacgugccccaccgcaucccuaccuggaaacugaccagccugcacuguggaaaagcuggcccuguggcgugacgggggagcacccccauccagacugcgaagcugcucuggggucugcacccaccccugcccugacuuguguugccugacaagagacucaucuuuuuuugaaacacuggugguuagaauuucugucacuuaagacccaaaagguccuuuggggcucaggugacuggcuccuggaagacagggcugggcauccacugcaucugucagcugucccccugacacccgauggccaguacagcacacacugguguuuauggccccaagacaaagccccugcuggcaccaguggcugcuuuaucuucaguggagccuggaaaacacuguaccccacguggcccagauaaaacuggaccccaggcucaaacaccugcccaggccccccaacugcccacucaccccagccuccucuguccacacccauuuugucaucucccuuucgcuucccaagcuguggucugcacuaggccuggggcugauggcaucaugugggcuuugguugggggagggcagauucuguacccacucaggcccauugagggcacucacuggacaccugccacugagccacaagcccuagaggaggccugggguuuccaauucucacugucaccugggugaugugcuggugagggaugcaggugucagccacccucgagugguccggcaccgagggucagguguggggagcucuugcugccaacugagcccuuuggguaagcagggcccagauagacacaaagucucagaaagacccaaaaccuuuauugucccuaccagggagccagugcuuccagcccacaccccacaccccaggagcuucagcaaggucucugcuugggaggaugcugcccagaacugcagccagggccaccggugccaccugcaggcuuccucccauuccagcuaggcaguggccaggcugcccccugaccagccccacugggaaggcagcaggauggcaguggccaguggggucaggcugggccaucucccucucagaccucagcaccuggguccucggggcugcugcucuuguuccggaaguggucucgacuccgcuuccugcugccauggaagccaacaguuuccaccggcgggagaccuggcacagacccacuguggacagacccugacagugccuccaccuccugcaggccuccaugguggcugccccacuccucagccucugggcucccgggcccggccagaugggccagcuccacagggcccucgccccugucuguggcaggauucccaaggccgccccugccuggcucucccaccuuccccaggacccucuuccucucgugucuggcuucgaccccucggacugguuuggugaagaugacccuccccuccccacagcuggagggauccugguugaaggaggacacgcagucagugggggcagccaggcucugggagcccaggaaggccagggcgguggccugauugcucugcucgcugaccucggucacaucuuccaggcuguacuugguccagcgcucggggugugccacguagucggggaccggaggcacccuuggugaggcagggcuccgaugggcccugcccaggccuuccacuggagaccggccugagggcgcuaggggccgcuugaagccuccguugucacucaugcuggugugggccacagaggauggagcccgucuggccgcccccuccaggcagucaaagaugucacggcugcgcugggagaagguggagcucaugccucucagauggaauggcugcaccguggcugggaggaggccugacgggggugagggcggcucaucaggaccugaauccuccuccccaggcagccccaucggggacagugcuuccacuucagcaccaccgggcaagcugaggucagaguccgagucacugagggagacugugucggaaggcagcgugucauacuccgucccguguucgcccuccacgcugggggacggcucaccuguuccugccucagccaugcguccccagggccacgccacaccuaaaccaaaacagcccagaaaauuuguuucucaggaggaacaguauugagaaugaguucccccugcagauccacugccccuggacaaguggagggucaacugacagaacugucccacacaggguggagucccgccucccccuccaagcccuccucucaccucucuuggcugcugggugccagugguugacacuggagugugauuggacagccaagcgggccaaguggacggagcccugaugaagguccucagcggcacaggcguggucgucucaggccucggagugccccggcauggccucuguucagcugcucaacugcagguggguggggugggggagaggaccaaccucagaccggaguguacaugugugaaacaggugccgggcaggaccgaccugagccuggguuuucggagccccugacaggcuaggacccaggguagggacuuuugacucguuaccucauuuaauggugccaacccucugcaggcaggcuuggagcuacugagcgauuuugguaguaagcagccacccagggcuugaacccagggcugaaaucaggcaggagggccacuuauaagcugcuugcugugcggggugagcagucguauuccacaaagagcgugcaccuuccugauccacggggaaaagauuugcuccuauuugcuggaagauccccgggagcucccaaggaaucugcagccaaggcccuggcaucugagggucaagcucucaggaaaguggggugucgaccaucaccuugagcagcccuguuaggcagagguaaauccccgcggcuccuggagcgaccuccaguggccuuccaccuguaacacucagcacauacccugccuuuccagcugggcagacaagugcugccuccugcacccauuuagugcuggagugacugggugccucagaacuugaauuuccaggcaaaaaaagacggcccagccacacccuucugcacuguccucagccauccauccaccgacuccucuccugcuaccaaaacuccuugcccgcccagagugaccugugucuugugcacccaauaaggauggggucagggguacuaucaggggcucuuagugccccccaccaggucgaacacaggcaggaccucaguuccucugaggcgcgacucuccucagugaagaagccaccccagugaaaggggauacgcagcaccccccacugaugaccguuuuaaagcuggcaggaacggggcgggggaaauaauuugcccaagucacacaguauguugcagacgaagcuggaguucaaccagaacccugcuucccagauucgcacucccguccucugcagcggaacgccgccgcggccagaagcagccuggucagcggggcacuccgacggguagcggggaucgggcugcaagauagggacuccgguaguccguuucucgggguucucggcgaaagccggcaacgaguggaagguagaguugacuccuucauguccguaggcugaaggaagccgucucuuucuccacaugaacgcagagcccggccuuucuccacuauaugugccagcaagaccuccccgccagagaacaaacgaacucucggugccaagcuggcucucggugccccucggcacuguccagucgggcuggacaggccuccgggccucacaaggaugcugugggucccaagggcccggccgcgagguacgggggucggcgagcacagcggggccuucgagcucagguauuaaagcugcgcucggugaccucccggaggcucggccggcccgcgcggcccguccucccucaccacaaaccuaccggcucaaggcugcucggcagucuccaucuuggucggcgccgcaccuccgugcggcgcgcucagcccucugggaaaccgagugcucugccggccgagcaccacggcuuccgcgccugcagaacuacagcucccacaaggaacugggccgccgcucccgacgccugucgggacguguaguccugugcgcaugcgcucgccccucuacuccuccacgccccggcccuuggguccggcucggaagcagccccggaaacgacggcauuuguuggggaaacaagaccggaauugaccaagaacaggaagaggaggggccaggccugcaauucccagaaugcucgagggcuaaccgacagccaggcuggcuucccguggucucagcgccaccugccggaagccgcgagaacagcggccgccucaggcaggaagugcgucaucucgcacggaggacgaaugccguucccggcacuuccgguccugaccggaagcgguaaccgucacuccuucugggcucugucagugcaccgaggcggggcuccccaggaucccacggucccgcucaggccagacgcagaggcagucccagcccgcgaugaggacguggggucgugaccgcugggccacggugaagggggcagcccugcuggacccgcuagcugggccgacgcuuucccaccccuagggguuugcugggcccuggccgcaaacuuguggggcgccguccucggggccacugcccggccacccucacacccuugggcccucagcucuggugcauugguccgggcuccgggaggcacugagacgucccccuagggcgcugcagggaagcgagggccaggcccuuccagguccccgguccucccgggcaggauggaggcugcugaacgcuccucaagcuuccaagucagccguggcugggcgggcggcagcagggaagguuugggcuccgccaugcuugcgagccagcagccuggccucgccuguccgcagcagggggcaggucagcugcccgcccugaaagggaggaccagggcccagauucucccugcgacaagccgcgucuuccuuggccacugggcccuagaugguuggcaccuugugccccuucucagcugggagaguuccugccccacacacucaaggauucugaguucuccuuggcugcuagaccucuggucccucugaaaggcucgagagagaacucccccagggccugcuguccuggcauccgcugggaaauaggauucaaggaccugcuguggcucagccuagaaaaaaggaggggaagcaggacccacuccucggcccccggucugcugugcgccuuugggauuccuuauuucuuaaacugcucuucccuccccacagggaacacagcggaaaguagagagggggcuccuuggaccauuauguucucccaaccagugcaggcuugcaaguugggagcagcaggggaggagggccugcugagagacucuguaacccccuaaaaugcagggcuggggacaguuuccaaauuggccugcaaagaggcugcugggagcccuagauaugaauucccaggcacucauuuccuccagggaacagugaaaugugccagcaccccccuccccacaacuagggaaaaguagccuaacccagagcaagccccaccccacgauguggggaaagauaggagagucuagaccaagcccacuggcuggaggugcucagacaaagggaaaaggacgggggagugcaggggcuccuuagccccacagccugucugcccccaaccaccgcucgcuggugggcugggggggcucccuaguaggaugaggucuuucuuccccuccagacccucugagauguggcucaggccugagccaucagcuccucaaaggaacauuuacagguaacagaugggcagggcagagacccucaaaugcucgggagggggcaguguguccauccuuuaccaucccucaggaggaagaggaguccugcagcgcacccagccccuaccccaagcccaucucacugcauucccuggcugcccgaccccuccugcccaccugcuuacacugugugccccuugugugcccaaggggcaggguggaaguggcugcaggcaacacagggccucucccaaaagagaauagagagaacgcucccaaaaagggcccuugcuaccuggaguugcucccugguuuaaacccaaaguaaaauucuaagcaaccccaaccaacugaaugggcaccucuuggccaaaugcauucuaaaguaaaccugaaaagcucguugaggccaugaugacuguggguggccgaacaugccucauaggcacagcugaccagcauucacauuaaaacagagaccuuaguccggugugguggcucacaccuguaaucccaaaaccuggugugucacgugaggucaggaguucgagacuagccuggccaccguggcgaaacaccgucucuacuaaaaauacaaaauuagcugggugggguggugcaugccuguugucccagcuacucaggaggcugaggcaggagaaucgcuugaaccugggagguggaggggaggcugcagugagcugagaucacgccauugcacuccaaccugggugacaagagcaaaacucugucuaaaaauaaaaagaccuuaagacucacaaaacagacucuguaguaauaagauaccaacgugacagcaggcccugaaagaaaccgaaguauuuuaccccaaaauauauuucucugauguauuuugaaauggcccugcaaagcugucucuugggaaaaucuacauucuauagagaaucccccucccuuuccaggucuauuuccugauccaggagagaauuaacuaagauucugguaccuuuuuaagucugauaagaaacauuuacaaucuggcggcuucaucugcauaauaaucuuggucuccacaacuccucuuaacccagauaguccauucuauugauuucaggucuuuagauaaaaucaaccaauuauuaaucagaacaucuuuuaauccgccuaugaccugaaagucccuccccuucaaaucgucccaccuuuccgacuaaaccaacguacaucuuagauguaaugaucaauguccuaugucccuaaaauguauacaauuaaguagccagaccgccuugggcacaaguucucaggaccuggggcugugucacaggccaccggugcucauauuuggcucagaauaaauaacuccccaaauuuuacagagugacuccuuuggugaacaccagggaucccgacccacccacccucacccuggaccccacagaguccacagagccaagccccaccgaugucagauuccccugcccuccggccaaccccuaggucucagacaccacuggcacugagggacugcacaggccugguagcaugccugauguuccuucuuuauuaaaugacggagucaggauguugugauuacaguugaaggcgacguguuagaaaggacaggugcaugaaggcagagagugcccacagacucggcucucgaaccggggcaggagggaacaaggugagcugugcagcccacaggacgggcgggcuggguggacacagccccccaaguuggccaagcugagucucugggcgaguggcucccaggagaggccuggcugagcaggcagagcacccugggaccccagggcagaaggaccccugcccuccaguccccaagacccaggcccgucuccacucauacacgccaccuacaugugacgucagcccugaaaagguaacaggaaaguucagaacaaaaacaaaaccccaaaaguaaaaaggcuacguguagcagaguaauaccggaaacguuauauacacaggcggugauggcccccucggaaguguccgggucacuuagggggcacugcagaggucccuguggccagagcugcggggccucaguacacggagcuguuccggaugccacagcacagcaccaugcucaggaucaucucgaagaucugcaggagggugguggggggcgcagucagcacaaggccccgcggaaggggcagcccagagagcaggcccuccgcccccgcccgcucaccaugaucacagcgaccacgauggcagcaaugccgaugagguacagcuucccggagaagaggucaucgaucuucugguggcaguccuccugcagggguggccaggcacgcguggucagggaccgggccucggcucccggcuucccguugucacgcaguaauccguggucaccacagaaagcguagaggggaauccugggaacagccccccacccccuacccaccucggaacaggcgggugcagcggcccggccucugccggcuugcuaucuuccacccguuuuaacauaaacgcgaaaugccugggacacacugugcccuuuuccacugagaucacggucauuggugucacuagaccccuaaagcaucacugaugacgacuuccacugaggccucagcaggaaacuuccacagggcacuauauggccugcaggcccugccagcuacaggcugucaggggcguccacacccacgagugcacacguggagcugggggugcaggugaguucccaccccccagagccuccaccuucuucacccggaaugcgcagcacagggcgccugccuuccucgugggccagaugcggucccaccccaacccucccagcagagcagcccugacaggggccaugccacccaguguggucgcucccuguggggcugccgugugaccugcccaccccuaggaccccacccaggggcgggacaugcggggggucaggcgcggccccaccggccucgcgcaccuugaagagguugcugaugauguugcugcccgagggacacaaauuguucuugagcacugagguggucaaagcagucagugugcuggagccacagcagucaagcugcagagagcaggggugcaaggucagcccuggaugugcccagggggacgguggcucuagggaacccauggggagguggccagggguacgcagcgcuccccacugcagaaugcauccaggggccagccuucuuccuccucagcugcgcugcucagagcuuuccgcacccugggccacccuggcccacuagguucccacccgaggaccaguugagaccagggguccuggaggucccaagggcaccuccugcuccugaggucugggcguaggcaggauucauccaggacgagacacaccccgccggguucccggggcccugcuccccgcccucgccccccggggccgcaccgucucguggaaggucuucaccacagccuuggcguuguuggcgucaucauccaccacggccugcuguagggccuggucauagaacugcuucacauccuuggcgaucugggggaggggugcggucacaugcacagggggaaccucccccuccuugcccccaccccgccccgccccaggcggacgcacuuuucccaggcucucccugggcaggguggcuucgaggcuagaccccagaggacaaggacucugcacucucagcugccccgggagugcugggacacgggaggcuggccuggugcucagccccaaugcugccuccuccauaaagccccuggagauccuccuggcaagugggacccaggaagagcccaaagagcucccacaagccaugagucagcccaacccccacccgcgacaggagaggagggugcccccgucacccaccccacccugucccugcacacccaggcucaccugguccuuguugacaaagccccagaugccggcggccaccucacaggcaaacaggaugaccaggcaggugaagaacuggagccgggcaguggccagagggaggaaagagggcaggcuguaggcggggcccaaggacacacacccaggugcccagcaggcgugucugugaggggcuagugggagccaccagcccacgaccugaccaggagugagcggcuuguguggagcccuggggcacagaggcuaaaacucagcgcagggaggagccgucaaagcccaggauguccccacgcggcaccaggcuccacaggacgggguggauggggcggggcgugugguuuggggucacaggcuggugaguccaggaugucugcagcccccagggaggcgugugcagcagcaugaccccugacugaucuuccccacccccuuguuccugcuccccacggaagggggagccaugggaucugccucaguuucccccacuggagacacgggcauaggcucccucuuccuggacuggccaggcccuggauggcacagccaggccugggcuucccacagggggcggugugcccgggacgccgaggcuggccucagagcugaggcuugcucccuguuauauuuguggcuauuuuuugacaaagaaaagcggucacguaggaacuggccacgauggagaccaagcacggugggauuuaauuuaaaaaccaaacgggaaaagcagggcacaggagccaccucccccagaauucuaggcuccgcccugagcaccagcucugcccccuccucagggccagacgcagcccccagccccuccccggcccaggcacaggcccgccucccugccuuaccguccccagcaggcacugggauuccuggauggccccguagcagcccaggaagccaacgaacaucaugacagcgcccacagcgaugaggauguagaugccuugcggggagagagacaccaggugggugccuacacacucgccacagcccaagaccccggaggguccugggugccgaacccaccacgggccgcccagcugggaagauguaggguugcugacugccagggaugagcagcaagggaccucacaucccagccuggccuggugaguuuucugugccucaguuaccucuuccaugacacaggacggagacuaaggaggccacauggggacugggcaccucaugagcgcucugagugcuggcgacaggugcuucgcagggaugacaccugcgguggggcccgccaccugccacacccaccacccaccgccugcaccugccacccgccacccaccgccuucacccgcucccaaagccucugggacuuggcguggggugggaguggcaucagaaggcacagggugggccccacuguaggccgggguugagagggcagcccaggaaccggaacuggaaccaaugcugccuccccaguguggugcgagaagagggugggggggcccugcuggcuccugccccccaaucugggcugcacagcagcacuuccguuacgggaccugcauuugaaccuggcugcuguguggggaggaucaaguuggauuccuaggcccugggcugagggcugaagcccagcaccccaccugggacagcuggaccagggcguguaggccagcccucccgaacucccccacgcucccuggcugggcagcaugcaccuggggagggagaaggcgccguccaaggguggggggcgcacugugggcccgagacaugggccuggccacccagacagggcccuguacccgcgggacagcugucagugucucucacugccugcccacuccccuaucccucagcaggcaggggccaucucccgucaccgaggcaaugcagaaggcagcccaggcccccuccucgcagccaggcccauugucccugcccagccagcccagaggagaaggugccuggggcaggacccaccgccaggcagagaacacacccagauuuggggcucggccacccagccuccuaccuggccagaugaagccucugccaggaaugcccugcagguggccaccuccuuacgggcacggcacccaggagccaggucucccuccccucaggcccugacacuccuggguugcaagguuggguucacuccgggguacaggucaggagaggcgcguugccuuuuuugguccugacaggaggugggaggcccagggcugccagacccccugccaggccccagccccaccccagccuccucucuuaacgcccuugggccuaacccaccgcacccgcagcgucucugaggggagugagcccagcaaauccacccuguucccggcgcaggaaaaaaagcccuuggcaaggcccagcccgcaucagggacagcaagaggcuccagaaggccgauucuggaaugggcgaggacuugguggccagaggagcuccaaggggucccuguccagugggggcccaggcagagcccacgucggggguggcagguccuguggucguguggccaacacaacggcaggcuccuccagcccagggaaaccacagccaaggaccgagggugggcggcucuggggcuggagcucugauguggccacggugacaccaugcaggucagacaccugcuuccaacgccagccucacccuggcaucaugggggcagcaccauggggccucagcacagccugugaccucugcuucugccgagaguggggcgcaggaaggaggccuggcauaccucucugggguguccccuguccucgccccagcccgaagcuaagugacccuucagcuccucuccggccacacggggcccgacgccgaccccacagcgggagcugcuccagccacaagccuuggccgccgggugccuggagagugaccccuuccaagaacaccugccucacacccacaggccccagguccuggagaaggggacucgguggcaggggcagccccuccugucccuggacaggaguacgaggaacgugcugggggcagccucguuccaggccggggaugcugugguugucacuggcuggacugguggccccggaggacaaggcccaggauggcugggaggcccuucuggaccccaaauauccuaaugaucugggaagcggggagcaagaggcccaggaggggccuccaguagagaugcacccuuggagaucggaggaugcuggccgggcucugccacccacagcccaggcacaugggcaaagcuaagccgagugcuucugaggacacaggcaggagcgccccagcugcgugcaggggguggucuccacaugagccccugggacaagcagccuuucccguccuuccugacaccaccugugagggcaccacggccccgagagaggccaggaaccuaugggcagggccaugggacccucccuaggaucggcugggcccagaaacccuccgugggccacaggcuucugucucuggggaggacagggaccaucccuguugacaccaucuggaccccagcaccggcccucugacccaugagcggggcauggggaagaaggaacgggcacgcuguguggccagggcccucaccuggcccuggggugacuggacaaagaggugggacggcgcagguguggggcuauuucggccuccuggggcccugguucagcaaccaagccaagcagccuccguaacuggcagggggccuggcccugcagcuccaggccugggggcaccugccggcugagggaagcccugaggacuggggacacacaggcugcccaccucacccaccccucagccugugagggcaacagagccaucccaggggccuccuuucaaggccagaagcaucucaacaaaugcucccagagccccaccagcaccagcccugccaggggcaccaggaggaagggugcugcucucugcacagugagauggcccuccuccuccuccuggccuugccccuccccuccuccuccuccaucacuccugcuccugcuccugggggcagggagggcagcccagucccccacacgcagccuaauaaggcagcaaggugcagcugccugcaggggcagcugagucacaccgccucuggggcgucuccaccccucuccaccccuccccugccccgucuccaccccucacuggguuccaucccuugagcuccaucccucccucccucccgggcuccacagcgccagcugccucggcugcucuguguggcccaggcauccagccccacccuucucagggagccucccccgaaauaaccccacacuuaaaauaagcaaggucuccacacagucccugcccaggccuagcugccacccccugcccuggcucagaccagaagggccagcaggccacaggcccaccuccaucucaacccuugugcccagagcccuuuccagggccgccucccugcccggacacgccaugcccgacugucuuucacccuccauguccccauccaaaaggcuaggaccugccuccuccuagaagcccucccugaaugcgucugcggccacaugugcacucaccuacauagaagguguugggcgcgggcuugucucccagcuccagauacaggagguugguggucugcgggucauggcggagccacagggccacacccaggaucacgccuccagccagcugggaaagagcgggaacagugucacauguacgaagagcacugcagcagggagugcgcccaccccacacgcaaggccuaagcagccuccugccuugcuggcucccgagcagggaccaggugucagcucugcugcugguuuucgcaaugcccugaagagccccgggagucaggagcauggggcgggugcuuuggccgccaucuacuuggagccuggcccugcccugcaccuguggagugugacuccagggcaggacugccaggaagacacgggacgccgguuaaaucugccucucagaugaaaacagaauacuucuuuaggguaagugugucccaaauauugcacgggacauacaaaaaaauaaucugguguuuaucugaaguucaaggugaauuggaugcccuguaguuucaccuuccguaucuggccagaggugauaccaggaccugagcaucccaggaacacugcccccuccugcaaggguguggcagcgccccaagaguucugaggucgcugggggacugcuucugucugggggugcugagaacucuggggugggggcaccccaucuuugcugccaggaggagaggguaggauuugauguuaccaggccaagcuguaggc

SEQ ID NO: 12625 - RNA, 425538 nt, Homo sapiens
acccacccagccauccagccuuccaccagccugcccaccugucauucacccaugcacccauggcaauccaucccuccauccguccaucuguccauucgucuguccauccauccacccgucugucugucgauucauccaucuauccguccaucugucuguccauccauccauccauccauccauccauccauccauccacccauccaccaaucuauccaugcauccaucugucuguucauccaucuguccaugugcaucuguccaucuguccaucuauccauccauccauccaccaaucuguguauccauguaucaaacuguccaucuguccacccacccacccauccauccaucuguccaucucucuacccgucuguccaucacuucacccaccuguuuucuccucucuccaguuacccacucaccacuuacuaacuucuccacagugccuagucucuccaggauggcgagucagucucuggucucaggaugcccacacucuggggaacaggcagcagguagccaugggggauuggccagagcaccccaagagcguaggcaguucucgugguuucuccccagccagcguaucucccagaagaggucacuauccucgaggccaggagccucaccuuccgcuccccugaccucccccacaccguaacccagcaaggcugggaauucaguaggugcccaauaaaucccggcaggcuggcugagucaucccaccuccuccuccccuacugaucacccauucagcuccuggccccauugcccaaacccugccagccuuugggugaucugcucagccgccaccucacauccacucucagcucggggccagcucugggcuccagcccgugaugggccauggugggcuucagagggugagccccccacaccauuguaccagucuggcaagacggaugagugcccuggucaguaguggcccaccuuggccuggaaggauguagggacaggcugcccacccccauuugcccuccuucucugaguggcuaggacagccaccaccacucuccagggaggggaggggcuggccugucacacgucccggacaggccugccugggcccaggaaagggcuauguguguagguggcaggcugcugcccugggcaggggccccgccagggcuggggaggccucagaccuuuagauuguggggcugguccccagcacucccacugggggugggaagcuuggcggccagugacgggagggucagcagaggggcccgugcuccuggcugaagccaaccucccacacaaggugaugccgacaacuccaagaaucgaugcugugucaggagcagucuccggaagugauuuccgccagaugggcugggcccaggugggaaucugggagcuuccccagaacagggagcaugagaccagcucagagagucugcagugacaucagaugaccuaaccucagaucaaagugaacgcagccagaagcaccccgcucgcccaccugggcacugggccgagacccuggguccugggcugggaggagugagugugggugugugaccuucagggagggccccgccaccagccaugagcccacaggguguagcuccccaccucucuacucugccccacugcuuucuguccugggugcaccuuucccagccugcuggauccugcugcuuuaaggcugccugucuuaggagaagggaugggggauccccagguccuucauggugacaaaaaggcucuuucacacaugcacaccuacacauacuugcacacaugugggcagacacacauacagccucagucuucccuggcugguucccagcuugucgucuuggaagaggaggaggugggguacacccaagcugugaauugggagacaggucaugacacacccaucuccuacaucuccugauuucacaggugagaaaauugccuugguggggagcccuggcuucagugugcauguggaccugcuucuggguggggggugccuuucucuaugaaggugugucuguccugcaccacugugggauucaggaaggcaaggccucuugugcaguguguggggcacagucaaugccggugcugacuguggagugaccaucugacauagccugcaaucaggaaggaccaugucaaggcagaacugaaggacccugagcuaguucuggcucuguccugcuguggugcccaaacuuggggacccucaggacauuccaaaccucagggucuccugcacaggagagaggggaguacacuaaaaugcagauuccuggggccgacccagccccacuguacugggucugcauuagaggcuguuuacagagcccccaggcaacugcccugggguccccucccagaccugcugguaggggugggucugagcugaccggucuuuaugagcaugcgggggcagguaguuagggaauaggugaggcagugaugaaccaggaaccgccugugggguuaggaucaagaacaggggcuugcugaugaacguaaauauaaaaauccucaacaaauacuagcaaaccaaauccagaaacacaucaaaaaauuaauucaccacagucaaauagacuucauuccugggaugcaagguugguucaacauaugcaaaucaauaaaugugguuugucacauaaacagaacaaaaaaaccauaugguccucucaauagauucagaaaaagucuuugaaaaaauccaaacaucccuucaugauaaaaaccugcaacaaacuagccaucaaaggaacauaccucaaaauaauaagagcugucuaugacaaacccacagucaacaucauauugaacgggcaaaagcuggcaaaagcauuccccuuaagaauaggaauaagacaaggauguacacucucaccacacaaaaaaauuaccuaggaauacaucuaacccaggagaugacgcaucuccacaaggagaaacacuccugaaagaaauuggcuggaugcaguggcucacaccaguaauccuagcauuuugggaggcugaagcgagcggaucacuugaauccaggaguucgagaccagccuggccaauauggugaaaaccccaacucuacaaaaaaauacaaaaauuagccaggcaugguggcauaugccuguaguccuagcuacuggggcgguuaaggugggaggaucaccuaagccugggagguugaggcugcagugaaccaggacugugucacugcacuccagccugggugacagagugagacccugucuuaaaaaaaaauuacagaugacacaaauggaaacacauuccaugcucauggauaggaagaaucagcaucauuaagauggucacauuguccaaagcaaucuacagauuaagcgcuauuccuauuaaacuaccaacgucauuuuucacagaauuagaaaaacuacucuaaaauucauauggaaccaaaaaagagccagaauagccaaggcaauccuaagcaaaaagaacaaagccagaggcaucacauuaccugacuucaaacuaauguucaaggcgacuauaaccaaaccagcauaguacugguacaaaaauagacacauagaccaauggaacagaauagagagcccagaaguaaagccacacaccuacaguaaucugaucuucaacaaagucaacaaaaauaggaaauggggaaaagacuccauauucaauaaauggugcugagacagcuggcuugccauaugcagaagaaugaaacuggaccccuaauuuucaccauaugcacaagugacacaagauggauuaaagauuuaaaugcgagaccucaaacuauaagacuacuaagagaaaacaucggaaauaccauucuggacaucagcgcugggaaagaauuuaugauuaauuucucaaaagccauugccacaaaaauauacauugacaagugggaccuaauuaagcuaaagagcuucugcacagcaaaagaaacuaucaacagaguaaacagacaaccuacagaaugggagaaaauauuugcaucuaugcaucugacaaaggucuaauauccagaaucuauaaggaacucaaacaauucaacaagaaaaaaauaaauaaccccguaaaaauugcucaaaggagaugaacagaugcuucucaaaggaagacauccaugcggucaacaagcauauaaaagaaagcucaacaucacuaaucauuagagaaaugcaaaucaaaaccauagugagauaccaucucacaccagucagaauggccuuuguuaaaauaucaaaaaacaauacaugcuggcaagagugagcagaacagggaacgcuuauacacugugggugggaauguaaauuaguccagccacuguggaaagcaguuuggagauuucccaaagaacucaaaacagaaguuccauuugacccagcaauuccauuaauuccuggauacauauacaaaagaaaaaucauucuaccaaaaagacaccugcacuuccauguucaucgcagcacuauucacaauaacaaagaccuggaauuaacccaaggugcccaacagugguagacuggguaaagaaaaugugguauauacacaccauggaauacuaugcagccaugaaaaagaauaaaaccaugucaucugcagcaacauggguccagcuggacaccauuauccuaagcaaauuaacugaggaacggaaaaccaaauaccacauguucucacuuauaagugggaaagugggaacuaaaugaugggugcucauagacauagagggacaacaauagacacuggggacugguagauggugggggagcaagcguugaaaaacuauuggcuaccauugucacuaucugggugaugggaucauccauaccccaaaccucagcaucacgcaauauaccuauguaacaaaccugcacacauacccucugaaucuaaaaaagaacagcagggccuuaaauggggugaugccuuacagauguagggcaucauauccauaggagacauucgccaggcauaaggauccucuggagagacacaucagcuugaggaauacagggugguggcucuguccagccacccugccccaucuccuacccucccauccauucugcauugggugccuccugcaugcagaguccuccuccaacagcaaaugccucccagauuugcugaagggccugcuccagggucucuguggagacgccccugggacccuugcugaccacccuccacaaucugcacccccauccugugcccccuucguuuuuuuugucccaccacuaccugguggugagacagcucuguaaccugcgccuagaacagcgccuggcacucagccggugcucugcgaggaucugggggaaugaacgaaugauugaaugaaugaauagguaggaagacuaccugaaggaggauguuggccaggaagccugugguggccuggcuguucuagcagcccagcccuggcccgcagaugcugaucucacagcagccacacacccuucccuuggucagccucagcuuccccauuccucaugcauucuuggugacuucugaggcuccucccacugugggccucugacccugcuggaggaacaugaggugagccuggugagcugagggaugucggcaaacagcccuggaagguuggugugagguagauugagugccauguuuccagaagguucugaggcucugggacagccugagagccugagaggcugggagaggguugccuuccuguucaugcuggcugauaggucugucagucuuugcaucuaggacagccagggcuggacaugugcacccaccggaaugauagaggaggggcuuuccucaguggaggguguguccuggagagagcagguggcagcugggaggcuacaacccugcgguccugcucccucagcugaugggggcccuccucaccuccuugcucacacagagaguggccacugggcucggucaggccccacuuguauugucuguccuaccaggccauccacccuuacucccccacccucagcccuuggccucaccugagcccacacccagcccagcccagccccaccuuaccucaccugcgcaccuggccuuacucccuccucucaguuccccacccaucccccuucagcuccuuggagcuugcagggagcuugaagacaaucccuuguccagucucucuccugccucaguguccccaagccaaugggaccccauacccccagagcagcaggcuguggcacagcucagggcccaggagacagcccugggggccuccaagaagccucccuagugaguuauuagaauuuuuuuuuuuuagauggaguuucgcucuugucacccaggcuggagugcaguggugcgaucucagcucacugcagccucugccucccggguccaagugauucuccugccucagccuccugaguaggugggauuacaggugugugccaccacacccagcuaauuuuggauuuucaguagaggcgggguuuuaccauguugaccaggcuggucucaaacuccugaccucaagcgaucagccugccucggccucccaaagugcugggauuacaggugugagccacugcauccggccuagaauuuuuaaaauauggaggcuugaccugccugaccgcccugccuuuucacucguuuucagaauaaugagcaaagcaaccugcagaagaucaaauaggauuuuucaguauuaucaugaaugcaugggcuuuucagcuauuugauguguuuucauccaugacucuuucugaugcucaaauugucccauuguugaucagccccuucucaaacuugacaaugaacaauaguaggauauaccuuuuuccuaagauaaaauagcugaggagucuaugcuaauauaguccauucaauuuaaggacugguuuguacuucuuugauuuuuuaaaucuguaucacuuuuauacugaaaaucuugguuccaaaggaauuuagcaucauucuuugauacacacacacacacacacacacacacacacacacacacacacacagaguucuuugggauccuuugguugaguauuagugaucauauugaucauggcacuccaucgugugacuguaccacagcacagcugaagcgauugaaggacauugugauugucucuagacuuuugcuaauauaaaaaaugcuguuuugacuaucauuauguauauguacuuuucuauuuuuccuacauaucuuuggguuauuuccuagaagugggguuucugugucaaaugauacauuuaguaauaucgcuaggucucuuuucuaccagugaugaggagugcaccugugccugcugccucucccacagaguugccaucaaaagucuggauuuuugccaaucugauaagcaagcagugguaucagaguguacuuuucauuugcauuuuucuuguuauaaaugagguugaacauuuuuucauaagugcaaaggucaugaaccccauuuccuaugaacugcucaugucuucugcucccuuuucuauaggacugucuggcagguuccucaccucaguuuugauguucuuuauguaucagugauauuaauccuuugugaucgaaacugcaaauacuuuucccauuuggucauuugucuccuuuacuuugcuaauggugcuucuauuuuaauuuuucuuauuuuaucuguugcuuuuggauuucaagucauaguuggaaauguuuucccgauucacagguucuugaggaauugaccuguacauucuuguagaauuugcauggcuucaucucacccuuuacacuugagccucugauucauuugagauuuauucucgugugcggugagauggacccaagguaugcuuuuucuuucuuuaugacuguccaguuguccaaacgcugcuuauucaaagcucaccuuccuccugcugaggugggaggggaaggcagagacuccaugcagguguauguauguucacccggaaaguaacugcugaaugcgugcugugugcccugcagagcugacugacugcccccaucuucugacccgcugcccuucugcaccuucacugauaugcuucccaggaagguacccucuccucggccucccuuguguuaucacagcgcccagcacaagcugggacccacuccauccacucuugcugcaaauacagacugugcacuccuguguggcaccucacuaggguggggagucaggcgucaagggccugggcuggacuccguccacgauaaaagagcagacuuuuggcagggggugguagauacaucaaauugacccagggugcucagggacgaccuggaagugucacaugaguuaugggucuccuggcggggcggagagucaccgcugagcuccaccuuuagucccugccucagggcugugugcaguauccugaaaaaagccggucucuucuguuggcugccccccaccccccccccaagccugagacgugcugagacccaaaugccaguagcgggcgggaggcagugcagagaccugugaaaaucuuccgaugugaccaacccacccccacccaggggaauccacggggcgcagcggcagcgcggucucgacgguggggaggacaaggcgcccauucuccaaguuacuaggguggcgcaagcgccucucccuuuaacugcccaggcagccccgccugcuaugcccggcagucaaaccagguccagaccccggcugugccgcccccaccccccagcagcccugccggcuccccacccacacagcucccacugggagguaccugacagugguggucccaucucacccucccgguccaagggcccuggugggaagcgacccgagcguauucgccgcccgcagcucgcgcgccugggcacccgggggcgcucacagugaucgcggggccagcacacccucacccaggacaucccuuuccuccccccaaccccaacuccggaguggcucagagggagggaaaguagaugccggcacccuaccccgccccuccugcccccgcugugccguucucggucgugguaucggccaggccuuaccccuuccucccuggcgcagcugggguccuccuccgggccaggcagagcaggcgggcaucagaagugggggccaagcaggugggugagggcagggcaggagcaagcaggggagaugcagacggggcggggccaagcaggugggugagggcggggccaagcaggugggcggggagggggcggggccaggcgggguaaaugcacacuggaacggggccaaacaggugggcgaggagggggcggggccaagcgggauagaugacacgagcggggcuaagcaggugggcucgggcgggggugggggugggggcgggggcgcaggcgggggcgggggcgcggacaggccaagccagggggugaggcggaggcagggccaggccgguccguggggagagggcgggccaagccggugggcgcgggcagggacgcccugugcgcgccggaccggcgggggcggggcgugcaggcgggggcggggcacgccgucccaugggaccggcccucggccacugcccccuccggccccgccccgagcgcccgggcugggccggcagcggccccccgcggcggggcuggcagcaguggcugcccgcacugcgcccgggcgcucgccuucgcugcagcucccggugccgccgcucgggccggccccccggcaggcccuccucguuauggccgcggccuccuccccgcccagggccgagaggaagcgcugggguuggggccgccugccaggcgcccggcggggcagcgcgggccuggccaagaagugccccuucucgcuggagcuggcggagggcggcccggcgggcggcgcgcucuacgcgcccaucgcgcccggcgccccaggucccgcgcccccugcguccccggccgcgcccgccgcgcccccaguugccuccgaccuuggcccgcggccgccggugagccuagacccgcgcgucuccaucuacagcacgcgccgcccgguguuggcgcgcacccacguccagggccgcgucuacaacuuccucgagcgucccaccggcuggaaaugcuucguuuaccacuucgccgugugaguaucgccaccggcgacggccggcacgaaggugcuuccugagagcuggugugggggagcucugucccagcgccaccugccccgucggagcugcgaccccggagcagaggagggaaggaaguggggaaacgcagaaacacaaacucugcacucucccuugaaguucagaggcgcugcugugucugggggugcgcaucuucucgcaggcccggcguggggagggagccggcuggggaggggaccaccuggagcccagaauuuggcuccacaccuccgggaggguaguccaggugugaauccuucugggaagagaagcgugcuggggagcgcacccuugggugcaguaagauaacuccucaaggucggcugagacucgaggcucaggagcccccaagagagaaggccccugauguccggugccgcaucucagacccccugaggcccagguggacucuggggcagggggcuguccaggauaggaaggugacgguggcggugcucccugagggcucagcaugccacgggccguccccacgggccccacauuaacuaauugaaccaagcucaugaaaaccuggcuugaugcagagagcggagaggcacguuugcagcucucacuaagaggcagcugugcucccggagaaagcagcgcugguagcagaggcaccuggccccccuguuaccaggugguuccaauucccgguacagcgugccugagcagggcugggcacuggauuucucagggacaggccugggaagucaccuccgggaagguccaggcugcucuccuccaugccugccuggggccuucccccgcugccccaguggcccuacuuccuggcugcccagccagcggccuuuugguguggugccagccucuggccugggagccucuacccagacaucccauggcugauggcuguggggcucaccugagggcugaaggguggucucccugagcguccucagguggaagcaucuccucugccucgggcaggcucaguagagaacuggcuggagggcauccagaggccuguccaugccugcuggcagcugccaccagggccucagggcgggugacagcaggagccaggccccaaauggcuucaagcaucgucucaggugagggggugggguaggggucgcagggcuacugccuuccuugcuaagagguggccuuccacaucaggaaggggaagucuuacccaccucccuccucaaagaugugguuggggggugaucuuggagacuuuuccccaccccagcucccaagccccugucuccugacaugucagugggugccugagccacagccgcugcuggucugugagaggagcuggcucugcucguggcugcaacagcgggggcucggcuugggguuugggagauauuugugugcagugaccccaggggaacccaguccgaugccacugugcaaaugucuagcagaugccagguucacaggugcugugugcugguggccaccugccucccggaccccagacucucugagauguccaagggugggaagaccuccucagccagaggccaaggcaaagugcccgcagacccccucaauucucacuuguauucagguuuguggacacaugccuccgggcucacugcagccacccguguggaggaagaggaggaagagggcucgccacgccccagaggaagucucugcuugcacuuguguuuucuuccucauuuggauuguuuaggucucggaaguuugcucagcaagagucuaccuucgcccagccuccgcagagcuggcaaggcagggguggcuucuggggacaggggcaggauggcuucugugaagggguggccaggaaagggaugcuucugugaaguggccagaucuggggcugguccuuuccaguucuggguccuguccuuguaagacgugugccuggcccugggaaguugucaugaacagccuccaacccagguaccuccauguggggugggacuggagguggacccugacugggcaggacauguggcuuggugggggccugggagaugcgcucccacccucagugcccuaggagguuggcaggaccagucucuugaggggagaccuggucauagaaccaggauggcagaguagcuggaggccaccugcagccucacgaaaucagguccagccuugcgccaguccagccuuguguugcuguaagaagucuuggcaaugguggcggagacagggcccuguccuuagguggauugugaaaugagaaauauugugguuucuggccugaagacgacaagccuggccuugaagagccagggcccaggcaugugugcagggggguugaggcaggagccgguguuccgcugacccuacagggcuagggcgaacucuccugugugcgccuggggaagccagccaggauauccuguccccuccucggggaacccccccuccccaggagagcagcucuuccuguguuccuucuggccucccugggcuggccgggguggacacggcaccugggccacaacucuugcccgcuuaggcuuccugcccccaacacccccaguuaucugugguugcuugcgcccccacugggggcagcucccaucuuagcugaggggauggggguccauacagcccugcugcacccagcgguccuagcucccuugcugugagccuuagccagggguguggacauccagguggcaucuacucugguugcugagaugcuuggagauccugguuguggccaaggagagggauuugaggggggaccugcagugcauggagacugccccuguaggcucucaaaccuaagucuggcucagcagccccuguuccccgcuccuacagccuuggcuuucccuguuucccaagaacuuuccagggguguuggcagaacccucgcgggugcguguuaaucaacaauggagccagaagcaggucccagagguggauggggcugaucuggcugccuccccaaaagacaaggccaugcagagccagcucucagggugcagcacccaacuuuguggacuccagugcccuccuaucuccaggcucuggcauuggagucugaagcagcugcugggcaguuguucugcagcugggcagggaggccagaggccaaggcaggugguggggcugggcacagaggaggacggggcucucugagccaucaggucucuuucucuccaucuucuuuaagaucuguccacccacuccucagcccuagauucccaggaaaacugggaauuccuuuuggggcuuuucccagugcuaccuucuguggggcaugagcccuuggucucauccccuggcugucugggguccccucaccuacaucgcagacccggcccaguguuucuagauccgcucuugccaacaugucgagugccuaacuguggcuucguacuaguuggggggaacacaggcaucccuuaccccuggccgucagcuggggaggggguaguccagguggcaagagccuagagccugggagaaagggccuccccagccuguguggggacaggggaucaggagggugguagggacuuggguccuugcagguggccugggcagugccuggugggcauggaucagguggcagggcuuugugucugggcauggcccuguggcugggcugccuuggccaggguccugggccuucugagucugcgucucauucucuguggcaggcuccuggugcuggcaccuucagugcagggugccucgguuggagggaacauucacccgugccuggcacugaagccacagcucccugugggcauggugcccgcagcuugagccuacaacccugggguacugggggcaggagggucccuuuuugcuuggcaguugcgagguacuggaaccuuugcauauaacgugcgggcugcguugugucacagggccgggucugagggaggggcuuugcggggacacuccuggguaccgaugggaugaacuuccgcugggccugaaggccugggaugcuuuugggccggccagugcggggucaggugguuggagccagggagcuggcacgucagcugcugcuaugaguucugccacgugccauccuggcauguggcacgucuugcagaggacaggaagggugaacagcuccaaacccacccuaugugugcuccagagcuggaaacaggcugugcggagcugagugccuuugggggcagcugagaugggcaggagcaccgugcccaccgagggugucagagugacagggguugccaggcaacuccacccggguggcugaugcccccguuuuuaaaggcguugggugccgagaauuccccuccugcugcuaggcugguuucaagucugcuccuucugcacuugacguccuugccagugugauccagagcugcucacacgagcaagcguccucgaguccuagggaugcuguuaacagggcagcggguccagggagcugguccugacgcagggguccugaugcagcggguccagggagcucaugccuuccagcgaugggaaugccaccggucccuguagccaaggugcagaugcacacguccugguccugagccccugcucggcccuaggcagggcccccaguucccugcauuccacccgccuugucugggagguggacgagcccuccguagcccugacauuccaaacuggcuuuuggccccugcgauaucuugcugugauucaagacucuguccacgggcaagaacaacaaggcugggacaaucucaucucaggcaucugugggaggagacagcucccaagggcggugaugccaggagaacauuccaggcccaggaagagcugagagacagcagaugcccaagacgaguugcugguguguggccagugcugggagagcauggugucggcccggggagaugccgcagagaagcuuccagaagcccaacaucugcugcuggaggggagaaugaggcaaugaauaucaccauccugggccacuuugacccagaccccaaggauuugguuacagaggggagggcggcagcgucuggcuucacucucgggaggugccuuggggcuggccaguaugggauugcugucacugugggucacuccagccccggaugcuccuacaccaugcucugcuugcaucuggggucccugcgggcacgucggugagaccguccuggccuccacaccccuuccugguggguagcugucucucuccagcagcuccuccaaccaccaugagaaaccccagaccucacagaugcaaaauuaucgugguugacaaagggaggcggcuggugucucugguacuggcugggugaccacagggaugccgcgugacccuaguccagggggccgcuuuuacacgaggcaucugaccaugugauaggguguggcuucugcugccuggcccagcccucuucugggagccccacgugggugggugcuggcuggggaggggcuucucucuggggagcaggcccuggcuggagguggggaagauccaugaugggacccaggugucuucccacuucucgaccaucuccugggaaguucuaauguuugguucagggugugggguccaucugagcaggcauggugcuuccagaaggauccagguuaagggugguggguccaagggggugccugagcccuucugcagaaacaccguuccccguagagcagcaguccccaaccuuuuuaguaccagagaccuguuuuauggaagaaagauuuuuccacccgggcaguggugaucuugggaugaaacuguuccaucucagaucaucagguauuagauucucauaagaagcgugcaaccuagaucccuugugugcgcaguucacaauaggauuugugcuccugugagaaucuaaugccaccgcugauccaacaggagguagagcucagguggccgugcacauucaccugacgcucacucacugcugugcggccugcucccuaacaggccacggacccgggguuggagaacccugucuuagaggauugaggcucggggccaugggaucggcacugucauugcccuuggaggguucugagcacuggaaggaccuggcuguggucccaggcacuggguggauggaccagcagaaaggcucccaggagggucguggcucccucaucggcaccggacucucaggaugagccgccuggagucuguuggcaucugccuggccgccucuggcaggaacuucuccugauggaagagccgggcuggggagcugacuccaggacaggccccugcccgcucugggaccuggggccugggcucugcuccccauuucgcuccuccacucacagaugaggacauuugggucgccuuacagaugagacaacuaggccuggccacuuugcucaugccacacccagaaagcccucaggacacccagaagcccuuaggaugcccagaagcccuuaggaugcuguggucucaagugagguggugcacuauuccuggccucaggcccaguuuguauccaugggcacccccacucccaccuagcacuugccaccaggaagcacccugaggacuguccccuuugagaguuggcucucaaagccuuggucugugccugcguccuggcagcgggugagcuacggcugcccucacccagagagugcagguucccugggggcgggggcucuuagcuuucccuccauaucugcuaaggugcacaccuuucucugcugccuuccaaaaucauacucuggggcgcacugaaagggugcucugaguagcucuccccggcuccuggcugaacuugcuccaggcagagauuugaagagauucagaaagcaggaaccacaggcagagcagcuggacagggacccccaccccuguacucccuucggcccuggaaugcuccucugcauggagacagcccagcugcacugggaccccucaccccacccuggggccaggggcuguguccucgacuuccacgcagagcagcccgggcagcuuagaggagggagcagaaggagcucugacugagagggguagaccccucccagaggcauccccacccugccccaaagaggggagcagcuggagacggggcgggaaccuccucuggcuauaucuaagcagccccgggaaccaugcgcuucaagcguuugaucuugacgggcccugggcuuggcauucuauuccgugacgucuccagcuguucucuugugaagagucacgucugugcucuuggcuaggauggcucaaauauuauaaaacauacagcuuugcuaauuaaaacagcaugacauugccuuauaggcaggcagaucaccaauggaacagcuuuuuaaaaaccgcauguaacuccauuguauaugaaguuucguaaaagaggcagcaucuccaaccaguggggaacagaugggcggcuucaugcgugcugcgggguggguggguggccauguggaaagugaccagacugcacccacuugucacaucacacaccaggauagacucccagugggucagaaaaccacuuggguaccuaaagaaagcgccuggaauucuuuacccugagagcgaagaaacuuuucuaugacuugaaugcuagaugcguggaggagauuuauguguuugaccacauaagaaagaagcaaccuuggcugggugcgguggcucacgccuguaaucccagcacuuugggaggccaaggcgggcggaucaccuuaggucgggaguucgagaccagccugaccaacguggugaaacccugucucuacuaaaaauacagaauuagccgggcgugguggugcaugccuguaaucccagcuacuugggaggcugaggcaggagaaucacuugaacccgggagguggagguugcagugagccgagaucacgccguugcacuccagccugggcaauaagagugaaauuccaucucagggaaaaaaaaaaaucuuaaugggaaacagccaauugccaggcugggggaagaugugauguuucacgaaggguuaaucuguuuacuacagaaagaguuucugaaaacagaagaaaacccacagccagcaggagaugugaauaccacucacaggacagugacccacagggggaccuugaacaugugagaaggugccgccuucacuccuggcgagaggggugucgaggaaaaugucacugaggucccuucuggcuggcagaaauccuuuggcauuugcugguaggcaugcaagaggguagacucugugaggaagggauuuggcaacaucuagcaaaacugucuucacugaccugugacccagcaacccccuccccagaaccuaccugaaggcacuggcaaaggcaggagaagcugcgugugcagggcugcuugugaaaguacuguuuggaaaacugcaaaugcccauuguaggagacugguugaaucagagauuuguggaauauuaugcagcuguaaaaaaggaaugcauagaucucucuuauuaugaagugauuaucaggauuuauuuaauuauuuuuuucaggcagggucuugcuguguuggcaaggguggucuugaaaucuuggccucaagcaguccucccaccucagccucccaaagugcuuagauuacagguaugagccaccacaccuggcguaucaggaugcuuuuuaagugaaaaagcacagugaauaaaaauauagcagcuauucuucaucugauaaaggggaggaugcaagucuggauguauauuaaaaacgaaagcaauggaagccuccaaaucuuaaaaguuuaccucaaaaggguggcggggggggagguggcauauggaaucaagaugccucugaauguaccugguuuuauagauuucacuuugaagccauguaaaucaauagcuugcguaauuuuuaaaaagcuguucguaaucgcuuggugaaaaaucccuaaauaaaucuuaaccagaaaaaguagucccucaaaauugaaaugaaacaaaugagccuaaaaaugugugcugaauuaguggcuuaaccacccagaaggacugauuucaggugacauauuucuagcggguuacugcugaagacaaauagagcugcaugcaguggccacauaauuguugugauacuauuuguuauauuauucuaagagugcugcaugggaauugcagguuaagguaaguaauuguguugguaucaccaagaauggagguuuuacaaaauaugauucacauguaaacagaauuaaaaacaaaaaccguaugaucaucucaauagauguagaaaaaaacuuuugauaaaauucaucaucccuucauuaaaaaacccucaacaaaaauaggcaucaaaggaacauaucucaauaagagccaucuaugacaaacccaugguaaaugugguacugaauggguaaaagcgagacacauuccccuuaagaauaggaacaagacaaggaugcccacuuucaccacuccuauucaaaauaauacuggagguccuagucagaaaaaucaggcaagagaaagaaauaaaaggggauccaaauaggaaaagaggaacucaaaucaucucccuucaccgaugaugauaagauucuauaccuagaaaacccuaaagagucugccaaaagccuucuggaacuguaagugaagucucaggauacaaaauccauguacaaaaaucagcagcuuuuuuuuuuuuuuugagauggagucucacucugucacccaggcuggagugcagugaugagaucuuggcucacugcaagcucugccucccagguucacaccauucuccugccucagccucccaaguagcugggacaacaggcgucugccaccacgcccggcuaauuuuuuguauuuuuuaguagagacgggguuucaccguguuagccaggauggucuugaucuccugaccuugugauccacccgccuuggccucccaaagugcugggauucaggcuugagccaccgugccuggccaaucagcagcauucuuauacaccaaugauguucaaacucagagccaaaucaagaaugcaauuccauuuauaauagacacaaaaagaauaaaauacccaggaauacaucuaaccaaggaggugaaagaucucuacacaagaguuacaaaacacugcugaaagaaaucauagaugacagaaauggaaaaacauuccaugcugauggguuggaagaaucaauauuguuaaaauggccauacggcccaaagcaaucuacagauucaaugcuauuccuaucaaacuaccaaugccacuuuucauagaauuagaaaaaacuauucuaacauucauguagaaccaaaaaagagccgaaauagcaaaaaaggaacuaagccagaggcaucacauuaccugacuucaaacuauacuucaaggcuacaguagccaaaacagcaugguauugguacauagacauauagaccaauggaacagaauagagaacucagaaauaaagccacacaccuacagccaucugaucaucaauaaaaucaacaaaaauaugccauggggaaaagacuucauauucaauaauggcacagggauaacuggcuccccauaugcagaggaaugaagucagacuccuaucuaucaccauauacaaaaauuaaagacagauuagacguggccaggcacaguggcucaugccuguaauccuagcacuuugggaggccaagguggguggaucauggggucaggaguuugagaccagcuuggccaagguggugaaaccccaucucuacuaaaaauacaaaaauuagcuggguguggugguacgcaccuguggucccagcuacccgggaagcugaggcaggagauugcaccacugcgcuccagccugggugacaagagcaaaacucuaucucaaaacaaaaaaaaaaaaauuaaaaaagauuagauguaaacauuagauuacaaacugaaaaaauccuggaagaaaauagucuucucaauauuggccuuggcaaauaauauauagcuaauaaguccucaaaagcaauugcaacaaaacuaaaaauucacaagugggaccuaauuaaagagcugcugcacagcaagagagacugccaagggaauaaacagauaaccuacagaaugggagaaaauauuagcaaacuuugaacugacaaaggccuaauauucaaagucuacaaagaauuaacaaaucaacaagcaaaaaaacaaccccauuaaaaagugggcaaaagggccgggcgcgguggcucacgccuguaaucccagcacguugggaggccaaggugggcagaucaccaggucaggagaucgagaccauccuggcuaacauggugaaacccugucucuacuaaaaauccaaaaaaaaaaaaaaaaaaaaaaaauuagccgggcgugggggugggcgccuguagucccagcuacucgggaggcugaggcaggagaauggcgugaacccaggagacggagcuugcaguaagccgagaucacgccacugcacuccagccugggugacagagcaagacucggucucaaaaaaaaaaaaaaaaaaaaaaaaaaacccaaaaaaacaaaaagugggcaaaagauaugguagacaguucuuaaaaagaagacauacaaacagucaaacacaugaaaaaaugcucaucacugaucaucagagaaaugcaaaucaaagucacaaugagauaccaucucacgccagucagaauggccuuuguuuaaaaagucucaaaacaacagaugcuggagaggcaguagagaaaggggaacacuuacacccuguugacgggaguguaaaugaguccagccaccauggaaggcaguuuggagauuucccaaagaaccaagaguugaacuaccauucgauccagcagucccgugugcugaguuuauacccaaagaaaaauuagucguucuaccaaaaagacauaugcaccuaaacauucauggcagaaagacaugagucaacucaggugccugucaaugguagaucgaauaaagcaaaugugauauauauacaccauggaauacuaugcagacgugaaaaucauguccuuugcagcaacauggaugcagcuggaggucguuauccuaagugaauuaaugcagaaacugaaaaccaaauacugcguggucucauggauuauaagugagggcuaaacaucaaauccauguggacauaaugaugagaacaagagacacuggggaauacaagaguggggaggggggaaggggagcaagguuugaaaaguuaccugugggugcugugcgcacuacgugggagaccggaucguuuguacuccaaaccucagcaucaugcaauauaccuuugugacaaaccugcacuuguaccuccugaaccuauuaaaaaaguugaauaaaauggaaacuuuuggcaugggagaaaaaaaaaaaaaacagauguaaguuagaagagguuacgcaaaaauccuccaucccugcauuugaaugaggacuaucaguaugcauccaggaugacguuuacuuaaauaucucuguuuccuggaaaggcccaggaccaaggaccacucagcagcuaagagcaucucuagaccccagacuguggccucuagguaccauuucccccugaaagaaaccagggccccuggcggauuccaggucuguggcagaagaugugcaagcuaagccuggaguauucaucacagcagaaggcagggaaguuaucagaggcccccuagggccaugucacuggaacuugaagggguccuugucuucccccuucuccccaagcugaagaugcaguggguaagccucacugaaaauaacagaggaaguggaugagcugcauugaugggguucagaucccaaguucauccugauacugaggggcaaaaccaguggacuuugauuugcauuucucuaaagaucuguggaggucaauagggagaccgcucaugauguugaauccuggcaagcaaacggagagaaucugacaugugucccagucgugauuaaccugugaacuguaacucggggaaacccaguagcugaugggguugcguccuucuuugggacucccgcagaugccugaggcggcagugcugcugaaguccugccaggcuccagcuccuggugaggucagggauuccgcaugcagcgucacagcugccaaccucuccaaagcaguaaaggccuucggacagugcacagaaagugcucccauccacaaugcuuccuugccuggauggauggauggauggauggauggauggauggauggauggauggauggaucgaucgaucucaccaagccucgugcucuaaguacaaguuuacuggaaauacucgggccagaggaacgcgcuaaaugauacuacaggaggccacuugcagaaucccaguggugggggauggcucuguaggacacaugaccugauuuccucaguaagucaaugaccaagaaauaacggagagaaggaggaaagaaucaccuauccaccaauugugacauauggccuuaguuagguccucaauaaaugaugacaaauauuggauuaaauuacuucugguuugcugcauguuccauuuuugcccaugccgcaccugccauggugcauuucugauucccgugcccaguugggaggcuuugggguuguugggaugcuuuugugaauggcuuccuuccuucccaggcacaggggcuuuauggggcucuggagcagacagaccagaguuugcacccagcucccagcuggccauguuaccucaacugcaaaacgagagacggacuuccuugggacgcggugguggggacacuguggucugucuccucugggcgccccguggcgcccgguggugugagguuaggauguggggcgugguguccagggacuguguggccugccuggagcugggcagagacaaagcaugcaugugacacucccugacuucaggccauaacaggggcagggguggggggcaaucaggguuccuagaggacaaccccauguaguuccucacugcagggcuuggagggagcaggugaaggcuuaccugucuuagguaaugaggagcugugcgggucugagacagcucugguuccuuuaaggguauguaggggucacugccagucuguagcucccucugugggggcaggcuguggcacuguggcgacuggcaguacugacuuccucuaagccaaccgggcagggacaagucagcuuguuguuccguccacaguagagggcggcccugggggugaacggcugaccgugagggcguggucccuccccccagaccaccccggaggcccccuccgcccuccugccuacaaagaguucccccuuuguguugagaggccugggucucagagguagaugaauggagucgugaaaucaggcagggauucccuucugcuuaaaacccacucuccuucccaugcagcacagguggccaaaaccugcggcugggucagaggacugguuuaguaagaauuuuuuuuuuuuuaaaugugguuaucugcuagccagaaaaggugugugguuucgcagucuuucagacaaacugaauuuaauaguagcugacgugaaccccuguuucuccucuaggcuccagagccgcaccccagugcagguguggaagcucaguuccuccaaaacccagacaggccuugguguccugacugccacccccagggggccccucacucgaguccuugcuugcagugcccaugggcagcagagguguccggagaugcaacagggcccagaccccuaccagccuguggcccagcugggggcaggacuccggggcagggugagucccugcgugaccugauucucugugggcaggccgggcaggguggcugcagggcggcggagccugugcugcuggccugcauuucucuggcuggacagauacugcgcccauaucccuggucuuucaaagggcucuguggcugguggagggcagcaaugccccaagggaggagcaggugcccaagcccccagguggcccugcggguacagguacuuguuuacucuguggcaucaguccugcuucccagcucaaggcccuggccuccacaggccuccucccucccucccucccucccuccuucccuuuuuuccuguggcuccaaggcccacaguagaaaggcuccagucuguguccauguguuuuggaggccucucagguacagggacugucagcccagcuguaaguggaccuuggaccgcaaauuugcaugggccccuuugccaaagcccugugcccacugcuggggaacgcuggggacuccgcucuuguggggcaguggggcugggugggagcaaccccccauccggguggcuguggccgaggcccuuaugagagggugguaggugugucuccacagugggggaccagaucucucucuggccccaaagacugcuucaagccucuggaggagcacuuugccccaggcuggggcgugacugcuucugguugaggguugcugccugugcagguggcccucuugucggucuugucugcugcauggggguguggccuccuguggauggccccuguccugggugguacugcugcaggaccuggguuuccggggguguccgggagucggaugggccucacucuccuggccuccacuggguccaggaguggcgaucugugagccaauggccguggcugggggcagccugggguguugagaggcccugggcagccaccuugccucucugaguuuguccucaugugucucuggggcuggaacucgguguccgaccuggugaugggucaggugugaucagguguguggggcucggucugcaugugcagggcuguuugaaggccuguggggccaucugaugccccccuuuucuucagccuuggagaggauggcuucucaggccgccucgcagcagauuuguagucugguugcugucguuccugaaauagccucugaagcucuguccgggaagggaaccuugaguguggaggagauaagccugcugacugggugagccggccggggcggggguggccccucuucccuuccuccccugcagcuuccauggccuggggcugugagaggcccgggaaggcacugucuuugcgccugcacaugugugugucuggaguguaggauggcacuggugccgggccuggauuuacucagcccagaucacggcugcuuuuguuuacguggccccugcucucacccacaacuccagguuucuggcucucgggaauuugaggccuguggcugcuguggacccugggaaagagccugugcuuccugagccagugcggggccuggcauggaguagguaccccggggguggacagauaggcagaggaagggaugggcagguggauggggggcugaauuguggucaguuauggguggcggguagauggguggacagcuggauagaugaaguacuggguggguggagagagaaagggguggguggacggagggaugggcagggagagaaauggauggggcaugcugcuuccagcacccacugggugcagcugucugcugucugcuguccugggggaaggucuggagagggccucucggugaguguggacucagccagccuagucccaauacagcugggaugcauugcugcuccuuccgccaucccagcagcuguccagagaugagacccagccccacugugucuuucugggauucacaagaauccuucccugggcugagggggcguugcuguggguguaucucauggagagccccaaggagccagggaggagccuucuggugguuuggguucuggauuggugggugcugggugggucuucauggcuguucuuggggcugccaggccugcaagguagacaggccucuggacuugaguguggcuguggacgagggcagcgucgccaucagaggcgaugucuagggccacccccucugacuugccuccuccuccuucugacuugccuccucucucugacgggccugcuccugagcuugacaccugccugggggcucccggcgaaggccgcugguuucuagaaugcaccaucucuuccuggcaugacgggaaccaccugugacauugccaccaccucgcuguaaucugggcagcagcugucaugaucccaccaugugccccccgugaggcccccaccuguuacugaguggcagggacgugcucccacacccccaugcgccauccugcaggugcuuucugcugacuucugugugcccuggggccugcucucuugguagggguugacccugccugugacuuagacagcuuggagggccaggacugaggggagggggcgguggagugaaggggagggugggcgcugcuggcaagaaccacaggcaaagagggugccgggggcagggaaggccuggagguuugaggagcagaaaguagacccuugacccucccugggcuggugagucggggcccagcccagagugacagggaccaaaccuggguccaugugccgugcccagccugggguucagguuucuuccccgugagcugagcagacagggagggucuugggggaaggcugugggcccuuggguggaagagucuugggugaggccccugaacugguaagcggggcagcggcggcagggggcccagggaaguggggccagucggggguccucagggguccuucagggauauaccugcugucaggguguggggagugggaagugggggacgggguggauuccaggauuccggguugugcuuggucagaguggggaacuggacgcuccgucccuggcucagccucucccggcugugaccuugggggaccauugacuuuacugugugccuggagagccuaaucccuaccugccagugggugacacagaaggcaggaaugcagaaggccuuucagaaguucucacuggccugcaagguagaggcuguuuucugcugaggauacauuugcccccucuaucccccagaucggcggcugcucaaggagccugguacagcugcacggaggcgcagcacccacaggacaagugguggaauguucugguuguccuuggugcagguggcgggcggggcuggggggcucuguagccuuccuggcuucgguccccuggacaggcuccaccucccucuuaucguggccccuuuggcaggcugccugccaccucaaagucacgcugcccugggcacccugccucuuccggggacuggggcuggggcuggggcagcuguguuuauggguguacucccugugcugggcacugcgcugagcucaacacacaggggcucggggaggucugugggugcccaggccgagaugugaacccugaguuugugcaacucgaguuucagaguggcggccucugcuccucacaagacauugcccugcgagggggucagcccugaagccggauggcccggcccccgcuaccacguggaggcucccuguaggugcuuguguagaugcccccgugcggggacuuguuuggcugauggaucagggggaagguucuccccacggugugaggcagcaccgagggcuccgugcccagcaggcucacugucggcaguugggucugguuugauaaccguggaccggggugacaggcccugacucugcagagcaggacuguggaaaauggacacugaugcugcccgguggauccaggcagggccgggauguuugcaggacccacgggacaauuagaacgacugggccugacuggcacagggauguggacuacggugcuugccaucagcagauacaagcuguacgcagugggccgcaggcgcucccugggccggaacacauggacguccagguguggaauggcccggacagcagauaacaagccuucgucguggucaccccugggugugggcuguggguuuuaaucuuuucauuuuugcucaucugaauuuucuaauuaaaaauauauugcuuuuuaaaaauaauaaaagaucauuuaaauuaaaauauauaagugaggagaggcugguaagaggauucuggagucccuggagugucuucuggcaucgcauggaugagaacucugaaugaauugagugugauuugaccuaggagagugccggggugggggcaggugcacugugguccuggguccacauggugcuagggucccaugggcuccuggccccuggcugcugcccccacauugggcccugcaccaggcaugagucccauguccuguccuuggggaggccugggggacaggaguugggggggugggcagugccucuguguggcagauuccagcuucucucaggggccaggauuacaugguccguguuggacucugggaugcuggugggaagaacagucugggcgaggaggaaaggguggcucugcugaccccuccuaggugggcuggggcugaggcggaucccacuguggggagcugcccagagauggaaggagcuggaguccacagggcgcuucucuucucuuuuccuguguguuaagguaguucaaaguccuccugcccgaggaaguaagacagcaaucucugggguccugggcaccaacucugggcacugaugggcugguccagugcagggagcugccccggccgcccccgugggugcaggccaugggcucuuguuuccuuucccccaucuguaaaauggguaacggccgcuccuucaggggcuguuagccacaugcuuagaccgcaccgagaaaaugcagucccuccagagcuccuaaccuuccaugggccacaggccccuucccagaaguuuuuuuauuuuuuauuuuuuuuugaagcagggucucacucugucgccuagguuagagugcaguggcacagucaucacucacugcagugcgaccuccugggcucaagcuggcaccgugaccccuucuccaaggccugccaggcuggccuccaguccaggugugaggcccugaggcccuggcugcagcuggaagcucuugggcagugcacuguccccacagcggacugccuccugcagccagguggccuuaggugauccuccaagguccagccagccaggaucugagucaggaggaaccacggcccccaccagggcugagacuccucugagcucgucacuugucuugguuggguagaggccugagaggguggacacuugcccagggucacacagcuugugcguagcagagcucccuguccggccccugccccgugcuggccccucucacaccuugcucacgcuaggugccuuguaccagugccugcuuggggguggaauuggagaggggaggggugggcgccgagcucugccucccaccagcaugcuucccagagcuuccugggagaagguuuacggaggaguggccuugucuggugucccucuggguagagccuguguuccgggcaggcugggaacaaugaaugguacagauccacggcuccccuugggccuuggugggcuccagccaugccuccuggaaggccauuuggagccuggcuggcaggcaggagcugugugcugccaggcgggucuagaugugguugguuccuggcugcaccugccgggcucaugaccugcccuguccuuuccuuggggagcuuggugacggcucaggucgacucccaggggcccgcccuucagggccugcaugaguguucucgggcuggcuaugggggcauugcuucuuccuguccuagccgggaccugcccauccacccagggggcucagggacguuuuugaguuuuccugaggcuuugccuagggagugucgcugaggaagcuggaacagugaccuucguuguugggggaggagaugcaggcaggcuguggcccagcugccccauuuuguagcuggggaaacugaggcccagaguggagaagcgaucuccaaaggggaggugacacauggcugagccccgccugaugggugcuugcuggggggagaaguccuggcugggacuuccccuccccaggcugggguuuguccccuacuuugcaggaggaggggggcucccagaagagagugaguuuugagggaacacagugcuggggguccccuccugggccuggggcugugguucuuagaggggcaaggggcuggccccuguugcuggcuguggcagccacagccuucugacccuugcuggccugucguggagugggguucaagaugcuaucacugacaucugcccaggcucgggggcuucuguguggugccagccuugcccgggggcacagccaucagcaggccagaaguccucaggagagcuugcugccaggcugcugccuggggccaggcuucagauaugcuggccagccuuguccagggggccuccugccaggugggcagagggagagggccuuccuguccucaugagaacagggcugagcuccauguuccuuagccucccuuggccucagucauccuaucuggaaacagggaucauaauaguuuuaguuuauagagagcgagggccuggccccugcgcucuuccucuguggucuccucugcccgcucccagaacaccuggccuccugcucugagggccagcccuggguugcagcagugagcaugaccuggccacagucuaggggcuuugggguggguuugugggcagcugggcugcagggggcugugggagccugagggagugccuuccaggggaagcccgacagaugggggcacuccaggcaggggcaggaggugaccuggaggucggaggagcaagcuguggcuggagagccgggcaggguuggucagcagguccgagggccugggccucccuggggugagggccagggugccucugcagggguggaagugggcugugagggggucuggguuuaucuccccauugcacagggcuccauggggugggcugagccaugagcgcccuucguggcaccuugguguccggcagggaggcaggggcccaggaggagggcaggacuggcuucaacggugucggccucuacccuuuugguccucacggaggaggcugcucccucuucccuggagcagccagggaugguguggggcccugguccccuggcuugauauaggcuucugcagaggauaugguguggccgggggcucagcugagaagccaccaggagacagauacagccucaggaagugguuuuguaucucugcugagaaccacaauccgagucacaugggaccauugagaucacgucagggugcaggcuggggaaggcugggagcugggguuuggcaaaggcguuggggugcucuugugcuggacaggcugcugcccaccgggccuggcccaggugaggugagagacaccugccccccacgucaaugccugggcacacgggcccagugcacacagccagcaggcgugcgucuugcaaugggggcuguggggaccccuuugcuccccugaucccuucccugcagacccaggccagguggauucaagguguggggcaggguaggagcugggcacugcuggauggcaugggccacccgcacuggggcugcugugaccuccgaguccaggcacugccuuccaccugguuagggacagggcagggaggcugaugggcuggcccagcguggggaccugcccaguggcccugugggugcaggccaugugccucugcauuuccuuuaccccaucuguaaaauagggauaacagcagcuucuuaaagggcuguuagccacgugcuuagacugugcccggaaaaugcacugucucuccugggcucccaaccuuucacaggccacaggcccauucccagaaguuuauuuuuuauuuuucgagacagggucucccucugucacuuaggcuaagagugcaguggugugaucuugguucacugcagccucgaccucccuggcucaagagauccucccgccucagccuccugaguagcugggacuacagaugcacaccaccacgccuggcuaauuuuuguauuuuuuguagagauggggucuugcuauauugcccagucuagucucaagcuccugagcucaagcgaucugccugccucagccucccaaagugcugggauuacaggcaugcacuuuuuuuuucuaaguagcuuuacggaggcgugcuuggcauacgguaaacugccccaguuuaaagcagacaguuccaugaguccugacauuuggaggcccugugaagccagcaucagcagagugggcacacccaucacccucacagcgucccccuguccccacgaccaggccacugcugcccuaccaucaggcacgauggaugggcuugugccuuguggaauuuuauuuggauggacucuggcagccaacgcugguuucgucuggcuucuuuuauucagcgucaugauuuugagcugugugucuguugugugugucggccuguuguuuggguagagccuacuuugccgauccaugcaccuguugauggacaugugggcggcuguaucccauuugggcucucacaaaugauacugcuaggaauagcuggagucucugugcgagcaaaugcuuuugcuucucuugugcaagcaagugguugaacugcucugcagcccgcugggaaguggaacggcugugucauggggugggugagggcuucacuuucuaggacacugacaaaccguuuucuaaagcagcaauccccuuuugcaguccagcagcuccgugcgacagcucuaguuccucugucuccuugucaacacuugguguggucggucuuuaauuuuagccaaucuaacaggugugucggggcccucccuggcauuccuggugacucacuguguggggucaucuuuucagcugcuuaguuguuguccacauaucuucuuugguaaagugucugucaaauugucuguuaagaaaacgugggugguuuuucauugaauucaagaguuuuuuuuuuuuucuuuauuuugagagagaaucucacucuccgucucccagguuguagugugguggcgugaucuugcuuggcucacugcaaccucugccucccggguucaagugauucuccugccucagccucccaaguaguugggacuacagaugcccgccaccaugacuggcuaauauuuguauuuuaguagagacaggguuucaccacguuggccaggcuggucucuaacuccugaccucgugauccaccugccucggccucccaaagugcugggauuacaggcaugagcuacggcucccggccgagauguuacauguuucuauauucuggaccaaguccucuaucagauaccugcucugugaagccuucccuuaucccuugcuaguccuucaguucuuuuaaacaauuuuuuuuuucuuuuuuugagacggagucucgcucugucacccaggcuggagugcaguggcgcgaucucggcucacugcaagcuccgccuuccggguucaugccauucuccugccucagccucccgaguagcugggacuacaggcgcccgccacuguauccagcugauuuuuuguauuuuuauagagacaggguuucaccguggucuccaucuccugaccucgugauccgcccgccucagccucccaaagugcugggauuacaggcaugagccaccacgcccggcccuuuuaaacaacuuguuuuuagagcugcggucucacucugucgcccagguugaagugcuuggugcuaugacggcucacugcaguuccaacuccugggcucaagccauccucccgucucagccuccuaaguagcugggaccacaggcgcaugucaccacgcccggcugauuguuaaauuuuuuguagagcuggggucuggcuaugucgcugacaaucaaaaugaggacuugaagcauacuccucaaaucaucgagguuuauugagccaacgugagggcacgcccaggaaaaacuccagucacagaagcaucuguggcugcuuuuuccaaagaggugcguaggagguuucauucauauuuauauguuuucuugaaaaggggaggggcaucaagugagacaaaugauuauauacuugcgagacuuuaguuagagcccaguaaaucuacauuuuacagaagacguauauuggaggaaagagggagcauggaagcguauaucccagggaggcggaagaacaucucguuaucucgucucgccuuuguucugugccugggaaggaagacaagccggcgucuuaugaaaaggcugguuucuguucagcccuuugggaagaaaacccaaugacaguuaucaagggagggggugugaugauacguauccaaccgcacauccaucauggcccugaacucagcuuccaggguuucucugggguucccucggccaaguggggauccacucaguuaggugggggggggggugcuuagaauuuuauuuuuauuucucauugcccagacuggucucaaaacccuggucucgaucaauccucccaccucagccucccauucucuuaauagugcccuuuuagagagcaaacguuuugacuuugaugaaguccaguuuaucaacuuguucccuuauggauuguguuuuuuggugcucucagaaaucuuucccuaaaccaagggcacagauuuucuguuuucuuccagaaauuuuguagugucagguuucacacugagguggauauuccuuuugaguuaaugucugaccagcugggaggugucgguggaggcucccuuucugcccgcggguuccagcacauuugcugggauggcccuccucccuccacagcagaguucuacccgcccucaccacccuguaucaacucaucucaucgauaucucccaacggcuggggaacaagggcugacucggcugcaaucauccugcagccagacucggggaccuaggacucugaaccuccaacugguguggcuucaggguccccaacuuuucagaccccaccucuguguugcucugcaaguggggaucagcagggcuguaccccaaaugcugcuugcuucucccgcccuccucccucuccccaucugcucuuggcugcacccccaacccugacccaaguguccuucacgcucagcaacgccacagccucugacacuccacggcacuaaagugucaagagacccaggggaccugcgagauccaucucgccccacacaccaccagguccccaggacuuggaggaugcugauggcccagcucuggguccuaagcauggcaguaucacagccucacaggcacauguguaugugugugugugcacguguguaugggugcgugugcaccuguguauaugggugugugcacguaugcacggauguguguacacauguguaugggugugugcaugggugugcacauguguaugggugugcauguguguauagguguguguaugugugcaugggcguguguaugugugcaugggcguguguguacuuguguaugggugugugcaugugauugggugugugcauguguauauaggugugugugcacguguaugggugcgugugcaccuauguguguauagguguguguguuuauguaugggugugugugcacauguguauagguguguguaugcgugcaccuauguguguauaggcguguaugugugcgcguguguagguguguguucauauauaugggugugugugcaccuauguguauaagugugugugcacauguguauagguguauguaugguuguguguguauagguauguaugugugcacauguguguagguguguguguucauguauauaugggugugugugcaccuauguguauaaguguaugugcacaugcguauagguguguguguuuuauguaugggugugugugcaccuuuguguguauaugugcaugucuaugugugcacauguguguagguguguguguucauguauauaugggugugugugcacccauguguauaaguguaugugcacauguguauagguguguguuuuaugugugggugugugugcaccuuuguguguauacgugcaugucuguguguguuuguggguguguguguaccuaugucuguauagguguguguguuugugucugggugugugugcaccuauggguguguguguguaugcaugugugcaugucccucacagggcagagcuggaaagaacuggagaggcugaggcuggucccuucaucucagggugaagcaccuuuacccagagaaggagggucguggccugggcuacuuugugggcuggaguccuggucucugucacugaaaaaagcaaggcagagcgucugggaggggugucaugcggggcuuucugagucacuggcugcgugagaugugaguaggucugugggauagggagcuggccagggacuugagcucccugccugcuaugaccucagucagccccugcccauugucaggcuccuucccugucuagggguacccaguagagcugcccagcccugccacuccagcuuguuugaggaaaaagugcaaccaugcuguggguggaggcagaugugauucuguccucagaggcaugggggugacuccauggcucugagccaaguugcagcucuggggcccuucuugauacuccagggccccccaucaccccagcaccgagaugggcaugagcagaggggcucauggugauggggugggcguggcugggagaagccugcauaugaaggccucugucauuggaggagacugucccaugucccuccagaucaugucccugaguggggagcgccuucugggcagaguggcacacagggucccacccaucucaaguccaugggauuaacuccccugugcuggaagcugcaggagcugcugccuguggcugaggagaggccaggacgggccaaggagagcaggcaagagaagggguggggcuggcagggagggggcuccauuaauucugaugucauuuauugcuguuccuauauuuguauaauaaauggaagaaaauagugguugggggcuugcuggggacucagggaggguuggggaccuccagggcuuccauucgaccugaggcccauggugcagugaguccugccuggagucccguccagcaggaggcaggagagcugguguuuggagaugugaggggcugggcccucccaggugagcggguugggaaaggaaagggucugugcugggaaauccaaggggcaaggccguuucccguccugguccgucguugaguccccugccgugggacagcgcucagcauggcacagacgcucagccgugucauguggcuuguagagcgagggugugcggccggcaucauccucagggaacucuggagggacugggccucaguuggccuggccuggcgcggggcugccagccaagagccuuccuccaucccauugagagccagggcagguccuggagauggcagccugcagguugaagcccccgacagcugggggaggcauugcucugcacagguagggccauggggcccgcuggccaggguggccauugcucaguggcaccagcugggcagacagccgcaugcgcucaccacucgcccuccacagaugggagccugggagagcccugccucccggaacggacauccuccuucaccaaauccgcaaaauaggccugaugccaggaacggggcacugcagggcccuugggagggagguaagcgggcagccgggccaaccugcugcuuggggaagggcuguggcuggccccagccuccuaccgcuggcccaguggucucuccacacaucacccaguguggagugguuuuuugucuuucuuucgaaacaggcuuuccucacugagggcucaccauggggcugugcuggggacacuggauguguccaggguccgucaagaagcguuggggguagucagggucucagggaccacucugcuguccucgagucuccugguggugaccaguggugacucuuguggcgcccgggccacagcuacuuuguucaccuccuaggagggaagagggcgagggugagccuagggcagaugccagggcagugaggcucacgugggucucuuugccugaugugccgguguccaggcugcagugggcacccgagcccugugggaagccuccugggucugcagcugagcaaaacagcagccgccagaugaugggcccuaaguggcugcagauagcaggcaccauuaaaugcagaggccaucugaggcugcaggcucagcacagguggcuuuggugcccuuagggaggggcagcgguggagcccaggucucugaaacauuuaugacuucaugcgucagcuggaggcucuuucaccgcccagacaaaaggcccuugcgucagaguguuccauguggggcgggagcuugggcugagagcuugggccccugcucccagagaggcccagagcugggguggccacaccugcugggaaugcugcuggugggacuagguuaaggcgagaaggagguguccauggccagguggauuagugcagauugugauggugugguggugcucacggugggggacuugccuaugggaaccucaucacagccccacaucgggcccuuuuacagaugggaaaacugaggcauggggugcauagcuagugaggagcagagccagaugggaaccaggcgucgacuucagagcugaccuuugugcauuugugcauuguuuguguugugauaaaauacacguaacguaaaauugaccuuuuuaacccauguuucauggucuucgguuuacucgcagugcuaggcguccgacacgucuuucuaauuccugaacauuuccaucauccgcaagaggaaauuagcagucaccccuuucccccaugcccccagcuccugacaaccacaagcccacuuucugccccuggauuuagcuauucuggauguuucaugugccugaaaucauggcaaacguggcccugugugucugguuuccuucaccgagcguccugucuucacuguccgccguguuauaacacgcaagggaauucccuuccuuucugagcugaguaguggucugugguguggauggacuacgugcagcugucucugccuuuggcuguuguggcuagaggcuccuuccugaaagccugauacuuagaauggauuuaaaaacaaauucaaauguguguugcuuaugaaaaucacaaaauuaaguaugaugccaucaaaaugaaaaaauggcuaaagauuuucaagcacacacaccuaaagauagcagacauuccauucaaccuucaucucaaagaauuagggcaaggagggcgauucuaaauggcuggagacauagucagcugugaagcuguaacuuucaugaagacagugacgugguuugucacugcccggaucucaucuugaauucccuguguugugggagggaccuggugggggguaauugaaucacggggacgagucuuuccugugcuguucucguaauagugaauacgucucauaagaucugaugguuuuaaaaagaggcauuccgcuacacaagcucucucauguuuugccugccaccauccacguaagaugggacuugguccuccuugccuuccgccaugauugugaggcuuccccagccacauggaacuguaaguccaauuaaaccucuuucuuuuguacauuugcucagucuuggguaugucuuuaucagcagugugaaaacggacuaauacugacaauaaauuaaaaacuauuuaaaaugcaaaggaaaauauaaauuuaaaucaccucuucgagucucugguagaucaagaaaacaaaaauaaucugaauuauugauauaguuaaauuaauagauauaucaaacuuuguaacuuaaaagcaaaagauguaccuuuuacaguguuccuggaacacucacaaacauugaucauauacuagacugcaaaaacuucaagacauucuaaaauuaagaaccuaugcuggauaucucugauuucaacguauguuuaaaauauauguuauuaauuacaaguuuaauuaaugaaagucuaaagaagaaaagucuacuuagaaguaaaaacaucagcaauauuacuguguaauagaucugaacauuaaaggggcauauaugcauaucuguacaccgaggcaaauuuauagcuacaggcauuuuccuuuuuugaaaaaaguaaauauguaaguuaaaaaguucacaguaagaaaagugaauguaaauaagagauaagaauagaaaauaauaggaaacaggaaaacagacuugaggguucuuuuugggaggugauucuugguucuuugaggaaaacaauauauaucuuauaauuucaaucauggaaaaaccccaaguauauaucuaaauuuagacaugagaaggcucuuuggcaaucgauuuagaaaaguuuuguuuguguuuuuaagacagagucucacucaaucacccaggcuggagugcaguggugcaaucuuggcuuacagcaacgucuaccucccggguucaagcgcuccuccccccucagccucccaaguagcuggguuuacgggcaugugccaccaccccuggcuaacuuuuuguauuuuuaguagagacaaagguuucauuauguuggccaggcugguauugaacuccugagcacaagugauccacccaccucggccucccaaagugcugggaucacaggcaugagccacugcacccagcccaguuuuuaaugugacaguacuuuguaaaauuguacuccagugaauuugaaaaauguugugagauggcuuauucuuugggaaaaaauguuaagucaaaauuaggaagaaguggagacaaucucaguaugugugagaugaaucugaacccucaucagaacguccacagcugacggugaacacauuggcaggugagauauguggagacauggcacguggugaaaaugcuuggcaaaguguucaaggcaggauggagauaccguaugggcauucacuggacaguguuuucaucccguauguuugaacaauuuuuaaugugggaucaaagguaggaaaugcucuuuacaaagucaucaaaaaguuuuuucuggaaaagccuccagcccacggugaccuagguucuucccaccauugaauuaggaugccgucugcuacugagagagccagucauguuaguggcucaaugggcagggugcccagguuagcugugaacaaagugaucucucugcugccucacuagcagagagaaaagaaaacuacagaccagugauauguacacagagagcaaugaaaauccucauuaugauggcagacuaaacccauaguguguuaaaaaugaccacacauguaggcuaggcacaguaguucaugccuguaaucccaccacuuugggaggcuaaggugggaggauugccugagcucaggagaccagccugggugacauagugagaccccaucucuuuuuauuaaaaaaaaaaaaaagaccauacauacacacaugcacacacaacagugguaauggauuauaauucaugaaaaaagaaucuaugcauccacagggacacacccauguauauaaacaaauaaguggaagaaaggaauccaguucucacguuagaaucaacagggcuggaaggccaucaaggaaaccccguggcaggggcagggguucaaagagcuggugguuguagucucagugucucccaccaccacuuacuaguuacaaaggaaaaagaaucacuuucuagaggcaaagcuggcgacaccacccgagccaagugauccaaguuaacaucaccaggaaugggacaggccagcuucaccacccuccggauggacagccucgguagcagaacuccugccaaagacacagcuguccagggucgaaucauccggagacacagggcaaacccacauggagggagacacacacaguggccugaauacuuugaaaaugccagggccaaaaaacguagaaggcuaaauaaaguaccguucagggugaaggggaaggaagaaaugugaugccuaagugggagucuaugauuccacuauguuauguauuaguccauuuucaaauuacugauaaagacauaccugagacuggauaauuuauaaagggaagagguuuaauugacucacaguuccacauggcuggggaggccucacaaucacagcagaagaugaaggaagaacaaaggaacaucuuacaugaugacaggcaaagagauaaugaaaacugagcacaaaggguuuccccuuauaaaaccaucagaucucgugagacuuauucauuaccaugagaacagcauggaggaaaccacccccaugauucaauuaucucccacgaggucccucccaugacacgugggaauuaugggagcuacaauucacgaugagauuuggguggggacacagccaaaccauaucauuccaccccggccccucccuaaucucauguccucacauuucaaaaccaaucaugccuucccaacggugccccaaagucuuaacucauuucagcauuaacucaaaaaucugcaguccaaagucucaucugagaccaggcaagucccuuccaccuaugagccuguaaaaucaaaagcaaguuaguuaauuccuagacacaauuaggguacaggccuuggauaaauacacccauuugaaaugggaguaauuggccaaaacgaaggggcuaaaggccccaugcaaguucgaaauccaguggggcaguuaaaucuuaaugcuccaaaaugaucuccauugacuccaugucucacaucuaggucaugcugaugcaagagguggguucccauagucuugagcagcucugccccucuggcuuugcaggguacagccucccuccuggcugcuuucacaggcuggcauugagugucugcagcuuuuccaggcacauggugcaagcuguugauggaucuaucauucugggaucuggaggacaguggcccucuucucacagcuccacuaggcagugccccaguggggacuuugcaugggggcuccaaccccacuuuucccuuccucacugcccuagcagagguucuccaugaggaccccaccccugcagcaaacuucugccuggacauccaggcauuuccauacaucucugaaaucuaggcagagcuuuccauaccucaauucuugacuucugugcacccacaggcucaacaccacauggaagcuaccaagaguuggggcuugcacccucugaagccacagcccaagcuguaccuugacaccuuuuagcuauggcuagagcggcugggacacagggcaccaagucccuaggcugcacacagcauggaggcccugggcccaguccaggaaaccauuuuugccuccuaggccucugggccugggaugggaggggcugcuccuaaggucucugacaugcccuggagacauuuuccccauugucuuagugauuaacauuuggcuucuuguuacuuaugcaaauuucugcaggcugcuugacuuucuccucagaaaauggguuuuuauuuucuaucacauuuucagacugcaaauuuucugaacuuuuaucucuguuucccuuucaaaacugaaugcuuuuaacaacacccaagucaccucuugaaagcuuugcagcuuagaaauuucuuccaccaaauacccuaaaucaucucccucaaguucaaaguuccacaaaucucuagggcagugguaaaauacugccagucucuuugcuaaaacauagcaagagucaucuuuaauccacuucccaaaaaguuucucaucuccaucugagaccaccucagccuggauuucauuguccauaucauuaucagaauuuuggucaagcccuucaacaaguuucuaggaaguuccagacucucccacauuuucuugucaucuucugagcccuccaaacuguccaaccucugccucuuacccaguuccaaaguugcuuccacauuuuuggguaucuuuacagccgcaccccacucccaguaccaauuuacuguauuaguccauuuucaugcugcugauaaagacauaccugagacuggguaauuuauaaagggaagagguuuaauugacucacaguuccacauggcuggggaggucucacaaucauggcggaagaugaagaaagagcaaaggcacaucuuacguggcagcuggcaaagagagaaugaaaacagagugcaagggguucccccuuauaaaaccaucagaucucaugagacuuaauucacuaccacgagaacaauaugggagaaacugcccccaugguucaauuaucucccacugggucccucccacaacacaugggaauuaugggagcuacaguucaagaugagauuuggguggggacacagccaaaccauaucagaguugaauccugucugggaagagauggcugcaauagccagugucugggcagcugaugaugugagagugugagguagagaacuguagugugcaauagagaccuguagugugcaugucaguguuguuucccgauuuugacaacaguaccacaugguuacagaagagaacacccuuauuccuaagaaauccaugaggaggcguuuagcagaaaacaggcauggugucuccaagggcucagaaagauucaaccaaaagagggaagucuggagagggacaggauggagcaggacgggggcaguguagaaaccgcaggcaagucuaagcagagcacguuugggaguuccuucugcuauucuugcaacuucucuauaaguuugaaaugaaaucauauaaaucgaaaguuagaagagaauuaccacaucauguuggauuucacucauagccacgagaacgggugguggucucuucugcagugaacugaugcgaugugugaugucacuaguucucauccaaagcagaugacaauuccaguuacuccucaccagacauaagaaaaugcuuuuaguagaucaguuuuucugauuguaaaguucagaaauguuaaucagagaacgugcagaaauuuuuaaagaagaaaaguaaaaugacucaucguaccaaaagccagagaugccagcuuuuaguuuccugcuagucuuuuucucggcgugugugugugcgcgcgugcaugcacauguuucuacuuggucuuuguguguguguuaagggcguguacacacacagugcagucaggagugaguugcacgucuacagcuaggcugcuuccccgaggcuguguggccaucagccaggcguccccaacccccaggccaugaagcacuaccaguccauggccuguuaggaaccaggcugcacagcaggaggugaguggcaggugagcaagugaagcuucaucuguauuuacagucacuccccaucacucgcauuaccgcgugagcucugccuccuaucagaucaguggcggcauuagauucucacagggguguguacccuguugcaaacuaugcaugugagggaucuagguugccuccucuuuauaagaaucuaaugccugaugaucugucacugucucccaucacccccagaugggacugucuaguugcaggaaaacaagcucagggcucucacugauucuacauuauggugaguuguauaauuauuuaauucuauauuacaauguaauaauaguagaaauaaagugcccaaugcaaguaaugugcuugaaucaucccagaaccacccacaccacuggucuguggaaaaacuguuuuccaugaaaccagucacuggucccaaaaagguuggggaccacggccaucggcuguuugcuuuaugaauuugugccucaguuucuucaucucugaaacgggaacgaugggagcccucaccucguauggugguuugaggauugaaugaacucauuguccagcacccuuagcuucuugccagcucaggaagugcugagcaggguaaccccuaucacugcguguguguguguguauaugugugugugugcauacuugccuaugugugucugugcaaauacuugguaaaauugagaggguacuagacaacucauuuguaucuucuuaccuuuugacacauggcagacaugucucacaucuguucuuccuccaaaugugaccuuucaauggcugccuggcauuuccccuguguuauugaacguaaucaacucucuauugacggcuggguuauuuccuaauugacugcuguaaauagcauugugaugcaaauccuuguacacucauuuuugccuggaacucaagauuauuuccuugggucacauuugcaggagaagacugacaggaucaaaggguuccugcauuuuuauggcucugacaccuuuggccaaaucaccuuccgggaguguuuuccuaauuuagcuuccuacugugcugcuggacaucacugacuccccccgccaacccccaccccacacugcaccacaaagcuggguauuaucauaaaaacacugccauuaugaugaagcaaaaauagaauauccuuccuccucuuagugaggggaguauguuuauguuuguugagcucuuuguauuuuagccacccauucacuggcccaccugccccuggugcaccugcagcagcaagacugucaucuagguuguuggggaaaccaggagugaguggagcacgagggucacccuccaggaagugaccugcaagagaauggagagagucauggaccggcauggcgugguaaugcauggugcgugucucuuagcaguaagaccuugagaaggagccaggcagggaggaaugggagggugaaggagugccuuuuguggaggggagucggacacagaugggauuucagcagagaccugauggaauugagggaguggguggugugugcuucugcaggaagagcacccagacagagggcauggcacaugcaaagguccuguguugggaacgugcuuggugcaugugaagaacugugcagggaaggugcuggagauaggacgggagggccacgaggguuaagauccugagagcaaugcggggggugugagugaugagggacaacaucaguccucucuuggcuucuguacuuuaaaaaaaucauuuuguuuugaagcaauuuuagaccuacagaaaaguuccacgacaguacugagaguuccuguggacuccuaguauuaacaucuuaauaacgggguguauugaccaaaaccgacaccugauacauuaccgugaacucaacugcagaucugauucaaaucccgcguuuuucuagcauccgguuucuguucugugauccccacguugcuuucagcugccaggucuccuuucguguccugcagccugugccagcuccucagucucucuuugucuuucgugaccuugauguuuuagauaaguacugggcggcuguuuuguagaacgucccucgguuuggauucucugauaugcucucaugauuagaucaagauugugcauuuuuggcaagaacaccgcgggaguguuguugggucccgaggagucccuguggcagggcugugugaggucagcaugucuuagggcggguucauuugaccuugaccacucagguaggagugugucagcugggcuucucagcuguaaauuaaccauuuuccgcuucauaauuaguaaacaccuugaggaagcuacauugagacauugcagcugccuuuuuucuccugagauuuugccccgcugauuuuagugcccaucagcugguuuugcuugugacaggcaaagucuguggugcuugccaaauggggauuuguuuauuucccacuuucuuucuauguuuguuaauuuggauucuucuccaggaagagcuguccccuuuguucugguuauguauccaguggcuuauguauaucagcaugguuucauagauacuucuuuuguguuaugggcuauaagccaaugcuauuauuauuuauuuuccuccauuuauuuauuuauuuagagacggaguuuuacucuugcacaggcuggagugcaguggcaugaucucggcucacugaaaccucugccuccgggguucaagugauucuccugccucagccuccugaguagcugggauuacaggcacguaccaccacgcccaacuaauauuuuguauuuuuaguggagacgggguuucaucauguuggccaggcuggucuugaacuccuaaccucaggugauccacccgccuuggccucccaaagugcagggauuacaggugugagccacugcacccagccucauuauuuauuuucauugcucaaauugugcuggcuuuugccccagaaacaaccuuccauucagcuuccaugccccuuuggugggcccugucuuuucuuggacacugccuuccuggcaccccaagaugcucugggcucagcuuguauuuccuugccucagucuugaaaucacccacuucuccaaggagccaggguuccuuccauuggagaguggucuuuagaaacccaggccugggugcauggugugcucaucgccacuguggaccugcugcucugcgcccacucggccgacggagcuggggaauauguguauggcacccccacgucuacgcuucuguguucaucugcagauauauucauacaugagugggcucauacugucuccaacuccaguucugccccaguggggccaauucucucucuuuguuguaacaccuuucuucaauagugagaaaccuggcucucucaccuucaccugcucguccaaccccagcugcaagggaacuggcuccauacuugcugaugcgugcccccaugagaagugacugaccacccagagccuggcgccugugcauggcgucugugcacggcgcgucuugucuucagccucacugcgucccaucagugcuuuuccccacggugacuuugaguauuucuuuacuucuguacucccuucagugugauuaugucauucaucugugacauguuuagauuuaucuguuagguugguauuccauuuugggugucccccgauucugauuguuuuuaguuacuuaucugggggucugugugaagggaauguaaagcugcugugacuccuggagucagaggugcacaaagaguguccucagaggagagccaggcgcccacccugccagcccuucccuccccacuccaucccccacccccccacccuggacaaaaccagcucuucagccuuucaugucucucuugcaggccucucgcacagaugagaaaauacacguguguuuuccuguauccccucuuucuuacaaaaagggaagcacacuaucaauacucuuguagaucuuuaauugcgguaagauacacuaaugcaaaauuuaccauuuuaacuauuuuuaagcacacaguucaguggcaugaaguacauugauuuuguuaugcaaccaucaccaccauccauuucuagaauuuucucauccucccaaacugaaacuccauccccauuaaacaccaacucccccauucucucuuccccagccccuggcaccuaccauuuaccuuucgucccuauggauuugacuaauccaggaacuucauaaaagugggaucauugaguacucuauuugucuuuugugacuggcuuauuucacuugggcauaauguccugaaaguucacucaugcuguagcaugugucagaauuuccuuuuccuuuucaaggcugaauaauauuccacuguauggauagaccacauuuugcuuauccauucaucuuuugaugaacauuuggguugccuccauguuuuagcuauugugaauaaugcuacuaugaauauggguguacaaauaucuuuucaacgcccugcuuucaauucuuuuggguauauacccagaaguggaauuucuggauuauaugguaauuauaguuuuaauuucuugaggaaccacuaugccguuuuccacaguagcuaccacauccucaccaacacuuguaauuucugggguuuuuuaauaguagccauucuagugggugugcagugguaucucauuauaguuuugauuuacauuuucuuaugaguagugauguugaguaucuuuucaugcucuuauuagccauuuguauaucuucuuuggagaauaucuccucagcucuuuugcccacuucauuaaauugagagguuuguuuuugcuguugaguuuuagaacuucucuauauauucuggauauuaaucccuuaucagauauaggauuugcaaauauuuucucucauucuguggggugccuuuuuacuccguugauagugucuuuguacaaaaauuuuuaauguucacgaaguccaaguugucuacuuuuuguuuuguugccugugccuuuggucuuuguguuaguccauuuagcauugcuauaaaggaauaccugaggcugguaauuuauaaagaaaagagguuuaauuggcuuaugguucugcaggcuguacaagaaacauggugccagcaccugcuucuggcgagagccucaggaagcuuccaaucacggcagaaggugaagcgggaguaggugucucauaugaugagacagggagcaagagaaaggagguuccagucuccuuuuaacaaccagaucuugcaugaacucauuaccuaaucauggggaaucugccccuaugacccaaacagcacccaccaggccccaccuccaacgcuggggaucacauuucaacaugagaguuggaggggacaaauaucugaacucuaucaauguuauauccaagaaaucauagccaaauccaaugucaugaagcuuuugcccuauguuuucuucuaagauuuuuauaguuuuacguugcacauuuagauauuugauccauuuugaguuaauuuuuguauauggugugaaguaaggguccagcuucccucuugcauguggauuuccaguuuucccagcaccauuuguugaaaagacaguccuuuucucauugaauagucuuggaacccuagucaaaaaucauuuaaccauuuaugccacgguuuauuucugggcugucucauguuccauugguuuauaugucugucuuuuugccugugucacacugucuugauuacuguaaguuuauaguaaaguuuugaaaucagaaaguguuaggcuuccagcuuggcuuuucuuuuucaauauugcuuuuggcuauuuuaaguuccuugagauuccauaugaauuuuaggauggguuuuucuauuuuugcaaaaagugucauugggauuuugagagggauugcacugaaucuauaaaucacuuuggguaguauugauaucucaacauugucuucuaauccaugaacaugggauauguuuccauuuauuugcaucuuuuuaaguuucuuucaguaauguuuuguggguuuugcugcagaagucuuuuaccuccuugguuaaguuaauuccuaaguauucuacuugaugcuauuauaaauuaaauuguuuucuuaauuucauuuuuagauuguucauuguuagcauauagaaaugcaacugauuuugcauguuuaccuuagauucuguaacuuugcugacuucauuuauuagcucuaauaaguuuuuguggaaucuuuagggguuucuacauaugagauuauguuaucugugaauagaaauaguuuuacgucuuuuuuuuccauucuggaugccuuuuauuucuuuuaauuuuuuucuugccaaauugcucuggcuagaauuuucaguacaauguugaauagaaguggugaaaguggucacccuggccuuauuccugaccuuagagggaaaaauuucagucucaucauuaugauguuagcuguggauuuucacauaugguuuuuauuauguuaagguaguuuccuucuauuccuaguuuguugagaguuuuuaauaaggauguugaauuuugucaaaugcuuuuuguaucaauugagaucaugugaucaugugaguguuauuucuucauucuguuaauaugcucuuuuacauggauuuauuuuuguauguugaaccauccuugcauuccaggacuaaaucucacauggucaugauauguaauacuuuaacuauguuucugaacucaguuugcuauuuuguugagaauuuugcaucaguuuucauaagggauauuggucuguaguuuucuuguagucuuugucuggcuuuaguaucagaguaaugcucuccucauagaaugaguuagaaaccuuuccccuccucuuuaauuuuuugggaaagauugagaaggaugggaguuuauucuuuaaauauuugguaggauucauuggggaagccaucagguccaggcuuuucuuuguugagaguuuuuugauuacugauucaaucuccucacuaguuauagguccaugaagauuuuguauuucuuugugauuuaguuuugguagguuucguguuucucagaauuuguccauuucaucuagguuauccaauuuguugauacacaauuguucacaauacucucuuauaauccuuuuuauuucuguagaauugauagucaugucccuauuuucacuucugauuucaguagucuucucucuuuuuuacuuaguccaucuagcuaaagguuugucaauucuuaaaaucuuuucagagaagcaacuuugauuuaauugauuuuucucuauuguuuuucuauucucuauuuuguuggucucugcugugguauuuauuaucuucuuucuucugcuagcuuuggguuuaguucuuuugcuaguuccuuaagugguaaaguuagguuauuuacuggagaucuuucuuguuuauuaauguaacaauuuauagggagggaguggagcaagauggccaaauagaagccuccaauuguccuccccaacaggaacaccaaauuugagaacuaucuacacaaaaaagcaccuucauaagaaccaaaauucagauaagcaaucacaguaucugcuuuuaacuuuauauugcuggaagaggcacugaagagggcaagagagacaguacugaaucacugacagcacugugccucccaucccccagcuauguggcauggagagagaaucugagagcuugggggagggaaagugcagugcuuugggacuguccaucgagcucagugauucccuguugccacagaaagcagaaccaggcuaaauucagcccacacccagcacagagggagcauuuaaaccagcccuagccagaggggaaucacauaucucaggggucagaaacugaguuccagaaaaccuugccaccacgggcuaaagugcucugggguucuaaauaaacuuguaaggcagucuaggccacaauaacugcaauuccuaggcaaguccuauugcugagaugggcucagagccaguggauguggggggcacacaaccuagugagacaccagccaggguggcuaaccccaggcagcacagcucacagaaacaaaagugacucuuuuccucugcuuaaagagaggagauggagcaguaaagagaacauugucuugcaucuuggauaccagcucaaccacaguaggagaggacacugggcagagucaaugggcacacauuucaggcccuggcucuuggacauuuccagacacacccugggccagaagggaauccacugccuuggagggaaggaccuagucuugucagaauucaucaucagcugacuaaagagcccuuggacccugaacaaccagcagugccagguaguauccugugggccuugaaugagauucugaaauauacuggcuucagguaccagcuugaccacagugggguagagcaccaaaugggcucuuggggucccugauuccaggccuuggcucuuggacagcauuucuggaccugcucuaggccagaagggagcccacugaccugaaaggugaguccacagccuagaagccuucaccacaagcugacugaagagcccucaggccuucaguggacaaccaugguagccugacaguacugccuaugggccuguaguggugguggccacagggagaggcuccuuugccuauggaaaggagaaggaauucuggguaugacuuugucuugugcuacuacugagugccagcuuagccucuguaguauaccacaccagguagguuucuaaggucuuugacuacagacccuugcuccuggauggcaucucuggacccaccuuggacuugggggaacucaccacccuaaagugaaggacaaaagccuggcuggcuuuaccauuugcuaauuguagagcccuggggcuuugagugaacauaggugguagccagguagugcuuacagcgggccuugggugaaacccagugauguguuggcuucaggucugaccagcacagucccaguggugguggccacagguaagcuugugucacuccuccccaagcuucagguggcuuagcauagagagagaguccauuucuuugggagaaaguaagagaagaaaacaagagucucugccucguaaugcagagaauucuucuggaucuuaucuaagaccaccaaggcaguauuuuuuuuaauauuuauuuuuugaaacagaguuucacucuuguugccaaggcuagagcgcaauggugugaucucagcucaccgcaaccucugucucccggguuuaagcgauucuccugccucagucuccugaguagcuaggauuauaggcaugugccaucaugccuggcuaauuuuuguuuguuuguuuguuuguuuguuuuaguagagacaggguuucuccauguuggucaggcuggucuugaacucccgaccucaggugaucugcccgccucggccucccaaagugcugggauuacaggcgugagccacugcgccuggccccaaggcaguauuuuuaugagucugcaagaaccacaguguuacugggcuugggaugcugccuaaugcagauacggcuuagaucacaacacccaagucccuuugaauaccuggaaagcuuuaccaagaaagauggguacaaacaagcccagacugcaaaggcuacaauaaauaccuaacucuuuaaugccuagacaccaaugaacaagaccaucuaggaaaacaugaccugaccaaacaaacuaaauaaagcaucagggaccaauccugaagaaaagagauaugugaccuuucagagagagaauuuaaaauagcuguuaugagaaaacucaaauucaagauaacacagcgaaggaauucagaauucuaucagauaaauuuaauaaagagauuaaaauaagaaucaagcagaaauucuggaguugaaaaaugcagcugacauauugaagaauguaucagaaucucuugauaacagcauugaucaagaacaaaaaagaauuaguaagcuugaagacaggauauuuguaaauacacagaggagacagaauaagaacgaaugaagcaugaucuagaaaauagccucaaaagggcaaaucuaagauuuauugaccuuaaagaggagguagagaaagagauagggguagaaagcuuauucaaagggauacuaacauagaacuucccaaaccuagagaaagauaccaauauucaaauacaagaagauucuagaauaccaagcagauuuaacccaaagaagacuaccucaagguauuuaauagucaaaguuccaaaggucaaggauaaagaaaggauccuaaaagcagcaagaaaaaaaagacuuauaauugaacuccauuauaucuggcagcagaguuuucaauggaaacuuuaugggccagaagagaguggcaggacauauuuaaggugcugaaggaaaaaaaagaaaaaaacuuuugcucuagaauaguauaucuggugaaaauauccuuccaacaugaaggagaaauacagaccuucccagacaaacaaaagcugaggaugucaucaacaccagagcugucuuacaagaaaugcuaaagggaauucuucaaucugaaagaaaaggguguuaauaagcaacaagaaaugaugugaagguacaaaacucacugguaauacauacacagaaauacaaauaguauuauaacacuguaauuaugguguguaaacuacucauauauuaaguagaaggaugaaaagaagaacugauaaauaaugacuacaacaacuuuugcgguacaauaggcaguacaauaagauauagagacaaaaaaacuuaaaaagcggagagacaaaaguugaaguguagagauuuuuuguuuuacuuuaaguucuggaauacgugugcugaacgugcagguuuguuacauacguauacagugccauggugguuugcugcaccuaucaacccaucaucuagguuuuaagcccuacaugcauuagguauuuguccuaaugcucucccuccccuuggcccccaucuccccacagaucccggugugugauguuccccucccuguguccguguauucucauuguucaacuuccacuuaugagugagaacauaugguguuugguuuucuguuccuguguuaguuugccgagaaugguuuccagcuucauccccacaaaagacaugaacucauucuuuuuuuauggcugcauauuauuccaugguguauaugugccacauuuucuuuauccagccuaucauugaugggcauuuggguugguuccaagucuuugcuauuguaaauaguggugcaguaaacauaugugugcaugugucuuuauaguagaaugauuuauaauccuuuggguauauacccaguaaugggauugcugggucaaaugguauuucuaguucuagaaucuaguucuagaaucaccacgcugucuuccacaaugguugaacuaauuuacacucccaccaacaguguaaaagcguuccuauuucuccacauccucuccagcaucuguuguuuccugauuuuuuagugaucgccauucuaacuggcaugagaugguaucuccuugugguuuugauuugcauuucucugaugaccaguaaugauuagcuuuuuuuuccauauguuucuuggccacauaaaugucuucuuuugagaaguaucuguucguauccuuuacccacuuuuugaugggguuguuuuuuucuuguaaauuuaaguuccuuguagauuuuggauauuagaccuugucagauggauagauugcaaauauuuucucccauucuguagguugccuauucacucugaugcuagcuucuuuuacugugcagaagcucuuuaguuuaauuagaucccauuugucaauuuuggcuuuuguugcaauugcucuugguguuuuagucaugaaguccuugcccaugccuauguccugaaugguauugccuggguauucuucuaggguuuccgugguuuuagguuuuacauuuaagucuuuaaucaucuugaguuaauuuuuauauaaguuguaaggaagggguccaguuucuguuuucugcauaugacuagccaguuuucccagcaccauuuauuaaauagagaauccuuuccgcauugcuuuuuugucagguuggucaaagaucagaugauuuuaggugagugguguuauuucugaggucucuguucuguuccauugguuuauauaucugucuucauaccaguaccaugcuguuuucguuacuauagccuuguaguauaguuugaagucagguagugugaugccuccagcuuuguucuuuuuacuuaggauugucuuggcuauaugggcucuuuuuugguuccauaugaaauuuaaaguaguuuuuucuaauucugugaagaaagucaaugauagcuugaugggaauagcauugaaucuauaaauuacuuugggcaguauggccauuuucaugauacugauuauuccuauccaugagcauggaauuuuuuuuccauuuguuuguguccuuuccuuuccuucagcagugguuuguuguucuccuugaagagguccuucacaucccuuguaaguuguauuccuagguauuuucuucucuuuguagcaauuaugaauggggauucacucaugauuuggcucucugcuugucuauuuuugguguauaggaaugcuugugaauuuugcacauugauuuuguaucccaagacuuugcugaaguuggcuaucagcuuaaggaguuuuugggcugagacaaugggguuuucuaaauauacaaucaugucaucugcaaacagagaaaauuugacuuccucuuuuccuauuugaauacucuuuauuuuuucgcuugccuuauuguccuggccagaacuuccaauacuauguugaaugggaguggugagagagggcauccuugucuugugcugguuuucaaagugaaugcuuccagcuuuugcccguucaguaugauauugccuguggguuugucauaaauagcucuuguuauuuugagauauguuccaucaauuccuaguuuauugagaguuuuuggcaugaagggauguugaauuuugucaaaggcuuuuucugcaucuauugagauaaucaugugguuuuugucauugguucuguuuaugugauguuuagugauuuacauauguugaaucagccuugcaucccagggaugaagcccacuugaucaccauggauaagcuuuuugaugugcugcuggauucaguuugccaguauuuuauugaagauuuuugcaucggugcucaucagggauauuggccugaaguuuucuuuuuuugugugucgcugccaaauuuugguaucaggaugaugcuggccucauaaaaugaguuagggaggggucccucuuuuucuacuguuuggaauaguuucagaaggaaugguaccagcuccucuuugugccucugguagaauuugggugugaauccgucugguccugggcuuuuuuugguuggcaggcuauuaauuacugccucaauuucagaacuuguuguuggucuauucagggauucgacuuuuuccugguuuagucuuggaggguguauguguccaggaauuuauccauuuuuucuagauuuucuaguuuauuugcauggagguguuuuuaguauucucugaugguaguuuguauuucugugggaucaguggugauauccccuuuaucauuuuuuauugcaucuauuugauucuucucucuuuucuucuuuguuagucuggcuggcagucuauuuuguuaaucuuuucaaaaaaccagcuccuggauucauugauuuuuuuggaaggguuuuucaugucucuaucuccuucaguucugcucugaucuuaguuauuucuugucuucugcuagcuuuugaauuuguuugcucuugcuucucuaguucuuuuaauugugauguuugggugucgauuucagaucucucuagcuuucugauaugggcauuuagugcuauaaauuugccucuaaacacugcuuuagcugugucccagaaauucugguacguugucucuuuguuuucauuuguuucaaagaauuucuuuauuucugccuugauuuuguuauuuacucaguagucauucaguagcagguuguucaauuuccauguaucugugugguuuuuagugaguuucuucauccugaguucuaauuugaucguacuguguucugagagacuguuuguuaugauuuccauucuuuggcauuugcugaggaguguuuuacuuccaguuauguggucaauuuuagaauaagugcuaugugaugcugagaacaauguacauucucuugauuugggguggaaaguucuguagaugucuauuagguccgcuugguccagagcugaguucaaguccugaauauccuuguuaauuuucugucucauugaucugucuaauauugacaguggaguguuaaagucucgcacuguuauugaguaggaauauaagucucuuuguaggucucuaagaacuuguuuuaugaaucuaggugcuccuguauugggugcauuuauuuaggauaguuagcucuucuuguugcauugaucccuuuaccauuauguaaugcucuucuuugucuuuuuuuaucuuucuuaguuugaagucuguuuuaucaaaggcuaggaucuuggccgggugcaguggcucaugccuguaaucccagcacuuugggaggcugaggugguuggaucacgagaucaggagaucgagaccauccuggcuaacacgaugaaaccccaucucuacuaaaaauacaaaaaaauuagucaggcaugguggcgggcaccuguagucccagcuacucggcaggcugaggcaggagaauggcgugaacccgggagguggagcuugcagcgagccaagauagcgccacugcagucuggccugggcaaaagagugagacuccaucucagaaaaaauaaaaaauaaaaaauaaaauuaaaaaaaauggcuaggaucacaaccccugcuuuuuuuuuuuuuuuuuuuuuuuuugcuuuccauugcuugguaaauauuccuccaucccuuuauuuugagcauaugugugucuuugcacaugagauggaucuccugaauaaagcacacugaugggccuuaacucuuuauccaguuugccagucugugucuuuuaauuggggcauuuagcccauuuacauuuaacguuaacauuguuaugugugaauuugguccugucgucaugaugcuagcugguuauucugcacauuaguugaugcaguuucuucauagugucauuggucuuuauauuuuggugugguuuugcaguggcugauacugcuuuuuccuuuccauguuuagugcuuccuucaggagcucuuguaaggcaagccucagcauuugcuuguuuggaaaggauuuuauuuauccuuuacucaugaagcuuaguuuggcuggauaugaaauucugcuugaaaauucuuuucuuuaugaauguugaauauuggcucccacucucuucuggcuuguaggguuucugcagagagauuugcuguuagucugaugcacuucucuuuguagguaaccugaccuuucucucuggcugcccuuaacguuuuguccuucauuuaaaccuuggagaaucugacaauuauaugucuugggguugcucuucuugaggaguaucuuagugguguucucuguauuuccugaauuugaaugcuagccugucuugcuagguuggggaaguucuccuggauaauauccugaaguguguuuuccaacuugguuccauucuccccgucacuuucagguacagcaaucaauuguagguuuggucuuuucauauagucccauauuucuuggagguuuuguucguucuuuuucaucauuuuuucucuaaucuugucugcaugccuuauuucguuaaguugaucuucaaucucugauauccuuucuuccacuugauucauuuggcuauugauacuuguguaugcaucacaaaguucucaugcuguguuuuucagcuccaugaggucauuuauguuccucucuaaacugguuauucuaguuagcaguuccuguaaccuuuuaucagguucuuagcuuccuugcauuggguuagaacaugcuucucuagcucagaggaauuuguuauuacccaccuucugaagccuacuucugucaauucgucagucucauucuccguccaguuuugugcccuugcuggagaggagaugugaucauuuggaggagaagaggcauucugguuuuuagaauguucagcauuuuugugcugguuuuuccucaucuuuguggauuuaucugccuuugcucuuugaggcugaugaccuuuggaugggguuuuuguguggggggucccuuuuguugauguugauuuuguugcuuucuguuugcuagcuuuucuucuaagagucaagccugcaguccugcaggucugcugcaguuugcuggagguccacuccagacccuguuugccuggguaucaccaguggaggcugcagaacagcaaagauugcugccuacuccuuccucuggaagcuuugucccagaagggcaccagccugaugccaaccagagcucuccuguuugaggugucuguugaccccuguugggaggucuugccugcucaggaggcauggggcucagggacccacuugaggaggcagucugucccuuagcagagcucaugcacugugcugcgagaaucccccuugucaggaucagcugcucucuucagagccagcaggcaggagaguucaagucugcugaagcugugcccacagccaccccuucuccaggugcucugucccagggaaaugggaguuuuaucuauaauccccugacuggggcugcugccuuucuuucagagaugcccugcccagugaggaggaaucuagagaagcagucuggccucagcugcuuugcugugcuuuggugaauucugcccaguccaagccucccagccuccuuagcacuaucaggggaaaaccgccuacuaaagccucaguaauaccaaaugccccucccgccaccaagcuugagcaucccaggucaacuucagacugcugugcuggcagugagaauuugaagccagugguucuuagcuugcugggcuccaugggagugggacccacugagugagaccacuuggcuuccuggccucagcccccuuuccaggggaguaaaugauucugucuugcugggguuccaggcaccacugggguacagaaaaaacuccugcagcuaguucaaugucuguccaaacagcaacucaguuuugugcuugaaacccagggcccuggugguauaggcacaugaaggagucuccugaucugcagauugcaaaacccaugggaaaagcauaguauccaggccggguaucacagucccggguaucacagaugacggguugaugggugcagcaacugcaugcaaacugcauguuugcaguucccucggcugggggagggaggucucccggcuccuugcacuucccaggugaggcgaugccccaccugcuucugugugcccuccgugggcugcacccacugccuaaucagucccaaugagaugaacuugguaccucagucagaaaugcagaaaucacccaguguugaucucacugacagcuacagacuggagcucuuccuauucugccaucuugccagauguaaaguguagaauuuuugauuuuguuuuuuugcuuguuuaugcaauuaguguuaagucaucaucaguuuaaaauaaugaguuguaagauauuuucaagccucaugguaaccucagaucuaaaacauauggcagacacacaaauaaaaagcaagaaauuaaagcaugccacuagagaaaaucaccuucacuaaaaggaagacagaagggaaguaacaaaggaagagaauaucuucaccagaaaacaaauaauaaaauggcaagagugaguccuuacguaucaauaauaauauuaaauguaaaugggcuaaccuugccaaucaaaagacagagugguugaauggaccccugcccccacaaaaaaagacccaauuaucuguugcuuacaagaaacacauuucaaccuauaaaaauacacauagacugaaaauuaagggcuugaaaaaagauauuccgugccaauagaaaccagaaaagaucaggaguagcuauacuuguauuaggcaaaguagaguucaagauaauaacuauaagaagagacaaagaaggucauuacaucaugauaaagggaucaauucagcaagacgauauaacaauuucaaagaaacaucuaacuuaaucugcacuguagaccaaauauaccuaauagauauuuacaggacauuucauccagcaauuccaagagaagaauacacauucuccucagcacauagcucauucucaaggauagaccauauguuagaucacaaaacaagucuugaaacauucuaaaaaauugaaauacuaucaagcaucuucucugaccaguacagaauaaaacuagaaguuaauaaugagacauuuuggaaacuauacagacauacacauaguaauuaaacaauaugcuccugaaugaccagagggucaaggaagaaauuaagaaggaaauugaaaauuuuauugaaauaaauuacaauggaaacacaacuuaccaaaaccugugggauuuguuugugucuuuuuuacuuccuugagcagugguuuguaguucuccuugaagauaugaacagacacuucucaaaaaaaagacauuuaugcagccaaaaaacauaugaaaaugugcucaucaucacuggucauuagagaaaugcaaaucaaaaccacaaugagauaccaucucacaccaguuagaauggcgaucauuaaaaaaucaggaaacaacagaugcuggagaggauguggagaaauaggaacgcuuuuacacuguuggugggaguguaaauuaguucaaccauuguggaagacaguguggcaauuccucaaggaucuagaacccaaauaccauuugacccagugaucccauuacuggguauauacccaaaggauuauaaaucauuguauuauaaagacacaugcacacauauguuuauugcaccacuauucacaauagcaaagacuuggaaccaacccaaaugcccaucaaugauaggcuggauaaagaaaauguggcacauauacacugugaaguacuaugcagccauaaaaaaagaugaguuuauguucuuuucagggacacggaugaagcuggaaaccaucauucucagcaaacuaacacaagaacagaaaaccaaacaccacauguucucacucauaagcgggaguugaacaaggagaacacauggacacagggaggggaacaucacacaccggggucuguuggggggugggggcaaggggagggagggaauuaggagaaauaccuaauguagaugacggguugaugggugcagcaaaccaccauggcacguguaugccuauguaacaaaacugcauguucugcacauguaccccagaacuuauaaaaauccugugggauacagcaaaagcaguauuaagagggaaguuucuaguuaaaagcaccugcaucaauaaagagaaaaacuucaaguaaacaaccuaaugaucuuaaagaacaagaaaagcaagaguaagucaaccuaaaauuaguagaagaaauaauaaagcuuagagcagaaauacaugaaauugaagugaagaaaacaagacaaaagaucaacaaaauaaaaaguugguuuuuuuuuuaaaagauaaaauugacaaaccuuuagccagacuaagaaaagaagagggaagauccaaguaacuaaagucagagacaaaaaaaggagacauuacaacugauaccacagaaauucaaaggauaauuaguggcugcuaugagcaacucuaugccaauaaauuggaaaaucuggaagaaauggauacauuccuagacaugugcaaccuaccaagauugaaccaggaagaaaugcaaaccugaacagaccacuaagcaguaaugagauugaaccuguaauuuaaaaaucuuccaacaaagaaaacccugagacuugauggccucacugcuaaauucugccaaagauuucaagaacuaauacuaauccuucugaaacuauuaugaaaaauagaggaggagggaauaccuccaaacucaucuacaaggcccguauuacccuguuaccaaaaccagacaaagauacaucaaaaaaaaaaaaaaaaaaaaaaaaaaaaaggaaccacgggccaauaucccugauaaauauugaugcaaaaauccucaacaaaauacuagcaaagcaaauucagcaacaccuuaaaaaagaucacucuucaugaccaagugggaguuaucccaggaaugcaaggauaguucaacauaugcaaaucacuuuaugugauacaucguaucaacagaaugaaggacaaaaccacaugagcauuucaauugaugcugaaaaagcacuugauaaaauuccacaucccuucaacauaaaaacugucaaaaaccuagguauagaaggaacauaccucaacauaauaaaagccauauaugacagacccacagcuaguaacauacugaauggggaaaaacugaaggccuuuccucuaagaccuggaacaugacaaagaugcccacuuucaucacuguuauuuaacacaguaguggaaauccuagcuagagcaaucagacaagagaagaaaauaaagggcauccaaguuggaaagaaagaagucaaauuauccuuguuugcagaugauguggucuuauauuuggaaaaaucuaaagaccccacaaaaaaacuauuagaacugauaaauucaguaaaguugcaggauacaaagucaacauacaaaaaucaguagcauuucuauaugccaacagugaacaaucugaaaaacaaaucaagaaaguaaucccauuuaaaauagcuacaaauaaaauaccuaggaauaaacuuaaccaaagaagugagagaucucuacaaugaaaauuauaauacacugaugcaagaaauugaagaggacccaaaaaugguaagauauuucauguucauggacuggaagaaucaauauuguuaaaaugucuguauugucuaaagcaaucuacagauucagugcacccccuaucacaauaccaaugacauucuucacagaaauaguaaaaacacuccucaaacuuauauggaaucacuaaagucccagaauagucaaagcuauccugagcaaaagaacaaaacuggagggagcacauuaccugaguucaaauuauacuacagagucauaguaaccaaaacaguauguacugacauaaaaacagacacguagaccaauggaacagaauagaaaacccagcaaacaaauccauaugucuacgacaaacucauuuuugacaaaggugccaagaacaugcauugggaaauggacagucucuucaauaaacgaugcugggaaaacuggauguccauaugcagaagaaugaaacuagaccccuaucucucaccauauaaaaaaaacaaaucaaagugaauucaagaauuaaaucuaagacuucaaacuaugaaacuacuaaaaagacauuggagaaacucuccaggacauuggagugggcaaagacugcuugaguaaucccuacaagcacaggcaaccgaagcaaaaauggacaaaugggaucacaucaaguuaaaaagcuucugcacagcaaaggaaacaaugagacagccugcagaaugggagaaaauauuugcaaagugcccaucugacaagggacuaauaaccagaauauguaaggagcucaaacaaccgcacaaggaaaacaucuaauaauccaauuaaaagaugggcaaaagaccugaauagacauuucucgaaagaagacaaauggaugaaacuggaaaccaucauucucagcaaacuaucgcaaggacagaaaaccaaacaccgcauguucucacucauaggugggaacugaacaaugagaacacauggacacaggaaggggaacaucacacacuggggacuguugugggguuggggggaggggggagggauagcauuaggagauauaccuaaugcuaaaugacgaguuaaugggugcagcacaccaacauggcacauguauacauauguaacaaaccugcacauugugcacauguacccuaaaacuuaaaguauaauaauaauaaaaaaacaaaugacaaauaaauaaaugaaaagguacucaacgucacugaucaucagagaaaugcaaaugaaaacuauaaugagauaugaccccacccuggucaauauagcuuuuauccaaaagauaggcaauaauggaugcuagugaggauguggagaaaagggaauccuuguacacuguuggugggaauguaaguuacuacaaccaccguggaggacaguuucgagguuccucaaaacuaaaaauagagcuaccucugauccagcagucccacucuaguuauauauccagaagaaagaaaaucaguccagcagagaaggauccgcacuccuguguuuauugcagcacuauucacaauagccaagauuugggagcaaacugaguguccaucaacagaugaauggauaaagaaaaugcuguguauacacgcaacgguauacuaguuagccaugaaaaagaaugagaacgugucauuugcaacaacauggauggaacuggaggucacuauauuaagugaaauaagccaggcacagaaagacaaacuuugcauguucucacuuauuugugggagauaaagauuaaaacaauugaacucgagauagaguaaaaggaugguuaccagaggcugggaaggguaguggggguugugagggaaguagagaugguuaauggaaacaaaaaaaaaauagaaaaaugauuaaaaccugguauuugauagcacaacagggugacuauagucaaugauuuaauuauacauuuaaaaauaacuaaaagagagcugggcacaguggcucacagcuguaauuucagcacuuugggaggccgagucauaugacucacuuaaggccaggaguucgaggccugccuggccaacauggugaaacccccuucucuacaaaaaacaggaaaauuagcuggacuugguggcauacaccuguaaucccagcuacuuggguggccgaggcaugagaaucacucgaacucaggaggcggagguugcagugagcugagaucgcgccacugcacuccagccuggguaacagagugagacugucucuaaauaaauaagacgaaaagaguauaaugagguuguuuguaagacaagggguaaauguuugagguaguagauacccccauuuaccucuaugugauuauuauguacugucugucuauguuagaauaucucauggaccccauaaaccuauacaccuacuauguacccacaaaaagcaaaaagaaaaagagcuuauggguaucaauuuuucuguuaguaacgcuuuuguugugucccagcaaguuuugguacauugucuucucaucuuuauuugcauuuaaguauuuucuaauuucccuucugauuuuuuuuuuuuuuaauuuaagucccaggacacaugugcaggacaugcagguuuguuacguagguaaaugugugccacggugguuugcugcaccugucaacccaucaccuagguguuaagcccuacaugcauuaacuauuuauucugaugcucucucucccucugccccccuuuuucuuugauucauugguuaagaguauguuguuucauuuccauacauuuguuaauuuuuccauuuuacuucuauuauugauuucuaagcuuaucccauuaucguuggagaagauccuuuguaugacuggcaucuuuuugaguacuuugagacuuaauucguggccugaucucuccugggaacauuuccacgugcacuugggaugcacaugcaugcuguggucaugggucgaguguucucugcauguugguuagaucuagguggcuuauuguguuaaguccucuauucuguaacuuaucuucugccugguuguucuauucauuauagagaaugugguacugaagucucucaccaucauuguagaacuauuucucccuucgguucuguaaauuuuuccuuugugucuuuugaucguuagcuguuagaggcauaaauguuuauaaugguuaucuguaacaucuucuugcagccucgaaccuuuaagugugcagcguccucuuuugucucuugugaccuuucuagguuuauuauaaaaccauuuuuggcugauguuaguguagccacucugcuuuuuguguuugccauuugcauggaaccucuuucuccacucuuuccacccuuucacuuucaaucuuuuugugucuuuggcucuaacgcgagucucuaguagacagcauguagcuggaucauguuuaucuauucugccacugccgauaucaccuuuugauauacagacuuuacauuuucauaaaauuuaauuuguccacgugcuuagccccugugauccagcaaucccacugcuaguuauauauccaaaaagaaagaaaaucaguccagcagggacagaugcgcacuccuacguuuacugcggcacuguucaccggagccugugccuucaaugucguauucaagaaaucauccucaaauccaaagucuuucuauuuucuccuauguguuccuauugcuuuaggucuuacauuuauaccuuugacccauauugaguuaauuuuuuauauccagcuuuauucuuuugcauguagauacucaguuaucccaccaucauuugucgaaaagacuauacgugaacuuuuugaauuugcuuuucucacguaauaguauuuccuagagaccacuacauaucaguucgugggguccuuccauauucuuuuuuacagccaccccauacuuuaugguuggaugugccaugcuuauucaaacccucuccuauuuaugggcauuuagguuguucugauauugugcaaugauaaauaauguugcaaaguauagccuuauacauaugucuauuguauucuugaaacaauguugcaaagaauaacuucguagguauggauguuccuauuguuggagguguuaucuucaggguagauuccuagaaaugggaguguugggcugaaagagaagcccguaguuuuguuggaugugaccaaauuucccugcagaacgguugcacauuugcacucccccagcaaugcaugagcauaccgguuuuuucuacaguugcgccagcagcgugcugucacaccacuuuuugccagguccauagcuuuguuuuaaucuguauuucuguaauuacauugaauuugaauguuuucccugugucuaaaagucauguguguguguauuuguaaaucgucugucuucucauuuccaacuucuuccauuggguuuuugguucuuggucucucaauuuuuaagucauuuauauugugggaacguuugucuggacuaaugugaauuguuuucccagcuggucacuugucuuugacuuugcuuauggugcuuuuugcuaugagaaauuucgcauguuuauaucaucaaauuuaucaugcuucuuucuacugacuccggauucagggccacaguugagagcuuuuuccuccaccgagguuaaggggaauccacuguguuuucuucuggagguuuggggucuugucuucagcauuuagcuccuuguccguuuggaguuugcucuugugcaugaucuaagguaaucuuuucucagagaguggccugagaccucuuccuuagaaguucaccccacuggcuggggccuucacgaggccccucuggccucuaaguggagcauggaguguggggucaucgggcaggacacgagaugcgcaggaggcugugacugagguggcugugggaugggacggcgugguuugcucuagaggguuugaaggaagggugagaagucaggaccacugcuguagaaaacaggguuugcagguagauaagguggcgggugcagcgggaggaagagaaaaggaugcugcugggaccccucgcaccugggaggaugcacuuucuguuucugacaugggucaggguuggggcgaaggaguccagcuggggacauguuauuuuggagguguuugugaggcagccaggugagguggguugaaggcaguaagaccugcaggugggagcucuggggagagagugcgggcugggcucacaaguuaggggaggugucaguguguaaaugacaugagcgcaggggcuagacagggccuccuguagccuggguggguggaagggcagagggcaagggccaagugauggcagcuguggaggcugagggcaaggaaggcaaguccgggagguuggguguccugcagccuccacaggggcaauggaggaagaacaaaggacucuguguugagcccuccugagagguuuuggaacuggccuugacuuggugaugugggguuaugaguuuuauuccacacacguaugugggagucuggguccuggugggucccagccccguacauggaggcugggacccugcccugaaaccucucagacacaaacacccagcucggccccacagagcuggccugggccccagcaggggucuguguugccuuggccccacggcaguggagcugggguuucccagggaugcugcugcugaaggugagguuugcaaacacuaggcaugcauguuugagguaccacaaccuccaccaacccaugguggucaccaagggucuuugggcuccuguggggaccauacuggcuugucugacuugccguuacccggcggagauaugucuuggaaagacuuuaggccaggagcccaucauuguccuggaaccugggcuuggcagggcaagcuuuggggagcacuguccagacagugcccuggacacugcaccucaggucaggacacagcucccgaggccuggcugcucugcauggggaggaguguggguccugaguggagugucccaucugucaugcagagagggugaugauauaaccagcuggguguucgcaccugagagguuucggggcagggucccagccuccauguacggggcugggacccaccaggacccagacucccagacuagcaggugggcuucucagagcacagagggugugggugacccagauauccuguuguugcucagagacccccagggaauccuugaagauggcagugaccaccuggcuuccucuauagaaacuccccgaaugggagggaugggaaagacuguugaacuaagcuuuuuaggaagaaagccaucaauuccccugcucucauacaggcuugaggagggcuaaggaaagucacaguugaaugcaugcucccuccacacccaugugccugaugcacacagccuggcccuugugggcacuggagggcacccuacagucacagaggcaaacgaagaauguagagcuccagcuggaugagggccguggggaaggggcacagcccugggcaagggugugcagagucugcaugggauuugacugagcaaucuggaaggcuuccuggaggaggagcuauugcucagggugaaauagaggucuugaaauuaguacaacacaugccccauacuggggaauuugggggucccugggggaaggacucuguuaccaaaagcacacagcacagguugggagagcaacuaucucaaggcuuuuauuugcuguuucaugaaacugaaaauuuaaguuuuuaauaucacauauuauuucaugaagaguggcuucggacuuugggguagggucugguaggaucccagggccccuucccuuggcaucaucauuguuuccccuccauguucaaguucagcaucucugcaccccuugccuggcaaaccccaucuuccuguccaaagccagacuuggcucccuuugcuccagugaguggccguuggcugggaggcugggucugugcugugugggggguguuugguguccuaggaggagucucuguccugagcagagacagaggaaggcagggcagccugcucagaggaugagcccagcuauucugggaagcaggcaggaaguggcagcuccagguccgggugugagggcaguagugcaggucguggucccagauggccacggaggugucagcguuucacucccagcacgucacgccacgucccuuuccucugcuuuguuccuccucagcugugaacugucugggacugggccaggagacaguccugggauagggaaagaaaagaggggcuuccggggguggggagcggggcugggcggcugcuggcugagccaaguggacugggagguguggacagggaacccuggcggggccggccaaugguggcgugaugcagccuggcuugggaaaugcccauggaggugacaagugacagccgggaacagacccacugccagggcugccucucucuuuagauauguccuggcaucugacuuugguuuccugguguuuaaaggcuaauugggaucggucguggugccucaggccugucaauccaguacacugggaggccaaagugggaggauugcuugagccuaggaguucgagaccagccugggcaacauagcaagaccccaucucuaaaaaaaaaaauuaaaauauuaauacuagcugggugugcuggcacauaccuguggucccaacuacucgggaggcugagguaggagcaucacuugagcccaggaguucaagguugcagcaagcuaugaucuugccacugcacuccagccugagugacagaacgagacccugugucuaaaaaaaaaaaauuuuuaaauaaauaaauaaagguuuguuggacauguuagcucacgccugcaaucucagcauuuggggaggcugaggcaaguggauugcuugaggccaggaguuugagaccagccugaccugccugggcaacauggugaaaccccgucucuacuaaaaauacaaaaauuagcugggugugguggcucacaucuguagucccagcuacccuggaggcugaggugggaggaucacuugagcccaggaguagagguugcagugagcucagauugugccacugcacuccagucugggugucagaaccaggcccuuucucaaaggaacaaacaaggcuaacauguugggcuuucucugcuucugggcaauguccgugaaauugaagccgcacugguguuguuccacccuuccuuccagcuggucucugaggcccaggccagaugcuucucugguuagcagcagauucuaggccagagccugccuccagguccugggaaggcuggcacgcucagaugcacuccugggcguggccuuccuccgaucacagugugagcgaaucucccugcccaucacucugcuccccuggcccagaccaggccaugccucagggcuucugcacgugcaguuuucucugccugcagggucugucccuagcucucuacccgauucagaucccacaccagcuccuggggcagcccucuugcccugccucuccccgagacgucacccuuucucuuuuccccauugguggugguuuuauguguucauuuacgguuuauuuucucucucccugugucuguuaucugucucugcaccccuggagcccagcguggugccaggcacacacuacgugccuccuggguugggggcagcagggacaaaagccaggcaugggauguggcucuugugggaugcaccuugggugugacugucacggaaaaggaggagacgugggguggggaagggggcagccccuacuguuccuggcagcagggccagaauugagagccagagguugccacuggagggcuuccuggggaggcagcuggcaccgccugauuccuguuucugaaugcccucucacucucccccacccccauggaaccagaaccaccucgucaggcccagcagcccuucagggucagucucugcaugggugguaauauggcuuaccugaguccuggucagucuguggccugggaguccacccuccaugacuagugguuuguggcaggugacgggugaguggucuccaugcucccagccgcuguguagaggugccaaccugccccuccugccagagcugggcuccuguugggcgggacugaggauaccgagacagaaauaaaacugcuaaaugcaucuguuguugaauaauucaaugccccaugccaggccuguugcaaaauuagccacuuccucccuccaggcccaugagugacuccuggauuuggugaaagccaggccuaguggaauuguggcccggaagguucucugggagcugggaaccuccaugcaggagcccaggggagggggugcuuggccacaugcgggccccucaaucugcccuguggagcccggccuggccugcagcccccugugcagggaaaaacccgcgguuuucccugguggagggcacaggucagagcgggcauggacagggcaugaggaagcagugcagaggaagcgugagcauuugucucgggccagcuggagaaaggaaauggggcugcuuccuggagggcagagacaucaggggcugcgcugucgggcucggcgugcaagauuugugucucaucccaggguuaggugccucccaaaugccagggcuucccaugggccauacacacucagucgaacaagauuugcacaaaaccugggccauaagcucgcugagcacuuggccugcccagccggugacaaugagaaccgcacaugcucagccuucccuggacucagggcccuacgggugcuggagccggggcgggagagggccgcaggcugccccugccucugcauccuccccgucgaugccuggggccacugggauuggcagaaaagggaugcccccgagaugggcagccaggagaacugucugucuccuaucccaauaugccuaccucccucucugaauccccauuucccccucauccuugcccccacacacccagauuugcaaugggacacacggccaccugggaugacaaccccucccagucuucccucaagacaaguguggccaugaccgcauggggccagcagggugugaguugaagugucccgcaguggcuuccggggaugugcagcccugcccugaggcccucuggccgccucuugcucucugagcagggauguccgugccuugggccugaggcugagcugggcuaggucccugggugucuggggccacacucucugguccagccugcuguuacaggggaugccucagggccaccacuggucauggaggcugggggcgccugccugucugcccgccuggaguucagguaaacaaccccacugaggaggcaccccuagccgugggaguuggcguguccugcuccccagggcggucuguccccuuggcgagauccuugcugugucagcagaggguuuuccuggcccagggucuuggggagcagaugauggggcuuuaggagcucuggcucugggaaggcaguggacccuggagcagggaucuugggaggauggagaguuggcggcucaggaaggaggcugcucaagccccggccugcucacugggaagagcgguccuuggaggagagagcucccgaggagaaagccaugaugcugugcugcgcucugggccaccaggucuugucuggggggaauccugacccugugugaugugagugcagggacucccccacccuccgaccaggaccuuuguacucuccuggccgugucauugcacaacuccaggggccgucacucaccugagcccucuuugcucuucuuggcuguucccugauauggccacgcagagacuaucucuaagugucaguucuggacucagcuggaaagguuucaugaccucaagggacccaugggacuugaggguggggcagcuguuugcccuguggaucaaaggggagugucugggaugggauccaccugcccugcccucaaagugcugggcagucccucagagccauagagccuagggggucuugggcccucuuccccagggcauggcccaggcaccugcuggccugaggucccugcugggcccaaggcaucccugccguguucagaguuccacaggcaccaguccaccaugcuggggccuacugggagagacagccacccgccugcugucgggagccuccaucaccagagccugggggugucccagccacccuggccgcuguuucucugccuccgcaccggccucucuccugaguuccauccaucccugcagguuggguucuccucucuccucugggaucugcacagguugccauucucucugccuagacugggccuccaccucugagaagcccucccuuauugccccuuccagugggcugggagagggaggaaggccaggugcagaaagagaauucaccugcccggcuaaagccccaccugccuauuucaaggccucugaugccccccggccugcaaggugugugcauggggccugucccaugcuggcucacccagcugcucagagaggcaaguggcucccgggccccacagugacacugggggacucuuugucuccauuuggggggugugcaggucacuccuggugcccuggucagcuuccccaaccugagcugcccucagcuccuggcuuggcccuccacggagugggagaugccccccuccccugccauuaucguaccuuaccucgcuggcggccauggaggcagugagaagagccgagggagcuggccggggcgcauuuccgugcaggacacuggcugccucccagcucacucuuagccuggucauagagcccggcagcaucuugccaggugccuguggucccagauccuggggcugccccaucucuggaauauugagguguggcuggggcugaucugaggaugaauguggcucagguugccgggugcccuugacgcauucccaugucccaguggggaaaccaaggcucaaggaggccacacagcagcuccauuuccagggacacccaguguucucuguaguggguaggagguuucccuauacaggagaccaagcuacagcaagaaagacuuggccgggcgagguggcucaugggcgcgguggcucacgccuguaaucccagcacuuugggaggccaaggggaucacgaggucaggagaucaaggccauccuggcuaacacugugaaaccccaucucuacuaaaaauacaaaaaauuagcccggcgugguggcgggcgccuguagucccagcuacucgggaggcugaggcaggagaauggcaugaacccgggaggcagagcuugcagugagccgagauugcgccacugcacuccagccugggcgacagagccagacuccgucucgaaaagagacuugggcuagaugugaggagggacuuucccaaguagggaugaacccugaggacccacacccugagccgccagugggucguguugaccuggcagcuccagggcaccugaggccuucgcuguccuuccgcaccucgcccccuucccgaguggaggugcucugggagcucugccugcuuccucaagucuuucuuguuuuuuuauguuauuuuauuuuagauuugaggaguacacauacuugucuguuacgugcguaauggugggguuugggcuucucgugcgcccaucagccggauauuggacguuauacucaauagguaauuuuucaacccucccccucucacccucuccaccuccccuuuggagucccagagugaccuuucuccgucuuucuguccaagcaucccaucugucuagcuuccacucaugagugagaacgugccguguuugguuuucuguuuccgguaguucacuuaggaucauggucuccagauccauccguguugcugcaaaggacaugauuucauucacuucuuggaggcuuuaacgccugcccugugugagggagggcggagccccuggcccaggggcggggaggccuguccaccccucccacccguccccgaggccccugcugcccagcaagaccaccacccucugcuccaggacagcgcagccgccaucagugggggugaggggacaaggcugcugggaccaggccucgcccaggcagagccucgccauuucugggguggggggugcacaggugcaucuggucugcccagccccuccucacccuaggcaggccucucacagagacaagacgaguguccuagggcagauagggccacauccauggggucacuucaguuuguccucccggcgccuucuaaauauacucucugugggugucuuaucacagcccagggagccaggcuugguguggccggcccugggagcacagagccccguucccagcagcccucggcccuggggggcuugugcucugccgggccaccugcacccuccgggccccaggagaagcucaugccuuuccugcuugcaccccagagccuggccaccccuguccucugcugaggcccugaccaccucuaugugugccauggcugcagugacagcccagaccccaggggccgggcaucccacagcucuccucacugagccccugggccuauccgcccacgcccaggccagggcuccugcuggaaucucccuguggaaggccaggcugccuggaugcccaccacuccaggcuuacuucuggguuguaguuuucggggugcuucgaggugcuguggggaccugugaugcugucagggagacccggaguccaguucucgccaaccgcucgaugcugugugacuugaggcaggucccuuaaccucucugagcuuccuccucuccugugaacaaaggauggguccacuucucaggcuucucaugaaguuuagaggcgacaggaggaggugggcuuuaaauggcucagucccagcguccccucaugccugggaccgcugacccaccgggauucuugggggccaccauagagccuguuuuuaaaggggauguggcggccagcucugggggcacacguuccuguuugaauucucaaucuccgggcucaaaauuggcccccagaaagccuuugagauggacagggagcuggaccuucccaauucgguugcccuugcuugauguuuacaugccacuguugggugcuccugauuguguagcggguccccugaaaccaacacacaggugcagacacccacaugccauccugccagagcccuggguucucagcaggacucuuugccgggauccucaugcuacggccaccaccugauuuugucgauaaaguuuuauuaggacacagccaugcccggccgaauauugccacagaggccaccugccccaccacgccuaggacauuuccucucuggcccagaggugugccagggcugcacugggcucuucugguggggagggacauuguucuggccccuccugaucucucccccaccuugccacgaccccccagaguuugccuggugucaccgggaagcuuccuggcugcccgagggucccccagcaccugucccucuagggccucugaagggcuuugacgugacacucgggauggcauggcagggcccucaagcacggcuguguucaccccccaggcugcuccuggaaaggagggaucagggcccaggcuccacgcuccgcacugagguguggucgagggcccugggcguccgggugagaugggaaugagcccuugguaggugccaggcggggccagcccucauccccacugcaaggccugagcguccaggagccccgugcgcagcuggacccaucaguccccacccugcagggccguugaagagggaaugcacaccugucaccucuuggugcgggggcauccagguuccuggcgauggggauggggugagaugcaccugauggaccuccaggugggaagcuccugggacacccuggagggcucuggugggagacauggcauucugucugcaccgaagggggcucagggcugagaagcccugggacggguuggauuuggggcgcguuccccagggccccacgcguguugaguccccgcugcgucacugucuggccuguggcgccucaccucucugucuggcaggacucaggcagaauggaaguaaaggcaggaccuugucccaggacauccaggcauguggcguggcaaccaggugggauggcaggguuucccccuggcaggauccccaccuccugcaccuguccugacuuggucuucuggggcagccccuaagacgcuucuucagggaagagggaccgguuuggccagugggaccauggcccugggagcauaugccugcacguccugcccgcucacaccugccugcugggggggccaugccugcgcccgcagcucacgucagagcccaccccaggaggcucccagcgaucugucaaccugugcuguuggcaugcagccugggggugagggguggcggaacgcugccucaguaccacguccugcucaaaggccacuugcgagcuaggcugagccuguggugugcggugggauaggaaggaaaagaacagagucuaaggagccuaacucacuuccagauucacccggaggccugcauggaggaggcggcacugagacuucauucaccgagcuugaggguuuacccuaacauucauucacaccaucagucauucagcaaacacuucacaaacgugcaucccacgccuggcacugggccuucggagggagggaaugcagcuggugggccccugccuggggagccccugcucuggucggggaggcagugguggcaguggcugccuggcgguccaugaacuggugcaagccagagccggaggccuccugagagccuggcagggaagcccaggccagggccuccgcagaaggaggguuugggguccaggcuucauguggggggucuuguaacaugggaggguagacgcugccuugggacaggagagacagaggcggggggaccaggggagugggcugcaguuggggugcaggccugguggccccggcagggggaccagccucuggggaggugcugcaggcacaggaguucuguguggacccagccgaaagcuggcaggaagggaccuguuucuugggguucccaguccagaucuguguuggaaaaagugucagcugaaaccccaagaggcuggggacagccuugguccugcugugggacacagguuuaaucuccagauggcuccuggauaggcgggcuggcggcucugucuaacggggacagcacacuuggggcuucgggagacaaugagggcagaaaucuuacccaccggccacaccaagucacccauuguugugucccuugggcugggaucccauggcuuucaagaacuuuuuaaagaaaugagacucagcugccgcggaacaagccacagguaaagaguauaagacagcgugaggcaugggguggccacgggagcccugggccaaggaggcccagucugguggggaggcguccauucacccggagcuggacggggaggaccaggcugugggucugugaagcgggugugggaucacauccacgcuccuucugugguuugugcccuguuguggcugccaggggaggggcuuccaaggcccugccaaccagcugggcaguguggacaauggcagacagggugcugugugggggccugaggggcaaugguuggggggcagcuguugccguucuggugagaaguggcggucccugaagggcuggggugcuagggagccucauggaccuacucccgacguggcagcugccugcugcagaugggccagccaugucccgccugugccgggaaucaccacccccagcucccuucucuccaacaugacaggguucgggugaugcccugugggcugaauggugagagaggcgucccugugcugacaccagugggcguggacgugacccucuuuuuaaaagaauuuuuucagaugcaauuccauuaaggaucuggaggugagaggaugaaaaggaaacucugagcuuugaguacauuuuuaauuauguuuuaaaaauuaagacaugaggccgggcaugguggcuuacgccuguaaucccagcacuuugggagacugaguugggaggaucgcuugagcccaggaaaucgaggcugcagugagccaggaucauaccacuguccuccagccugggugacagaacaagacucugucucaaaaacaaaacaaaacaaaacaaaaaaccaaaaaacaacaacaacuaauauauguuuuugaccaauaccuaauucuguuguuuaagaauucaaaaucuaccaauagugaucauaaguaauguauuaaauacuuacauaguacagcagguguuggcccccccccacaacauugguuuccaucccuggaagcugcaaaugugaccugacauagaaaacaccccuuugcagcugaggcugagggucccgagaggcgugauugcauuauccagggggcccaaguccagugacacguguccuccuaaaagacaggacagauucaacaaaggaggauccggccacaugcugcacagcacgggagugaugccgccacccacccaggacgcgggagcccgcagaggcuggaaggcugaaaagggcccugucgcccccaccccccaggaugacguauggccugauguggcauuccugccucaggaccauggcaccaagugguggcgcuggggccccuggagucggccagucugggcacgucccaugcugugucugagccucaguguccccaucgauugguagugccuccugaaccccaauccagggggcuucuggggggcagccugggaccagacgugccucaccagggcuucugucuccucaccaggacuuccaugaugugacaccuuccacaugggguucagagcggggaaccugugccuaguguccagcccagcguggggcccucggugugggccagggcucaccccuuugggaggggucgggagaugccuggcccaggcuccauccaugcagagccaggaagcaggugaaccuguggggaccuuggcgaccuccaaacccugcugaggcugccugcugacagccacuggugaggggggugacagccacuggugaggggggugaccagcugguagcuuuuucugaggugcagauucagcccuggggaacagcccuggcaggcugugagaccucugccccugggcguccacaucccagggcucugagcucagcagcccuggagccggcagccacaucagggauggagggagaccugcuggugaccagugagugagcaggggaagccuguccucuccagcgcccaguguuuccuuccuggggcacaugggauuuggaggcauuuggagucucccaggaugacuuuuuuuuuuaagccccuagaagugguuugggguuuaagcgucaauauuuaaucucuugaaguuacacauucaaggcccuauccugccuucggcuuuagguucgcuucacaaacccauugucugcuuaucagccuggcgaggucccguccccaguaggggucuuugaacauugcucgaucucauucaccagccacggggaacauuuugaacccucugaugcuugcucuaugaauguuguuugcuuuaaaaaaaguuuuuuuuuuauugugauaaaauacacauaacacacaauuuaccgucuuaacucugugucaggucacggcccaguggcaauagguacauuuacaugguugugcaaccgucaccaccauccaccccaaaacuucucucccaaacugaaauucugcacccaugaaaucccacucccucuccccggccccgccauccugcucuccgcaaccguggauccguccuccccauguccacagauccccucucccucggccccgcuguccgcuucccugcgacgguggauuucgcugcucugggccuuugcgcuucugugacuggcacuguguguuauccgguguccucaaggugccucucugcucauguccuuccaugcaugaugcuuucagacugacaaaacucuucaaguauuaacguaauuuuuaauguuuacagauucaagaaauuaagcauacggucacgagagugcaaaguucugugaaacgcuccagugguuacacgccccgggguuucagcuucgacccugggugaguuccauggugcaguggcuuccagcuggaguucuaagggcaccccuugagcugcccacgugucuuugcacgugaaguagguggcucucuuuaagguuccucaacuuuauugggaaacaucucaggguuacaaaacgccccccaugggcuaaagaggcugucacucacuguguguggggccuguccccgagugggcauggaaggccagagucccggcacagcccccacccggacuggauuugcuuggcgggucaccuggaucaaccaggcccauuuaggagcaccacucaggggcccuagugugugcggcagggcaggucauggagucuccagccuucagcucgcguuagccccaggccaucugagccguggagcccacccaggcccgcugccugcaccccgggggagcccucccacagcgucucgggcuaugacccuggcaggguuccugcauucuccuguguucccgggcacccggggcugagauguugaaaugaugucggauaauucaccgggugccuucggggcugguacucgccgucacugcuccugaggccuauuugcugucaaggggaacaaguaggagguuguuuucuggggugcggugggcuccccgcucaugcagcuccccgccccccgcaugaccacgcccucuugggagcucgggugggacagcauucaggggaccacaugagcugggggggggucggugucuucucucccccaccccuucgcuagccuguccugcuucccacuccgaguccaaaacacgcauaggauucguccucucccagggccuuaguuucccggcucugcagaguggggggcugugacugccuggccuuggagcugaggcagagggggugguagguggcccugcagaggcaggaggggacacaggcaccccaggcccugagugccucaagggcagggaccccagcucggcaccugugagguucccagcuccgcccgagacaagaauagauaaagcgguaaauaagauaaaacucuuuuuaucuggaguagauaaaaguaagcuuugucauauaauuccuucugaggcuagcacgguauaucaaaauaucggaagaaucauuuagccuucagaauauggcaaggcugacagccagccuggcccaugggcaccuguccccaccaucugccuggccugcgggggaacguuccucagccccugcuggcucccaacccccgggccuggagcccugucuucugccucagccgcgauuccacugcacgggacuuucccaggcaccucugcccagguaguugggguggacgcccacuugggugcacacucugugggggcugguccaggaccacccaugugcagucuucccuggccacauccuguauucucccgcaacgcccagucaagaaucuuccugcugcaguaacuccacauaucugagccagcugugucuccugagcacaggacaugggcaggagaggccccugcagcuggaauccgcgccaugaagcccaggcgcgugguauuugcagccagucaccaaguuuucaagcccucaccugcggccugugagugcccacccugcacauggugcuaaccagcauccaucacugcuuucuuuuuuaauuuaauuuaauuuuuuuuuuuuugugguggagucuugcucugucacccaggcuggagugcaguggcgcgaucucggcucacugcaaccuccaccucccugguucaagcaaucccccugccucaaucuccugaguggcugggauuacaggagcacaccaccacccacgcccaguuaauuuuuucauauuuuuaguagagacgggguuucaccauguuggccagacuggucucgaacuccuguccucaggcaauccucccgccucggccucccaaagugcugggauugcaggugugagccgccgcgcccggccccaccacugcuuucuaugcuguggccgaggucaccaacugccacugugauggacggcugucacccaaacagcacgagaaucgaaaagccgugauggcagaugcagaaggcagcgucgccuguggucuuuuagaagggcagcugugaagugggguuaucucagcuuccacauugcaucacggugccccugugaagggcagaggagcugcagguaauucuguucgcucgccucugccuuggaggaaguuuacaguuuuuuuuuuuuuuuuuuuugaaaguuuaaagcuuucaaccugggccuggaggcugcagggucagcagaccuggguccugcccauggcccccuucccuccucaggccuccauuugcucaucugagaguggggggagugcagcgccuuccgugcaggucacugagaggcuggggcaguggcguggauucgggugcaugacucgcagacauggcugucgcuuggcugaacgguggccccugaggugucuguguccuuguccugugaacaaguuagguuguguggccaaaggggcuuugcagggugacugagggauggcucgugagaggggagguuguccuggguuacccgggugagcccucacugugauugugaggauucuucuaagagaagcaggaggaucugaguuggaggaagagacgggaggauggaagccaggcucggcgacgggaaagcugcugugccacccucaccgcagcccuaucccugcucacgugcaccaagaccagagccuggcaagucgucucauaccgagggucaaaggggcccagggcccagccuccagggaccccagccaugccgggucagggaaccaggcugcaguccugugucuccuccucaguuuaccccaauugugaccucagaagcccuuggagccucaguuucccuacuuguagcauguguuugaugauaguguggcagugaugucacagucuggcagggucucgugggggucuguguuacugucugcaaagcacuggcugggccaguggucagugagcaggggcguggguagcgggcaguggccugcaguccccaggagcacuuccuguugcugaacagacagcaacuuaguggauccuucccagggccccuggugggugguggguuuugccacaucuuugcaguagacagcacuggcagcuuccggcuuauccaaggccucagggugaagucgacgcucgcugcugauucccugcuggacgucaggugacacuucccuccacagccugggaagaagcaccugugggccacuucuuuguguugauaaggaaacugaggcaggggagcugccugggucaccagugggcacugcaucuccaugugcagauggugcccuggcccucucugcacgccgugggccuggggagcaggcagguggcaucuucugccccgggcagcccggcucugcuuccucguggcugagccaggcugugucuaaucucacuucccugcucacugcaaaucaaaacaaacagacguccaggaggauuaaguguggcagucauggcggagggagcccugguaggguggagagagccaacaguugcaccagcaaggggcagagacccagcccagcccugggggcugcaggguguggggacagggccugcagcuuggcacaaagacucuucuaagaaccuggagggaacccugcuccggcagugggcagcaugcugugugcaaggugagccagucugagcccauucccagugcccggaauggugcccagugcagaugggcacucacccuuccaaccaaccuuugcuuguguccccgugagauccacagauucacccuacggagggcuccccacaggguuggcccggaggcuccagcugugucuguugaacaaauuacucugcauccaccgcgugcuagcgcugugcggauuauagucccagagacagaugagagcagggguggucaguguaggagcacccagagggagccuggcagggccuggacauccuguccaagcuggccaggaggaguccucagagccaaagcaguguggagggugggggugcagagagcgucccuggcuggaagcaccgcguuugcaaaugccaggcagcuuaugcagccagcgcuuugggcaggcgggagucagggggacugaggcccaaggagggguagggcugcaugccagccuuccaggugcuccugggaaccacguggcugaucagacuugugcuuugggucgaaugucccagugggggaguaaccucagggagcagaggaagggucauggugguggggaugaagcagcagcauuggggcuuagagauuaaaugaaggaagucccacggggcugaucaccuacugugcaccaggcugcgucccgggcauggacugcagcccacagccccacucuuggggugcucauggucuaggggguggacaacagacucuggucccagcgaugaugcuugaguauaaaggacacaguugggguguugugggggccagggucagacaucagagcuggccucugccuaugagacagggcccgcuggcaggacccucaagcugggcuuuuaggcugggcagcagcaggugcacgggcccugaggugggccgggcugggcacagucaggacuggcaacaagggccgggaggagcuggggugaucuggggccaucgugguguaaauacuggggcacgacauggaggguucacugacuggcugggugugugggcugggggcgccgaggguggaggugggcacuguggucagggggagaugaggauggaugggcagggugcagacaggggcuggcuggguucggcucugcagguagagcugaccgguguggcagggacagggugucggugaggcagguggcugaggaaaugguagcugcagguuuuggccccagucccagcagcgggacuauggcuguggggagggaggaacccagggagggggccugagcagggucuuuggcugagugagcccucaagggccuuuggguagggcuaccagaggccaggaaaggauuguccuguccacaggagcuuggggaaggggguggggggccagagccccaccuuccccagaaaccuccgugcagcaggaggaugagccgaggcaggcugugcugggagguagccuguuuguugugggcucugggggccuggggagggugggcugggcuguccacaucuggacagguggaagaggauggguucuggguggggcugacuucaggaggcuggaugagaggcaaugcagggggccuucuggcuguccugggguggguuagaagccacucaggauggcaggaucucagggagcggagggagccuggggcacccuaugccaggcagaggaucuaugccggggcccccagggucuguguguggcuuucucuguuugugucuccccuggcccugggggccauguggccaucuccuggcucuccggucgcugaggauccacgggggucccuggagucuccggagcccgugggaaucccccuagaggcgggaggaaggccgggcgggcccuggaggguacguuugcaguggcagcagcucccuaucuuuaugguuccggcgaucagagaaggcggcccgucuuuucucugcgggcccacaggcccagaacguuggccccaggguggggcucugugcgccuucccuuucaugaguucuguggcucggccucggggccuuggaaaggaggaagugaaacuggaggagagcggcccacagccugccgccuggaggcuccucugggaagcagacgcuuggugcaggugucaggacccccaccuggcgggcuggcuucugugcugugaccaccaacaccccugcccugggcccugaacuccuggacagggggcguugacugcucucuggaagugauuuguaaaaucagcuuuguagagacguaauuacacacugcaguucauuuguggcucuagggcccuaaguggcucuagaauguucagaguuguguagccaccaccaccauccacauccagaacguuuaauuaccccaaaagaaaaccccacgcccacagcagucccgcccuggggcagccaccagccugcuuucuguuucuguggcucuggcuguccagggcguagccacacugcagguggucagcagguggucaccugucugugucuggccuuggcgccauguuucucggacccauccacguggcagcauguguuggugcuucgucccuucccguggcgggacggcaucccucgugcggaccuaccucuagugugugcuuaccagcuaauggaugacuggguuuucgaagcacugucuguuccuaccugggggcggggcugaggccaggggccccuccacuccccaggugcaucugugggaugggcagaggccgugaugcugacugccgugucccugucuugcagcuuccucaucguccuggucugccucaucuucagcgugcuguccaccaucgagcaguaugccgcccuggccacggggacucucuucuggaugguacguagcaucugagggcauggcuggaugucauggcugccuuggaagcuggcaucucccuggcgcugggccccauaagguggggggcagagccacucccagccccuugcccacacauugguccugcccugauacagggggcaccuccccagcccccacacuugccaagugacuugggauguaugugccacaggcgagggggaccaaggacugaggggaaccuggagcugguggucugaaagggcuuccuggaggaggggcuuccaggcugggcuggaaggaaggaaggaggagguaggguagagcugguguggccagcaaaggccugcccgagccuucgugucccuggggucugggugacucuguuccuggguuauggcuggcacacaggcccugcuggugucccagcagcagcccccaccccaggcaccuggauggucccuuccauuggccugagcggugucugugccauuucugccaggcaggugcugagagcagggcagggcaggcucauagccuggugggaaaccccaaaguugaucuggccgugaggcugccuggaagguggggugcagggggccagcugugucuggagcccacgggguccccacggaagccaccugaaugugggccgugagcagcaggacucuggcaggacugggucuagcaccucuccguggccaggcuuuuguguuuuccugucuugucguggaauaguucuaguaucuacaaaggaagagagugucacgacucagcucccggcaugcacaggcagaucugggcugguuucaugcugcuuucuggcacugugucuuccuggccaggggagcccgucccuccgggguccagaguccucucgcgauggccucggcagugguauccgucucauuucuagggaguccguuuuaccuuuccuuuguugcuucuggaccuugagccauagcuggaagaacucaccugugguuuccuccagcccugaccagguuaacugugugugcuccaugguggcugggaguuuccuggguaaguggugugaggcacaggccugcugucacucuucccucgucuucccaguucucccagcacuauguuuuccacaguccaucuguccugccugacuggaggggccgucuucucuguaaaccagacguccagaggcaguaggaagggucugcuuugggguuuuucuauucugucccacuggucuccuggacuuuuccuuuaccagggcccuacugacuugguggucccgguacuaaaaucaauuucaugaugucacuuugugccucggcagggcuuucuuuuucggggguuuccugguggcgcuugcagccuugcuuuucccagugaacguugccaucaccuuauccagccccgggaagaaacucgaaggccgcgggugaauaaacugggggagacugacaucucgguggucuccaggagcaugguguguguguuuaugggcagcauuuuaugguuucauuauguagauugcaggcaguuuaagucuauuccucaucauaauaauauugagagaauaaguuguuauuguugccaucacauagggaguuucuagucuaucauguuuuccaggcacuuuccuggcgucugcgaaagcuguuaauuucugcuacagccugugguccugcuacuucucgugacuguggucguagaaguuuuucccucuguccuuugcaucuuuugcguuuccagauaagggaugccuuccaggagggcagauugcugcuugggucuguccagagcugggggugguaccugcggccagcggggcccuccuggcuucugugggcgggccggcugccaggcggggggugcgcaccucccgugcucaggaaggguccuucagguccgaugccuggcgugguuuuacggugaccauguggauucuggucaggggucuuuccugcuucugugaggugcuccugucagugaggggccccccuugccuuccuggaauaaacccccuugguccuggcgugugaguuucauguccuaucacauuguacucucaugcuuuguucagacuuuugcacugcccugugaaguggggugugugugucaucuuguggugccaucuugguuggggugaggccguccuucccccacagggcgauguccaauacccuuggcagcaugggccucauguuuuaugggguccccaagguaccugcccaggauccccaaguccuccucacccaccacagaccuggcucucagaugagcacccagccaagucucuggccaugucuagcaggaggauguucugccccggccaacugacaggguuggcucaacugcaggagugggcacggcauguccuuugcugguucugccauggggcgggucuguggggggucccugaccugguaguugucccuggagggccuggggccaaggaugccagugguucccaggcugugagagccgcgcugccaaacauuccccuggagagucuccgugugaggcccuuuguaccucugcagguguguguacauguguguaugugagugcccacaugcacgggaauguguacacgcaugugcguguuuaugggugagcugugugcuuaagugugcaucuguaucugaguauuauguaagugugcauacacaugagcacguggggacuuucacgcauguuuggcucuguuucaauguguguacaugugugcacauguguaucugagcguguacaugugugaauguggccacauauaggcacauuguagugugcgccugugagcauguauuguauguuuaugcauggcuguguuguguguauuuauguauagcuaugugucgcugcguguguguaccuauguguauguacguguguucaugccugugcugugugugagacgugagauccugccugucccaucccucacguacuaaccuggaucuaggugguuagccccucgcccccagguggccugggacuugccugguuuuaaauggagccccggugcuaacgugagcccacccaggugcuccugcccagccagggcugucugucagcaccacagcguccaaguucagguccucacuuccuaggugguuaucucccaggcagcugggagggcgaagccuggagaagccugcacccaggcuggaccugcagggaccuucagacgugcccugggcuccacaugcccgucugcagcucgagaauuagacgugcccugggcuccacaugcccgucugcagcucgagaauuagacgugcccugggcuccacaugcccgucugcagcucgagaauuagacgugcccugggcuucaugugcccgucugcagcccuagaaucaccagcagcaccccaaggcccccaugcggcaucuaaaccaggcaggggacaggggcauggagcagaccagguaggguugcucccuaggaugcagcccugcccaggcaggagggcagacccuacacagugcugagcugugcccccagggaagccuccaagaugguccucaucccagcagcccugcccacugucugcgcaucccuggggucugugcgccaccugguggcuauuugcugaacuguggccacaaaccccuggucagcaggaaccggcccuuucacugcccugcagcucccucuccuccgggguggcauggcagagaagcagcccguggccccaagcauagagcccccuuucugcuguagucccccuugcaguccccucugccuuuuccacugcuuggaaggcagagagacccuggccgccucccuugucccuuuaucugucaugccagcugccucccugccacaccuugcgucucaccaggcaacccugcaaacagcagcuggggaggacuuucuaagacaaaaaccugaucauuccagaagcucccugugacguuuaggcuacauuccccaagguggugccacguucaggcccaucaccuguaacacuacccaccccaccucacccagccugggcucacucacuccaggccaagccuuggacauuccuggcugccccagggccuuugcaagcccucuucucuggaccuggcuguccucgggagugucagcacucagccucuugucagguuucaggccucugcuuggcacuauccugcacaccauccccgccgaccugcccuguucuggguucauggggcucugggaggcucacaagcaucugucugccucaggccauuccacacucccugagggugggaccccguggcugcgcuaaccccacaagcucugcauggcgcuuccuggccgugcaugucccucccugcaucaaaugcauaggccagaguugcccagcgaggaugacccagcuugguaugugcucccggcuucagcugccccugcgugauggagacacccucccacucgccuugccacacuucccagcagucucucgaagcacuggccgcguggaaacaaauccuucaaggggauuugaggguccagcugucacucagucauggccauggugggggcacguuggggacacagcagagagugaggcagccgugggccuggccuugacaggcggauguacagacacaucagggccgagacugaggcgugggcucuggguggggagacagugaccacuugcuuggaggagggggcgcucaggugggaggggcacagugagaaggagguaagcuggugcuggcggggcaggcagggaccccucccagggcucacagcuuccagcggacagcaggcacagggcuguggggaucagagcacaggcagaagucaccugacagcagguucccgaggcuucaggccuggaggagugaggacggcuguuggguucuugauuccagcagagggaggcugugcaggguugcaggaaggacgguugggggcgcuucggggagguacgagaagcaaagguguuugcagcccuuggggccaggcggcgggaaggccuguagacgccagagggcgcucgugcuacaugcaacucaggagcugcuggcacccgccaaggagugcugagcgcggggagcccaaaccacagccuuggggaacccaggaggggccgggcgggugcaggacccgcaugagggauuccgagagcacgauguuuaaauguugggggaaaaaauggaucaaagcgauguguucccagggagccccuguuuucucguuucuuuucguacgcccagcuuugcagugccagaaagcuguuaucucagcacugcuaaggaaaccccagcgcggccucggagggauuaggcauucugcugaaccagggauaugcggugggccugaaaaagccauuucgggaggaaucuggucucggcugggguccggccggcaccgugaacaccacgugaacaccacgucggaaaucugcugggcagggagauuuccucaaggccucccagggaggagagccacuuccugggcugcaaagagggccccaaccuggcuucugaauucagagggggcugugugugcacguguguacguacgugcaugugcacgucuguguacccaugucuguggaaguggcacacgugugcaugugugcacucaguguacgugugcgugccuguggguagcuccgugcgcacaugcguacacauaugccuggugugugugugcacacgugugucugacgugugugugcuuugcguguucuugccugggaaggaguucccgguuuggguggcucuccuguuucuugccgaagccagcugcugcuagaaacuggcccccugcucucugcaguaagagacccugcccuggcccaggugagggccuggcuuuugucuccaggaucacagcuuuugucaaacuccacacaaagagagaggcacucaaaagcacaacacaaacacggcuaguccgcgccuuugguggugaacauaccagggaauuguccugcaaugccugugguuaaaaaaccccgugagcugcggccccggaggccuaggggaugaggucaucgcugcggcuuccuccccucugcugaggcucccuccgccccgcccgguggcccaccccucccgccagcugcagccuccacugccuggguuucugcugcgccuucagcacacagcgaggccucaguuucccucccagcucagagcaaggccucaguuucccucccagcagcaaagugagacccuguagggagucucugggccuccgugacggcccugggcggcccucucuguggaacaaggucggguccuguccucagcgcccuggccuccacuugcucagggcgcccgcaggcccgcagguccucaccugguguuuuucaccugggacccgcagcugcucugaugaggagccugcucugcgcacggccuggggcgguuucccgcagcaccauuucugccgcugccgggaaaagacgcagagcaaaggcaccuuugcccagguuggggaaccagugggugacucaggauuuuccuccacccaccccgaggucugacucccucugcagcugccgcccgcugaggguugucuuccucccugccugccucgcccugccuggugagcuccuaugggucugacgaagccccguccugcacacuugcuucgggggcaacuccccacuagacugguugcccagggacggggguacccacucccuccucagggcugcagggugcucugggaagaguugugucccucugugggccugugggcucacuugccuuuuugucccugucacuugggagcuacccagcuaagaccgguccccaccacccaggccacucugaggcuucagaacgcggucgucuucucccuggcaggguuguuuccgccugcauuuguucagccagcaaaucuuuauuaagcaccuacugugugccaggaucuaugugcaagcagcccaugggcucaugaaaggcagagcuggacugagauuccgcaccccugggauccucacugcagggcccuguguaugugcgggcuggagcccugguuccugucugcacugagccccuggagcuaggcccagaggacuugacagaugugggcccucugucugcacagcccccagggcacgggguggccugcagcucugcccagccagacuucaggucacugccccaugagccuguaggagaaacuucucacucaucuguccugagaccugccuggagcccaccccagggagacagaggcucucggagccuguucagggugaaaggacgcuagacacuggccugcaggcuuugggcggguaaggguagcgaaggugaaaguggaccaggggcagguggagcaggguaggcccaagugucugucuggggcagcuggggacacccaggugggcugaacuucagcugccacccagcuucagcugccaaggcuccucccgggucagggucgaccccugaugucccggcaagaguuccaagaacaaaggcucagaauccaccaagcggaacuugaagccacugcccuguggggacaggagaagugacuuggccggcucuccggagcccaguguugaucacugaggaccaccggauacaagucccuccugccuuccccuuuagugacacugaagcuguugaaauccccauccaccaggagcuccugguccuggggagcccugugcaacccacucacugccuuucagagcccuguggcgucucucucaugcgcuggccguagagcuuccugaaagcaucucuaucacccacucugcaccugagagagggcggucaggugacugguacccccugaagaccugggaccaggcccccugccucugggaauccaucaaaaugcucccuucugaggccgcuuugcugggcguaggaucagccuugcuuugagggcuguuuaggagaggaaccccggcgcugcugcuccccggaggcagccagugcuugugaugggcacccugccuccaguguucugcuucagggugugggaugcacagcugggggcaggggcgcugcugaagccacagucucagagccugaggcccacggggcauggcaugaagacccggugguucuguucccccgggacagccuugguccagccucacuggccacaugcucugccgagcacacccgcugcuguccccagccacccagccccaugcacaggccacgcggcgacaggggcugcugaaggaaggcugguccgcucccugccugugacaggagcucaggcucagggcagcaggggcgcucagcugggccgcggcuccacgguguuaagggauucuagaaauuuccugcugugccaggcugcagcagagacuccggccccaccaggcuuccuguacuuggugauaaacacaccauccgcacugccugcggcucuuacaggagucucucgugcaccauugcucaacccccgagaguuauggaaggaagggaggcuggggugggugccccgagugccuuguuggaguggaggcuggcgcugcccugccccacaggguggcuggcagggcucagcaguugccuggccugugggggcagaggaccuggggagacaugcugagcccucccagcgagacacugagggucgggaggguaacaugugauuuugaggccacccgcuacagcuucuugggaccucccucucucaggcgggucuggaacccaacagagcugguuugggccacagcaguggcuucccaggcugggcuucaaaaccggacacagggcguggcucucccucccagccugccagagggaccgcugggccuaucuccagccacgugggucgcgagagucgaccugggcugcgugaugggggaccccaggcugggcggcuuaaaccguggaggucgcccucucacagcucuggacgauggagggccgagacccaggugugggcagggcugguucuucugaggccccucccggcuucugaggguggcuagcaacugucuucuagauguaguaccccaaucccccccagucccucccuuuaccucacagggcauccucccugcgugugagucuggagccaaauuucuccucuauguaaggacaccagucuuacuggauuggaggcuacccuacuccacugugaccccccuccuaacugaucauaucugcagggaccccauuuccaaacaaggucuuacucugaguacuggggauuagggcuucaucauaugaauuugagggcaacccaggggucuccaaaccauggcccacaggguggcucccuguguguguaaauaaagcuuuauuagcacacagcaccacauacuugagggccuaaugccucuggcugcuuugugccauggcagauuugaguccugccauggagaccaugcagcccacagggccuaagauuucuacuaccugaccuuccaggaaagguuugccacgcuauuuauuuagcaggauaauuuuggaaagagcaguugcuaggggcauuuaaacuugcagucgaauuaguaacaauuuuauuuuuugggaaaauagaagugggagagcgugugccccgggccagcccaccgugccccacguuucuacagugcccagguuggcgcagggccuuuugguuccacagucugugucuuucuuccugggugucugaauuuugauuuaaucucaggcuugucagaacgagcagcucccaggcacccucugccaggucagcaguggcuuucaucuucugccauuugcucugcacguuucucucuauaugcaaaaaccuauauggguuuugugggguuuuuuguuguugguuuuuuauuuuuauuuuuuugagagagagagggucuugcuguguugcccagguuggagaguaguggcauacucacggcucacugcagccucggccuccuggccucaaguguucccacuucagccuccugagcagcugggacugugggugcgugccaccaugccccgcuaauuuuuguauuuuuuguagagauaggguuuugccauguuaccuaggcuggucuuaaacuccugaguucaaacaauccucccaccucggccaacccaaagugcugagauuauaggcaugaaccacugcacucagccugcuuuguuuuuauccugagucauuugagaguaaguuggaggcaguaugaccguuucuccguauaaagcccguguauauccucuggaaugaggaccuucaacuuagccaggguguccgacucucaggacaccgcuguccauuucacagccugcauuuaaggcucgucacuggucccagugaguguggcugguuuuuucucauugcacauggcugucacgcgguuucagcuucuuugaccuggagcagcccugcccggccuucccuucuuggucucucucuugggcagggaagggcgguggacauggaggcuuggggacaguccccuggccccacggauguuguguggacgaguuggagggcucacaggccccucuguggggcccagggcagaggcagcaggcaggcugucuccaccacgauggacaucauuuaugccccagccagguccccugucccaggaccgcgguugacaggguuuggauuggcugcguuccugucugaaggcagcugcuugggaggaggacagcugacauucuuucaugcgaaaucugcuugcgggagagucgugaaagugggaauccugggcuggaaccggaacguuccccgaguacauaggaauccugggcuggaaccggaaacuucccugaguauacggggccuuguguguggaggggcccuacggugaaucguuuucuguaacaaaggcuuccucugugcagcccacacacgggccucacguuaucuucugcaggccagaauugucauauauaucaaguuuguucagaacaagauggggugggguggggggcagugaggggccuggggcaggagguagaggaaacugcaagauuuuuuaaaccuucuccaaaaacacguaacccgauucuguccaagcgauuugugagaaugggguugacaccccugggcuggaaccugggaaccaccagucagcgucuuuccuccagggaggcugugcagagggaaggcagugagccccaccuggguuugaggaaccuggggcuucaagggaggcggucucagcccauggugcuccggccagggguggggcagccgaggcaugaguggaugaugucccgucggcagcccguggucccucuggggggcaaggugccuguuccccauugcuccuccaccagaacaccuccuccagaucuccgccaggugcgcccccugaaggaaaaggggaugggggccuggcucgugccugguggcaaguccucuugggccccagaaagaccccauaauggccagguagaagcuccuaccugcugcugccugaagagucuggggcccugucggcugguuccaucgucuucccuguuuucaagcuacaggagcgcaaucuuuccagagcauugaguggcuagaggaacgggcuuacgcuaggcaggcgcuggcaucuuagacaauaccugacaucuuugcgggagcucuggugagaggccccacaagcgugugacccugugcggacuccaccgcggcagccugggagccaagccgauggcugugcuggccgaagggaacaccgccauggugcucugcucucugcagcccugggucugguuggaaguugcaucccuggugaagggcggccgcggcuuuccagcucucccaggccaguucccguguuuucucucccgccuuccccauaguccaggacaaaagucagaccuugguggggggugcgccugcugcaggggcccccaggcuucuccauucggguuuagugggauuagagugugcggccauggggacagguguuuccuuuauguucugccugagggcuggaaagagccucaucagugagugccacguucggugggggucucuggugcaggggagccggcgggccggguuggguuauguccuuguuuucacaucugacccuggccagcuggagagccucgcuugaagcgcagggcagcagcugacacaacacaacgggacgggcugagcaggccgggcgcaggcaggcuugggggagcuggcacuggcacugcacguggggcuccuagggggcugcuagggaagucauugggggauaauaggauccacccuguggggcccacuggccauggaguacugcacagugggguccacccgcugugucccugaacaaggagguagccugaggucuccucugacgcugggcagcagccuggggagggggcugggcaggugccaggggaacccccuagagggcauuacauucagaugaguucuaauuauguucuuggcuucccaggucacacagagugaaaaccagaggcccuggccgugcaccauugaagugugucaucaugugacuuugcagguuggggggacagggcucggugcggccucacggggucaggagccacggcucgagcaccucggaucccagcccccuguucagggccaggccuagacagcucuucccacgagauuuucuuucucccggguauaaaacuggccaacgggaugccuggugggaugacugggguaccuggggccaggggcggccagcagccuccucaguagcuugugggagaugcucucaaccccaaggucagcuccagcuggccucaggaggaguggauguucccuucaggugucuuuaggacccuggcaacuggggacaauagucuccuccccaaauaugcagucuugacuccuggccacuugggaaggugcguucugguccucugggccucacagcuuugugcccucuaggguggcaaugggaggcagagagcacagccuggggacuugcugugaggggacugcauuuagauuuuuaggugaagccaaucccuguugggcugagaaaaguccugggcggcugugagcugguggugaguuuuccagacuuggucauggucaagguaguugaagucggggguugaaaaacacacucguguccagcccagaugccuuauggagaagaggaugcacaggcacacacgcacagacauaugugcacggaugggcguguggacguaugcacacauagguacccauguggacacacucacgugugugugcacguucaggcucagacacgugccugcaugcacacgugcacacgugcacacccagcccuggaccucaggcaggcagggagagagacccccuuggggccgcguuccauuugcacauuuaauccagaaacugucagcaugggaagccuggaugagaacaaaaugucaagugugugccgagaggcgcaggccagccccuuuuccuggcggggugaugaucuggucaguuuccgagcaccaugugcugagaaugaugcgugcauucagagcagcauuugguggggaaccugggggaagggcgggcgucuuuauuucauuuuagcuuucuuuagcggggccugugucucuucucacugaccguuuucugaaacuggcuggggagggucagggauggcugcuguccucgggggagggacugagcugggcccuuuucguugguuaguucucaguguggccuacccagccaggucccuggaccuggcgguggcuaugaaagccugggauugaggacaaagccauggggacgccguuuucgggaugcuugugagcagggcuuuguccccaccguuaggauacucugaacguucccagaaagcccccuucugcucaaguucucuugcuucaucucaggcucagguguuuugaguuuuuuuuuuuuuuuaaaugaggacaucuguuagaccacuuaggaguucuagaaccuuuggaaaacccccucucaucccgggaguuuguaagaauuuguaguuucuccccagaguucauggagccccugucagaggcgcugaggcccagguccuguggcugguccucgcauagacaucagcuaaggggguuugggggccagucggcagccucuggaggccucugcaccccuccugugaaaggccggcgcagagcugcaccgugggguccccuggcuuggggugggccucagaggcugucgccgugccugcuguggcucuccauggcccuggagccugggauugcagaaagacucccagaccuugcuggggaaacuccaggauauggggguauccagacuccugagacuuccccguggguccacacacgucaccaauccucucugcaccucagcuuccucaugugugaaauucaggucauaucaggaccucaguuccuggggcugugccgaggguguggggacauugggcaugaagguucucaguccagagccaauggccaagagggcaaaaggguguugguggacgaugccuccuccccuggcgggggcggggaaggaagugcuaggggaagccgguguaaggggccccgugcccaccaaaggcgcgcuaauugcgaaggaggggccucagccaggaaccgccauagccucaguuuuauuuauucugcucacucaaacaaaaaaucagcuuuguugagguauaauuggcauagaguggaaggccuuguuuaaaauguaggauuugacaaaucuggacauggguguacgccacaggaccaucaccacaauugagacagcaggcacauccgucacccccagaaggcuucucgcucccgucgcuggccccuccuccgcugcuccuggcuccggaggggaccccuggucugucuugucaguguagacgguuggcguuuucuggggcuuguugucagugcaaucauacagugugugguuuuuauugucugguuccauauuugagagucauccaggcuguggcauguaauaauucauuccuuuuucauugcugagccguaucccauuguacggacgcauugcagucuguuuauccacuugugugcuggcggacucuguauaaaaguguuuguagggacuuauauuuccuuucugcauggguaaauaccuagguauagaauggcuggauaauguggugaguguauauuuuuaacuauuuaagaaacuggcuaacucaucaacccuugacgugguccgucauuuucauguuagccagucuaagaggugugcguggcauccugcugugguuuuaacuuucauuuccuaaggaccagugauguugaauaucuuuucacguguuucauuggcauccaggaaacaucuuuggugacauaucuuuuuaaauguuucacccauuguaaaauugggcuguuugucaucugaguuguaaaaguucuuuguauauucugguuacauagauauuuguuuuacacauguauucucuagucgguggcuuuccuuuucauuuauuuaguaguaucuuuuuuuuuuguuugagacugggucaugcacugugcucaggcuggagugcaguggcguaaacguagcucacugcaaccucgaauuccugggcuccgaggauccucccaccucagccucccaaguagcugggacuauaggcaugugccaccacaggugcuaacuuuuuaaaguucuuguacagacagggucucacuuuguugcccaggcuggugucaaacuccuggccucaagcgauccccuugccucggccucccaaagcgcuggaauuacaggugugagccacugcuccaggcccaauaguaucuuuuaaagaccaaacauuuucaauuuuaugaagucaaauauagcuuuuuccuuuuaaauauguuucaugcuuuucacauucuauuuaggaaaugcuuaccaaacacacucuuacuaagauuuucugcuaguaguuuuauaauuuuugugcuuaccuuuaggccuaggaugcauuuugaguuaauuuuucucuaucauguaagacauaggcggagauucauguguuuuuucuuauggaugacugacugguccagugucauuuguugaaaagaguauccuuuacccagugaaucaucuugacuccuuuuaagagguucaguuuaucauaaaauugucucuuucuggacacucuacugugauccguugaucuguccuuuugccagucacacacugggauuguuacagcccuauaauacgguuaaaauaaguuaggguaauuuagccaacuuuguuuugcuauuucaaguuguguugguuguucgggguccuuugcauuuacauauaaauuuuggaagcugcuuaccaauuuuugcaaagccugguagaauuuuguuugggauugcauucaaccuaaagaucaacauggggagaauugaugucuuaaccaauauugaauccucugaucaaugagauuaucuaucucauauauauauauguguguguguguauauauauauguguguguguguauauauauguguauauauauauguauauauguguauauauguauauaucuauguauauauauguguauguauauguauauauauguguauauauauguguauauauaugugugcauauauguguauauauguguguguauauauauauaugguuacauaccuaauauguauaugguuauauaucucuuauaaggguuauauaucucauauacauaugagguuauauaccacuuauuuagauuuuuaacuucugucagagauguuucauaguuuuuaguguauaggucuuguacaucuuuugagguaccuaaguguuucauauuuuuuaugcuauggucaaugguauuucuucuaaucuagaacugaaauucauuuugacaaauuuaucuugaaucuugcaaccuuucuaaacucauuuguuccaguggcuuuugaaaaaaugaauuccauugauuuccuuauaugaaugauguuuucugaacauagagacaguuuuaccucuuuuuuucaaauguggacgccuauuuguuucuuuuucuggccugauugcacugggcggcucauccacugcaguguccaauacaagugaacacugcuguguccccagccuuagaagacacacaucauuguucaccgucaagggugauguuggcucuggguuuccauagaugucuuuaccagguuaaggaaacguccccucuaauacuauagcugagagcuuuuaauaugaauggguguuaaauuuugucaaaugcucuuugauacaucuuuugauaugaucaugugcuuucucuacuucagucucuuaauaugauaauuacacugauucauuuucacagguucuguauuccuggauaaaccacacuuggucaugcucuaguauucuuuuuguauaucacuggacuugacuuguuaaaauuuugcuaacaaccuuugcaucuagguucaugagggauauugucuauauauuuucuuguaacgucuuuggcuuugguauuagaguaaugcuggcaugaggagugaguugggaaguguucucucucccuuuuagagguggaguuuguguagaauuggucuuauuucuucccucuguguuugguggacuccaucaggaaaguuguuuagguaggccuggacuuugcuugaugagaagauuguuaacuagauuuuaaauugacuuaauaguuuuauucaggugauugauaauaguuauauucaguugauugauaauaauuauauucagguaauugauaauaguuauauucaggugauugauaauuauauucaggugauugauaauaguuauagucaggugauugauaauuacauugaggugauugauaggugauaauuauauucaggugauugguaauuauauucaggugauugauaauucuauuuaggugauugauaauucuauucaggugauugauaauagugguauucaggugauugcuucuugagugggcuuugguauuuuguguauuugaaagaauauguucauuucaucuggguguuaauuguauuggcauaaaguuuuucagaauauccuguuacuauccuuuaaacagcuauagaauuuguagcaaugucucuucucucauuccugauacuaguaauuugugccucuuucuuuguuaguguaaucagucagcuaaaguuuuagcaaauuuauggaucucaaagaaucagcuuuugguuucauuauuuuuuuucuuuuugguuauuugauuaauuuuaauuauuuuauucugccuacuuaguuuuaauuuguucuuuuuuuucucguuucuuaagguggaagcugaggucauugaauagaaauuuuuuuuuccuuucuaauacaggcacuuggugguauaaacauccacaaauuuuguguuuuuuuaucccauuuaaaauauuuucuaauuuccuuuuuaacuucuucucugguguaugcauuauuuaaaaguguauucaaaacauuuagggauuuucaagauaccuuucuguuacugaugucuaauuuauuuauggcuauagaaacacuuaauauaauuuggucucuuaaaauauauuaagacuugauuuagggcccagaauaugauuuaucuugguaaauacuccauugugugcuuggaaagaguguguacugcuguuguugggaggacuguucuauaaaugucaaugagacuaaugugguugaugauggcauuguccaagucuacaucaguaaugauacauccuuacugauuuuguaucuacuuguucuauuaauucauucuugggagaaggauguuagaaucuccaacuguauuuguggauuucucucuuuauucuucaguucuuuauucuuuauuaguuuuuuguuuaauguauuuuauuuuuugcuuuugucauuuaaaaaauuauuuacauucuuuauuuuucauuuuuguggauacacaauaguuguacauauuuauggaguacauaugauauuucaauacaaguauaccauguguucaauguguuuugaagcuucguucuugggugcauuagcauuuaggauuguuauguccucuugagaagucaacacauuugucauuaugaaacugccucuuuaucccuggccacuuucuuugcucugaaaucugcuuugucugagauuaauauggcuauucuggcuuuuucuuuuuaucauuguuagcaugguauauauuuuacucauuuacuuucaaaccauuugugucuuuagacucaaaacuuguuuuucauaugaagcauauaguugagucuuauuuugugagucaaacuauuuuucuccugaaaaguacagcuaauuugcauuuauucauaggacugacauucuuggucucaacucugucauugucuuuuauaauuacguguauuuugucacgguugcuguuguaguuuucuuuacaauauguguauuauuuucuuuuaaaaacauuuggguaauuaggagguuguauuauuuauuuauuuauuuuugcgaaacaguuucccucuguugcccaggcuagagugcaguggcaugaucucagcucacugaaacccccaucucccaggguuuaagugauuuucgugccucagccucccaaguagcugggauuauaggugggcgccaccacaccuggcuaauuuuuuuuguauuauuaguagagacggcguuucaccauuuuggccaggcuggucuugaacuccugaccucaagucaucugcccgccucagccucccaaagugcugggaucacaggcaugagccaccgugcccagccuguauuuuuguccuaauaguuaccuuuauacauaugccuuucaaaguuuccuuggucccugguuucucauuuaacccuuuacugucuggcuuaccguuuuuauuaaucugccuuaacuucuacuuagugccuauaccacaaacaauaagcugacuccauuuccaucuuuuauaaguucagacccccacaaccuuggguggacuacugacuacuucgcggguaagaaauggugaguggcauggaaggggaggggcggcaguucucaguggagcggccgggcugcgagucucuguauggaggugaagguccagauguugggguuucagggucaagcauuccuggcagagagcauggcacgugccaagacccggauggggcgugugccuggcgcggguggagggagcugugaggagccuguagcauucagagacaggggagcagggagcggugggggaugaggucagggagguggcaggaccuggcgugugagggcuuggggcgacucuggggaguuaggguuucgcucugcaugacaggagccuggggccuggcauggugugacucagacuuaacgccgccccucugacugguagaggccaggcccaggauaagguggcggcaggcaggucucuaagcaguggcagcucagacccgaggucccagggucaugcguguuuguccugauugcacgagucgugugagcacagaaacguagguggaaagaugguggcuucguccagggagguagacugggaacgucuuuugcugcuucccuuggauuuuguuucucaaagucugaaucaagcguggcagaagaaaauacagcagaacaugggaugggaauauccaugcguauaaucggucagguuaguugcuguauucugacuuauuugaaagauuucauagcgaacaaagaaaaauuccgguauaacuauaauuuuuccauagcaguuuauauucccuuucucagccuuguagguguagguggaguguccuaagcucuggggguggggggacacguuuacgugucugcaaaccgcuacauucugcuaagacaucucaggagcccgccaagcccuuagugaaaaguuucuuaaggcgguuucauaggugcguguggggcuguuggauacagugacccacuucaaggugacaucuucuucuugcaucucagauagcaccagguuuguguguuuaugcgugugcacacacgguguugggcucuggcgguggccugggggugcuuaggcugugcacaaaugcccacgcacguacacacacagacacacagccugacuuggcccaggugggugggugucugaggagaaguucgccauugucgacuuugggguaaagugaggaccugucuggcgggaauaaaggggcccuacugucccccgacuaccacugccccagcccuccugagccccugugacugaaaaauccucacuuuggaggauguuuggugacaggugcuggggcccggacacgaccugguuucuucaucccaggggcugucuccaggguggguucuagaguacauccagcuuccacccaagggagaguggcuggguggagagggggcaggcugagaucugagaagccaggcuaggggguuguggagcaaaugaugaugucucaaccauguggcuuuagguccccagcacgugcuaguggccaucagcaggcuacagcauccagccagugccaccaggagcccacuggugccaggaugcugggguggggcuauggggaaggaagacaugugggccagggugcggggugcgggacaaaccuggguccaggcaccuggggcgacccuccuuggccguccuugccauccucgccauccucucuccacacaucugaccuuugccugcuuugggggcaguuugaggccucagauuuucuaccucaaagcgauggaacccagaagacauggggcccucgaggagggucccccgggggcugcaaaagcagagggaguggagugucaccgggugucccggcgugggcagguccuguuguggagccucgugaccugcucauagcacagcugggacacuuccagugacugcucugcgaggcccgggguaggggcgugggggggccuccuccucccaagcaccuggggugggaacaagaggcguuuuguguucugcauggguggcccugggcuccccaggccuggugugggggugccuggggggcaguggacgugagcagcagcacguggcccccagucaugaguaccccaggccccuaugcgccuccuuccccaugacuggcccuggguggcggagagaccccugggcaggacaccccucccuggcuuuuccuucugcaccacucaaucuggggguuccggcuccuugcccaccgcccccgccacccagcgcgagccgcguagaggagcaggaagggagccagcuccaccuccaguagacccagagacggggaggccagggugcaggggacuguuugggccucgagagggacggaccccagaacuggaccccaaugugcaggucuggguguggauguaucuguaugucuuugcggagcucagaugagagaugcucagaguugucuguagagaaccagagcugccgagccccggccuggauggacaucccgcaggcagugcacgucccucccccgccucucuuugccguugccgggacugggccgugugccuggaguuugaacuuuucugaucacggggugagagggucuuugcaguugcagagccguggcgcggcgccuggauuuccgacacacugcagcaucugcauccuugccgucaccccucacacccccugcuagggucccucuggggguugaaugaaaaggcauagguagaaggugggagaagcccacguucugggagcgucgcaguggcccagacacccauguuccucccuaggcagcuccaugcgcgggccccggagcuggaaagcagccaagggcacugcccgcccugggagcugaugccugacaugcauccucgccuaggccagagugccaggcaggguaggggaacaaaugccaacacgugagcugagugaccggaagagggggcgccucccugagcaggugaaugaagggugcugggguggcgaguugagggccaacagagauggugucccggcugauguagggucaggggcuucuggaaggagccucacaggaagggcagggcagcaccaggcucagcccaggaccagagcgcaaauagggcuggagucccgaguacaaggcauggacaggagccaggcuucaccuagcaccuggcuccccgggggcccagauggcaggcgaggggugccuggggaggcugccaagugaggggggggcacagacugagacaggguccccguguuccauccaugggguacagcugcucccaggccagacucuggugguagcaggaggcaggggaggcugugcugagcucagugggcuugguggggucauagcugccucucccucuaaauagauuaacuaaaaaguauuguugacugacucaugcauuucuuagguuuucuuauuuucuaauuucuucuuuuaaauuuagguuugucgagguuuaaguuacauacaggaaaacucucccccucuguagauguccaguucgaugaguccuggcaaacauuuaugguccuguaaccacccccaaagucaagauccaagguguucccaucacccgaaagcucccugguacccacuggcggcuagccccuccccgcaccugggaaccguggacguguuuccuguccccaugguuuugccuuuuccagaacgucaugugaauggaaucucgcggcguguagccucugcgccuggcuucugucacuuagcauaauucauuugaggcccauccgugucauggucucugcauucagcaguuugucuccuuuuauuuggaaaggauaaaauguaccacaguuuguuuauccauucacaggcugauggacauuugagcugucuccaguuuucagcuguuaugauuaaagcugccaugaauauugcgugcaguuuuuugaguaaucauaugucuucauuucucugggguaaaucccugggagugggauugcgggaucauguguuagaugcauauuuuccuuucgaagaaacugccaaagcauuuugcaaaaugguaggcccguuuuccacucuuaccaucaauguacgagcauucuggcuccuauggauucucaccagcacuuaguauugucugcuuuuuaagcuuugcccauccuaaaggcuggagccauauuccgucauggucuucauuugcauuucccuagugacgaaugguguugggcauauuugccauucauauaucuccuuugauggaggaucuguccaguuuguugcugguuuuaacaauuagguugucuucuuagaauaaucaugugaguuguaagaguugugucuauguucuggauaugaguccuucaccagaucuguuuuacaaauauuuucucccagucauggcuuugucuuugcauuuucuuaacaggaucuuucaaaagagcagcaguuuuuaauuuugaugaaguucaauucaucaggguucuucuuuuuuuuuuucuuuaggguucauguucuuuguguucugucuaagaaauauucgccuaauccaagauuacaaaguuuuuucuccuguuuucuguagaaauuuuauaguuucacauuucuuguuuagaucugugauucauuucgaguuuaauuuuauauauggugacagguauggauggagguuaaaucuuucugcaugugguuauccaguugucccagagacuuuuuucccauugaauuacuuuggcaccuuugaugaaaaucaguuggccguguguguggguucgauuucuggacuuugucaucuguucugccaggaaagcacugucuugauuacugugacuuuuacgcuaagccuugaaaucagguccuguuaauccuccaauuuuguucauuuucaagagugagcuguucugccagcuccuucacauucucaugaauaucuuagaaucagcucgucaauucuaccaaaaaaaaaauuggcuagaauuuugauuggcauugcauuggauauguagauaaauuuggaucucauacacgucuuaguaauaccgaguuuucugauccacgaacacggucucucuccccagugccucaugcacgucuuaguaauaccgaguuuuccgauccacgaacacggucucgcuccccagugccucaugcacgucuuaguaauaccgaguuuuccgauccacgaacacugucucgcuccccagugccucaugcacgucuuaguaauaccgaguuuucugauccacgaacacggucuugcuccccggugucuuagauauuuuucaacaccacucaucaggauuguguaauuuuuaguggugugaaacuugcuagauuuguuccuaaguauuuuauguuuuugaagcuacugaaaugauauuguuuucucaguuucacuuuuggauuauuuguugcuaggauauagaaauacaauugauuuguucguauauuaaccuugcguccugugacuuugcucauguuacuuauuaguuugagaagguuucuuguucaucuguuuuugggguuuuuuuuguuuuuuuuuuuuuuguuuuuuuguagauucuuuaggauuuucuauggagaugauuguguuguccacaauuaagucagucuuauuuuugccuuuucaguccauauacuauuuauuucuuguuuuuacuugaaugcaccugacagugucugccaguggggagagggcugcuauccuuaucuuacuccuaaggugaagugagguaaucuuucaccauuagguguggugggagcuguaggguuuuaguagaagccacuuaucaggccaagaaguuccuccucuuccugguuugcugggaauagagagugcgucaagaauggcuguuggauuuuuugacaagugcuccuucugccucuauugagauaaucauaucauuugcaacaaucucaaucaaauucuuucuuaauuugcuaguguggggaaucgcacugauugacuuucaaauagcaaagcaaacuugcuucccuuacacaaagcccacuuggucaugaugaauuuuuauuuuauuuuauuuuauuuauuuauuuauuuauuuuauauguauuuguacuuuuuuaaauuuuuuauuuuuuugagauggagucuuggucuuuuugcccaagcuggagcgcaauggcgugaucucggcucacugcagccucugccucccaggcucaagugauucuccugccucagccucccgaguagcugggauuacaggcgcccgccaccacacccagcuaauuuuuguauuuuuagguagagauaggguuucaccauguuggccaggguggucuugaacuccugaccucaggugaucugcccgccuugaccuuccaaagugcugggauuacaagcgugagccaccaugcccagcugucaugaugcguuuuaaaacaccuuuuuggaugugacugacuucgguuguguguagaacuuccacgcccacgcucacgagggcgucaccugccauguguuggcuguugugucugguuuuggcaucagaugccgcuggcaucagagaaugaguugggaaauauuuccugcucuucaauuuuuaggaagaguuuguguagaauugcaauuauuucucccuuaaacauuugauagcuagaacauguggagguaucugggccuggaguuuucuuuguggagaaguuugccauuggaaagucagcagauacagggcuaugcagguugucuauuucuucuugaugagguuuugauuguucaugucuuugaaaguauuuguccccaaggagcagaagccccagcccaaauuuggaaacaagaccauguugugcugacaugucauuccugagcagcuuaggggcugugggguuugcagaccucugaaugcagccaucugcagggggacccuccucagugcccugagagggggccugggcuggguggucucugcugcuggccaucccacugggcacugccuccccagggauucugcaacaggacaccguaaggggcacgggggacaaagaucagacuuucucuguuuccuuccagcuuugcuccccagggaggcagucccuucucagaggaaugaaauuuaagaagacaggcccuacaauuucacgacaagucugcuuuugacucucccguuuacuguguaaacuucagcccuaaaacaacauacauccuucugaaguuguucacauauuagcucuuaaaacagcaaaauccgugcacaauuuccucucaaucccuuaaaacauuccugaaagggggggaaaacaacuguuuaaauucaccgccuguuauuaaaaucucuagauuugcagaaucagagugagguacucagcagucagaaaacagacuagacaggcccgugugcacacacgcgcugacacacgugcacacacacacguccacagggcagccuuuaauaaccgcaggccuuccugucccaacacugcgcgggccccugaagggccgguguggguugcagcuccucaaucucugcuaaaguaaacaggguucaacccugcggccuucucagcacucuccccaagucaaaagaagggugcucagccccuggucucuuugguuugccaaacuucuagugcuggugaaauucuuaaauaugacauuuuuagaagcuucggcuccuggcagauaaaaauaaugucccccgcuccacccccuuuucccccuaucccaguucuagcuaagacagugaucagaggggugcaccgucuuugggguuaacagccaucagcagugggguucccaggcugaaacuaaauccucguuuaacuggccuggagacggaaacagcccugccuggggaagaugggggauuugcuuuaaauacguguaaagcugccugccaggcggcuaauggugucugcagccaggcgugggcgucuccgggccaugggcucccccaccacaaauugcagggcagccggcuugggccacuccugugugugcggggcccuggguaugauuccugggaggcagcucccaaacuguggggcucagcagaggauucagggccugauuugcgggcagccccaccugccuuuuugacuguucagagcccugagugccucccauaugcccacauuuuccugccccugggccuuuucuucuggucaucggccuggagugccuccacuggcacauugaguucugccuucagagccuggguuuucugguggaauggggcagggguaggcugauagaccucuuggagagacagggcccacuuucuuguaggcccacagggaccccgccuggggagagagaagcuucaggcccugaggccuauggccuggaccucucuagagacccuagaacagaccucuggccuggccuugcugaugaccuggagccccugggugccagcugcagcccccugccuguccaggagucugagcuccagguaucagcgagguggguucguucugaggcugugagggaguguuccaggccucccccagcuacuguggaaggguucccggucgacgcaucgcaccagacccugccuccgccuccauacagcgccccccggccggcaaguccauguccagguuucccguuugauaagaacaccaguuguaugggaauaggggcccacccuaaccaccucaucuuaccuaauagcaucugcagcaacccuauuuccaaacaaggucacacucugaggugugcuggagggucuaggaccucaacauaugaauuugcggggcgggggacacaguuuagccgguaggaauaccuaccugucagaggauucuuuaauccaaggguccguaaaccauagccuacaaaccuggcugcugaucuguauaaauaagauuugauuagcacacggccacgugugcuugugaacaucucaucucuggcuguuuuugugcuauaacagcacaaaauugucugcuggaguuguugcaacagaaaucgcguggccugcaaagccuaaaauauuuacuaucuggcuuuagagaaaaagcuugucaagcccuguucuaaacuaugaagacaauguuggagguugcuuucuauacccacagagccguugauggggugaagggagaggggugaaaugcagucacacgcaaauucuuaucuuccugaggagaaagccuuagggagcccacuacaguggacacugucuuuagagaguagcagaccuggcugugaguuugaggaaccagugaaaugagaguucagugacauccucaacuucaugaggaucagaacauggauaacauguggcucaacuaaacaaccaaaagcaaaagggagaagucaacagagucaaauagcaaauauaaggacagaaagagucaaaucaaaugccuccaacuucacaccaaauguaaaucgccugaauuccucuuugaaagacagagaaggccgugccguagcucugggcuuuuaucuuuuaacaaauacauugcucagcagcauuaaguaaggcaaagcaauaaugggugguugaaaaauaaaggaauggccaaagagaggccaagaaacugcaagcuaaaagaagaaaaggagagaaaaaacagggagaucaggaugaauaucaacacugaagcccaaacaagacaagugugaaugagaucaggcacuauuagaagaccugacuguaaucuuuaaggcaucauacaacauaaaauacauaaagcaaaaacuauugaaaaucugcaaggacaggaagguuaaauaugauaacgggaggagauuuuaauguaccucuuuuggaauaggacaguucuagugggcacaaaauaagugaggacauggacagguaaauguuguaaucaugagcaauuucagauucuaacaguaauuugaaauaacuccuguucuuguuaucuauagccauguaacaaaccauccacaaaucuagcaccuucaaaauacgcaucacgccugagcucgcuagccuacagucuggcagggcucagugggacggcucaucuccccucugcauaguaucagcuggggcuggagccuccacagcauugcaucuacauggcugguaaggcuccuguucaugagggcuucuccaaggcugcauggauuccucacaucucagaaaugaacaguccaggagacaggcagugccagggacugagagccaccuggcuguauucuccugaugcaggugucacagagcccagguucaguuggggaggacuggcaaagaacuucauaggacugugcuuuaaaaccagcacuaucacuucgaacccuaguaauggaguuguuuuguucccuuaugucugcggaacacuuacaaaaccaaucauucauguggcuacaaacaaaucuaaccuaccucaaaaaauugagauuuaacuggccauguucucugaucaaaacccaauaucaugagaaauaaaugauuaaaagauuggggaagaaaaaucccuuaccuauuugggaauuaaacaacacucuccuaaauagccagaaagaagagauugaugugggaagugcgggcccuguagggcguuaugagacguaggccccgcugccugccccagccccuacaucacuccagcugccccccagcaccaacuguagaugcuuuuauuuuguaaauuccaugccagugcccacaucgcuugcugguggcuucacuguguuugcaaauguugucccccacguggauugaaauucaucuauugccugaaaguaaugaaguaugugccuugcacacuguguaagcauacguguuuauucagugcguccuggguucucaccccuugccaggugauggguugauucagugugcugggggucuccaggcggggggguccacauaguuuuugcuucaucagaaucugcugauaagcccaguucggagcagagacuagaugggccagccugugggcacucugccuagcgccaucugccucucccaccccaggcaggugucagguggcugcugcgcccuguguccgccuccugaccuugagaacacccaggugggggaggaagugggccgcgcuucgggaacccccaccccgccggcuugcgcagcgagcugggucccagggcuggaggcaccucauuaaaccgccugaaacguguguaacucuagucggcccccguaaggcaccggcaguacaugugaaauuaaaauuacugagaggccccacucuccuccccuccaugggugggcagccuucauggggaggccaaggcccggaagccggcaguccugggaaagauuuggccccaaugauaaugggcccaagaaugugcuaggcccagggugugguccaaguuccuuucuuagcuaaccccuccacccugagaagccucccccacuacacccacacauggggccagcugccuugagcaccuccugcucagacccaggugagguaccugagugacaaaugucaagaguuugcaguuacucccagagcuacggacaaggggcaagguggggcuggaggcaccggcucagcaagaggggucacuugagccuuggccugcagggagguuuugcucaaggagugucccuugagcaaaauauugcacuuucguugcucucugaaagccuaccaggcagucuucccagaggugcuucccgggaagcccguggagaggaugcauucgacacccaaggccuuauggaaucaguccuggggccuggagggucguagagaaaugugugaacauggcuccccuuaggccagggguagacgcaggcacagggaggaucaggaaagcccuggaucuuguugacaccccgggaugugcccuuguggcuacuuagacguagagcccggggcagggggagggccagccccugugguuuuagccuccugagagucuccccagacagcccacaggggacacugggccucaugccgccugucaggaugguguccgggauguggggaccagacgacagcugucacccacuugcagggcccggcugcccgguggaugggaacggccauccccaugacgacccagcaagucccuugccucucucgcucaccaggaagaagacacguccgggcagcuggcagguggggcuaguucuggagggaaagcggccucgugccucccagagucaccccgaaaucauuaacggggagacaagcacacagagcagcuggccgauugcagcucugaaggucagagauggccgccagcugugggaaggccuguggcuagggcucugcugccugcuuccugggcaggggcuccuuccucccucucugucucuggggucccaugggaagucaggguggggccugguguguggcuuccgcugguuuccugggugugucuuccugcagggccaggacccccagaguguuccagugacuucagagaggggcagccagaccaggaggagcuccagaggugcccuguggggagaggcagcgucccaaacacgggggaggggguaccgccagccuggggacagauagcagcaucucagccauggggggccgugacauccggucaggaggggguuagcaucucagacaugggggggagauguccagcccaggggaaugaggggggugauguccauccuggggaggggugacauccauccuggggggacggaggcgugacguccauccuugggggaugggggggugacguccauccugggggagugggggcggugacguccauccugggggagugggggcggugacguccauccugagggaacaggggggugacguccauccugggggaauggggggggugacauccaucuuggggguacugggggguggcguccauccugggacuggggggugacguccauccuggggggacggugggggauguccauccuggggggacggggggugacguccauccugggggcgggugauguucauccuugggggacgggggaaggugauguuccuucugggggggcgggggggggugacguccauccugggggagacaguaacaucccaaacaugggggaugauguccagagugggggucuucaggucuuuacgggccccucagccuccccuuccacaccccaaguacagcacccacaaggcaggugccugggagggagacacaccuguccccugccugaaguuucucagcaggauuuugggcacaagguggguagugagcuggucucagcacugagcuugcagguggagaaggcgggccccugacuuuagggcgcucugggugggaugaggacagacguggaggaaaggagggaucccagcagaggcagcaguggaugggggagggcuucacugcagggagagugaggcugcgcggugcccugcaggacagauaggaacucccaggccuguaaucccagcacuuugggaggccgaggcgggcggaucacgaggucaggagaucgagaccauccuggcuaacacggugaaaccccgucucuacuaaaaauacaaaaaauuagccgggcgagguggcgggcgccuguagucccagcuacucgggaggcugaggcaguagaauggugugaaccccaggggguggagccugcagugagccgagauugcgccacugcacuccagccugggcgacagcgagacuccgucucaaaaaaaaaaaaaaagaaaaaaagaaaaaaaaggaacucccaggguggagcuguggacagauaggaacuuccacagccaggaaggccaggugacguggagggccccaggcagcugggccagcacgggacggggcgucaggucagcggggcucuucugugcugugugcagcaugagagucuguaccccaccuguacucaggacccugccccccgaggacaaggucgcuucccucuugagcacaugggacaccaccuuccugcuacacuauucccaugcccuuuccacaggcccaggccacuguugucauuucgcccuccccacaguccuaggaggugggcacugcuggugccccauuuuacagguguggaugcugagcacagagaggcugagcugcucgucugggucccccgccugggaugccaccaguguccucacaccagccugcuccugcccugugcccauccuccuccugcuuagcgauccuuucucuugcuaaugugugggacaaggggcucucagggggccuggccaagguagcggguccccccaccauacucccagugccaccccuggcugccuggagcuagcugugcaggggcccagaagcccuccccuccgaggaggugggccuguuccaggcuaccuugggcgggcagggccuuggguggccagggccucaggagggacacagagggccccacucaaggucacgggcugcacguuccauggggccuggggaagcagccgagcagaaggaugcagcccgacuaaggcugccucaggguggcaccccagcggugcccacacuaaggggacacuuggcaggggaggggcuguggcagggcagggucauguccccagcaguaaggccaggacagggcagccggaccccgacugugccacccucagcccaguggauggugcaucucaccugggccuggccggcugcacuguggcgccugccccaggccaggcuaccuugggcgggguggggacugguacuccccggggggugggggugagggcgggggugaguguggaugagggccccagcugugcccagcacgucacugggggcccacaagcucucagcacaggcuggcggcugggagcagcuggccacaggcaggcccugggacaaagggcgcuuugagcugccugagugccugcauugcccuccggccagcugacccuccccggagccgaggcuggcucucucuguggcuuaucagggccgggccgguguggaguuggaacagcuggccccaaagcccgccagccgggcucuaugcuguggggaccacugcccccacagggaagcgccuggcucagcacaggcccagcccucuggcuuccucgcuaugggagggggugagacccuaaucccggguccccacagcacccucagccuaaccccuguguccaccccucuucagagucuccaggccccaucuuggccugaugaggccucauugucuccuaaaaaguguggguacagaucucaggcuuuucaaggguggguggauuccuggcuccaguggaagguccccaggccuaagucuaugggggcgccagggaggccggcuguguuucugcauccuugacccuggccccuuccacaaagcucagcucugauccuucguauuuaaucuucaucuuccgccgucuuuaaaauuaauuuuccuuuaaagauacuguagagcaguaacaucagagacaccaaaauagacaaaagagauaauagaagaguaauaucagagacacuaaaguccucgcgauaagggucugcgaggcuuccuuuauguuuugcaaaaaaaucuauauauuucauccagagagacaggaugugagcgcagcuggucagaaccaguuauuucaggcugcccugugaucuuucccacgugauugauugacacagggaccuucucuaggguccuaaauuaugugguuccagcagcauggaacuucaaaacacauugaaccccagaaaaucuucgcuauguuggagauucgccggcugauaaaagcaaaacaauagauaagauggccaggucgaccuucagccuucucggagaacaccgguuccacggccgguugcaacacguuugagccaaagugcgaccuuuccccgcucuguucacucggagacuaaaaaucccagauaagcaccugcuuugcuagacccuugcuggcccuccggcuucgggcaggucuccucuuuaugccacuguaaccccacaacaccggauaccagcauggggucggccugcggggccaugugucuccuccugugugaccuugagcuaccuugagcuuccauuuuccuuccgcaccaugcacugauuuccccuggguugagguugagggucccagggucugucugccuaaugacaagauuucaguaccaauagcgaagccgucaguggcagugacugugccuuagggugucccguuggcauccagggccccccgugaaggauggcaccgagcaccauucaacauaagucuugucagcguuccgaugaaacaagauuaggggaauuuuacagcuugccuguguuuuuccacccagggcccuuugcacugccugcuauuuguuuucugucuucauccugagagggcucaaggucugcaugccauuuugcaauugacaaauggcuugugcuuagcuauuucguugaaugcugaacuaacaauagucagugaagauuaagaacuaaaggcucaaggacagcuacagaugaccacagcuggagugcggcagauacucggggccgcuggguggcccugaaggcccacagaauccuuuuggagaccugacccgcgggagcccaggugagcaaccgccacgggccagggccccucgaggcacucauuucaguaucagagaacacacauaacguaaaauucaccauuucagccauuucagccauuucagccauuucacagcgugcaauuugguggcauuuaguauguucacaaggcgguucagccaacaccugucuccgguuccagagcuuuuucaucaccucaaaaggaaaaccauccccauugcccuucuccuaguuccugacaaacauguucuuuuuaaacauuauggugaaauauaaggccaggcgcggugacucaugccugcaaucccagcacuuuggaaggcugaggcgggcggaucaccugaggucaggaguuugagaccagccuggccaacauggugaaaccuugucucuacuaauaauacaaaaagauuagccgggugugguggugggugccucuaauccagcuacucagggggcugaggcaggagaaucacuugaaccugggaggcagagguugcagugagcugagauggugccacugcacuccugccugggcaacagagcaagacucuaucucaaaauaaaauaaaauggaaauauguuuuaccaucuuaacccuuuuuaagaucacaguuccuugcgaccaucgccaccauccagcuccagagcuuuuuucaucuugcaaaacugaugaaagucuguccccauuaaacacucacucccuacucccccuuccccagccccuggcgcccaucaucuacuuucuaccucugugaaucugaugacuguagcgaccucacgugaguggaagcagauaguauuuguccuuguguaacuggaucauuucacugagaguaaugucuucaagguuccuccauguugcagccugugugagaauccccuuccuuuuuaaggccaaauccuauuccgugguagggagggaccacaucuuccgucuccgucggugcacugagggacacugggcugguuccccuuuuuggcuguugugaauguugcugcuguggacauggguguguauggaucuccuuuaaagagaccggggacagacuccaaaguggaauugcugggucauacaguaauucuguuuuuuuucuggcauguuauuuaaacagacuauuuguuagagcaguuuuagguucacagcaaaaucgagcggcuggucauuucacgcuuuaaaggagcuguggcauucuacaucccccagcagcacacaaggucccaacuucuccggauccuugggagcacuugucacucuguuugggguggcagccacccuaauggaugagagguggcaucucguuguggucuugauuugcauuucccugaugauuagugacacugggcaccucuccgugugccucuuggccaucuguguaucuucuucacagaaaugacuguccaagcccuuugccuauuuuuuaaaaauugaguuguuaggaacuuugguuuuuuaaauaauuuuaaagcacacaaauaagacaccugagagccaacuuauaacacgccccaggauggacauggauucacacucaugguagaacagagcugagggugcagugugggaugggcugacuuguggccaggggaaagacccguggccuaucuuguuuuggggggcagggacccagaaacucauugcuuucaggccuugcuagaaaagcauacagucgaacgaguggguccgauguggagugcaguggcaucagccaaggcuccgaggcguuucuucccacuucacaugucuuuucuguuguuucugcgaaggugucucagggaggggcagaacccaugggguuuggcuuccugacccugaacgucuuugucccaggcccuucacugggucuggaggaaggagggugcugugguccugguggcucuugugccugcacccgccuuggggccaucugacacccacacccucccuccaggccagacccagcucuccagcuucccggcugcccacuagaugaccaccaaggcagggcggcugguggugcugacggcucugugaggcccaggccugucuuccccaccucaccccacagggcugagacaccucccuguccccuggcagggcuggaggcucuggagucucucuugguuacccucucucucccagggccacuuuugcagccugguguccuuaucucaugucuggguccccuuugccaaggguccuccagccuuuggccugcacccacucaucuggcaguaacagggccacuuccagaaccaccaccaugcccaggucaugucugugcaugagaguggucagcccuccauggcaggccuggccucaccugccaguguccucucccacacccgaggacaccuguaccuugucccggggcggggcucucucugccauggacgccagucuucccuccccuaagcugcgggugaccugaccuaguugagccuggcuuuccuccucuguaaaaugugaacagaggccaccacccccauuaugugggucuguguuugcucugugcacgucucggugcccagaucugaggcccuuuuguccaugaagccaucugcagccaggaggcggccuugcuuuagucugaaggagagugaccaggguaggaggggccuccuugucccuuuggucuguuuguggucucaguggagaccaaggacggcucuucuucucguaucuacggggcagagcucagggccgcacuccaucagcaucccgggccauugcauccuugaccccggggggcuugcaggcaccacauagaucuugugagaggcgcuuuguggggcuggaugauccugggugccccucagagaaggcccuggggcuggccuuguuaucagugggggagucaggaaguaccccgguucuguaccuguaguggauggggcucucagagggauugggggugaugggggugcugagcuggccugagaagggugggguaaccuaggggguggagugggggagggagagagcacuccugacacaggguccugaggaggcaggggugccccagggaauggggggcaccuggggcccacgggaggcucugggggagacugggcggugagccccugggaaggaggccucagggacagcccuagacugucacccucaguguggacagcaggagcuauggcagcugcuugagcaaggugggcaagggagaaguaccaaaugugugcagguucuggggaggagcuugaggccccuuuaguucaccuuuggaacuuaggaccaagucugcaaauacagaugaacccaggguuaggaggguggcuggggcaucacccaccuggggucuggacugcuggaaccagggggaggcaggccugccauucugugagccugcuuuagacuggggauguggucccgugaaucaggggugggccauggcauggcgugggggaccagcccuccucccuguccccagcugagugugagcucccuggggucuugcuguggccuuggcccuggguguugucccacacagcccaggagagcguuugaggcugauggugguggagauaguuuuaucucugagcaaacauuccaucuugcuguuuccagccuagagauggugaggggacuuuuccuuggcucuuuccuggccugcuagcagcaccagccuaauuaaccugacaagcggggccuccccagccaugcagccuugcacugccuucccacauccagcuggauuuggggaucaguguuguuuuuaaucauuccuaccaccuugucccacaggcaggaguccugccaucuucgaaggccagccccuaaacagguucccugaguguuaggucaaaauaacuuuaaaaagacacgcagcuauccacagcaauccuuaauaguuacuuaucuauuucaggguauaacauaagacacaccuaucauuucagaccugccuaggacaugccuggagaagguauuuaaguaauuuuaaaagugcaucaaaacaaggucaggcgcgguggcucacgcuuauaaucccagcacuuugggaggccgaagcaggcagaucaccuaaggucaggaguuccagaccagccuggccaacauggcaaaaccccaucucuacuaaaaaaauacaaaaaaauuagccaggcgugguggcaugcgccuguagucccagcuacucaggaggcugaggcaggagaauugcuugaaccugggaggcagagguugcagugagccgagaucacgccacugcacuccagccugggugacagagcgagacucugucucauaaauaaauaaauaaauaaauaaauaaauaaagugcaucaaaacaagaaaaacccugcuaagggccagucugcugggugguggaugggucagcagagcugggcugggagccgcuaugccuccccaucaaggccaccaauagucgggugagccggccucugugccgucaugggcacccugucucagcuccggggacuuggagcucuguguuuccguggccuuuuucacgaugaccaaacaaaggcggguguuaugguguccaggcccggucucccuaacgggcaguuucucagaagcaaagaccgacgagacagagcuccugcuaccagagagcccuaggccggcucauuggaauagucauuuauuuguuccuucauucguucauucagcauguccauguugagcacugacuggagcagguccuguucuggggccugggaaauggggguggauaagaccaagguagccucuucucuaaggagcucagccggaccucagccuagagcccugguccccaggagcugaggacagaggugggacccacaccccccccaugaggccacagagccugcagguguccacaccuuuuguuuuuguuuuuugauuuuuguuuuucguuuuuuguuuuuugagauggagucucacucugucacccaggcuggaguacaauggugugaucucggcucacugcaagcucugccucucgaguucaagcgauucuccugccucagccuccugaguagcugggauuacagggcgugcgccaccaugccaggcuaauuuuuguauuuuuaguggagacaggguuucaccauguugaucaggcuggucuugaacuccugaacucgugaucugccugccucggccucccagagugcugggauuacaggcgugagcccccgcaccuggcccacacccuuucuuuaccuuacaccccugccaucuccaguaugcaccuguccgcacacacccacacaccccugaaggauuugacgucaugagccaaaaacauuuuugcaaaaggaaagcaacuaagcucccagcgugucuccccuuauccauugggcuugucccaaacacaugccggaugguguaaguaucauuccauccuaauuaauaacauuugggagccagcgauggcaguguccagcugacugcucauaguggacucccuggugggggcguggcaugggagcaaggccagccacugucacccagugggagcagaaguccccuccagggcccggcuucugagggaggacaggcaggaguccgccggaagugggccugagacgccguaugccuguggcuuuguggcuuuguguggcuagcgccucucacacgugggggcugguuucaucuuccagccccacacaccuuccccaagggccucccguacaccccggcugccugggcgcugggcuccagccugcagguggccgcugcacuuuaagugucacaaugggcugcacuucacaugaaagcugcauuuuggcaauaaguccccaccaagcccacugagccuggcccugcugcauccacacuauacagcugaggaaacugaggcccagcuuuccacuucugugccuagggggugggauccagcuccgagggucuucuucccacuccuccaggaaccuccgcccucuggugucgguggaguugaggagguguugggguguggaggggccaggugacucccuguaagggcaaagugauccagaggcugccccuaccgcagguacaccaggcucaaaggccagcugugaggcuuuccggggcuggaucuggugggaaagugcuuaucacggagggcacccgggguuccuggcgugggacccccucugacccaggcuaggguuccuggcgugggacgcccucuggcccaagcugggguuccugguguggggcccccucugacccaagcugggguuccuggcgucggacgcccucuggcccaagcuggaguuccugguguggggcccccucugacccaagcugggguuccuggcgucggacgcccucuggcccaagcugggguuccugguguggggcccccucuggccaaggcugggguuccugguguggggccuccucuggccugggugggccuggccugagagcugcagccucaccugggcuccacugccuauggacaugagcugaagcugcucagccuuccagggccucugugcgcaggcaucaccauccgcagcaggccaggacccgggccugcuguucucaggguguccuucagcggaggcuccagcauggcuggguucaaacagguugcagggucugaagccacucaaggccgagccugccugcagugagcgucccacucugucccugcaggagaucgugcuggugguguucuucgggacggaguacgugguccgccucugguccgccggcugccgcagcaaguacgugggccucugggggcggcugcgcuuugcccggaagcccauuuccaucaucggugagucaugccugcccuguggaggucacgcccagguuuccagaccaggaaggacccccaccucaugaccccuaccagauggaguccccuaaggacuggggaaccccaaggccagcagggggugacugcccaggacccagcacaggagcauuggcagcccucagcagccucugcacucagacgcugaucaugguguuggggguaggggguuggucccucacagauucccaugagccucacagcccagcauagcuucauggugggccagucacccucggcagccugagaaccaugguccaggccugaggcccugcccuuucuggccacuugcagggcucagcacagggcccagccuaggccgggggcuccacauggccaggacagagguugggucucuccguuuagaugcugccugccucccuauccgaggugucuccauguccccggucaucagggcgugacccgucugaccagcaagccccuuccccagacgagagcaggguguaugcucuucccuggggcccuggcuguggcgaucacgaaaagcucccccucuccugcacuccacagaccucaucguggucguggccuccauggugguccucugcgugggcuccaaggggcagguguuugccacgucggccaucaggugcgucugugccacaagcuccccccgccaugccgccccaccccgagcaccccuccugagccgcggguggucucacgccccauccaccuugcucagaugcaaggugccuuggugcccacugcccccgggggcacugagccaugugcugggauggguggagcagggugggugcaggcaaguguggagggcacggcucaacccaagaugccucaggcagcccuaggcucuggcccagcacuagcgccucugaacuuccaggacuugggugguaaccugaccaucugggcacacagccugcccaucugcaaacuggggugacccaaggagccccccagaaggcagucuggggacugagggaaucuggagguaccuggccgacccccagcucagcccugugugggcagauucagagcaggcucuggggggcugcgccugagagggagauucccaggccccugucgggauggacauauacccagccuccccacccagaguggacgccugggaggggcaggggcagggacacccaugccaucggccagcccuaggcccggcgugaacagcugagcccagccuggcucccucagccccacaccaucuccuucgcaggggcauccgcuuccugcagauccugaggaugcuacacgucgaccgccagggaggcaccuggaggcuccugggcuccguggucuucauccaccgccagguggguggcccggguuaggggugcggggcccagguuggggacaggacggagggagcagagcagcccacacuaggacagcuugagaugcgcugaggccccgggggccggugggugccugggcgcagggguaccugaacggggcccaggaucucagagcaagcccaagcuugagcccagccuggaugcuccaccccagccuggugccagugacccuggccugccaggcugauggugugcucaccuuccucugagcugggggcaaaugaagacagaaagucagaaaugaaaaacccaggcaaaucaaggacccggucaaggcagggccaccagacucccucccgagggcugcacucagauggguucaggcugcacuggccccuggcucuguggggugaggggacccuuccucucccugaggaucuccuggguccugguccauucuugguucugucacguggcaggaaagagagcugggcaaucaguggagcccgcgccggcccagacagugggccuagggcgaccccagggcugagccucauucuggggguaacccccacccgccacuuaccggaguugugaggagugggcuauauugaagccggcccugugcaugugaaccgcgcuggagcggcguaggacgcccagugaucgcugggacucgcugccuuaggcgucugcacaggaggcucccagccugcgguuccuggagcccgacacuguguguuuucuggccuaggagcugauaaccacccuguacaucggcuuccugggccucaucuucuccucguacuuuguguaccuggcugagaaggacgcggugaacgagucaggccgcguggaguucggcagcuacgcagaugcgcugugguggggggugguaagucggaaacuuccaggcauggggacaggggcagcucaggcugaggagugggcaggacaucugggcacuggugucuugagacuucgggccuuggcaggggcuucucaccugcacgcucacaggccucuguccacaaaccugugcuuggagccgcuggcacagguccccacgcucaguguugaguccuuuggcaucaccaucuugaaguucugaauggucucauccuugaacuugagauuugagagggaaaucggaggggucacuggagcguguguugggggcuuagcgguuucggcucccccauggcucugccucccgccaucguccuagguugcccauucccugccuccaccguggcccucacccuggcagggcccaaggagagcggcgucagaugcauaccucgcgugucucugaggguccacacaggcccuguaagugccccuguccccaaggagccagacaugagacagcaaacaggaaagaccaugauggcucaagagaccccagcagagaucagagagcccccguguuuccaguggaugcugggccugcaaguucuggagccgggccugggcaguggcgacauaggugcagcugggccuagggaagcagggacccggccugugggcccagaggcugccccuggcugugaagguggguuccggccaccuagagcagcccgggagccuuggggaagccggugugcagcaggcagaucccgcacuggaacaccgagccacccaaagcucagagaggcugugcgggagggguggggcagggugucuugggccgugucugugggggcuuccuugagggacucaggcuugcacgugggagagggagauguuccgaugaggaugcagcugcaggaaucagggugcgcccuccgagcugcaggcuccccaagucccaagucacuggccugugggcccagcagcaguuucucauggcucagaggacgcuggcugaggcauuuuuagggggcaggccuagcuugccagugucccucugggagcugguggcugccuucaaauccuccagugaaagucggcguuuauauaugcauggagcucaagggcugcuucuagggggaacacguggguaccccgaggggaguagcuggcuggaggccagagugcagggagggaaugacuccaucccaucuccccccacagcugcagggccaggugggccguccacaggccacuaaggcccaggguggcaccaucacaccuuggggaguggcccuggguggggaccgagaagcccaagugccgaggugacagggugaccccuacucugccgccacaagccugcccccgcgucugcccuugucuaccgaccuccgggcucacucaguccgauaacagguuagauggaaucgugguagcaacaggggcugggggcuggggaggaggccgucgaagcccacacagggugggagccaaggccugggggccgcacgggggcuggaggugggggcgggcagggcagccgugggaaacacgugguggugccaggacccaguccgucugccccgaguccuccuuccagaaaggaccggacuugcuggcucucgggaccccccaccaccaucagagcauaucuggguggggugagaagccucccgguggcuccccaggcaggcacgugucccugcgauugcugugccuccucccucccccucaaccgccgcuucccccaugaggccagacacucagcaguggcuccugacguaggccaagucagcagguuuucuggaagcuuccaaagugcugcaaugcucagggauggcaggggcaugcugacacagcuccuggguuggggcaggccccacuuucggccucuucccgccuuccugggggccuguguccccgaaggccccaguguggcaggccugagcagguuugggcagcagggcccagccccccugcgggagccugccugcagugaguguggauggguagggcgugcucgggggauggacggcccagagccaggagaguucccgggaggcugguggcaaggugggcagugaggagcuggcggugcagcaaaagccaguggguacuggccccggcacggcugauaagcagugcccagccuucgcugcugcccugccugccuucccagccgcccacuggagcugugggcagcggacgcuacuccccagccccccagcccgcagcagagcggcacucccacucccacaccugugcaaacauccgcccgcuggccgggaacacggccccuuugugcccggcuuggcaucagugccccggcccacaccgucagcugcagcccgagccucggccaucgcgcgcccuggccuggccauuguucccgccaggccccgcgccccuggucgcccugggccccccaccgcccagggcuguggggcaaacagcucccauucagcugcccugcagcugucuggggggagcggccccugaggccugaguuaugggcuguguuccuggcauuucucggacaaacagaacuugagaaacgcaagaaggggcagcagcccagaugggggcuuuuaagccaguuuugccaauuugcaacugcgcccugagcaguuguuuucuuucagcuccuuuguccugcuuccuucaccccaccggggagugaaguacgcccucgccggccaggcagccagggcugcuccaugucuguccguccgucggggcugccacaggcccuuacugggugggagguggcuuccuggaggccaggccauucugaucaucaugcugcaucugccccagaccuugccuggacucuguggacuccucaccccucagacacacccugagagggugcuggagcugccacaacaaaguccgcgaacugcugggcccagagcaacagaaacucaugggcucuagaggccagagcccgaagcgaggugugcacagggccugccccuccgaaagcucagggagaaauuuccucuccucuccccguggcuggagacuccaggcgugcccggugugcggccgccucuuuccucugugucaggcccugucucucaugaggacacuugcuguuggcuuuaggguccacccaggugauccaggaggagcucaucuugauugaaucuucaaagagccuauuuccaaauaucgcauucuguggguccaggugaauaugaauuaggggggaugcaguccagccuaggacaguggguggcccagguggacuuccugggaaggucccuccccuugccggccaccaguuuccacagcuguccagcgaaggcgccggcucagugguugaguguccccuccuguccccuucgccgggguggggauacgcaacuuggaugugagaacucucgaauccccugaguguggcgccugcccuggcugccaaggcguuuggggagaauuuaagacuuuucuuugcccuuggaacaaaaugcguuuguuuguguuaaaguuugaguggagggagaagcaguuuuugcaaacacgggcuucucuguucagcgcccgggggucucuacaaacaggaggcugccgggcuguguuugccccucugcaccuaaauuuagaauugaaaguaaagaagcuggaaccccauuccuacauuucagccgccuuuugaagucgagucugacugccugcuguucacucucuccucaccuggagccuccagaaauucccgccucccuggcaacgcugcacccuggcggggcaaggccagaaggggcugggggcuggugcaggggugugcgugagggcagggccucccagacagucacaggccagcccuguuggcacugcccagcgggagggguggugucaggaagagcuggggaagccaaggcgccgugggccgaggggcggcaggaccuggccacccaccgagccccugggucagcguucuuccuccuccuggaguuccgugcaaaggggaacgaguucagcugcccuacugagugggccuggggacagaggcagaguacgcaccugcugugugccucaguuucuccaucugcacaugggagacagcaguccgucucccagggccaaugcagggcccgcugcaagggcugcugaggacuguaaucccagaggcugcaaccgaucccucugcugcggagacuuucccuggaccgaaagggccuccuggugaggcugggucuccguuuguggacucacuguugaggcgugugguuugcgguccugcugugugccaggcaccggcagggguucgggcagcccugucuugcucucucugucacagucaggagcgagaagcauggugugagcuggggcuggccuguggugguucgcagguggccaugggaagcaccgccggagugucccugcaggacuguuucggcccaggagcagggaggccuccuugaggaagugacagcugagcugagaccucaagacacagucaccugggccaccuuccggcagggcgcugagccuggcuguaccucggggaagacgcggccuggggccugggugccauggggguguugacgguuucaccaccagcccguguguggggcuccgggcuucgugagugaggagaggacuccaugugacggggaggccuggcccucgugaauugguguucguuuauuuacuuucuccugcugaaaggaagcagguuuauuuuggggugugugucugcuuuugcuuuuacccugagaguuugccagccugcuggcuuguucccccacccccaccugguggcgucagccccuuuauggcuguuccugagagacaggccggagucuccagggcggccccacgggggcugggcguccccuuggaaugugagugccuggccuguuagagccccaggaccgcuggccccacccuucucugucccagagacaguccugccccccacccaggggccucccucuguccacggcucccccuuucccaggccaccccccuaggccccuuuccuccaccuucauuggcccugcccucuguagugucacccaggucaguggggcccuguccugcccuguccugaggagugcaugucucugagcccugcauggggggagcccaccagcuagcagaggcccagaaggcucuagacaggcucuagacugggucucuaagucugcaaggggcaccaaagcacuuuacaaauuccaggagugagugacaggcuggccacgugccaagcccucacccagcaggcagcccgugagaaguguguugugaucaugcaccuucccgagagggggaaacugagguacagaacaugcuggggcuuugccugaggccagacggacagggugagaacugccccccacacucagagccacggugccagcccagccuugccagcagggcagccacaggacuuccaggcaaggugacggugccagguggggcccgaggcccucacucauagggcauugucccacauccccuggaaccacugagacaggcaucgugccacgagaggggacaccugccuggaccucugugugcucagccuacugggggcacugaggccgagggcccagcucugcgagauccugcaugggcuuccuuccaagcccuggagaggggagcaggccugggagggcgcccuuggcccagagccuccaugaagagccaggggccuccucauggcuggggccccagcacagugaccugggaauggcuguggccgcaugggaugucccggagccccugccgcccuccuuggagcuguggggcugagcuugggugcugcgcucuccugacuccauccuuaggugccuccucacgggcaggcugggcucucgaggcugggcaaggucggggccugcaauggcugaagcagccucuuagcccaucucugccuucgggguggccacagcggggaacguggguccugcaggccuugguccagcugucugccuggccacuuucuaauggggagcccucagcacagugacugcccagccucaguuuccuccuucguagaugaucuugaccugagagugccagcuggggugugacaccucugggcuacccccuccucccgcucuugaccaccccuuccucuggacagacgaccaccacaucuccagccaggaccaccccuuccuucugggcaaaugacuaccacguuuccagccggggccagugagcucugggagccagggcuuggcaugcggcuggagcucagguuucugggcuggccucuguccuccccucgaggccagccuugaggaggcuacuucugaaaggagggaauagaaucccaguguuucucagggaggaacauggggggacuagaaggcuccccaugccucccgccccuucacaugggagugaaggcacaggccagcaggagggcgggggaaacacacugaccaguggggugugcguuccccgcucgcccccacaguuccugccaugggcgugacuuugugugccucauauggcuggugcccuggcaaggagccacggcccaggagacagacauguggaucugcauuccagguggugggccaucagggacuaauccccagcauggugaccauaaaacagcccauuccugagcugccugugucugaaugcaggaaaaacaaacaggucugcagggaggggccguuuccuuguuaacuugaggaugagggucuggggccgggucugggcagacaggcagaccaggcgaaggugggguccuggagcugcguccugcuguaugugugcucuccacggugggcagacacccaggggcacuucuggggcuggccuuucucucccucucggggcaccccugccuucuacugaccacccagccagccagcaggagcccacgugcacccagcucagccccaggaggugacacccccacccucagcagcucucgucuguuugggggcagguuuggaagguggucucggguguccuuacgcgagcagguggcuaccucaccugcucaccugaccccaacuccacucugacuuccaggccagccccacuccauuccaccuucaucaugcaguuucuguauuagauuuuuaaauaaucaaaauaugguauuuucauuuaaaaaguaaugcuuuuaaaauauauuaaaauaauuuaauguuguuauuagaacaauguuuaauaugccagcccgugccauuugucuugaugccuggguuugcuggcgccccuuacgcuuggcacgcaaggcaggagcuccccacuggccucccccaacugcuugccgcccagccccccucaggccaauuccugccucucagccuaucuuggguuuguccucggcugccucgggaggcagccgugcccaggccucuuggucucagggccccuuggugccccugacggagaagccuggcucgugggcauugugccaucacuauuuaauacaguggaggcauguaaaaacaauuccauauuaauuuauuaaaauaauagacccauuacauuuucauaaugucaugaaaaauuucuauauuuuccaaaacaaauauuaucgaaagaaaaauaugcauuuuugcaaaucuccagaaagccuggcuccccagaggacggggauccccacgccugucccggaacugucugugaagagcaacgucccacugcuuacgcuugggugggagcaggagugccuguuagugccccccagccacagagagugcugccgucccugagcccagccccagcagaucaucagcacacauuugccuggggaacacagacagcccuguccuggacgcagcccuucaacccugcuucucauaccugacccccaccuugggcgcuggucugccacaccccaccaccccugcuuucuucagccugaccuuguccucccggacccagugcuaggaggauguccaggcggggugggacuugggccugcgcugggcugcuccucaagucucgggcugcacgugccagccaggcagacggugcugagaggggcccuucugcagagcggaggcagagcccggaguggaggggugagcacugccucagggcauuggcaggggcugcgccagcccaggcacaggucugagggaugaauaggagguugcuggaugaacaaguaggaaucagcauguucauacugaaggggugaguguccccccaaaaaaucuggauuagacagacucuggagcccucuugcuccagguugcaggggcccuccgagcucaaggccaggauaggccagggucccugcccugcccaggcccuucuaggcccguuucugggccaccugugugugcuuucuuggacuugcuguagacuugguaaacaguggaugugcugggacccugggcugagccccuuugggcugagagcucaccagguggaagucacuccccagggcaggacuggcacagggucuccgaugccccgcccacuuugcagcccugugucugccucugcaacuccccaccccagugcaccugggcccucuggggaagguagcggcagcccagccugugcaugugggugcaggcccucuggggaggacacccugcagacgaggggcuccgguucccccagggccccccucucugccagccacugucagccucacccauggccuggcuucacccugcagggaccuggcugcgcuccgugugccugcgcugugcguucaaggugucugcaccugaaugugcccugagagugucaggcucggacauggggaccagcucccuuuucacaugaccuugucaucugugugacgcacgugcgugugccgggucguguguuuccgugugugugugcacaagcacagacacgugcacguguggagcaucccaucucugcauggggcacgcuugugagugugcacccacauacacagagccgggugguccacugaaagggccuggcaguaaacagcuuccugugcacauuguguguguggcaggggcaugggggcaugugugugucucuuaaggacaguggcgcugcagggagagcuccgugugcagcugugggagguagccugcaagcagccucugcagaagcauccuggccauaagcgaacgugcggucagggcacuaguggggcaggggccuggguggcggccagggcucagcagaggccugucccgcccuguggccuggcggcgguggcuggcguucaucacuguucguuaacgugcucaucgguacagccugguuucccgcaauguggccgcuucugcuaccugagccuccgagccuccugcuguggcaguucugggcagucgcgugagccgugugcaccugccucucuguccgcgugugcgccugugcaccccugcccggggguggccauggggcuucuccccacccucccuccuccucaguggcugguggaaaccacaggguggcccagggacccuggucucgugggggcucaggugggccgggguuuguucuugccuuccaucagaguguguuaaacaggccucaggccuuccugccaucagcacugggcccauagggcugggaauccagugggggucuccaugugguucccagcuggggcauuccugggccugcaagcgguggccgucacuugaccuugaccagaagccccaagccgguaaaugcugugcuguccugaguguggugcccagagcagggcugcaaagaccucccgcagccacagccauggucugggccaccaugccugcuguccagaugagcccaggcaggagccuguguguccacagggugagcugugccugagggccacucugggucuccuuguugggcucagcgccagcuccugaagaacccagcaggcagccugcacggaccaggcccagccaggguaggcuccuacguccugcagaaugacauuuccaggcucagacuggaauccccaggaagcaaaccucagaugccagcgcgggggaaaggguggggggagccuucuauugucccaccacacguccuggacggauggcucucccaccaagaagaaggcuugagcugcaucuuguacucucagaaaagaggaaaauaaaacaucuggugcccuggaguggcgucaggaagcagcgcgucaucccagccccugcucuuuguugacgaccagccucagugggagcucccggucuccugggggccggcgcacagcaacgucgguggcccaggggcccagccuccuggggacaggcaggcagaugaggcagccgguguggggcgagcucccaggcccacguucccagccagcaggccuggcccuucgugggugcugggcuccuuacaugugcuggugggacauaccuugugugugacgccgagagccugggagacaugugccaucccgcggcucuguuccuggugcuuucgccgagucacacggggucguccugguggucagggucucuugccggccucuccgcucaucagagugguggguuuggguuaggcaguuggcccucccgaggcuccagucccauccguggcugaccacugucccucucccugcaggucacagucaccaccaucggcuauggggacaaggugccccagacgugggucgggaagaccaucgccuccugcuucucugucuuugccaucuccuucuuugcgcucccagcgguaggugccccgugggugcguuuucccuggcuccuuggacagcugggguccugggguggcugcacgccccucccugugagcagacccacuuacguucagaaccaagagggugcuucccuucuagaaggugcuauacuccagagccccaccugcccucccuggggcccuggaugcagacuucccguuugcaguccccacugggguccuugcaggcagugugggaggcagccuggaguggcugugcaugggcgcaguguggggcaggccugcucacucagcccugggugggugggcaaugcugcuaccacgccccauggaggcagaaucuugugccuggagagggcacuuccacgcuguggcuggggggguuuuguuccauguccuuuccagaaaccacagauuguaaggugaugugucuaguucacaaugccuguauguggguguguguguguguguuaugugcguaugugcauaauauguguuuguguuguguguguauaauuuuauguuaccuguauacuauggguauguguauauguaucacauggguguguauguacuguaugugugcgugcauacuguguauacauauuguaugugcauauguuguauuuaguaugugugcuguguugugugcacauguaugcauuauacauguauaucaguauguuugcauauguguauuuauguaucugugucacagguauguauccuauacaucuaugugcguauaugugugugcacaugacauguagacauguguuaguaugugcuuguguuaguguuuguguguuaguguggguuaguguauguuuuaguguauguuaguguguuuguguguuaguguguggguuuguguuuguguuucuguguuaguguguguguuagugugcguuaguuuguguuuguguguguauguuaguguauguuaguguuaguguguguuaguauguggguuaguguguguguuuguguguuaguguguguguuaguauguguuuguguuaguguguauuuguguguguuaguguuuguguguguuuguggguuaguguguguuaguguggguuacuguguguuaguguuuguguguuaguguguuuuuguguguguuaguguguggguuaguguuugugugugugucaguguguguguguuagugugcauaucuauugugugugugugugcaucacacaugcacgugcaccacgugaucuccucuguagacacggaguucccuagcuucaggguggguccuuugcaucccaucaaccguccuugggcgaggcagcagcaggguccuccucagcugaggacugccuucucacuugcgaccccaaucccagugcccaguaugaccccuuccugggcacauacagauggaccagcccaccuggcccccagaauggucccugggaauggguuagagcggcugcagcccugccccaugggacugggccccuugcuggauaagaccugggguauaaguucugccccccaugcuggcccaggacaggcaggcugggcccgaggugggacuugggggggcuuccagcacugaccauaccuggccuucccacaacggugaccgguaaccacguccugaggcugcacccagcuggcaguggccuguguggacgggagccuccuguccauuccuucccaggggauucuuggcucgggguuugcccugaaggugcagcagaagcagaggcagaagcacuucaaccggcagaucccggcggcagccucacucauucaggugcggugccugcaaggcccuggucacugucauuuuggucacuguuauuguugcauccagcccucacggccaccugucagaaccaucauuggccccugcaucagcuuggcuggccuguggggcauacucugcuuguggaagccuuggcugcuguggugauggggugagcacggggcauuggagccugucuuccuccaaagcugcucccaucaagggccaugcccugugggcuggagaggaggcacggccguggccaugccaggaguggacgugguuggcucugaggcucccuugugcucccauucucccucccacugcacaacaaccugagggcugagucugggagugggguggccaggugauuguccccaagggagguaggacccagcugugcaguuggugccuucuggagggccuggcaucccucagggcucgggaggcccuggugccuggaggugaggacuggcgauggauggcaugggccucccucugggcucacaaggccagugggcugggaaaggcagagcccuggagcaacaggggcaggaagguucuggaggcagguggggaggcaggcaguaccaagcucugggaugcugggcucuggcucugucacuccaggcucuccaggacccaccagagaaugggacugcucuguuaacguaagcaaggacuuggcacaggagucacuugagaauugcgucccugugggucucucuuguuggccacugcagggccagggcugcccugaggaacagccgcugaggugcccagagggugggcguugccggguugaaugacaagugcccacuggggauagggccuccgcccagugcaguggcugggagcacagugucaguuccucugggcacacugggccugaugucccccaggaaggcccaggaccugggcagcccccgcuggcuggcguccccccugcaguccucgugagcucgcugccccaggcaaggcccaggcugucaggggccagucgcaguccuccugcacuccuggcucagccaucgggggggcugugugcucccacccuuagccugguuuuauggcuucacaguuucuccuuccugggagaccauaaaucaggcccguaaacccgccuuggucccagcaugagcaugcuggccgcccacgccuggcaggggaccacauuggauuccuggucccacucccugggaaccacagguccuuugaaagggguucccucggaagcugcacacacugugggaggacuggaguaggggccccagguggcaggugugcacaggagcagggcaggggucaugggguuugccaggguugggggaccacguggagugcucagccuguguguguaacacucgggccuuggaaggcugggcuugugcccucgccugccugucccugggugcuggaugggagugagggcugcaggugccccucgccagcugcugugucuaccuggggcugucacccaggagcccaucagugugggggaacauucuccacucggcccucucucaggcucauguggccagugaugacaaggccaccaggacauguccucauacaaggcccugggagccccuccugcccaucuggacgcugcacaacugcucccccgccggguccccugccgauaguguccccuccucccacccuucccuuguggugcugccauggggucucucugaaaugcuggcuucagagcugcacccaugugccaucagaggcucccccaacugcaaggugguauaggccucugggagagaccucaccuccugccagcccuagggauccugccucucccugcccccugcucagcaccugcagguccugggcgaccccucuuucucagcccuuccucacuguguggccacugguugcccauuuccgcauuggucuccuaugcacgcuguguacccuggcaccuggggaugaugugcgaccugcccaccuuugcaagucucuccuuuggcucaaggcuggcucagggcugguaaagaccucuguggugucccagcuguggguaacaauuagcccaugaggcagugagcugccuggugcagcaagggaccaagccaggcugccugggcagagggucugggagcugggaccaugucaagccugugacucugaggucccagacccugccacccagaggggaggggccaggccuggggaacagggagggggagcuguagcuuccauaagggcccccgccggguggcucagcaggugacagccugucccccugcccgaccucagaccgcauggaggugcuaugcugccgagaaccccgacuccuccaccuggaagaucuacauccggaaggccccccggagccacacucugcugucacccagccccaaacccaagaagucugugguggugaguagcccaccugccaccagggcagggccuucuugcuagcagguggggaggccgugggggccgcagcacgaggcugggaucucaccaugcauuuggcuugguacagccugugucagggagucagcaucguucgggacacugggccauacacccgaugcuagguuccugccaucccaaugucccccgacuuggggguauguaggaccggucauuccagggccagggcaugagagcuccagagauagagcucugggagcaggacgggcuggaaagaaggcucuucagagggccucaggguugggcuuuccacaccgggcgcaguggguggugagcagugggcagggggccgcgcgcaguggguggugggaggggagcagcaggggagggaggugaggcaggggugcagcgaagggggucuggaggucacagggcaguggaguuuggcaggcgcugggcagaagucuugugacauggcuggggucauaagggguuggggcugacgcuggcaugguuccccuuccuggcccgugcccacccccuguggagagaccuggccuucccaguuuccagcugccgguggagccuccgugccuacuguucccugugcuggaauguucccccagauuuccacacagccugcucccucacuucaggcgcccucuucaugcccugcuggcccccagccuguucccccgauaugcauucuccccuacuggucacagccccuguuaccaccuccacuggcaccaucuuguacguuuaucugcuuccugcuguccuguuagcgaggccgugagcucacagggcagcaccugggccaagccccccacgugacccccagcagcccugcccugucucugugugaagacacuggagcuggccccaggccucaggucccuguccggguguauguggcgggggcugggcucggggcggcugcacaggcacucuggggccggcguagggccuggcagacgauguccaggaaccgcuaaucuguugucuuguuuuuuuuagguaaagaaaaaaaaguucaagcuggacaaagacaauggggugacuccuggagagaagaugcucacagucccccauaucacgugcgaccccccagaagagcggcggcuggaccacuucucugucgacggcuaugacaguucuggugagaaccccucaggcaguugggggccgcggggccgggaaggucacugccuuuuuugggagcccgagcaagccagugaguuucucccuugggcuguggucucugacaacgagguaugaacagacagaggguggagcuucuagaaacuucuguaaaccuuccaggugccuuccccucagagucuucccaaggaggagcuggccacgccuucuguugcgagaggaagccugggcaggugauggggugggucggcuccauccggcuguacugagggaaggguguguuccugauuccagcugccuggcuuccucccagccgagcccacgggcucugguuggaaaguggcuagggugaccucugggccuacuggcagggacgccagagggaagggguuuggggauggggcccuggaggagcagcaccaggcccggguaaaacguggggggccugacgggacaggcccuucucaugcagcccaggggccccgagucugugcgugaugguguggcucggaucugcgucccuccucucaccccugcagcgggggcugggaugaagcuaccuucugcgggaccugacgauuggauggcagaccugucuaggguuuagauguccuccaucccuggugagggguuuuacccacgcuaacucguaagcguggcucuuugacagauguggagagcgaggcccuagaggcugggcucgugugcuccagccacacggcgggaauacagcagugcccgguuguggcucccacgagugaggcccuggaggcugggcccaugugcuucagccacacggcaggaacacagcagugucugguuguggcccccccaugccucccgccaacuucugcuguucccagaagugcagcuggcugagcacagacacagcaggugaccuguggugaugccagggcaucagcgcuuggccuccccacacugcuccagggcagaccuggccuccuggcugcaucaggaggcacacgugaugcauccgucaucucgggaccaguuuugagacaaacauccuauagggcaggaccgugaacuggguagcucuacagagugugaggggcuggagaccuccugcccacuggccacggaugccacggaugcccuugagaguuaggagagguggaagggaccccacuucucccugggagcuccaacuucucuugcaugugacuucagugcccacuucuggggacugugaucccaaacugccaaauucucuagcagcucucuuaaaaccaaaugugaaggauucuggcuuuuucuguccucugagcccagcgugggguauuugagauagcugugcugccaccaggacaggggcgugcaccuugucuucccaggagaaaacacagcaaagccuguuugcucccuaguaccucgugcaaaggugccaucuguggcccugcucgcugcuuccucugaggcagacauaguagugacuguguucugauacaaagauggcacuugcccgaugcugcacugcagcaccaaugcagaggcccuggcaaauguucgcagaagcccccgucccagggcguggucccccuuggaggaaaagggcaccuguuuugaaaacacuugguuaucauggugccagaaagcacuaguuuaggccccacaugaaacaguggccuugcccucccagcaugggagagcccucaucuuccaggugguggggggagcacagcauuugaagcccacuccccuuugaccacuugcuguuguccagacagacaucacgcacgugggccuugcauugguuccugcuuacuuugucucugcugacccgguuucugcuccuugaagucucagcccccuucuuccaugauuccaaggcaugucccucuaaggaggcuugaccccacccuggagggccugcuccccacucucugccuuccaugccccaugggagggcuccauguggcccagucccuuggaggcuggaccccacuguuccggacucugggcuguuggaagccaggcccugccucaguugugccaaguggccaggguucuaugccuggcagaggaggugugggaggccaagcgcugaugcccuggcaucaccacaggucaccugcuguguaugugcucagccauccaaguaauaugauccauucccuucucagcagccgucccuuuacccuuuggucauuucugcauccaucucucccucucggaccucuucccagugccugggacuaacccgaaugucucagcuuaccagcaguuguaaggaugcugucacaucuuaugcauggcagagaggggacaaacccacaguguucgcaacccuuugugcucgcaggcaccagcccagcccgccaagcuccaguucauucaggauggcucaccugcauccccaccuccuuggcaggaggcugggugguguucccugccccuuggggcuuuccugggcaucccauguggaagucagcaggcaagaccaaguccaggcucccgcuccacugggcaccaggcuccccaggacuuagaugccaucaggauugggcugggacccgaccacaucucagugagcccccgggacgugcucccgccugcccgcuggagccggcacaaagggcgauugugccaaccaaugcccagugcccccacagcuccggauucagggcugagaccauugucuccaugcaaaugggggcuuucugcgcaugcuaacgggcaggugggcguggccgggggcuggggacccagccugugugcggccuggagaagcaucgcuugcugcuugcugaaugcggggcagcccgaaucgaugccguccauucagccugguuaguguuaugaagucauuagugcugucugcggaauguuaaugaggggcaagugcggagaaagucaggcgccuuuuguggaaugcuccuccacggagaagauuucucuuuccugcuggaguuuguucuuuccuaacuugauaagucagcccaggcuggaaccaccagcuuucuggagccugagcuguuggccuggcccccagggacagagcgaccccugauaauccggaguccccuuugcccaggaggcucuuggagagcccuggcuuggggagaaggagaugcugaucccagggcagaugccacuccuggggaagccccacagccccacucccgcaaggcggguacgaacagccacacugagucccccgcaaagucaaacccaggccucgaccuugucuggcugugcuuucuguugugugaaccugcagguuaggcagaaguccccuugacccugccucagggcugcuaccugucugcgccauccaccugcacacaagccccuucagcucgugcucuagcuggugcugugcgguguuggccccauuuauagauggagaaacggaaggccagggccauguggggaacuccugaggacaccuguguguccugacaccucacugagccugucgagaggcacaggcagguauggcaguggcagaccucaggggagggaggcugggaagguagaaggucccccaugguagcaucagaacacagacuaaccugcagcaaaaaugggcuguguggucccuguagagcagccucacugaggggaggcaccagcccucaucccacgcagcagggcccgcugcugcucccucaaccuucugaccuggguggggagggaggggaaugucagcagccacccagcccgagagccagagcacagcaggggcuggccagccuagcccuagagucuuugcagugaagcgucacagacuccucaugaaggaugcauggggacccaaccgcaugccacuuggcuuggcagugucaaagggacuggggaccugcgaggaugcgguggccauugucugugcccagccuggggagccugacacucacagcccggcugcugcugccuugggcguccugaagauccucuguaugcuuguggggugggggcagacacacaggcagccuccugcccagaggguccaagcgggcauggccauccacaucugcaggucagaagaggccugggcuggagccgcauacuggccaugcugccucgcugucccugccucagagccacuguauucacucugccuggaacugucuuuccuggaucccaggaguccugaaggagccgccuccauccugagcugccuacccugccccuccuccacuccaguugucuccacagccaggucaccauugaccagguuguccaguccccuccucauaggggaguggcccuuugucuuucaccacugacccuucccaagcugguaccaugccuaacccaugguggguacacgauaaaaaugcagggcugugccaccaggguuuugucuugacaaagggacuggaggcagguugucagaguagggcuggccggagguggccuccugaaugccccuaggaggccagaggagacuuccccaaauucacugguccuggaggccgccucagaggccuuuugcugcucagagaacacugggcuggaaggucguggucugugacguaggaucggggaggccaccucagaggccuuuugcugcucagagaacacugggcuguaaggucguggucugugacguaggaucgggcagcacgcaccuuuccaccuggccuggaggugauucugaagggcuucuggggaggcgucuucaaagcugugccugugugugucaccacguguuugccaggugaccugggacuauugugugguuucccguuugugaaguggggcagcgugcuggaggagcaugcaucacauacccagagguccccaguguggucuggggacucaucguucacacucgugugugugcuuucuggaggcaugcgucauggaacagccucaccucucacuucugcacuugugagccugguucucacagggucaggcuguagccuccuccugcucccggcuccgcguccucagcccaacacaccaagccuggccuuucaugcacuccuccauucaaagccguguguucugauugugcacuuuugguggcugccacaggauuaaauccugaaugcuuugccaguugagaucaaaagucaccccaacuccucugaaaccucacugggaccucaaggugcuccagauccuacugccuccugccguuuccugggccuuuguugcccaguauuuugguuuugucuuuuaaacaauccucuuuuuguugaugcugcauacauugagauauuuacucacagacuugcaguuuucugucucaccauuuggauuuaauuuccuuuuuccugaagucuguguuucuuucagugaagguaaacucucaguuucaguuugucugaaauauuuuuacuuugccuuuauucuuggaugaugguuucguugggagaaaguaacagguuaauauguacauuuugucugaagacucuggagcuguaacacugcagucuccuggcuucugugggucaucaggcuaauugauuuuccuuuguaagugacccucccuaccucuagugacuucagaaaccuuccuuuugacuuuaguguucagagguuucaauguacuguaccaagguggugcauuauuuuuauuuaucaugccuacacuuuguugugauuccugaaucugaggguuuaugucuuucaucaaccguggaaagucaguaccauuauguuguagaauauugccuccccuaaugcuucugaucuuuuccagaaacuucuauuugaccaucucauugucuuccucagcugucucauagauuuucuaucucugucucccucugcuucauucacagaauuuucuaugcaguuucuaacucuugagauguuucuguuccacugcuuuaucuacccacugagacuuucaguuauauauuuuuuccuucccuauaaauccuuguauggggguuuaauuugcuugauuuuagcaucuuguaccuuucucauauuuuaaacuacaacuuuuaaucuuuaggucauuugaacaugcauauuuuguacccucuauccugucauuucaucaucugcaguucuuggagagucuaauucuguucacuguaguuuuuucugacucuugcucaugauggcucauuucauuguggguuugcaauuuagaucaugaguuugugugguggauguuuuuguuugugggguuccuauguauccuguauaagguacaugccucuggagaagcugcacuuuugcuuguacagggugacccagugaaccaauccaggaccuucaugauccauguuuuagauaugggaucuucuagacaaccuaugcaguguaaacagaaaccccaaucuccugugagagcaagucuaaguaacauauauugagaagagaguuuuauuuuauaaaauaaaacugucuuuauuugcagaagacaugguuaucuauguagaaaaucugaugaacaugcaagaugaccacuaugacuaauauaugaguuuaguaagguggcagauacaagauuaauaugcaaaaaucaauuccauucauauauucuugcagcaaauaaccagaaauugagauuuuuaaaauacaggcgugucucauucuuauugacugcacuuugcugauaaugcauuuuuuacaaauugaagguuuguggcaaccuugcucaaguugaagccaguacucacguaccauuucaacaauccuagggcccuuaagaauuaugcuaaaucuacucugcuuaugcucuauaaugaagcaacaaagcccgaugacaguacaucuguugacaacaugguuuacugaauauguugagcccauuuucgagaccuauugcucagacaaaaagaucccucucaaaauguuacugcucauugacagugcaccuggucauccaagaccucugauggagauguacaagauuaguguuguucuuauggcugcuaacacaacauccauucugcagcccauaaucaaggaguaaugccaacuuugaagucuuauuauuuaagaaauacauuuuauaaggcuauagcggccauagauagcgauugcuuugaugaaucugggcaaaguaaauugaaaacauuuuagaaaauaaucaccauucuagaugaaauuaagaacauuagugauucauggaagaacgucaaaauaucagcauuaacaggaauugggaaaaaguugauuccaacccucauggaugacugagggguugaagauuucaguggaggaaguaacuacugauguugugaaaacugcaagagaacuagaauuagaaguggagccugaagauguggcugaaauaucauuaguuauuagagaaaugcaaauaaaaaacacaaugaaauaccacggcccaauuauuauauuauauaaaaugagggagauggaugauaccaaguguugguaaagaugugucggagguggaacucucauaugcucccggugagaaugcaaaguccaaagcgaugcaaccauuugggaaacaguucagcaguuucuugauguguuaaauacauaccuaccauauucuacagcgauucuauuccuagguauuuauccaggagaaauaagaucauaugcaugccaccauuuguacauggaauauucauagcagcuuuauaaaaacuggaaaccccaaacuggaagcaacccaaauacccaucaacauuugaauagauuuuuuucaaaguuguaguauauuccuaaaauggaauacuacuuagaaauacaaaggaaugaaccacugauaugccuacaauauggauacauugcaacauaauuauggugagugaaagaagccagacaaaaaaaaaaagaguacaugguaucuuauuuauguaaaaaucuagaaaaugaccacuaauauagagugacaaacaagucagugguuaucagugguuaccuggggaucagggguaguaguaggagggaaaaggacaaaagggcacaaaaaaacuuuuggggcaguggauauguucauuaucauaaucauggcgaugguuucaucaugugucaaaaguuaccaaauugcacacuuuaaacauaagcaaguuaugucaauuauaucucaauaaaacuguuuauaauauauaauguaaauauauaauauauauuuugcauagcaaaaaaacauacugaaaauaauuuuuuauugauaaccuaaagaaaccaguugccacucaccuauaggcauggggcuaauuuaauugcuauauaaaaacgcucuuguaaaucaagauagaaguuaaaggauauuaaaacaguucacagaaaaggaaauaccaauaauucuuaagaaugaaaauaugcuggaugacuucaauuaugacaagagaaaugcaaacuaaagcaaugggguuuuugaaacuuaucugauuauuaaauaucaaagaguuugauaacacucuauggguauguguacauggaaacucucagucucagucauugauguuagaaaaauaaauugauacaaaccucuguggagauaaauaaggcaauuucaaucaaaauuaaagaugcauaugccuuugaaucauucuagaaauuuauucuacacauaucuuacacauuugcaaaauaauccaucaucaggauauugauuucugcaauuguuaaauagcaaaaaauugcaaaccaccgacauacccaucaguggaggucugcuucaaguaucauaucuccguuaaacagccaucaaaacugugaagcuucacucucaucacugaugcaggacaucccugauaucugauccuagaaauaacaguacaucuuucagaagaguaugaaaucugccaucaugugggggcaaauacaaugguuuacaaaacaaaguuuuaucuaccuuccuuguucugugucuuggaacuguuugaagaacauugggauuaucuuuucuguagagguuaaauagaauugaguuguaaaaccaucugggccugauacauguuuuauaggauaucuuuaguaauuucuuuuuagucuguuuuaugauauguuguucuaaauuaguuuauugcaucuuuuggaguaauuuauucauugcuauuuaauuuccucaagcauuucaauuguguugccacuugguagcaacugauuuuuuccuuuagugauuuuauggucuucucuaucaucucuucguuuuucuuuuccuuuaugccugaacuuuugugguuuuucuccuuuuuucuuaaucaagcacaugagaaauuuauguuuuauuuauauuuuauuaucagaaaacuaucuuuguacucuuuguuaucuauuucauuaaucuaagcuuuuauagcuauuaauucccuuuucuuggcuaacucuauuuuuguuuucuuuuacuuaagagucauaguucauuuauuugaaguucuucuacuaaaggcauuuuuaaaggcuauaaauuuuccucugauugcagcuuuagcugugacacguagaucugauuaugaaauauguuccuuuucauugcuuucuugauaguuuuaauuuuguguuuugauuuuucucuuuagaguucuuuuaaugucuucuuaauuuuuaagcaguaaauuuuuaucacuguuauuuauuucuaauuuaguaggcuuacagugaaaggauguagccuaugaagucuccacuuuuuuuaaaaugaagauuuucuuugucuccaaguaugaaaauaacaucauuauuuuuguaaaugcuccacagaccucagaaaauaucuucuguauuuguauaacacaaaguuuuauuuguauacauggacagacaaaauguacauugagauggauuguguauacauacuuauucauugccucauuuaggucugcucugcccuuaguuaaaaaaaaaaaacccuaauacaucugccaaauucugagacaggaaaauuaaaucuuccuguacaauuauguuucuaaaaauugaguggcagguuucauggagugguuuggagcacagccuauauggccaaccuucuuuagggucauagcccagcucugccauuuucuuauguggcccuaagcaagcuacugcauucucugugccucaguuuccacaucugugaaaucaggauccuaacugccugcucccaggacuccuguguugacugagugaguuagaacauguaagugcucacccaggacccauaugcagcaaacagucuugugucucugucugcugccaaauuggccucaggcucuaucaauaccagaucugaauaggggcuauucuuucuuuuaguguccuuaauguuguauuacuuuccaauauucacacuuuaacuuuacagaugaguagaauggaauagauguguuucaguacagaacuuuuuucuuauguuugcuugggcuccccuccucucuguuaccuauguugauaaucuaggauuuguugucuuacauuuuuccugauguucauauaauauucaaugaaauaaaauacaugugacauaaugaaggcauuaucauuguuuuccaaacucacgggaucauaucauaccugcuuucugcaucuuguuuuucucaaucaguaaaauaguaaaaaugccucuaaggcugcugaaacaauuuuauuuugauuuaauucuaucucuaauugaauuuuauuucuauuucaauucuauucuaaaauuuauaaucucugcuuaauuuccuuugguguacauacucugugauguucucuaucgcuuaaaauucauuuuguucaagaacauagguucuugaaccuguuucuauguacagaacuuuuauuucuauguguuaacuuuccaggauguauuaguuugcuaggacugccauaacaaaauaccacaggcuggguggcuuagacagcagacauguauuucucacaauucuggaggauagaagucugagaucaaggugucagcaaggcugcuuucccugaggccucuuuccuugccuugcagauggccgccuucuuccugugucaucacaugaccauugcucugggcacuugcacccugguguuucucuguguguccaaauauccuuuucuuuaagggcaccagucacacuggauuagggcccacccuaacagccucauuguagcuucaucaccucuuuaaagguccugucuccaaacaugcugagucacgugccgagguauuaaagaccagggcuucaacugcaaaccuugugggacacaauucagcccgugacacaggaauaggcuuguuaauuucagugauguagccagguuguuuuucucguuuugucugaccuugaauuccacaggcaggguuccucuuucccggccggcauuccugcccaccaguccuggcagagugacuuauugucagccaaguggggcagaguuucuccacuguaccucuauugaaaucuagugccggauaauucuuuguugagggaggaaguccugucuauugcaggauguuuagcagcaucuccggccucaguuaugaccaccaaaaacaucuccacauguugcuacauguccccuggagggcaaaauugcccccaguugugaccugcugagcuaaagcagucccucaggauuguuucuuaaaacaaaacaaacuguuuauuuggccauaauuuugaacuacagaaaaauuacaagcacgagauauaaaaacaccuacauacccuucacuaagauuuaccaguuuacuaauuguuacauuuugccacauuugcuuuaucauuugaaccccuuucucuacauuauauucacauaacauguuuuucugaaacaucugugaguugcauacuccacagcucuuugccccuaaacauuuugcuguguauuucugaaaaauaaagauauuaucuuugaaagcaguaauacaguuauugacuucugcaauuaaacaucaauauaauacuuggaccuaauuuaaugccuauguucccauuuugucaguugccaugacaauguccuuuguggcauuuuuuccuccacugcaagauccaguucagggucaguacugccuuuagaugugucucuucagucuuguuuaaucuggaacauuucuagucucuuucucuguuaugacacugauauuuuuuaaagauacaguccugccacuucuugggggagucugauguuuccucagguuagauccacguuguguacucuguaagugaccugauguccuucucaguguaucacauccugaggcacacaguguaucugccccuuauuaacgauguuauuuugaucaccaaauugaggccguuauccacuuuucuaccuuacaguuacuauauuuugccuugcaaccaauaaacaaucgggggagauucuuuaaggccaugcauauacccugcuacuuguuaaaaaaaaaaaaaaagucucuccagauuuaaaugcuuuuggaaaccaggcuuuacugugguaguugcaaaaaugaucauuuuccaacucuagcaccccuuccacgaaaguacagaaagaaaaaaaaauacuguccaguuggaaugguuaccucauugugguuuugauuugcauuuuccuaaugaugcugagcauuuuuccacgugccuagugcccaauuguguaucuucuuuagugaaauauuuauucagaucuuuugcccguuuaaaaaaaugagacuuucaagcuuuuuauuuuuagacauucauaugcagugguaagaaauaauagggaucccaugcacccuuuaguuaguuuccgucagugguagcaucuucuaaaaccauagcacaauaugauaaccaggaugucaacagcaagaguccagaugcagagugcucccgucgccacgggguucccauuauuuguccuuuuacacggacuuucucccaucccaucccuccaaucccuggugaccacucaucuguucucugauucucuaguuuugucuuuucaaaaaugccacguaaauggaaucacacaauacacgauaucuuagaaacggggucuuuuggcucggcaucauucucuggauucauuccgguuguuuuguaucgcgacaguucauuaaaucauagugcugaguggaguuucacgguauggacauauaccccaguuuauuuaaccauucccucauccaaggacaugugggucauucccaguuugggcuauuacaaaucagaguaggcugaacaauggcccccaaaguagccagguccuaacgccuagaaccugugacuaucgccuucuauggcaaagggcacucugcagaugugucaaauuaaggaccuugagauggagagaucauccuggguuaucugaaugggcccgguguaaucacaaggguccuuauaacagggaggcagaagaaugacuacagaagagaaaaaggguuacguggccacggaagcaggggcaggaaauggcaaugugauuugaggaaggggucacaaaccaaagaacgcuuccagaagaaaaggcaaggaaagggaagggaugcuccccugaagccuccagaaggaaccagcccugcugacaccuugauuuuucguccccuaagacucuuuucagacuucuggccucuagaacugugagaaaaaaaaaaaaagcgugucuuguuuuaagccacuaaguuuguggaaauguauuacagcagccaugggaaccuuauacauugauaaggaugacaugaauauucuuguaagguucuugugugaacauaaguuuuuauuucuuugggauaaaagcccaagcuuguaauugcugaguuguguggcaguugcauguuuaguuuuauaagaaacuaccaaacugauuuuccagagugacugcaccauuucacauuccccauuccugccagcaaggucuaagugaucuaguuucucugcauucuugcuggcauuugauguucacacuguuuuuaauuuucuccauucagauagguguguagugagaucucauugugguuuacauuuacauuuccucauuaggaugauacugaacaucuuuucaugugccuguuugccauuuuuguauucuaugcagugaaauucuuguugauaucauuuuuccauuucccaauuagacuuuuuguuaacugucgaguuuugggagauguuuauauauucuagauacuuaucuuaagucagaaacagggugcaaauauuuauucauuguagcuuucauugucaucaucucaacaggguacuuuacagagcaaacauuuuaaauuuugaugagauucaauguuuccuuuuuauggauuacacuucugaugucaggucuaagaagucuuuggcccuggaccccaaauaucuucugcuauagcuuuuuucuaacagccuuguggagauauaguuuacauaccauacaauucacccauuuaaagaauauaauugaaugguuuuuaguauaggcauaccucagagauauugugguucgguuccaguacacugcaaugaagcaaauauugcaauaaagcaagucacacaaauuuuuugguuugccacugcauauaaaaguuauguuuauauuguagucuauuaagugugcaauagccccaugucuaagaaaacaaugugccuaccuuaauugaaagacacuuuauugcuaaaaaaugcugacccagaaugaagugagcacauguuguuggaaaaauggcacugauagacuugcucagugcaggcuuaccacacacauuuaauuuuuuaaaaacacaauauccacaaagugcaaaaaagugaagugugccuguguauccccagagcugugcaacugccacuccaguuugagaacauuuuuaucauuccaaaaagaaacccagugccuuuuaaauaucacccccaaacccacuauuccaucccccucagcccuaggcaauaacuaaucuuucucucuauggguuugccuauucuggacauuuuauauaaguggaaucauacaauguaugguccuuugugacugguuacuuucacuuagcaucauguuuucaagguuugugcuucagugcuucuuuuuuuuuccccgagacagagucucccucugucgcccaggcuggagugcaguggcgcgaugucggcucacugcaaccuccgccucccggguucaagcaauucacccgccucagccucccaaguaggugggauuacgggcacgcaccaccaagcccggcuaauuuuuguauuuuuaguagugacgggguuucgccauguuagccaggcuggucucgaacuccugaccucaggugauccgcccaccucggccuccuaaccugcugggaccacaggcgugagccacugcacccggcccuugugcuucauucuuuuaugaaugaauaaucuuccaucguaugauauacaaugaauaaacauuuuguuuauccauuuauuuguugauaagcauuuuagauuguuuccacauuuugacuacuaugaauaaugcuucuagaacauguggguuuuuguguggacauguguuuucauaucuccugggcaugaaagagauaugaaaggcuggguguguugguggcucacaccuguaaucccaacaguuugggaggccaaggcagguggaucaccugaggucaggaguucgagaccagccuggccaacauggugaaaccccaucucuacuaaaaauacaaaaauuagcugggcaugguggcaggugccuguaauuccagcuacucgggaggcugaggcaagagaauugcuugaacccgggaggaagagguugcagugagccgagacugugccacugcacuccagcuuaggcaacagagcaagacuguuucaaaaaaacaaaaagaaaggaagaaaagaaagagauaugaaaacacaugggaguggaaagcugagucaaaugaucacuaucuuuuuuuugagaugaagucuugcucugucgccaggcuggagugcaguggcgcgaucugagcucacugcaaccucuaccucccagguucaagcgauuccucugccucagccucccaaguagcugggauuacaggcacaugccaccaugcccagcuaauuuuuuguauuuuaguagagacaggguuuuaccauguuggccgagauggucucgaucuccugaccucgugauccacccgccuuggccucccaaagugcugggauuacaggugugagccacagcaccuggccgauaacuaucuuuuugaagaacugaccaauuauuuccaaagugggugccucauuuuacauucucaccaccagcauaugagcacugcgcaaguucuccauauccucaccaacacuugcuauuaucuuuuuucaauuauagccaucuuagugguuguuaagcaguaucuccuuuugggugugauuugcauuucccugugacuacucacguugagcaucuuuucauguguuuauuaacuauaugucaacccugaagaaauuucuauuccgauuuuucauccauucuuuaaguugggauauuugucuuuuuguuuuugaguugaaggaguuauuuauauauccaguaacaaguccccuaucagauagauuauuugcaaauauuuucucccaucuguagguugucuuuucacuuucuuuaaggugucuuuugaagcacaaaagcuuuuaauuuuuaugaaguccaauauaucuacuuuuuuucuuuuguuccuuguucuuugguguuauaucuaagaaaccucugccaaauccaaggucauaaagauuuacccuuauguuuacccuaagaauuuuauagcuuuaucuguuacguauuuaugucuuugauccacuuugaguuaauuuuuauauaugauguggaguggaccaauugauuuuucucauguggauaucaguuguuucaacacuauuuguucaaaagacuauucuuuccgcauugaacauucuuggcauccuugucaaaaaucaauugaccauagauauauggcuccguuuuuacacucugauucuauucccuugaucuacauaucuaucucaugccaguaucacauuuucucgaauacuguuacuuuguagucaauuuggagaucaggaaguaugaagccuccaacuuuucuuuuucaaaauuguugcuauucuggguccuuugcauuuucauaugaaguugaacaucagcuuauuauucuacaaagaaaccagcugagauucugguaaggauuguguugaguuuguagaucagcacgauuccgggaguguugccaucuuaacaauauuaagucuuccagucuaugagcauguaaugucuguccauuuauuuguaucuucuuuucuuucaacaauguuuuguaauuuucagaggauaaguuuuguacuuguuaaacuuauucccaagguauuuuauuuuuucuuuauuaugguaaaaauauacauaaaaucuacuauuuuacucauuuuaaguauauaguuauguggcauuagguaaauucgcacuguugugcuuuauucuuuuuugauguuauacauggaauuguuuucuuaauuauauuuucagauuguuuuuugacaguguguagaaauacaauugauuuuuauauacugauuuugucuccugcagccuuacugaacucauucguuguaauuguuucacaauggauuccuugggguuuucuguauacaacauugauacgguuuggauguuuggucccuccaaaucucauuaaaaugauucccaauguuggagguggggucugguggggggugucuggaucauggacggagcccucgugaauggcuugguaccauccccgugguaaugagcgaauucuuacucugguaguuuaugcuaagagcugguuguuuaaagaaucugcuaccucccuccaccuugcuccugcucuugccaugugauaugccugccccucugccuuucgccaugauuguaagcuucuugaggcccucaccaggagcaggugcuggugccauauuuccuguauagccugaagaacugugagccaauuaaaaucuucuuuauaaauuacccagccucggguguuccuuuauaguaacacaaaacuggaccagcacaaauuuaugucaucuccaaauaguucuacuucuuucuuucagucuggauucuuuuucuucccaaauuauccuggauggaacacucaauaaauguugaauagaaguggaaagagcagaucucuuugucucauuccugaucuuaacggggaaacauucagucauucacuguuaaguaugauauuaucugugauuuuuuuuuuuuuuuuuuuuuuuuuuuugagacagagucucgcucugucacccaggcuggaaugcaguggugugaucacggcucacugcaagcuccaccucccagguucacgccauucuucugccucagccucccgaguagcugggacuacaggcgcaugcugccaugccuggcuaauuuuuuuguauuuuuaguaaagacgggguuucaccauauuagccaguauggucucgaucuccugaccucgugauccacccgccucggccucccaaagugcugggauuacaggugugaaccacugcacccggccaacugugauuuuuaauagaugcccuuuaucagguugaggauguuccuuucuauuccuaguauauugaguagggcuuuuucucccaucauggaaggguguugaauuuuaucacccaaaugcuuuucugugucuuuuauucuaucauuaauugcuauagacugaauguguguguuuccucaaaauguauauguugaaauccuaacccccaauguugguauuaggaggugaggccuuugggaagugguuaggucaugaggguggagaccucauggaauggauuagugcccuuguaaaagagaccucagugagcuccuuuuuuucuuccgucauaugaggacacaagaagacaacuguucaugaaccagaaagcgaguccucuccagaugcugaaucugccagugccuugaccuuggacuuccaagccuguaaaauugcaaaaaauaaauuucuguguuuauaagccaccaguucgugauacuuuguuauaacagucugaacagacugacagaaaucgugguguuuugucuuuuauucuguugauaaugguguauuacauuaauugauuuucagauguuaauucaaccuugcauuccugaaauaagucccauuugguuauaauguauaauccuuuuuaaacauugcuugauuuuacuugcuaguauuuuguugaggguuuugaggguuuuacaucauuuucaucacaguuauuguaaugaaauacaaaaaucaauaguauuccuauacacugucaaaaacaaucugaaaauaagaaaacaauucuauuuacaacaucaagaaagcauaaagcacaauagcguggauuuaccuaaugccacagaacuauauaccuaaaauggguaaaauaaauuuuauaaguucucuuuucauguuuuugucugguuuuggugucagggugauacuggacugaaagaauguauuggaaaaauuuuccuucucuucuauuuuuuuguuguuggaagaggucauaaagaauugauauucuuuagauauuuguuagauucacucaucuggcccucuugggcuuuucuuuucaacuaguguucucauaacuaauucaaucucuuuaacuuauuacagauccauucacauuuucuacuuauuucuuagucaguuuucauaguuuucaucuuucuaggaauuugucaauuucaucuaaguuuuauaauuuauuggcacaaaauuguucauaguguuccuucauaauccuuuuuauuucugucagguugguaguauacuucccucauucauuccuuuuuccuuuucuuuuugagaaacagagucucucucuguugcccaggcuggaauagagugguguaaucauagcucacuguaaccucgaucuccuagucucaagugauccuugccccuuagccuaugacaggugugcaccacaacaccagcuguuauucaaaaaauauuuuguagagauagggucuugcuuuguugugcaugcuauucuugaacuccuggccacaagcaauucucgaacuccuggccacaagcaauucuccugccuuggccucccaaagugcugggauuacaggugugagccacugcagcuagccucguuuuuuugcuuuaauuuguaaaacugucauucauuucugauuuuaguaauuugaguuuucucucucccccuuugccucaugcacuucccucucugucuuuccuccucccccucuuucuuccuccccuucuuuucuucucccucucccucucucuuaccaaucuaucaaagguuuguuaauuucaaagaaccaaauuuuggauuuguugacuuuauuauuuuuauauucuauauuuuauuucuacucuaauauuuauuauuuuguuuuuucuacuugcuuuagguuuaguuugcucuucuuuuucuaguuucuugagguggagaguuggcuuacugauuugaagccuuauuuuuugauauaggcauucauagcuauaaaauuccaucuuuacacugcuuuaaauguaucccauaaguucuguuauguuguaucuucauuuucauuaaucucaaaguacguuccauuucccuugugaauucuuucacccauugauuauuuaagaauguaguguuguuuaauuuccacauguguauguuucccuaauuucuuugcuacugaguucuacuuuuauuucauuauauucagaaaaagauaccuuguauuauuucaauccuuuuaaauuuaugcagguuuguuucgugacuuagcauaugguccuucuuggagaaugucucaugugcacuugaaaauacuguauauucaauguugguuguugggcgaagugcucuauaauuaccuuuugagucuaguugguuuaugguguugcucauaucuucuguuuccuuauugaucuucuuucuuguacuacacauuauugaaaguggaguguugaagucuccaacuacuauuguugaauuggcuauuucucuguucaguucugucaguuuuugcuucuuauguuuuaguucucuauuguuaggugaauauauguuuauaaucauuguaucuucucaugaauugacauuuuaucauuaugagauauucauauuuaacuucaguaacauucuuaauuuaaaaucuccuuugacuuuauuauagcacuucagguuacuuaugguugcugcuuacaugauauaucuuuuuccauccuuuuacuuucaguuggcauuuaucaucuaaagugugccucauauagauggaauacagauggauccuguuuuucaaaucuggucugauaauuccugccuuugauuagauuguuuaauccauucacauuuaauauuauuauugauauaauuagauuuauauccacaguuuuacuuuuggucuuuucuauguacuauuucuuguuccucuauuucuccuuugcugcuuucuuuuccaucuagugacuacuuucuaauauaaauuuucauuucuuuuaugauucuucaauauucuauuuguuauuaguguuugcucuagggcuuaccuuauguaucgucucaaaauuuacuucauauuuauauuaauccuggugagauacagaaguuauuccuguaugaguuuauucaguuuuaccacuuuuugugguauuguuacauauauuacaucuuuauuaugcgcuauuauaaugaucauacuauauaaugauauaucuuuaaagaagcugaaaggagagcaaguauauauuucuaguuucuguuuuauuaaccuccuuauaucauauauuugauccacuuuuuugguuuuuauggauuugaguuaccaacuggugguauuuccuuacucuagaacagcuuugcuccuauuuaccuccuugcucuuugcuuuuggauauaugugaacuuccugggagcacuuccuuuuugccugaagaacuuccucuaguaguucuuacaaaacuggucugcuaacaaggaauucuguuuuuguuuaucugggaaugcuuuuauuuugccuucuuuuugaaagaaacuuuucuggacacaguauucuugguuggcuuuuuuuuuuuuuuuuuuuuuuuuuuuuuacuuugagcacuugggaucuguuaccccacuacuuucuggguaccacuguuucugacgaaaagucagcuccacauuugucucccugacaccagaacaggggaggguauuaagcagagugccacauagccucaccucccaccauuucauccaagaauaguaguuggguaauaguucaauaacucacucugaauaauugauagaacaacaagacagaaaaucaacaagaguuaguacuauuauuguugaguugucuauuauuguucaguugucuguuucucucuucauuucugacaguuuuauuucauauacuucagggcuguguuuuuagcuguuauaaauuuuuauuucuuuaugacuucuguuuaugauuucuauuucuuccuguuaaauuuucccuuuugucauuguaaaaugcuucucaguaucucuaauaacaugguuuguuuuuaaagucuauuuugucugauuuuauuuauuuuuauuuuauuuuugggauggagucucacucuguugcccaggcuggagugcaguggcgugaccuuggcucacugcaaccucugccucccggauucaagccguucucuugccucagcaucccaaguagcugggacuacaggcauuugccaccauacccagcuaauuuuuaguagagacagaguuucaccauguugaccaggcuggucuugaacuccugaccucgagugaucugucugccucagccucccaaaaugcugggauuacaggugugagccacugcacccagccaauuuugucugauuuuaguacagucacucuagcuuucuuauuacuguuugcaugucaucuuuuuccaucauuuuacuuucaacuaugucuuugaaucuagaaugugacucuuauagaccauauauauuuggauccugcuuuuaaggcagucuggcaaucucugcucuuuauugaguuuuuaauucacuuauauguaauauaauuauugauauggaaggauuuauaucuaccauguuguuauuuauuuucuauaugucucauaucacuuuuguuccucucuuccuccuuuacugccuucugcagguugaauagauauguucuagaguaccauucuaauuccuuuguuaguuuauuucccccauuuuuaaaguguaaucuggagguuacaauaagcagcuuaagcaaaaacaaucugcuucagguuaauaaucuacucaaauauuuuugucugcccuauucucuccuucucaguacucuuauuaacacauauguuguuacuccuuaauuccacauauguuuucuacucuuaauuacauauauguuacaacuuaauuacacauacauuguuacacauccuguuaggacagggguucccaaccccagggccauggacugguaccagucuguggccuauuagaaacugggcuacacagcaggaggugagcagcaggcaagcaagcauuacugccugagcucugccuccugucugaucagugauggcauuagauucucacagagagcaaauccuauugugaacugagcaugugagggaucuagguugugcacuccguaugagaaucuaacuaaagccucccccaacuggcuguggaaaaauugucuuccacaaaacuggucccucaugccaaaaagguuggggaccacuauauuaugguauccaauggguaucucuucauuuuucuucauuauuuuucuuucuauucuucagucugaaucaucuuuauggaucugcguugaaguucauugauucuuucuucugccaggucaaauuugcuuagccgcacuagugaguuuuucaccuaaguuauuauauuucacaacuacagaauuucuauuugguuucuaauuucuaucucuauauugauauuaucuauuugaugagucuuugucaucacacuugcauucuuuaaugugguuucuuuugguucuuugaacauaguuauaauacuuacuuugaaaucgcgcccuaacauuuggggcccuucagagauaauuccuauuuauugcucauuauucuuguucaagggucacaauuuucuguuucuuugcauaucucauuuuuuuuguuaaaaacuuacuuuagauaauauaucguagaaacucuggauucuaguucuucucccuaaccagggaugauuucuguuacucauuuauuuguuugcucgcuuguguaugccuucucugcauggauucugcagagucuguguucuccugcagugugcagccacuggugucuuugcucaguuuuguuuguuuuaauucuuauguuuguuuuguaagccuggcuucauuggugucaccccuggaucagcauaaccuaguggucaagccaugauuagucagacauuuguuuaaacaucuugagccagugaaucuuccacccucugcugaggggaucuauguguggguugggacauucaaaguucaggcacuuuauaacucuguccuguauuuuacugucugcuugcaaaaggucucacagucagccaaggauaaguagauagcaggaaaccucucugaucucuccugcaagcauguacaacuuccauaucuccagaauuccuuuuaaaauuuuucuuaaucugucgcuugcccaaccaguauugaaacauuagguugcugugauguggguugccuccaauuauuugccacugaaauccuuguugcuuaacauagugcauaggguuuucuauggaauucaaaaucagaugagccuucuuuguugcugguccucaagccuaccgugccccugagcuuggguggggagauggcagccccacguuaaaucauaacccugcuauucuuaggaaggcuuaauauuuuuucuuuaauuagcacuuuucaauuuuauauuucuuuguccaguuuuaucauugcuuuucagggagugguuauaucaaggugcucauuccaccaccucagaaguggucccuaucuuguuaauuuuauuuuuugaauacauauaacauuaacauacuuccaaaagucaauacuaaacaaaaggagcuacugagagaaaucuuccucucacccauaucucuuccauccuaauucccccuacccauuauagguaaccaguuucaguguuuucuaguuuauaguuuguguguguuugcucuuuauaagacaugauuauuuucucauuucccaaaaaaguacuauucuguauaugcccuuuugaacuuugcuuuucucaccuaacaacaucuccuagaaaucacucaacauccauucacagagaucuuucucauugcauugcuaaaguugcauaguauuccuuagugugacugugcuauaaccuuucaaccaaucucuuaugcuugcauguguaggugguuucuagauggcagcuaugcucaccauucuuuggcuuuccuaccaugucucugagauacaucuacuccauaaaucgaaucuacccccaagaggugauucucugagggugccaccucaaaucuuagucauuugcaagagccuccacuauagcugcugcucuggacuaccuauuucugacauguguucuccauguugacauuuaauauagagucuucuuuuucuggugauaauucugucugugcugcuuuuuagucuucugugcacccuuuaaauuuuuuaaguaacagaaaccauuucaaaauguacaauucagugucacuuaguacauuuacaauauuguguuuuuugugucuuuucuaagaauuuauuuccaaucucaagucauaaagauuuacuccuguuuucuacuaagaaauuuaugccuuuaacucuuauuuuuuggucucugauacauuuugagauaauuuuuauaugcuaugaguuauggguccaacuucauucuuugauauaugaggauccaguugccccagcaccauuuguuaaaagacuacucuucccacugaauucuugauacauuuguugaaaaugaauugaucauauaugugaguguuuauuucuacauucucuauuauauuccauuggucuauauguccauccuuguguccuagagaccacauugugucaguaccacauuguuuugauuacugcagcuuuguaaaaguuuugaaaauggcaggccugagucuuccaacuuuguucuuuuucaauaugauuuuagauuguuuggggcccugggaaaauuccauuuacauuuuaaaaucaguuuuuacauuucugcaaauaaaaaggcccuugggauuuugauaaggguugcauugaaucuguagaucacuggguaauaucgccaacuuaacaauauuuaaucuuccaaucugugaacacaggauguauaguucuauuuauuuaagucuucuuuaauuuuugucaacaguguuuuguagucuuuagugcagaagucuuucaccuucuuguuuuaauuuauuccuagcuauuuuacucuuuuugaugcuauuguaaguggaauuuuaaaaauugacuuccuucuugggcuguucauuccugguauauagaggcacaaaugauuuucuuaaaauaaauguugaacauguacccugcaauuuugcuggacuuguuuauuagcucuacuaguuuguggauucuuugauuuucuagauagaagaugucauuauugaauaaagaguuuuacugcuuccuuuccaauuuggaugcuauucauuuaccuguuuguuuauuuaucugccuaauugucaugguuaaaacuuucaguacauuguucaauagcacuggguaaagcauacagccauaucuuacucuuuguuaugggagaaauuuuucaguuuuuuuucucauuaaguauauuaguuguggauuuuucacaaauccucuuuaacacauuuugaaaguuccauguuuuuauccugaaagguuguagaauuuugucaaaugcuuguucugagugaauugaaaugauugcauggauuuuuuauccuucauuguauuaaugugguguauuacauugauugauacucuuguacugaaccacccuuguauucuugagauaaauuccauguggucaugauauauaauccuuuuuaauaugcugcugaauuuggcuuacuaguacuuuguuaaauaaaagauuuuaguaucuaguuugucuuuucuugugguauauuugucuggcuuuggaauccauguaauacuggccucauagaauguauugcaaaguuuuuucuccucuguuuuuuggaagaguuugagagggauuggugugaauucuucaaguguuugguauaauucaacagugacgccaucuguguagcauuuucuucauuggaagguuuuugguuacugauucaaacuuucuacuuguuaugggucugcucauaauuucaauuucuguuuuggucuguauuaguauuuugugaauucguccaucuuaucuagguuauauaauuuguugguauacaguuauucauaguauucuuuuaucacacuuuuuauuucuguaagaucaguuauaucguucccacuuuuguuuuuuuuucuuauuuuuguuuuuuuuuguuguguuccuacuuuuguuuaugauuuuagauaugugcaacuucucuaauuuuuuauuagucauucuaguuaaagguuuucaacuuugaucuuuucaaaaacaagcaacuuuugguuuuguuaaauuaucucuguuguuuauuuaagcucgaauucaguuuuaucuccacucauacauauuauuucauucucucuuuuaacuuuagguuuacuucguucuucuuucucugguuacguaagguauaauauuagguuauggauccuucuucuuuuucagugugggcauucacagcuauaauuuuuccucugagcacuucuuucacuacaucccauaagucugaguauguugugucgucauuuucacuuuuugaaaguauuuuauaauuucccuucugaugucuucuuugacacaauaauuuuuaaagaguguguaguuuuauuucccugaauuuguuaauuuuuagguuuuucuucuguuacagauuucuggccucacuauauuguaguuagagaagauauuuuguaugauuucuauauuuuaaaauuuauugagacucuuuuguggccuaacauaucaucccuccuagggaauguuccaugugcacuugagaagaauguguaguuggguggaguguccauauauguuuguaggucuaguugguuuaugguauuguucaaguccucucuuuucuuauugggcuucugucuggcuguacauuaucuuguuguguuuuuuuuuuuuaauuuuaaaaauaugcauauuuaguguauaaaacauacaguuaaaucguuaacauagugaugcaaauuaauauguccaucaucucacaguuauucuuuuguguguaugagugagaaaagcuaugaucuacucaauuggcaaaaauuccaaaugcaauauacuaacuauucucauguucuacaugagaucucuagacuuguucauccuauauaucugcuacuugguauccuuugaccuacaucuuuccauuuucuucccccacaccuugcccaugguaaccacuaguuuauucuaucucuguauauuugacuuuuuucuuuuuaagauucuacauauaggugagauuauuuaaaacuuuucauuuguauauggcuuauuuaacuuagcacaaugucuuccaguuucauccauguggcaaguggcaggaucuccuuuuuuaaugcggaauaauauuccauuguagacauacacaccacaguuuagucauccaucaauggacacguaaguuuucauaucgugacucaugcauauaaugccacaaugaauauaggagcgcagauaucuuuaugagguggagauuucauuuucuuugggaauauaccuagaagagggauuagugggucagaugauaguauauuuucaauuucuuuaggagccaccauucuguuuuucauuaugacugcaccaaucuacagucccaccaacacuguacaagaguucccuaacccuagccaacacuuaauagcuauucucaugagugugaggugauaucgcauaguaauuuugauuugcauuucccugacgauuagugauguuaaaugucuuuucauauauguguuugccauuuuuauaacuucuuugcaaaaaugucuacucaguuccacugcccauuuuuuaauuggguuaucuauuuucuuguuauugaguuguaugcauuccuuauaaauuuuggauauuauccucuuauaagauauaugguuggcaaauauuuucuucuaguccauagguugccuuuuccuuuuguugacuguuuccguuccugugcagaaguuuuuuaguuugaugguauaccaauuauuuguuuuuguagccugagcuuuuggugugaucuccaaaaaaucacugccagagccaugucgagcuuuuccccuauguuuucuucugguuguggguuuuggucuuauguuuaggucuuuuauccauuuugaguuuauuucuauguaugguguaaggcagcgauaucaaaucuuuuggcuucccggggccacacuguaagaacaauugucuuaggccacacauaaaauacacuaacaauaacaacagcugaugggcuaaaaaaaugcaaaaaaauucaauguuuuaacaaaguuuacaaauuuguguugggccucauuaaagccauccugggcuuacauguggucugugggccauggguuggacaagccacagaacuggguuuccuaacgucauuuaugagagagacuaucuuucugcauuguuuucuucguguucuuguggaaaauugguugaucauauaucuuugaauuucuuucugggcucucuauucuguuccacuggucuacauguuuguuuuuuaugccaggaccauacuguuugaucaauaguuuuguaaaauaaaccagaaaguaugaagucucccuuuguuuuucagaacagaauuuucagaauuucguuggcuacuuaagguucuugcuauuccaaaugaacuuuagaauuuaaaaaaauuuuccaugggauuuugauagggauuuuauucaaucuguauauugauuuggauauuauugacauuuuaacaauauuauucagauucaugagcaugggauaucuuuccauuuauuuguaucuuguuuaauuucuuucaucaaugauucauaguuuucaguguacaggucuuucaucuuuuuggcuaaauuuauuccuaagcaauuuuuuugaugcuaucauaaaugggauuguuuucuugauuucuuuuuuggccaggucauuauuuguguauagaaaugcaacuacuguuuuauauugauuuuauauccuacaacuuuacugaacucauuuauuaguucuaacagguugcuuugucagagucuucgggguuuucuauauguaggaucaugucaucuucauauaaagauaauauuacuucuuacuuccugauuugaaugucuuucauuucuuuuucuugucuguuugguuguacuaguacuuccaguacuauguugaguaguaguagcuagagugggcauccuugccuuguacugguucauaguagaagggcuucuguuuucccucauugauuauaacguuagcugugggcuuuucauaaauggcauucguuauauugaggaguguuccuucuauaccugaacuguuagaauuuaucaacaaaggauguucaacuucaucaaauacuuuuugugugucaauugagaugaucaugugguuuucaucuuucagucuguuaguaucacauugauugcuacauguauauuaaauaagauuugcaugccagaaauuaauuccacauagacaugauauauaaucuuuuugauguauuguuaaauuuagucugccaauauuuuauuaaggauuuuugcaucgguauucuuggguuauguuggccuguaguuuccuuuucuugugaugccuuuggcucaccuggguaucaaggugaugcuggccucauaaaauguguuaggaaguauucccuuuagcugcauuuuuuuuuuuuuggaaguauucccuauagcugcauuuuuuuggaagaguuuaagaaguauugguauucuuugaauauuggguaguauucagucaugaagcuaucugguccugggcuuuucuuuguuugagguuuugggguuuuuuuaacuuuuauuuuugauuuagaggguauauguacaggucuauauguugcaugguauauggaguauacugcaugaugaugagguuuggaguguggauaagccuaucacccagguagugagcauaguacccaauagguagguuuucagcccaccucuccauuccucccccaaguaguccccagugucuacugaucaucuuuauguccauguuuacucaguguuuaggucccacuugcaagugguaacaugcaguauuugguuuucuguuccugcauuaauuugcuuaagauaguggccucuagcugcauccauguugcugcaaaggacguaaguucauucauguauauauauauauuuuuuuuuuuuauuuuuuuuuuagacggaguuucgcucuuguugcccaggcuggagggcaauggcaugaucucggcucacugcagccuccgccuaccggguucaagugauucuccugccucagccuccugaguagcugggauuagaggcaugcgccaccacguccagcuaauuuuguaguuuuaguagagacaggguuuuuccauguuggucaggcuggucucgaacuccugaccucaggugauccacccgccuuggccucccaaagugcugggauuacaggugagagcuaccgcaccuggccgaauucauucauuuuuauggcugcauaguauuccaugguguacauguaccacauuuucuuuauccaauccaccacugaugggcaucuaaguggauuccaugucuuugcuguugugaauagugcugugaugaacauacaaaugcaugugucuuuuugauagaacaauuuauuuuccuuugaauauauauccaguaaugggauugcugggucagaugguaguucuguuuucaguuauuugagaaaacuccaaacugcuuagcacaguggcugaacuaauuuguauuccugccaacaguguauaagcguucccuuuucucugcagccuucccagcaacuuuuauuuuuuugacuuuuuaauaauugccauucugacuggugugagauggcaucccauuaugguuugguguuuuuuuguuguuguuguuuuguuuuguuuuuuuuugucuguuuuuugcuuuuuuguuuguuuguuuguuuuuugagaaagagucuugcucugucucccaggcuggagugcaguggcgcaaucucggcucacugcaaccuccaccuccuggguucaagcaauucuccugucucagacuccugaguagcugggauuacaggugaccgccaccauaccuggcuaauuuuuguguuuuuaguagagacgggguuucaccauguuggccaggauggucucgaauaccugaccccagaugauccacgcaccucagccucccaaagugcuaggacuacaggcaugagccaccgugccuggccucauuauuugcauuucugauuauuagugaucaugagaauguuuuuuuguuuggcuacuucuguauuuucuuuuaagaaauguauguuccuguccuuugccaauucaauuggauuauucguuuuuugcuuguugauugguuuaaguuccuuauggauucuggacauaggaccuuugccagaugaauaguuugcaaauauuuuuucucccauucuauauguugucuguuuacucuguugauaauuucuuuugcuaugcagaagcucuuuaguuuaccacugugaucucuuugcuauuggucuguucaggcuuucuauuccugauuuaaucuuagcagguugguuuuuuucuaggaauuuguccauuuccucuagguuauccaauuuguugggauauaauuguucauaaaagucccuuaugauccuuuuuauuucugaaguaccuguuguaauauauucuccauuuucauuucugauuuuguccucuuucuuaguccaagaguuuguugauuuuauuuuucaaaaaucaauucuuuguuucaaaaauugaagucuuaguuuuacugacuuuuuuccccuaugguuuuucuuucuaacuugucucuguucugaucuuuauuauuuccuucuguuaacuuuggcuuuaguuuguucuucuuuuucuaauuccuugagguacaauuuugggcuauuugaaauaucucuucuuuuuuaauguaggcaaggcauuuauugcuguaaacuucccucuuagaacugcuuuugcugcauguuuugcuuuugguauguuguguucccacugucauuugucugaagauauuuuuaaguuucuguuuucauuucuucuuugacucuacccauuacugaaaguacguuauugaagucccuaaguauuauuguagaacugucuuucucacuccaauucugucaguauauuuucuuauauucuggggcucuauauuuugguguguauacguuuccaauugcgaagucuugaguaauuuuccauuuucucaguauguaauguccuccuuugucuccuauaacaauuuuuaaauucaaguuuauuucuuuuauuaguauaauuaccuccagcuuucuuuagguuacuauuuguaugaaauaucauuuuucauucuuucacuuucaaucuacuugugucuuuagaccaaaagugaguuuguuauauacagcauagguugaugguuuucuuuuaaauccauucugccaaccucugcuuuuuggagaauuuaaucgacuuacauuuaaaguacuuacuuauaaaaaagaaguucugacauuuugugccuuuucuuuugccuuacauuuuuuaaauacaacauuuccucccuuacugccuuuuuuuguguuugaugauuuucugauaguguaccauuaugauucucuauucgauugucuguauguguguauguguauuuuaaagacuuuauauuuuuagagcaguuuuaggguuccagcaaaauugagagguaaguacagagauuucccguauacccacugcacccauacauacagagcuuuucccauuaccaacucucccaccagaguggcacguuuguuacaacuuaugaaucugcauuuacacauuauuaucaaagucccuaguuaacauuagggcucacuguugggguguacauucuguggguuucuacaaauguguaacauguugauaugguuuggcucuguguucccacccaaaucucaucuugaacuguaauccccaugugucaggggaggggccugguggggggcaaacuucccccuugcuguucucaugauagugaguucucaugagaucugguuguuuaaacguguguggcacuucccaucucacuuucuuucccucuccuguucugccaugguaaagaugugccugcuucuccuuugccuuccgccaugauuuuaaguuucugaggccugccagccaugcuuacuguacagccuacaaaacugugagucaauuaaaccucuuuucucacaaauuacccagucucagguaguucuuuauagcacugugagaacggacuaauaugcauguaucuaccauuauaguaucauacagauacguauauuuacauauauuuguacauuuucacugcccuaaaaguacucugugcacugccuauucaacccuucuuccccaacaacccuuggcaaccacugaacuuuuuacugccuccauagcauugccuuuucuaaaaugcaauaugauuggaaucauacaguauguaguuucuucagauugccuuauuucacauaguaauauguuuuuuaauuaccuccauaucuuuucauggcuugauagcucauuucuauuuagugaugaauaauauuucauugccuggauguacuacaguuuaucugucuacucaccuauggaaggacaucucgguugcuuccaauuucaacaaucacaaauaaagcuucuguaaacaucucugugcagauuuuuaugugaauauaagucuucaccuccuuugaguaaauaccaaggaugugauugcugaacugcaugguaagaauauguuuaauuuuauaagaaaccacugauuucgauauacucuggauucuucgggggauauguauacacauucagaaguggaauugauggauccuaugauaauuccauuuuuaauucuuugaagaaccaccaaacucuucuccaccagggcugcaccacuuuacauucccauuaaugguauaugucaaaguggcuguaccauuuugcauucccaccagcaauggaugaguguuccuguugccccacauauuggcaaguauuugguauugucaguguuuugaauuuuggccauucuaauaagcguguagauauaucacauuucuuguuuuaauuuccauuucccuaaugacguaagauguggggcaucuuuucauauacuuaguugccaucuguauaucuucauuggugagaugucuguuaaggucuucaguccauuuuguaaucagauuguuuguuuucuaauuguuauguuuuuaagguucuuuauauauuuuggaugaguccuuuaucagguauaucuuuuacaaguauugucucccuucuguggccuguccuuucauccucuugacaguauguuuuacagagcagaaacuuuuauuuuuaacaaagucuagcuuaucaauuauuucuuucaugaaucaugccuuuggugucauaucuaaaaagccaucaccaaacuaaagaucaucuagauuucuuccuauguuaucuucugggauuucuauuuguuguugauuuccaaaucuuuuauuguggcaaaauacacuuaacauaaaaauuaccauccuaaccaauuuuaguguacaauucagugaauguauuagauacguucacaaugcugugcaaucaucacuaucauccaucuccauaacacuugucauuuguaauuaugaaacucuauauccauuaaacaauaauuccccaacccccccaccaccgccaucucuuggaaaccaccuuguacuuucuaugucucugauuugacuauucuacauaccucauauaaguggaaacauacaguacuucucuucuugugacugcuguauuucauuuaacauaauggccucgagguucauccauguuguggcaugugucaaaauuucuauuuuuuuuaaagcugaauaauauuacauuguauguauauaccacauuuugcuuauccauucuuccauggacauuuggguugcauugauguuuuaacuguuguaaauaaugccacuacaaucguggguauacaaauauaucuuugagacugcuuuuaauccuucuggguguauacacagagguggaguugauggaucagauaauucuguuuuuaauuuuugaaggaacaccaaacuguuuaacacagaggcuguaccauuuugcauucccacuaacagugcacaaggauuccaauuucuccaugucccuuccagcagugguuauuuucuguuuaugugggauuuuuuugagacaagaucuggcucugucacuuaggcuggaaugcaguggcaugaucauggcacacugcagccucaaccuagaccucugggcuuaggcuauccucccaccuuaaccucccacguagcugauacuagagaugggucucacuauguugccuaggcuguguuuauuuuuuuaauaguagucaucugaguguauguaagguugugguuuugacuuguauuuccuaaugacuagagauguuaaacaacuuuucacguacuauuauccauuuguauaucuucuuuggagauacgucuguccaaguccuuugcccuuuuuuuuuuuuuuuugagauggagucucacucuguugcccaagcugagugcaguggugccaucucggcuuacugcaaccucugccuccuggguucacaucauucuccugccucccgaguagcugggacuacaggcgcccaccaccacgccuggcuaauuuuuuguauuuuuaguagagacgggguuucacccuguuagccaggauggucucaaucuccugacuucaugauccucccgccucagccucccaaaguacugggauuacaggcgugagccaccgugccuggcccuuuugcccauuuuucaggugcauuguuuuuuggugaugacuuuuagaaguucucuguauaaucuggacauuaaucccuuaucagguaugugauuugcaaauuuuucucccauucuguagguugucuuauugcuuaguugauauuauuuuaaugcacacaauguaaauuuuuaaaauuuaucuaguuuuacuuuuauugccugugcaaguacaauuuaucuauuuuuacuuuuauugccugugccuuuggugucgcauacaagaagcacugccaaugauguaaaguuuuuccccuauguuuccuuauaagacuucauaguuuuaggacuuugacccauuuugaguaaguuuuuguacacaguguuagguaagggucucaacuucauucucuuuuauacaugguuagguaaggaucucaacuucauucucuugaguuaauuuuuguguaugguauuagguaagggucucaacuucaguuauccuggcaccauuuguugaaaauacagcacuuucccuauugaauggucuuggcacucuucucaggaaucauuugaucauguauacaaggguuuauuuuugggcucucuauucaauuccauuggucucuacaucuuuaugucaauaccacauaguuuugauuacuguagcuucguaauaaguugggguuuuuguuuguuuuucagacauucuuacucuguugcccacgcuggaguacaguggcauuaucacugcuuacugccaccucaaucucccaggcucaagcaauccucccaccucggcuucuugaguagcugggaauagaaguguguaccauuacaccuggccaauuauuuuauuuuuuguagagaugaggucucccuguguuccccaggcuggucucaaacuccuggacucagaaguccucccaccucagccuucaaaagugcugagauuacagguguaggccauuguaccuggccuguaguaaguuuucaaaucagaaagugugaguccuccaauguuguucaucauuuucaagaauguuuuagcuauucaaggucccuugagauuccaugugaauuuuaggaugggguuucuucuuucugcaaauaacaucauuaggauuuuuauugggauuaccuuggauuuguagauuguuuugugugguacugacaccuuaacaauauuggccuuccaauccaugaacauaggagguguuuucccuuuaugucuacuuuaauuucuuucagcauuguuuuguaauuuucauuguacaagacuuucaccuccuugguaaaguugguuccuaaguuuguuauucuugaugcuuuuuucagcuuuuauugagguauaauugacaaauuaaaagugcauauauuuaagaacauauuugaccuacugugaaaugauuacuacaaucaagccaauuaacauauaccuuacauaguugccaugugugugcguguguguggucagaauaccuaagcuauacucucuuagcaaauuccaaguauagaauauauuaacuauagucaccaaucuggacguuaugucaagaacuuauucaucugauaacucuauguuuguacccuucaacauuuccuauuuccccuacucccugaccccuaguaaccacccuucuacucuccguuucucugaguucaagcuuuuuagaauuccauauguaacugggauagugcaguauuugucuuucugugucuggcuauuucacuuagcauaauauccuccagguucaucuauguugucauaaauugcaugauuuccugcuuuuuaaaggaugaauauuucauuguguguguguauauaugugugugugugugucuguauguauauguaugugauguguuuauuugggaauuuggugauacacacacacacacuauuuucuuccuuucuuuuugagacagggucuccaucugucauccaggcaggaguacaguggcacaaucacaguucacuguagccucaaccucaugggcucaagugauccuccugccucagccuccugaguagcugggaccacagucaugcacccccaugcccagcuaauuuuuaaaauuuuauguagagauaggguaucacuauguuuccuaggcuggucucaaacuccuguguucaagcuauccuucaccuuggccacccccaaguacugggauuacagguacaagccaccaugccuaugaauacuauguugcucauuucuugacuacuguaacacuacaaugaacaugggagugcagauaccucuucaagauacugacuuuguuuuccuuagauauacccggaacugagacugcuggaucauauagcaguuccaauuuuaauuuuuuaaagaaaaucuaucguguuuuccauaaugacuguaucaauuuacauuccuaacaaaaauguauaagggacaccuuuucuccacauccucaccaacacuugcuaucuuuugacuuuuugauaauagcgauucuaacaguuaugaggugauaucucagugugguuuucauuugcauuucccugaugauaagugauguuaagcaccuuuuuauauaccuguugaccaucuguaugucuucuuugaauaaaugucuauucagucccuuguccaucuuaacagguuauuaauuggguuauuaaguuuuuuugcuaguuauaugaguuccuuauauauauuggauauuaauagcuuaucagauauaugguuggaaauauuuucucccgcuacaugugcugccuuuucauuuuguuguuuccuuuguugugcagacacuuuuuuguuugauguaguucuaauuuauuuuugcguuuuauuccuugugcuuuugaugucacaucuaaaaaauugucacaaaaaccaauggcaaggagcuuuucccuguuuuauagguuuuaugguuucaggucauauguuuaaaucuuauucacuuuucucuacaguguaggguaagguuccaauuuaauuuuuuugcauguggauauccugguuucacagugccauuuauucaagagaguacccuuuccccauuguguacucuuggugucuuugucaaagauuaguugaccauaaauguguggguuuauuucuaugcuuucuauucuguuccauugguuuauuucuauaccaguaccauaacuuugaaauauaauucaaaauaagcauguguaauaucuuucacuuuguucuuauugcucaaguaugcuuuagaucuuuaaggucuuuuguaguuucuuucaaauuuuaggauuuuuuuugucuauaucugugaaaaaaagucacuggaaauuugauaggcauugccuugaaucuguagaucacuuugaguaguauagcuauuucggcaauauuuauucuauugaucuaugaacaccagauaucuuuccauuuauuuguaucaucuuagaauuuguucaauguuucauaguuuucagugucuaggucuuuuaucuccuugguuaaauguaugccuaaauguuaugcaguccaauuucucuauuuuuuauuuuaucugugccuuucauauuauauccaaaugaagucaauaccaaauccaaugucaugcaguuuuugccccauguuuucuucuaagaguuuuauaguuuuaggucuuacauuuaggucugugguccacuuugaguuaauuuuuguauauggaguuagguaaaggucucgacuucauucucucacgugaggauauccaguuuuccuggcaccauuuguugaaaagagaauccauuugccauugaauggacauggcaugcuugucagaaaucaugcguucauauaugaaaggauuuauuugggagcucucuauucuuuuugaugcuauuuuaaaugaaauuguuuucuuaauuuguuuuucagguuguuuauuauuaguguauagauacgcaaaugacuucugaaugcugauuuuguauccugccacuuuacugaguuagauuauuacuucuaacagguuuuuuuuguggagucuguagcauuuucuacauauaugaugucaucugcaaacagagacaauuuuacuuccuucuuucugauuugaguguauuuauuuauuuuucuugcccaauuccucuggcuaggacuuccaguacuguguugaauagaaguggugagaauaucuuuuucuuguuccucaucuuagaggagaggcauucagcuuuucagcauugaguaugauguuagcugugggcuauucauauauggccuuuauuguguugcaguacauuccuucuauaccuaauuuguucauaguuuuuaucauggaaggauguugaauuaugugaacugcauuauuugcacuuaucaaaaugauuguaugauuuuuaucuuugauuuuauuaaaguaucccauuucuuguauauguacacuuaacuguccuuauguacuaaggauaaaucccauguuugugauauaugauuuuuuuaaugugcuguuaaauucaguuugaucauauuuuguugaaaauuuuuaaauguauagucauaaaaaaauaucagccaguuauuuucuuuucuuauauuguccuugucuggccuuaguaugagggcaaugcuagccuuguaaaauaaguugggauuguucccucuuuguuuggggggaauauuuugaucuuauacuucccccgcuacauuuuauuuuugaugccccaagguacaccuuuuaauauugcauauccauugagaaauuaugaaaacaauaguaauuuuuaauuauuuuucuuuuaaccuuuauacuagaguuaugugauuuauauacuaccauuacacuauuagaguauucuuaaguugcccguauauuuauuuaucagugaauuuuguacuuucauauguuuucauguuacuaauuaucauccuuccauuuaagccugaauaacucccucuggcauaucuuguaaggcaagaguaguugcugauaaacuccuucaacuuuuguuuaccugaggaagucuuguaucuguuucauaucugaaggacagcuuugcuguguaaaguauucuuagauggcaguuuuuuaucuuucagaacuuugaauauauaauccuauuguuuccuggccuggaaaguuuuugcucagaaauccacugauagccuuauggagguuccugcagauguaagaacuuuauuuaucuugccgcuuucaaaauuaucuugucuuccauuuuuuacauuuugauggcaauauaucuaggugaaaccucuuuuagauggaaacuaauuguaauucuuugagcuucauguaccuagauguccaucaaucugggaagagccccagauaugggaaguuuucagccauuauuucucugaauuaacuuucuacccuuuaccucucuacuuuccuucuauaaauccugugugaacauuaacucuccugauggugucccauaaauccuguaaacuucccuuguuaccuuuucauucuuuauuuuucuccucuacugguuauuuucaaauaauuuauccuccaguugaugaauuccuccuucuauuugaucaagucugcugcugaugcuuucuauuucacuuuucauuucaugcacuauauucuucaccuccaaaauguuuguuuuuuuuuuaggauuucuauuucuuuauugaaugucuccuuuuguguauuaaugauuucauuagguugucucucuguucucugguagcacacugaacuuccuuaaaucagucguuuuuaauuuucuguaaggcaauuaauguaucccaauuucuugggagucagucccugaaaauuauuguauuucucaggugggugcuauguuuccuugguuuuucuguuucuuguuacaaugaauugaaaucugcucacuugauggaguguuaaguagguagggugcagcagcuguagcccagaugaggauauaauggaauacucuucuugcagcuccaucagcugaggucagcaguggcaaacauuacaaagguccuugguggccaaggcugaguguccugaugcugucguguaaauagaguuguguuaauaauaucccuuucagauuguuugugauuaauguauagaaaugcaacugaaagcugggcgcaguggcucacgccuguaaucccagcacuuugggaggcugaggagggcagaucacaaggucaggagaucgagaccauccuggcuaacauggugaaaccccaucucuacuaaaaauacaaaaacauuagccaggcauagcagcgugugccuguagucccagcuacuugggaggcugaagcaggagaauggcgugaacucgggaggcagagcuugcagugagccgagaucgcgccacuacacucuagccugggcgacagaccaagacucugccucaaaaaaaaaaaaaaaaaaaaagaaaugcaacugaauuuuguguacugacuuacuauccugcuacuuugcugaauuaauuuauucaguuuuuguggugaguuuucagggauuucuacaaauaugaucauaucuaugaacaaacauaauuuuaauucuuccuuucuaaaugaugccuuuauuucuuuuccauauucuuuggcuagaaagccacuacuauguuuaauauaauggcuaaaaugcgcaucuugcuuuauuccugaucuuagaggaaaagcucuuagucuuuucaccauuaugaugcuccuuguggguuuuucuucuaggagucuuuuucuuuguccuuuuauuuuuagucaacauguaauaauuguagauauuuaugggauauacacagugauauugugauacauguauauaaugugucauaaucaaaucaggguaauuagcauauucaucaacucaaauaucauuucucuguuuugugagcagucaaaauccuccaucuuucugugccuaauuucauuuaacauauuauccaaguucauccauguugcugugaaugacaggacuuaaugcuuuauuaugacugaauaauauuccauuguguauacauaccacauucuuucucugcaucugcugauggagauuuaaguugauuccauaucuuaacuguugugaacaguacugcaauaaacaugagaaugcaaauaucuuuuuuauauacugauuuccuuuccuuugagucaauacccgguaguggauugucaaacuguaugauagucuacuuuuaguuuuuuugacaaaacaccacaguauuuuccauaaugacucacuaauuuauagucccacaaauaguguauuauuucccuuuucucugcauccuugccagcauuuguuauguuuugucuuuuugaaaacagccauucuaacugaggugaaauaaugucucacuguggcuuugacuugcauuucugugaugagagauguugagcauuuuuucacauaccuguuggccaguuguucuauuuugcacauuucuaaaucagauaaucugguguuuuuugcuguugaauuguuugaauuccuuguauauuccggauauuaaucccuugucagaugaauauuuucucccauucuacaggauaucucuuaauaguuuauuauuuccuuuuauguguagguuuuuaguuugauacagucccauuugucuauuuuuguuuuuguugccugugcuuauaaagucuuacccauaaaaucuucgcuagacccauauccugaaggguuucccuucuguuuucuucuaguacuguuugcuucaggucucauguuuaagucucuaaucaauuuugaguugauuuuuuuauaugcugagagauaguauaguuucauucuucugcauaugauauccuguuuucccaacaugauguguucaacaugguguccuuuccccagaguguguucuuggcaccuuugucaaaaaccaguugucuguaaauaaauuuauuuacuucuggguucucuauucuguuccauuggucuauaugucuguuuuaugcccauugcaugcuaauuugguuaccauuguuuuguauacaagggggauugcuuccgagacccccuguauauaccaaaagccauguauauucaagucccagagucagcccuguguaaugcgcauauacaaaaugucagucaucuguauacauaguuuucacuuuugugaauauugcauucuauccuuguuagauuauggggaaaauccacguauaaaugaaccuauacaguucaaaucuauguuguugaagagucgacuguauuuugaugucaggcaguguagugccuccagcuucauucugccugcucaguauuguuuguccuauuuguggucuuuugugguuccaugcaaguuuaaggauuguguuuuugcuauuucggugaagauugucuuugguauuuuuuuuuuuuuagauuucucuuuucucucucucucccuuuuuuuuauuauacuuuaaguucuaggguacaugugcacaacgugcagguuuguuacauauguauacaugugccauguuggugugcugcacugauuaccuugucauuuaccuuagguauaucuccuaaugcuuucccuccccccuccccccuccccccccaccccacaacaggcccuggugggugauguuccccuuccuacguccaaguguucucauuguucaguucccaccuacgagugagaacaugcgguguuugguuuuucauucuugcuauaguuugcugagaaugaugguuuccagcuucauccaugucccuacaaaggacgugaacucauccuuuuuuuauggcugcauaguauuccaugguguguaugugccacauuuucuuaauccagucuaucauugauggacauuuggguugguuccaagucuuugcuaucgugaauagugcugcaauaaacauacgugugcaugugucuuuauagcagcaugacuuauaguccuuuggguauauacccaguaaggggauggcuggaucaaaugguauuucuaguucuagauccuugaggaaucaccacacugucuucuacaaugguugaacuaguuuacagucccaccaacaguguaaaagcguuccuauuucuccacaucuucuccagcaccuguuguuuccugaauuuuuaaugauugccauucuaacuggugugagaugguaucucauugugguuuuuugauuugccuuucucugauggccagugaugaugagcauuuuuucaugugucuuuuggcugcauaaaugucuucuuuugagaagugucuguucauaaccuuugcccacuuuuugauaggguuguuuguuuuuucuuguaaauuuguuugaguucuuuguagauucuggauauuagccuuuuaucagaugaguagauugcaaaaaauuucucccauucuguagguugccuauucacucugacgguaguuucuuuugcugugcagaagcucuuuaguuuaauuagaucccauuugucaauuuuggcuuuuguugccauugcuuuugguguuuuagacaugaaguccuugcccaugccuauguccugaaugguauugccuagguuuucuucuaggguuuuuacgguuuuaggucuaacauguaagucuuuaauccaucuugaauuaauuuuuguauaagguguaaggaagggauccaguuucagcuuucuacauauggcuagccaguuuucccagcaccauuuauuaaauagggaauccuuuccccauuucuuguuucugucagcuuugucaaagaucagaugauuguagaugugugguauuauuucugagggcucuguucuguuccauuggucuauaucucuguuuugguaccaguaccaugcuguuuuggugacuguagccuuguaguauaguuugaagucagguagcgugaugccuccagcuuuguucuuuuggcuuaggauugucuuggcaaugcgggcucuuuuuugguuccauaugaacuuuaaaguaguuuuuuuccaauucugugaagaaagucauugguagcuugauggggauggcauugaauuuauaaauuaccuugggcaguauggccauuuucaugauacugauucucccuauccaugagcauggaauguucuuccauuuguuuguauccucuuuuauuuuguucagcagugguuuguacuucuccuugaagagguccuucacaucccuuguaaguuggauuccuagguauuuuauucucuuugaagcaauugugaaugggaguucacucaugauuuggcucucuguuugucuguuauugguguauaagaaugcuugugauguuuugcacauugauuuuguauccugagacuuuguugaaguugcuuaucagcuuaaggagauuuugggcugagaugaugggguuuucuaaauauacaaucaugucaucugcaaacagggacaauuugacuuccucuuuuccuaauugaauauccuuucuuucuuucucccgccugauugccuuggccagaacuuccaacacuauguugaauaggaguggugagagagggcaucccugucuugugccaguuuucaaagggaaugcuuccaguuuuugcucauucaguaugauauuggcuguggguuugucauaaauagcucuuauuauuuugagauacaucccaucaauaccuaauuuauugagaguuuuuagcaugaagggcuguugaauuuugucaaaggccuuuucugcaucuauugagauaaucaugugguuuuugucuuugguucuguuuauaugcuggauaauguuuauugauuugcauauguugaaccagccuugcaucccagggaugaagcccacuugaucaugguggauaagcuuuuugaugugcugcuggauucgguuugccaguauuuuauugaggauuuuugcaucaauguucaucagggauauuggucuaaaauucucuuuuuuuguugugucucugccaggcuuugguaucaggaugaugcuggccucauaaaaugaguuagggaggauucccucuuuuucuauuguuuggaauaguuucagaaggcauaguaccagcuccuccuuguaccucugguagaauucggcugugaauccgucugguccuggacuuuuuuugguugguagacuauuaauuauugccuaaauuucagagccuguuauuggucuuuucagggauucaacuucuuccugguuuagucuuggaaggguguaugucuccaggaauuuauccauuucuucuagauuuucuaguuuauuugcauagagguguuuauaguauucucugaugguaguuuguauuucugugggaucgguggugauauccccuuuaucauuuuuuauugcaucuauuugauucuucucucuucuuuauuagucuugcuagaggccuaucaauuuuguugaucuuuucaaaaaaaccaccuccuggauucauugauuuuuugaaggguuuuuugugucucuaucuccuucaauucuucucugaucuuaguuauuucuugccuucugcuagcuuuugaauguguuugcucuugcuucucuaguucuuuuaauugugauguuagggcaucaauuuuagauuuuuccugcuuucucuugugggcauuuagugcuauaaauuucccucuacacacugcuuuaaaugugucccagagauucugguauguugugucuuuguucucauugguuucaaagaacaucuuuauuucucugccuucauuucguuauguacccaguagucauucaggagcaggugguucaguuuccaugucguugagcgguuuugagugaguuucuuaauccugaguucuaguuugauugcacuguggucugagagacaguuuguuauaguuucuguucuuuuacauuugcugaggagugcuuuacuuccaauuauguggucaauuuuggaauaagugcgaugugaugcugagaagaauguauauucuguugauuuggguuggaauguucuguagaugucuauuagguccacuuggugcagagcugaguucaauuccuggauauccuuguuaacuuccggucuuguugauuugucuaauguuaacagugggguguuaaagucucccauuauuauugugugggagucugucucuuuguagaucucuaaggacuugcuuuaugaaucugggugcuccuguauugggugcauauauauuuaagauaguuagcucuucuuguugaauugaucccuuuaccauuauguaaugaccuugucucuuuugaucuuuauugguuuaaagucuguuuuaucagagacuaggauugcaaccccugccuuuuuuuauuuuccauuugcuugguagaucuuccuccaucccuuuauuuugagccuaugugugucucugcacgugagaugggucuccugaauacagcacacugaugggucuugacucuuuauccaauuugccagucugugucuuuuaauuggagccuuuagccuauuuacauuuaagguuaauauuguuaugugugaauuugauccauuaugauguuagcugguuauuuugcucguuaguugaugcaguuucuuccuagcaucuauggucuuuacaauuugucauguuuuugcaguggcugguaccaauuguuccuuuccauguuuagugcuuccuucaggagcucuuguagggcaggccuggugguuauaacaucucucagcauuugcuugucuauaaaggauuuuauuucuccuucacuuaugaagcuuaguuuggcuggauaugaaauucuggguugaaaauucuuuucuuuaagaauguugaauauuggcccccacucucuucuggcuuguagaguuucugcugagagauccgccguuagucugauggguuucccuuuguggguaacccaaccuuucucucuggcugcccuuaacauuuuuuccuucauuucaacuuuggugaaucugacaauuaugugucuuggaguugcucuucuugaggaguaucuuuguggcauucucuguauuuccugaauuugaauguuggccugccuugcuagguuggggaaguucuccuggauaauauccugccuugcuagguuggggaaguucuccuggauaauauccugaagaguguuuuccaacuugguuccauucucccugucauuuucauguacaccagucagauguagauuuggucuuuucacauagucccauauuucuuggaggcuuuguucguuuguuuuuacucuuuuuucucugaacuucucuucucacuucauuucauucauuugaucuucaaucaccgauauccuuucuuccaguugaucaaaucggcuacugaagcuugugcauuugucacguaguucuugugccaugguuuucugcuccaucaugucauuuaaggacuucucuacacugguuauucuaguuagccauucgucuaaucuuuuuucaagguuuuuagcuucuuugcuuuggguucgaacuuccuccuuuagcucggagaaguuugauugucugaagccuuccucucucaacuugucaaagucauucuccguccagcuuuguuccauugcuggcgaguggcugcguuccuuuggauggggagaggugcucugaguuuuagaauuuucugcuuuucugcuguuuuuuccccaucuuugugguuuuaucuaccuuuggucuuugaugauggugacguauagauggaguuuugguguggauguccuuucuguuuguuaguuuuccuucuaacagucaggacccucagcugcaggucuguuggaguuugcuggagguccacuccagacccuguuugccuggguaucagcagcagaggcugcagaacagcgaauacugcugaacaccaaauguugcugccugauuguuccucuggaagcuucgucucagaggaguacccagccgugugaggugucagucugccccuacuggggagugccucccaguuaggcuacucgggggucagggacccacuugaggaggcagucuauccauucuuagaucucaaacuccgugcugggagaaccacuacucuuuucaaagcugugagacagggacauuuaagucugcagagguuucugcugccuuuuguucggcuaugcucuguccccagagguggagucuacagaggcaggcaggccuccuugagcugugguggacuccacccaguucgagcuuccuggccacuuuguuuaccuacucaagccucagcaauggcaggcucccccagccucgcugccgccuugcaguucgaucucagacugcugugcuagcaaugagcgaggcuccaugggcgugggacccuccgagccaggcgcgggauauaaucuccuggugugccguuugcuaagaccauuggaaaagcacaguauuagggugggagugauccaguuuuccaggugccgucugucaccccuuccguuggcuaggaaagggaauucccugaccccuugugcuucccaggugaggcgaugccucgcccuacuucgucucacacucagugggcugcacccacuguccuguacccacugucuugacgagccccagugagaugaacccacuaccucaguuggaaaugcagaaaucacccaucuucugcgucacucacgcugggagcuauagacuggagcuccuccuauucggccaucuuggaaccaccccacuuacugcaaucuuuaacucccaggcucaagucauucuccauccuugaccccucaaguagcugggacuacaggcaugcaccaccaugccuggauaacuucuuaauuuuuuguagagacagggucgugcauuguugcccaggcuggucuugaauuccugggcucaagcgauccuucugccuuggccccccaaagcacugggauuuccuuuuuuuuuuuuuuuugaccgauacauaauacuuaugggguacaugugcuauuguuacaugcaucgaauguguaaugaucaagucaggguauccaucacccucaauuuaucaucucuauaguuaggaacauuucaaguccucuuuuuuauuuugaaauauacauuauauuguuaaauauagucaaccaacucuuaucaaacauuauaaauuauuuauucuaacuagcuguguauuuuuacccacuaaccaaccucucuucacccuccagacauaccuuucacagccuuugguaucuauccuucuacucucuaccuccaugagaucaacuuuuauagcucccacauaugauaauaacauaagauaauuaucuuucugugccuggcuuaaaauaaugaccuccagcuccauucauguugcugcaaaggacaugauuucauucuucuuuggucaauuaguauuccauuguauauauuuaccucauuuucuuuuuccauuuauccacugauguacacuuagguuccugaguccauaucuuugcuguugugaauagugcugcaauaaacacggggaugcagguacauuuuuaguauacugauaucuuuuccuuuagauaaauauccaguagugagauugcuggauuaugucauauuucucuuuuuagguuuuucagaaaucaaacuguuuucuauaguauuaauuuacauucccaccaacaguguauaagaguucccuccacauccucuccagcauugguuaauuuuugucuuuuuaaaauagccauucucacuaugguuuuggcuugcauuucccuuauaauuacugauguugggcuuuuuuuuuuaaauauaccuguuggcuacuuguauguuuucuuuugagaaauaucuauccaugucuuuugcucacuuuuuauuggaauuaauuuguuguuuacuauugaguuauuggaguuccuaguauauucugguauuaguaccuugucagaugaguaguuugcaaauauuuucucccauucaacaggcugucucuucacucuggugauuguuucccuuguuguguacaagcuuuaucauuuaauauagucccauuugucuauuuuuguuuuugucuguguuuuugaggucuuauccauaaaaucuuucccuagaccaauguccuaaaguguuuccccaaugucuccuucauuaauagugauguuauaguuucaugccucauguuuaagucuuuaacccaucuugaguugauuuuaguauagcaagagauagaaacgguuucauuuuucacauggauaucuuauuuucccagcuccauuaagugaagagggugcucuuuucccaguguauguucuuggcaucuuugucaaaaaucaguuggcuguaaauacauggauuuacuuccagguucuacucuguuccauuggucuaucaguuuuuauuccaauaccaugcugcuuuuaaugcuauagccuuauauuuuuaaaucaggcagugugaugcauccaacuuuguuauuuuugcucagaauugcuguggcuauuccagcucuuuuuugguuccaucugaauuuuaggauuuuuucuauuuccaugaaaaauggcauugguauuuugagagagacugcauugaaucuguagauugcuuuggguaguauggucauuuuaauuuuguuaauucucccaauccaugagaaugggauguuuuuuguguguucuuuucaauuucuuucaucagacuuuuguaguuuuccuuguuagagguuucucaccucuuugguuaaacucauuccuagauuuuuuguagugguuguaaaagauaaugccuucuugauuucuuucucagcugguucuuuauugguauauagaaauaagccugauuuuuaaauccuguaacuguaaucaauuuauugaucagacugaagaguuuugauuuuuguauuucaugguaugaguuguaauauccccuuuuucauuuuugauuuuauucauguaggucuucucucuuuucuucuuggauaguuuagccacugguuauuuuguuucuuuucaaaaaccgauuuugcauuucauugauccuuuauauuuauuuaguuucuuguuuaguucugcucugaucuucguuauuucuuuccuucuacuaauuuuauguuuaguaugguuuguucuugcuuuucugguuccuucagguguaucauuagauuauuuaagaucuuuucuaccuuuuuuaauggaggcauuuauuacaauaaacuuuccucuuagcauugcuuuugcaguaucccuuaaguuucagaauguugugcuucuauuuucacuuguuucaguaaauuuuuuauuucugccuuaauuucuucuuugacccauuggucauucaggaacauguuaauuuccauuuauuuauacaguuuugaaugcuccucuuauuuauuuauaguuuuaugcuauuguggucugagaagauaugugauaugaauccaauuuaaaauauauauauauuuaaaaucauacuuaguguccuaacauauaauguauccuggagaguguuccauguacugaugagaagaguguauauucugcagcuguuuuaugaacuggucuguaaaugucuguuagguccauuugguauaaagugcaguuuaaauccaauguuucuuuguuaauuuuuugucuagaugaucugucuaauacuggaaauggagaauugaaguucccaagauuauuguguugaagucuaccuuucccuucagauuugauguuugccuuauauaucugggugcuuugguguugggugcauauauguuuagaauuguuauauccucuuggucaauugaucccucugucacuauauaaugacuucgucucuuuuuaguguuuuuagcuuaaccuuuguuuuaucugaugaaaguauagcuacuccuguuugguuuuuguuuccuuuugcauguaauaucuuuucccauuccuuucuuucaacuaugugucuuuacaggugagaugcguuucuuguagauagcauuuagaugggucauguuuuuaaguccauucagccagucugucuuuuaaguagaaaguuuaaucuauuuauaugcaagguuauuguugauaugugagggcuuauuccugucauuaauugauuucugauuauuuugugugcuuucaugaaguuguccuuucacuucuuccuguaagacucccuuaagcauuuuuuguagugccaguguaguggcaauuaauucccugagcuuuuacuuuuaagggaaauacuuuauuucuccuucauuucugacgaauauaacuuugcuaaguacaguauuccuggcuggcagguuuuugguuuuguuuuuucuuucagcacucugcguauauaaucccauccuccuggccuguaaaguuucugcugaaaaaucuguuagucugcagguuguucccuuguaagugucuacaaccucuuuuaucgcugguuuuaugauucucucuuugucuugggaugggcaauuugcuauaaugugcuguggaaaagaccuuucugaauuguaucuauuuaggguucugagauuccuauauuuggaucuaaaucucuugggagauugggaaguguucagguauuauuucauuaaauagguuuuauaaucuuuugguuugcucuucaccuucugggacacugaaggugucaccuuauggcauccuauagucacauagccuuuguucauucuuuucuauuuuuucuauauuuuugucugagucauuucaaaagacuuaucuucaaggugugaaauucuuucuucugcuuguuguggucuguuauugaagcuuucaaauauguuuuuuauuucauucaaucuauuauucaauuccagaauaucuguuugguucuuuuuauaucuaucucuugggcaaauuucucauucauaccccgaauuguuuuuucugauuucuuuguauagucuaucagaucuucuuuaauauuauauugaauuuuucaagguuucaucaauuucuuuuucacuggaaucuguuggagaauuauugcauuccuuaggaguugucauguuuugccuuuucauguuucuugugugcuuacacugguaucugcacaucugguguaacaguaguuucuuccaauuuuuugaucugucuuuccuaagagagucuuguuccugaagauauaucuaugguguucuuugggcagggcacuuugguuuugauucugggugccugcaguagugugaucuccauggaauuuuuuucagcuguaaacagcaccaguagugucugggaguuccucuguaguuuaggaugcaguuguugguggaggcugugguaaagucuggcuggggauagggacaccagcugggccaguccucaggccccaguggcagcaguggcuggccccgaaugcuuauccuugggcccaaugguaguguaugcugguaccaguguuagcaaguccagggaaaccaauuuugggccuccaggcaacuugcucaggugccaaugaugacagagcugggccacaggguggguagguccuugagcucugagcagcagauauggcuugggcaauggcaguagcaguggcagaacaaucuucugccucccaagguguccaugcugguauugggauggcugggauaagcuggaugagcuugucccaaggcccacagguggcaaauucaagugaaugccaguuguggugguaauggucaguuggguagggcaguccucaagcccccaggagugcucaggugccaacaauacuggauagggcagggugaucccuaggcccagagaugguaugcgcuggcacugggagaaaagagggugggaccaggccaggugggccuguccugaggcccuccaguaaugcaagaauguacugacugugguaggcaggcacaggaagaucccuguauacccugcugaaugcucauguuggggcagcagcaacucuauugcagcccuacuccuggggaaguugagugggauugcuuucaguggcagcagcuauaaacaggcaguugggcaaugcaugcuucggccccagguggugacuaugggcagggucaccuuuccucauggcagccuugcuucggagguagcagaguauugccaauggcucaugcuuuggccuggagggagcagucaggaguggcaaccagcuuuguguaagggauguccauggggcuccagggaugagauagagggauguggggcccacagcagaugcagucugguggggguugggcuaucaaaaugggacuuuccugaaguugccugaggauucaggggaugugugaauugccugaggauucagggugaucucccucucugggagcuguucauugccauuucacagucuguagguagccucuuguuagucucaaggcaucuaugggucaggggguucucugacuaggauuucaggagucugcugugggaauguggaccacuaggggcucacuuacuuaccuuucugcacaucgaggagucucuucaugaucccagccagucccauagaagcagacugccugacuccccucuuaucccuugcauuggguuuuucuuauuacuucucaguugaauuccagcauucucucagaggcgaucuauauaaacugugguuaccuacuugcuauauuuuguggaggaggugagugccagaugccucuagucagccaucuugaagccccugcugauaucuggauagggauuucauagcaucuguauauugcuauagguaaauaugaucauuuuaacauuuuucuuucaauccaugagcaugggaugucucaaaaaauuuuguagccucuucaauuacuguuaucaguauuuuauaguuuucauuguggaaaucuuucaccuccuugguuaagcuuugcuuuuuuuuguagcuauugcaaaugggauugcuuucuucauuucucuuuuggcuaauuugcuguuucacagaaaugcuacugauuuuuugggggaggcaggggagugcagacagggucucacucuguugcccaggcuggggugcaauggugcaauuucugcucacugcaaccuucaccuccgagguucaagugauccucccaucucagccuccugaguagcugaacuucaggugcaggccaccacgcccagcucauuuuuguacugaugagguuuugccauguugcccaggacagucucaaacuccugggcucaagcaauccacccgccucauccuuucaaagugcugaaauuacaagcaugagccaucauguccacaccuacuaauuuuuguuuguugauuuuuuuauccugcaacuuuauugaauuccuuuaccaguucuaaaagauuuugguggaaucuuuagguuuuucuauguauaagauuaugccaucugcaaaggacaauaugacauucucuuuuccaauuuggauacccuuuuucuuuuacuugccuaauuguucuggugaggacuuuucuuacucugcugaauaagaauagugaaagugggcauccuugucuuguucuaguucuaagagagaagguguuuagcuuuuccccagguggcuguggguuugucauauaugaccuucauugaguuauguuccuucuagacauuaugugaugagcuuuuuuuuuuaucaugaagagauuuugaauuuuaucagaugcuuuuucugcaucuauugagaugaucauguauuuuuuuguccuuccuucuguuaaugugauguaucacauuuauugauuuguauauguugaaccauccuugaaucccugggauaaaucccacuugauuaugguguauuaucuuuuugaugugcgauuggauucagauugcuaguuugugugucuguguguguguuuuguuucugaggauucugcaucuauguucaucagggagauuggccuguaguuuucuuuuuugcuguuauuguguccuuaucugguuuugguaucaagauacugcuugccucacagaaugaguuagggagaauuccuuucucuucagucuuuuggaauugucugagaagaauucauguuaguucuuuaaagguuugguagaauucaguagaaaacccgugcaauccugagguuuucuuuacugggagacuuuauuacugauacaaucucauuccuuguuauugcucuguucagauuuuuuuucuuccugguucaaucuugggagguuauauauguccaggaauuuaucucuuuccucuagguuuucuaauuguugacauauaguuguucauaauggucucuaauaaucuuuuguauuucugugguguccauuguaagucuccuuuuucauuucugauuuuauuuauugggucuucuugguuagucuagcuaaugguuuauugauuuucucuuuucaaaaaaucaguuuuuuggcuggguuuguuggcucacaccuguaaacccaguacuuuggaaggccaaggcaggccgaucgcuugaguccaggaguuugagaccagccugagcaacauggcaaacccccaucucuaccaaaaaaaaaaaaaaaaauuagcgagguguggugcugcacaucuacucagaagcugaggcaggaggauugcuugagcccaggaagcagagguuacagugagccaagaucacaccacugcgcucuagccugggugacagagugagaccgugucucggggggugggggggaggccucauuucauugaucuuuugucuuuuuuaccuuuuaucucuauuucauuuagaucugcucugaucuuuacuauuuauuuccuucuaauuuuagguuugauuuguucuugcuuuucuaguuccuugagaugcguuuauuagguuauuuguuuaaaaacuuucuaccuuauugauguggguguuuauugaaauaaaugucccucauagcacuucuuuuguuguacccuauacauuuuuguaugcuguguuucuauuuucauuuguuucaaagaauuuuuaaauuuuuaaaaucaauuucuucauagacacaguggucauucaggaacauguaguuugauuuccguguaucuguucaauuucagaaguuccucuuguuauugauuuccaguuuuauuccauuguggucugagaagauacuugauaagauuuugacuuuuaaaaauuuauugagacccguuuuguguccuaacauaugguauauccuggagaaugugcugugugcuaacgaagcagcaguucaaaucuaauauuuccuuguugauauuuuuccauccaaaugaauuguccaaugcugaguaugaaauguugccaucccuaacuauuauuguauuggggucuaucucuuuagcacuaauaauauuuguuuaauauaccuggguacuccaguguuguugguugcauauauaauuguuauaucuucuugcugaauugauccauuuauaauuauauaaugaccuccuuugucucuuuuuucuuuuucuuuuuuuuuuuuuuuuuuuuuuugacucaguauuuuuugucugucuacuccugcaugcuuuuggugucuguuuguguggaauaucuuuuucuauccauucccuuacagucuaugggugucuuuacaggugaagucaguuucuuauaggcagcauguaauuggguuuuauuuuuuuaauucauuuagccaguaucuaucuuucauuugggaaauuuaaauuaccuacauucaagauuguuaucaauaggugaggacuuacuccugucauuuuauuguuuucugacugauuuguauacuuuuguuuccucucauuguuuuucuuugcaauuuuuugguuuucuguagugauaaucuuuuauuccuuuuccuuucucauuuguguaucugcucuacuaguguuuuaugcuuuuguaguuucaugaugguagauaucauccuccuacuuccagauguaguacucccuuaagcauuucuuguggggcugauuuaguaguaaugaauucccucaguuuuugcuugucugagggaggcaaaauuucuucccucauucugcuucauuucugaaggauagcuuugcuggguauaguauuuguggcuagcaauuuugugagcuuuuccccaccuugcagcacuuuuaauauggcauucaauucuuuccuggccuagaagguuucugcugaaaaaucuguuaaucugcuguugauucccuuauaugugacuucaugcuucucucuuguuuuuuaaauucucucuuugauuuuugacaguuugaugaaaaugugccucagagaggcccuuuuaggguugaaucuauuuagggauuugugagcuuccuuuaucuguuagucucuuucucucccaaacuuuggcaguuuucagguauuaucuucuuaaauagauuuucugguccuuaucccaacacuucuucuggaacucccaaaaugugaaauauuguuagcuuaauagugucucauaugucacgcaggcauucuucauucuuuuuuauuguuauuuuuuaaaucugucugguuuauugcaaaacaccugucuucaaauuuagaaauuauuucuucugcuugacuuagccggcuuuugaagcuuucaauuguauuuuuuauuucauucauuuaauuuaucaccuccaggauuuuuguuugguucuuuuucauaucuaacucugcuggauuucccauuuagauaaugaauuguuuuccugauauguuuguauugucuauuuguguucucuuguaucucauuggguuuccuuaagauuuccuuuacuuuggagucuauuauuggagaauuauuguguucuuuuggcaagucauguuuucuuguuuuuuuccccccaaguuuuuuguguccccaaguugauaucugcauaucuggaauaacagagacuuccaauuuuauggaguagccuuaguaaggacuuuuccuguacacgcgucuguaguaucauuuggguagggugcuuuggcuuugguucugguucagugcagaaguguggugucucuacaauuaauuagacuauaauccacaucagugguaucugcaaguucaucaguggcuuaggcugcuuggugcuuaggaugucugugaaggcaagaaggcuccuuagagguacuuacuccucuauuuuugcugauguugcuaacuaccuucaaacuuuuugacaaagcauuuuaagccucuucucugauucuguaugcaguuuugcagugcugggcaggggacuagaaugcuauuggaauuuggcucacuuugcuacccacaggcaauuugaagguauucuuucuccuaauacugcuaacagcaugggucaugugguuuuauuugcacuuacugauuuuaugcuuuuaggggaggaugagugagaugauuuauagucagaggggaugaggagcagcaugcuauuuuucuccaagccuggcugaaagucuuuuuuaaauuauccuuuuuucuuaguaccccuuucuaaucuaucaguaugucuuaucaacucucuggauuugcccacaccuagucucuccagcuaucucccugguuaaaaccaccaccauuucucugccuacauuguuguccauaccucauuacuggucucuugauuuccacucuugcuuccuguacuccauucuucacauaacagcucaagggaguucuuuaaauguacaguggaucuugcugcuucccuacucaaauguuccgacagcuuccugucacccugucuugugucagucucacagcacacacagcuuaauucaggaauuaagcugugcuggucacuuauugagaaagagcuucauggugggcagcugggaagcugcacagaacacuccucagaguucuacaagcggcugagagagcugggguauuuaucuuucacuagugagugcugccccggugguggcucacuuuccauuccuuuuggccugcccugugugcagcucagcaagugccugaagucagagguagugcuuaugaaaguaucuggugggcuugcauuaagaagcugucagugugaagaacgugaaugcuaagggcauaugagugugucccugagaacauggauauuguguucuuuaccuccaugucuccagugccugccacauagcagguccuccaagauuugcugaucugccugccccaccuggggucucugucucucccacagcucacugacauuagccacguggcccucuguuuccuguaauaggccauuuccuaaguaagcaucauccucauuucuauacguuuucucugauuacuggaaauuccucaaguguugaccauuuugauuccugggccccuuaagaguccauuagcauuggaauggagcccacaggaccauaccagacagaugccaccacaucuuuucuugaaguaguguucaggcugagggggucauagccgagggucccucuggggccgcuugcucuccuccuacucacagcccuccugcagccagcagcagugggggagccaagcugaguugauuacuuuugacaucaguuguuaacauaauuuugauguugagccuccccccaguucugggguggcucugacuguguccaggcuccaauuugagaagcuauggggagccucucggccccaguucuggccuggcugggagguggccugggaagggaccuguguuucucaagcccgcgcccucggggccuggggguggggccccagcagaugucuggauuugguagccagggccuggagccggaugcugagaaugaggccugcaacucauuuccccauuaaacauucugagaacaucugcaccgguuuccaaggcuucucccucacuaauugcuuugauuauugugugaaguuaagaacuggcacauuuccgcgauguugugaugaaggugaaaagaucgcucuuaauuagauuaaaaacauuuuuuucuuccuguguaauuuugucuugaaaaucaaggccacuuuuuuguuuucuccauccaaagaccuccagaaacuuuccuccccaccucuccagagguuucuggggaauguccugugagcucaacucuuggagaagauagugcuuaacccagauuccauuguauauuaaaguuuccuagggcugcucuugcugccuggaaccuuccccugaaaaugugucuugggagaccuagacagugacuuccugcagcauggagacccgggugggucgauuuuaguuguguggguggcuguguugcucucuuuccguuuccugggcucacucacgcucaggguugacccuguccuggcucugucacugccugucuuccucagcgcccccgcuacucagaccccacccuugggccugcagagacauuuccguucacucugagauuuguguaugcugaggcuugcuauacuuauucuaaggagaaguguuugggguguggggugugguccucaguauccuaaacuuagguuuuggaaagcccagcauccucccugggacuucucaggauuccggaagucaucuuugacugugucacaucacugucaugcuugaggcaaaucuauucugcacaccuuugauccaaugugagauccaacauguuccauaauuugcaucaaacauccucauacagcaggguguggagagaggcucacugaagguuuggggagaugaggacuugcaucacagcaguagaaagccaaugucccaccuuaggaaaucccuuuccaagaguucccugugcuguugcagggcuagggccagggccuuggccucaggccagcuucuuucccacaagccuucucccugcccucugcccugaaaacuagugggggcagugcagaccaguuuagcuauuuuguaaccuugacugcccccaggcccauguccguaggcucacaccucacccccaacuuugucaugcacauuccugaagacucucuugguaacaaaugauggaaccccaacucaaacaagcuuaagcacaaaagggacauuuuuuggcucacacagcuggacccagcuguuucagacacagcuggaccccagagcugagaugaucuugcucacuugcucucacucuccccucuugcacuccccuucucccuucccguucccucuuuuguucucccuuucccuugcucucuauccauuggccccaugggauggcuguauccuuaggcagcuacuuucuaaaaggggcaaaauggccaccagcuugcauucaacagcucaggaagcccagcagaacgaggucaucucuuccaggauuccugccagaaucuaaggccagguucuuauuggccucagcugggguacaagccauccuuggaccugcagcuguaccuccgauggcugaggcaagguccacagggaccccuuuggggauggccagaggguaccuaaacacugcacacuaggagugggaaaggaagagcccccuaaggaagauuugagaagcuguucccagaagccaggccuggcugcuggcaggcaaaaacaacagguguccacucaagcaagguauuuuccuaagcggaacugggugccagcugugaauauacauuuucacuccauuccucgccuuguuccuggcagcuguugugggaauggcuuuuacacuuuccauccaugucccuuacuucucgccucugaguggagacacaggugguggcggggccacucuggcucagggucuaugagccgggcaugggcagcuggcacaggcuguggggcugcggcucagcaaugucacgcagggccuggcugcagcuguccggaugccccuggggagggcuucuccuucacagugcaggauccgcagggcuuuggugaauccacugagagggggagauuucuugagggggccagggagggggcuucuacuugcaaaggauagggagagcuucuguucauccuugugaaguaggcuggcucagggaacucgccugugccaaacccuggggagacaugggugaggcagaaggcaagguucccgugcugagcgccaggcacacauaagcccugcagccguacaggggagggggcaaucuccggagcccuggaaagcuuguggaagagggcuuggguuacaccugggagauuaggccggauuuuaaucaaucaggaggggaagggcagggggugagugguugggugaaguuacuaggaagggcccagacacuggcgagagucucuugagggcagagggcagcagagaugggcuggagcuuugagcuuugucauaggcuggacuuggggcuugaaugcugaccuaaucugggcagggaggggucuggggcucgaugagaaggcagaggaagugagaccagaauuucuugggaacagaaagccucaaagacuuucaugauaggagagcucuauguagccucaugggcagcuccaggccagguggagggacauauucuggcaacucuaggauaagaugugcaaggucgugggccagagagcaaggcacagauacaggagacuuccacaaauuauuguuucuugacuuggaaaaguaucaugcaaaauagaaaacacagacacaauaaggaaggaaaugaaaaucacccaaagacaaaguuaacauuuggaucuguuuccuucuagucuuuuuucugugccuguauuuuuaaaaaaauaaaauucaaaucccccuaucgagcaggaccacugacuagaaaggaggaugcugugcugaguuugauuccuguucucuugagagggugagacuuggcagccagcguccccagcugggguagucgccacgcccgaggcugccuuugccaucccagaccucccacuuuccuagaaaacaaaauuguuuuguucugcccugaaaauuuaggcccagauccuggccuugacaaagcaaaggcagccaaagaauuaaagcaucaaaaaccaggacugucuuaggaaagugugacuucauugucaccaggaugcugugcucuuuguccccagggccagccacucuaggcaguucagcaaagggcaccuggcauugcuccgguaccuccugcagagccuggauauccagaugaacugcccuuucaaguacaccaugggcucaaccuucucugcagcugugaguucaggcugugaaauacccacuucagaggugggggugacaagcaagaccuguuagggcacagcacuugcccucaagcccuggccugaaagaggcagcaccagugugucuggaaagagcugaauccccacccacccacccccagcuccccuccaugcucuccuagaugccugaccuggcuacgaccacaggugaaaacagggaagagguggcagcucuggucacugccucccugugguggagaaagcacgccccacagucuccaacacacaagccagcagacaauaaccucuccucuugaauuggaaaaacaaaucuguggaggccuucucugccccuuguuauaggggccccauaugccguucccaggauuaaaccaaaaagcacacauuccucucuggcaggugcaggucccacccacucugggcagccaacugaugugcacauuuuaauuuccuaaaacaccaggacagaaccuuccucaggggucagguggcucacccuuggcccucaggcuuuggagaugggcacuugucaucauggguguuuggaaagcaacucuacguucuagccugugcuccaucguuccuucuacauacaagugaugcaaacaucaaaauauguuuuuucuuucuuccuuccuuuaaaaaaaauugaauccuggaugaaguuuuagcucugucacuugacaacugcauuauauaaccuaggguacuugaaucucagccccaaaucucuaaaaugggggcaguaacaugcuucugccaggucccagaccugugggucuccaaaucugcacauucuucaagccuuacagguccuucccuggucucucuaaggaugucaugggcacagagcccuuucacucugagcccuucuccuggcugugacuaaguaaugucugugugguuuccugcuggaagucugccacucgcccccacgggccaugagcuccugaguuuauuuacauuucccugauugcuagucaggcgcaacaccuuuccacaugcucaucagccuuuuggauuccucuuuugugaugugcuacuuugucuauugcccauuuucuauuaagucauuuauauuuuuccuauugauuuguaggaguccuuugcauuuugugggcacugucuuuucacucuuuaagguguauuuugaugauugggucuuaacucuaaugucaaauuacucagucuucucucucaugguuauugcuucuuuuaaaaaaaaccauccuaaugcugaugucauuaagauauucuucuauauucagucaugugaccuuuauaguuaugcuuuucauaguuaggucuucaauccccuagaaugacaagaaugaauuuuugguauaugaugugagguaauuaaggguccaacuuaauguuuuuccaguguggguauccaacugcuccugaacauuugauugaaaaguccaugcucuucccaggaugugcaggccaccucugauacacagcaagcuuccauauuugugugggcuguuucccaaugcucaauccugucccauuggccuauuugucucucccugugucaauaccacauugcccuaaugaccacugccuuggaagaaguacugauguuugguacagcaaguucucccaccuuguucuucuucaagaauauugccaauucuuggcuuuuugcacuuccaagucgcaguuagaaucagcuugccaaaguucucacacagaagccuugagauuuuuauuaagauuuggagagauuuauucagauuuugagauaaucuuuucaguauugagucuucuagucauuggaaugaaggcauauuucuccauuuauaucuucuucauugucucuuacuaaaguuuuacaauuuucuccagaguucuugcauauacuuaguuagauaauuaauauucuuuugugcuauuguauacagguucuguuuucucuuguuaccucacauuuuuuauuuacagaagagaaacaaaaauaguaccgaguacccacaucccuuucaccagcuuccccuaauguuagcaucuuauauaaccaugguacauugaccaaaacuaaaaaauuaacauugguacacuauuaagcuagaguuauaaauuuauuuggauuuccccaguuuaacuacuaauguccuuuuucuguuccaagaucccaucuaggaucgaucauuacauuuauugucaucucugaucggugacgggcuucucagucuuguucuucauuaacuugacacuuuugaagaauaccagucaggugucauugucccucaguuuggauuugucugguguuuucucaggacuagaccaggguuauagguuuaggggaaggaggccagugaggugagaugcuuuccucauuguggaacaugacaucaacaugguuuaucacugguaauauuaaccuugagccacucguuuaaaguggugucggccaggcuccuccacuguaagugaauagcuguuuuucccuuuccauagcuuagucuuuagaagcgagucacuaaguauagcccacacucaagguggggaagggagggguucaacucuaccuccugcaggagaguaucaaaaaaaaucugcaaauauguuaaaacuaccacagcaauuaaaauacauuucaaggaagaaacugugaaguuucugaguuucacuaacuaauuucagcauucauucauggaucguuuuccugcagcaaauauuaccgugauguacuucuauuuuccucauuccuucuacauuuuuuauuuggaauuccuuuauaaggaagauuugucccucuccuccaauuguuuauuuaauuuuaucaguguggauuugggaguauuuauuuuuugaguuauaguccaauauuauuuauuuuguugcucaaauuguucaagcuguggccacugguggguucauguguccuuuugaugugccccccgccauccuuuucauuuauuuuuaagcauuucuuuucuagcacuugacaauacuucaggcucaucuuuuauuuucccuacccuagcccuagaaucauccauucauccagagagcccuggcucccuggagaaugaauagaaaaccuggaucuaggcacgggguaugcucguggcuacuaggguaucauugcuucagucuccucucaguggacagagcuaggaaauauauguauguauguaaccugaguacacauacaucuuuacauaucuguaucuauauaaagcuaaccaugaguucauacugacauuucugaccagaguucauccuugcccccucccccacaacuuauuuauagcuuuuucucugacagcuagaaaccuggcucccauuaccuacaguucauuuacuuauuuguguaacccuauuguacacguaguacccuaugugaagcaaauuuaccuacuagauuagaguguuuaggacagacuuuugcuuuaaccauagaguguccagucaaaacaguguuuuugaaagcaacauaugccagcuccuccuccuccuuuccuuucacugcuaugucauuuguuuguaacacgcucaucauagucugcuuuucaucguaggguccuccaacauccggguuaauuuuuuaaauuugcauacaguaaaauccacucuuugagauucaguucuguggguuuugacagaugucuggagucauguguccacaauccaguaucauucacagaaguuccauaccccuaaaaauacccuggggugagucuuuugaagucaaguacuucuccccuaaccacuggcagcuauugaucuguuuuaugucccuguaguuuuguuuuucuagaauguccuauaaaugggauccuauaauauguauucuuuugcaucuggcuucuuucacugcuuagcaaaaugcauuugagauucauccauguuguugcauaaaucauuaguuaauuucuuuuuauugcugggugguauuccauugcaugaauauauacauuuuguuuaugcauucaccuguugaaggacaucuucauuguuuccaguauuugguaauuaugagcagaguuacuauacacauuuauguacagguuuuugcgaacauaaaaauucaauucacuugggugggaaaggaaccgauaggucaugugguauguguauguuuaacuuaauaagaaauugcuaaacuauuuccuaaagucacugugccauuuugcauucccaccaguaacauaugagaguucuacauguuccacauccucaagagugguugguauugucagguuuugaauuuuuuuuuuaauuuauggaauuucauugugauucuaauuugcauuuccauauuuauguuaauuauguaucuuuucaugugcuuauuuauaauccauuuuuaaaauuggauuguucacuuuauugucaaguuguaagcauucuuuauauauucugagugcaaguccuugaccugauaggugauaugcaaauauucuuuccaagucugugcuuugucuuuucauuccauuagcagugucuguugcacagcaaaagcuuuuaauuuugauaaaguccaauuuguugauucuuuuucucuuacgaguuaaacuuuugguuucguauuucagaauucacugccaaauccaagguccuggagauuuucucuuauguuuucuucaagauauuuuaugguuuuauguuuuauuuuagauuuuuuuucaguaaguuuguauguaguacccuuuaaauuuucauuuucuaauuguugaucaucuguccuaucaggcauagauacuaaaugcauuaaaacuuuuacacacauacauauguauacauacaacacauucaaauagugaaauuaggaauaaauuuaagagagaauuguauuacgcugaugugggaaaaccuuccuuuuuuauaaagcaaaagauguaucacuuuaaaaacauaaaacauuuucuaggauaaaagcaacauaauucaggugaaaaaacagacuggggaagcuaucuaugccucauauaacaaggaguuaaugucuguaauguauagaaaauuccuacaaagugauaagcaaaagugagcaaaggacaugaacaggcaauucugcaagaggaaacccaaacagaugccaagcccauaaaagguauucaacacagauggaaauaacagcaaugccucaguuuucauccaugcuugauagucccugcaaaaggugcugacaaccuucauucgggcuucauucaacacuucauucaggcauggaugugggaaagcugggggagccugaauugcuacaacuucuugggaaagcaaucuagcaacauuuauuaaaauuacuaaggacacacccucucacccugcuccaguaugucagcuuuuaagaauaaagaugaauauggcaucauagucugaauaauuaagcagcuuaaaacuauaagagccugaauguccaugauauacagaaugguuagcuguggccaaucuaaacuguggacuauuauguaaugacuaaaauaauuaaauccaugccuauauaccuagagaaaaaugaaaugagcuuauguuacagagugacaggaacagagucacagugacaucccaugugcauaaaagcaacucccaccuggcaucugcugcucggaugagcagagagggugggcuagggaucuaguuggcaguuaacacugaugaccuugggggaggaaagccauugugaaucuuugaauuauuccacuucucacagaugaguacuuaauccuuuugcaauaaaauauuuaaaugaagacaaauauaagccaagagcaaauacugauagugucaacagagaguggggagugauaaggaucaguauccugagcuccugugucaaaguugcagaggugggcccaggaaucauaaugugaagccagcuguuggagggacuccugugccucauuggggguacaacugguugauguagcaucguguuuugaggaaggaguucuguggcugcccccaccucccaggcuugccauuccucaugggucagagguccuaucaccccaucuuuccugacccacuacucugucaauguaugagugugacaauguaugguggugggagcuguugucccuuaccaggccugugccugucaccucuguuuuauucuugacccaagugucaguugugaacaugggaagaggcccagaaccugagguggggagagucuuggacaccugagcacagccccaggcacaguuaccacuccgaagaugauucacuggccuuuauucuccucagacacugaggugucaggcacuuuggggccaucuuaaacacccacccaccccaacacccaacuauaaaacugauugucagggcuggagcuuccaggcacaagcuccacuccucaccuggcccugggagcucacaggccuggcuccacagcacuggcagguugggugggaggccuaacgugcuguccccacacuuucuccucaguaaggaagagcccaacacugcuggaagugagcaugccccauuucaugagaaccaacagcuucgccgaggaccuggaccuggaaggggagacucugcugacacccaucacccacaucucacagugagugccuacaugugcgugaagggcugggcuggaggggacuggagcucaaggagucagacuuggugcuggggaagccuugcucucuggccagagugcuaucuacucgccuagugcccaccacuugccgucugccuggccccaacacggaggcaccaggcaagagaggagagcaagggcacuucccacugagccugggaacaugauccucuuguuuugacuuauggaaaaccagacugaucauuuuccacuuguuuucaugcuuugagagucugagauuguuuuucucucccccagcccccuccccugccccccaaaaaagagacgacuuuguuuuuuagcauuuccccauggaacccuggccaaagccauggggcagaugccgggugcagucugccaguugcugcugcuguccucaggggcuccuucagguggaggaaauggcugauuuuccacgccuuccaguuggccuuccccugaggcacagcuggccugggaugcaugcccguccucccccgccgucacggcauggccaggccaauccccggugcccggccacggugugauuccccugcgacaugugacuccccgcuggggugcccagcggugacagccgugcagcggggucaguggggcacccaaguccauucuggccacagucccauucuggcugcuaacccguuggggauuccccuugauaaaugucuuugugucaagaucugugagugacacucgcggcccuucugagggucacuuguggaaacucuccuucucucuaccaacauuuuucuaaaggguguuuuguucuuuggacucucugggggucaggagguuguccugagccaugugugucuuugucguagugaggcccugggccuccugccuuugcagccagccaggugcaaggccuggccuugcaaaucacugaggaaaucgggacccauggugcugggggcugcagguguaaccagagaacuggcaggguuggguagccagaaugaggccaccuccagggaaggaguggcuaucuuaagggguaauuaugaucagacaggaccugcccacugucuuuccaggcccccccaguucacagagagguuggcaguaccucaugguggguagggugugaagaggcuccaagggagccagcagaucacuggaaagcaggggugacuagucauggacacccugagaauagggcucugagcuucugggccccuccuggcuggguaaaaaggcaggagcagaggugugagcaggcugguagccagaugggcugcccagguacaggucagcaccagaaggcagaaugauggcuuacacuguggccaaggccuguaccaaguccuggauaugauggaccuccaaagugaucaguguuaguuuaguggcucauguugugugcaauacagguggcagugccuguauugccucuuggcuguccccucagagaggggacugucccuucucauccuucuggcugcuugcuucuccuguuggagcucucgcucaccuugguucucuuggucacggaccagcauccagacaugcaaaaaguccuacugggaggagagggccaucacccacaguccaucuagcugggcagccaggccuuaccaacucuugggucuugcaaggccccugcaggugaagguggugagagaccaggcacuuauguggaucacagccaaacuugcagcugcccaguaaaucaccacuaugggggugagggcugccagugcugguaucagcacaugccaagcucccuggagccagagguuacccaccugcccaagggugaccccaagccaguguggcugugucaucuaggacacugggcuguuucuuguuccacuccaggaugacagggccugagagaccugaacauccauccccaagcucucugcccacuuugggucuggcacauuaccauucugcaagauccugcagccuuuucagguuggcacucccauggccuccagugauaagugggcccaggcaggucagagacuccagucauuacccaaccaggucccugcccuguaacuuaccaaggccucucucagagcaggcuguuccaaaaguggcugcuagauaugagccagccugggaaggcaggaaggagcccaggcauggggcuuggggugagggaucugaagaggggacugggagagggaaaaacaaggagguugcugcaaaggggccaccuugaggcauuguguucuggucagggaagacucagggcugaggcuucaggggagcuggguuccugcauccucagaagucaggguacggucccuccagagaggccugaaggggagagugggcacguacagugucagggccuaggaacccaggcuccucugggauacaggcuggguagaggccccacuccaucugggggagaaggcuggcagcagugggcacccuguuuccucagggcccaaaccgccuggcggcaggggugugggggccgugcaggucuucugcccgcauuggggcugcauuccuccaccuccugcacagcccgcccagugaugcccauaauuaaauucggcuccagcugcucagggaugcagcgaagcuccugugggcagccuggccccauggacccugaacugggaagagaggcacacgcccuggugugugugagggacagggaugugugcuggggucucacagggggcagagugggugggaggcaguuaccaaaaaacauuuccauuuuucuucagcauucuacugauguuaaauguauuaccaugcugggccaguuccagaauucaaauuaaaaacauaaauaaagacacauuuuguuuccaucucgagcucuccccgcccgcagggccccagagaggugaggucacuauagccuugauuacgggaaggucccuggggcugggcgaagcuccucuuuccggggccuguuagccagaggugggguggggggugagcaggccugaugcaagcuagggagucaugacaagcugaggcacgggguacccaggagauaaagaguggcgucgcugcaccccagccuauaggugggcccuacugcucagccucaggacccucaaccagcucugggcggccaggacucagccucgaacacaccuuucaggcagaagcugucuuccuagguugaauggggcacaagagagucccugccagccucaaacucccugagccugugucucccacccagaaccauaugacagggcuucugagagaaaggugggaaguagagacuguaggccugcaugggcaguuggggagcacccccaugacaagaggagcccuguaccccaagagccaggaugaguuccugggauucugacccacucacuauccucugcucaccaagggucacuggcacgacaguggguggggacggugccaugccugugugcaucccugugccuugcgugugguaaccugccaucuagaaugcccuugucacccaucugcagccaccagauuuccauucaucuuuccaacgucugcucaguaaaccccccaggacacacuuaggcuguacggcuguguccuccuuuggcucucaaagcccucaguaccaguucccuaagccuuucgaauggugccaggagggagaagggcauguauagcccucuuggucucuuccuccccagaacccccaaagccccaggcauggagaagcccuaggauugcugcucacucaacccugccuaagaugaagcaaggacugcagacacauugugccagugcugaggcacagggcuaggggccugaggaucugcggcucugaacuugggggcugugugcagguguggccugggugagcuucuccaagcaacccugggaggcugaaaucauuuuugugaaauccucccucacacugcauccccaacugccaagccagccaggacuggccuggaauucacacgucugccccauugguugcacauggauaccugagauagacggcccaagaggacaggcccauaagcccugcagccuauggcucugcccagcccagucaugugguuucucugaagggccccugucucuucuguuuuggcaucuuagaugggcaagccccagcucgagguuaacagauaccgcccucagucccacucuccagagggacacucagggagcacccggcccauugagaugggcaugggggaggaccaggacccccgaggcugggcagaggggguggaaagaaggcagagggaaagcugcagagacccccaccaggugacugugagcaccucccuggcaagcaugugcuugccuggccucuugugacaugacagcuucgcaaauccuugagcaaaaacagccccgugugcguuaauuagaauuuccaugucuucaacuuucuccuggacccugcagaaucucacgccaagacauucgaguugcucuuuuccagcaaggccgcuguggccuggcuuucauccacaucacuacuaaugucuccugaauucugcauuugucagcaaggacagggccagucugugcugucuggaaauaagggcaaacgucacaaggguggccccaaauuuggcuucauggaccaaggggcuagcucuuuugaugggaccagcuuggccugggacauuuuggagacauccagguccacugugaccuacucccacagaccccaggguaccaggcacugcagcucugugagugucuaagcuccucaccauauuucucucccuguaaacuuuggugggaaaggacagaaaggacauucugggaaccaguguccagaaggaugagugaggggcuugucaagaacagaugagaccauuuugucuuucuagaccaguguccugucuucugcaaagcuccagaccaccucugucugcacgagaugccaaggaagcccucugggggcccgcccgggagggcuguacagggcugcaugagucauaggauccccgucagagccccacauagccccagccaggcucaaacccgucucugaaaugcacggggggauuaaauguucuucuaauuaaauuaaaaccgaggcguaauggcucagugggaaagagaugggauugggaaucagaugcccucaaucuggcuuccagccugccaucagcccagcuguggcggccccccguggcccccuaaccuuuccaaacuucacuuccuccgucugagcacgugaggaagaagcggcuggccuagggcugcugcuauggggagagggccgcacugucuagguggauggcccagaagaaagcagugaggcuucucauuuccucugcaagggaaaggccauccaaaucacccugccccagugcacucuggccaggcucagcccucuccacuugugaacucccagccaugaugcugcucagguccucagccaagcagaugguguuggaggaugugacagagagaacauucacgccacagagguggcuggagggcaaaggacuucacaacugcacugauauugucauggagacacuucuggcaguuggggcagggggucggggcgggguugggcggggggcacaucccauauagaucucuugugugcucugcugauaccugaaaggggagauugaacugcagagccucuggaggcugaagcacggaggugaccuagucaggaagucuggaagccguguccccuuaagugagggagugggauggggcugggccuagcggcccugaaggccagggcuauccaccuaauuaggcucaccugggcuacccugguauaggguggugguguuaaacuuuuaguuaaaggguaaugugcaugcacacagauuaguacacaggucucaagugcgcagcuugaggcaucuucagucccugggacccaugugugcagcacccggaggaagcaacagaacccccagaaagccucucaggcucccauuuccugucacugaccuugagauuaaccacaggccuaacugcuagcagcaaggaccagcuuugcccacauuugaacuuuaugcggugggaaugaugcaacucauacaccuuuguguccaaugucccucacucaauuugaugucuggcagccucucuauggggcugaagggagagugcucccucaugcuccuugcugacuggugcuccauugugugcauggccuacaucauucauccauucuaccaccuguggccagcaggcaguuucugguguagguugcuguuuaagaauauucuguacaugcuuuuggugagcaucagguugcguuucuggggaauauaugccuauguguggagcugcaggguccugggugggcauauguuuacucuuagugaauacuacccagcagucuaccaaaggagucauuccaauuuucauucccacaggcagcauucuggcugcuccacauccuaacacuuggcauuuuccgucguuuccuuuucagccaugauggugaaugucuagcagcaucaaauggugauuuuaauuugcaguaaccuguugacuaaugaaguugagucccuuuccauguuaucauuuagucagauacaucauucuguauaaauugccuacaucuucugccuguuuuauguuuauuuaugguccuauauaucuuuagauauucuggagucauuugucagagagagagauacacacacucacacucucucacagacacacacauugcaaauaucgccucccccucugcaggcugccuucuuccucucuugauggugucuuuugaugaacagaaggucuuaauuuucaugugguccaguuaaucaaacauuuccucucuggauagggcuguuuguguccuauuuaagaaacuuugacuacuccaaggucauaaagauauucugguuuauucuaaagcuuuauuagcucaccuuucccauguagaucugcacuccaucugggauugauuuuuguguccaaugugaggccgaggucaagguccacucuuccccuacuuggauauccagucuagcucagcacccggcaugggaaggcccguccucucccaacuacccugccguaucagugucuuuacaaucagcucacuggcuacguguggcucuguuucuggacccuauugggugccacuggucagauucaaguuguucuuuguggccaggaccuugcuuccuucucacuguaguuugcuaacagguuuugacagcugguccugcuggcucuggcugcuucuccuuccccaucacuggcuuugcugucuuugcaggguuucuccucaccauacauaugccaguugccauggaaagccuccucuaggcgcagcagccucuagaugggcaugggagaauggguauccuuauaguuuuggggcuccugaaacauggcaucaugugucccuuguuuauuuagguugacuuucauaucuuuuaccuugcccuguaguuuucagugugguggucaugaacagcuugucagauucauuccuugucagcuaaugguuugauguauguucgcugaauccagggacaaggucugucagggagcccuggccagcuugggucauuucauccugcccacaggacacuggggcagucaccuaaucucuaucagccucaguuuccucuuguauacauugggaguauaucucacaguauuaguguaaggccuugaggagaugguguuaggcauccagccacauaccugacucggggaaaugccugaaaauauuagccagcauagaaugucucuuugugaugggagauccuguggggacauuccuuauuuggccugagagcuuuugagacugccaggucaugaguuaccaugggauacaaauggggucacaacauauggcugucagcugcuguccuuaauaagaugugccuagaggccugagagucccaagcuccaggacagucuggagucagguggagggaagggaagucuagagguccccaagucacaaccucaaaucucggaaugggguucaggagcuguuggggucccguggagguacaggcggaaaccuagcacucacuauucugcucuggggaggggguuggaggcagaaucaguggacugugucucauggcagucacaggugccccaguaugcaucugucauuuguucuuaucacugucgggcccaucugccaaggcaagcacccacauuaaagcagagugaagagcagggcgagcuguguagcucaccugccuuugacccugcacaugacgggcgagggaagaggaccaugguagcuugucucuaggcaacccauaggugcccaauggagagauaaucucaaauaugguagcagaguucagacucaguggcuuucagaugguuaguauaggcugaaauuccaagagcauuaaccagacaccuacuauguguauuucuuguguugggguuaggagauacugcuguuggcugagacacacagcccacauccuugguaggucccucagagagcaucuagugggccuguccucccagcucacagaaggggaaauugaagccucaagaaggauagggacuugccaguaucacugggagauaggagcagaagccagggcucauucccagacacacaaucucugggggagccuggauaugcauggcagaggccaggaugaacccugaagauugguaggaaggcaguguagcaguaacaagacaaagggauucuguggcccauggagcaggagggaacagucugcagauauuaucugggcacuggccaguggcucuuguggcugcccucugcaauaagaauucuucaaguucagccucuaugugcaucauaaaccuggugccaccagccaaggaggucaaagguccucacuggccagugggccacugggaagccuccuggauugccuggacaaggcugaccugcccucccaggaugcaaauuggcaggcccagcuucaugccuucuuauggugccccagagccccuggcuaggcauucaugcuuuagauaugugggcccuguuagggacaacguagguguccugggcaggggcuguaucugaggcacacauccuugguagugacuggcuagcaggaggaagucuggcaguuagucugagcaguuagucugucaggccugguuggucccaugggaggccugaggugccaucuuagaaauagggccuuguuaggagaaaaggaaagaaaaauaaaagguagagagacagagguagacaggaguccaggucugaccucaaaauccgauguccccaccauccccagccccuuagccucugaucuucuccauaaguaaucuuuucccauguguggcugcagccucagaggcucccucugaagaugacacugggaauauccugaaaaagguacaggaacaccuggcaugccucucccaggguacucuggaugugcacccagagauucucccacuuuagcaggcagaagagcaacccagcaggggauauacacaaagaucugagaaagggauuauuuuuagggccaauucaagggauuuuucaaagguuaauuuugacucugccugacuuaucuccuaagucuuuggcacugagcauuuauacaagaucagacugcacugcacccuaaguauaaaccuugccacagcaguguccuguggugcccugcuggggaaacugaggcagagagcaggggugacuuugcaaggcaauagaggguacuugggaaguagggugguaggcaaggcuuuucagagaacaaggagcuacauacacauacaugcaugcacauaaucauucugacccagucaggguucuucccccaaauaaaucccugcaaccccacugugguuauaggucugagccuucugccccagggagccaagcccuggagaggaggugggcagcaccaggcagccagccugugggccccgcuaugcuuccucaggcagcuagucucuguaucugggguagaaagagugggcuaaaaagucagcuagcaccccugacuucaaguccucgaguguauguugggcuugucucccuacccuggcccggucugcacucaagcccaguauccuccccuggucccuggucuggacugagcagcugucuucugcccacaggggaccuuucuucucccaccuaauccucccucuuugggccuuucaaaguugggcuuguuuuucaguguuuucuuuagguucauguccugauuuguuaaguuaaauugaauuccuuccaguccaaaauacucaaaugcuuuuuucugcuuuucuuuuugaacugccccacgaaccccaccagcugggugugugggcuccaggugggagcucaagggggccugguguggugggugcagaagcagugugguggggcagccuucacaggcugauaugauugagcucaggcugguauggguuaggggaugagaguacagaacaguccaccccaggggcucugaagagcuucaauugagauauccuucccuaagguccccacauuccauggcagugccuaggagcucugugcucccaggccucuccauuaccagccugucuuccacauuggaagguggccuuaucaaaccacauggccugaauuuugauugggaaagcaucccuguaggugucaggugauggaaggacucuggguaaauggaagcacugagaccagauaugauaggaccuugcccaguggacacagccagcugauggcagagccaaggccagaugucagguuccagacuccaaguucuaugcuuuuuugcugguccagcauggccugucuccuccccgcaacagauccaaccaguccccuucagaagggcuggaccaagugaccccaacucuggguucugccugggcauuuucuugagugucauacccuagccaccugacugucaggggagcaguauguggcacuugaggccuugggcuggccaugcaggcccaccacagguggcaaggaaucaugaaccccagcugaguccccugcaggccuugccuaaaggagaagccagugaaucaauguguuacuugaacaaauauagggucuagggcuggccaaaagggacagugaaguuggcuucucaggccacaguaggccuucacgguacucagcaggagaccccagcaggcagcaucagggcaggggugcugaccaucccugacccaagcacgaggaucagaaugggcccuggagccaaggccaaaagccgaacugugacuaggcaagcugaguccccuguagauucuggggacugggugaugcagacugcaaagccucagccaccuucuccccuagaagaaaucuugagagaaacaaucccacaggcuaccaggccagcuuuuggaaacagucucauuagcaaacaaagggaagugacagagcagagcuccccuuggccuuuguuuagcccaccuucugccuaggcaccaggccuggagguuccaacuugguguugggccuccuugagccggaacaccugaaaagccauacagacuccugcucaucacaaccacuuguugaugcugacagccuguagaaagauugcucucagccuauccccucccuggccaugcagguggaagacccuauuacuugggcuaaagagaagcuaaacgugaccagccuacccaccuugcuacugcugaugaccacccugacucaugucccuugucugcauagguguuuuccuauaaauguuuaauuccugagguugcugaaucucagggcuuggaaggcccagacuggacaggggaagggguacagucccuucuugcugguauguugggaagcucuggugcaaagggcagugauggcccuucaaucccaggcccacaagcaccacagccaggagagucaagguuggauaugaagagggacuuccugaaagcaggcacaggaagggaugggagcucagcucaccgggugcuagacaagggagugugucucuuuccccaugagugacagcagccacaaggggaugcccagcauugggggugggguggggggagggcccuccgugcuuucuggcucuuugggccuggggugcagccccucauuuguacuugcuggcugccccaugggggcuugggcuaggucucccugccgguggggagggagguguggaagcugguuugccggggccacccagugugggcucaggaagggaaggaaugugaccaaggcuggguguggcuggggagagcacagccaguuguggguuuuucuuggggcccagauagaugugagcagagcuggaggccccucucucccagcccccggcacacacacuaggaccuuucuucaucaugcagccguagagcuggaggccaaggacacccucuggaaaucugaauuccauucgcucuuggcaaagagcagcuuccugcuuagggaaggugcaugcgugcgugugugugugcgcgcccgcgcgcacacgaccacagaggcuggggggaggcacguggggaggagggcugccugucgagauguguaagauggccccaguguuacuaggcacuagauggcacuugcaaagcccauucggaggauuuagacaaauaccucgagugagugaaucugaagcaugcuaguuguguugccuuuuaaauaggcucuggcuuaaaacagucacagcgaaacaugccuuugaauuggaaagccagaacuuuuugcaaaauaauuugaaaaguuuguugaaccuuaaaccuuuccugaugacuccuuccuucugaacuuaacucguuaaaguugcuccaaucccagcccagugccagaccagcuuccuggaaacucucgccaacugcuggccuuuggaaaggcuugucacccuaauagcuguuuuuuaaaaaaaaaaaaaaaaaaaaaaaaaaaagcucacugggcaccuuggcugcagggucugaaaaguccuuuguguuagcuccagcugcagaguuuuuccaggccucgcuucuggggcugacuggagcuguuucucuucguuuccucuuacaguggcgggcacucagccggcuucuucccgccugacuucucugccagagcccaggugggggacggggaugccaagggcagagccccuggagaggcuagugugggcauguccugaguggacagaccugaagguggguucacuagccucuuucucccauccuucacccuauuagagguagugcucuagcggggaaagauuagggccccucuaggucaauauugugucauuuccccagaauagccagggccaaaccagcucccaagcaguacuguuucagaagugaagauaacucaccucucccaaaagcagaguuuuggcaauauaaaacaugaaagugggaugggaucuaagucauauuuuuuuaaugaguuuaaaacacgugugugcauuagaaaacauuuaaacacagauauugggcaaauuaauugaaaaauauauugucauuuugcguuaaaauaaaagaugaucugaaaauggaaaaaaguuacauaaaaacguaaauauuucaugagacauagcagucacaacaugccauacacauuucuuccagaaucacuccacuggaaauucuguaauaagacauacguaacaguuucacuuccuaggagaucccaauugcuccucagauaggguggagagcaccccuuauuagagggugguugggcucucuaggagcccgcccagggccugcccugacucuggcucugccuuucccugucaaaaaccucuuugugcuggagcagccccugcuccacagagugacaugaaccagagacucacagcacugugugcggggagcugcugcccgcagggcauaccagccacgugcaugcagggcugcacacugcccuaccgugcauccacugccuggccaacaccugccuucuggggagccaaucgugcuuuauguauucaaggguugugcuacaaaaaucauacaacagucuuuacacacaugguaaaaccaauucagaguacaaaaggggugaaaaauaacacucuccccacccaacccuaauucccaaguuuccuucccuaaagguuaccacucaacacuuuccuauugcaucuuuccagacguauuuuauauaaacaaauauacgugugucugugugugcauguacuuaguagauacggcuccuuuuuauacaaaugguagcauacuguauguauuuuucuacacuuugccuuugacuucuuccauagguaugccauacuucuuuuugagcuguacauacaaugcugauuuauuauggugcaguacaucugagaagcauuuuuauugcaaaauguguguuuacauguauacagacacacgugugaacaggugauggcucugaacaguguaguugaagugcuguuuucucaugguugggcuuccaguauaauuggaaggagcauagucucuguguucagcuagagauuuagcccaaugggcugggcuuuucccagauaggacaugcucacuguucugcucagauuguuagcuguagucuuucuggcaucaguuccauuucuggugaacacuuggacuuggcaaaaggcauagagguagugguacaggaaaggucuaagaaggcuaaggaccaucauacuggguauucaacagccagcucuccaaagaggccucuaagaaauggguagcuucacagauucacagauagauaguucauuaaggucuugaguauuuccaagggagcacuaacuggacuacagccuggcaggagauaaccaagucauaugcauaguggcuuuggguacgauggucugcuguaugaagcaacccuaggacauuugaagagaauggagugauggccaguguauugugcugggaucuaccacaggggucauguuguaaugacaccugucagcuuugacuggggagcccuuucauuucuuaguaaguguucagccccagugugcaccacuuaaaaggaagacacugguauguucuggagauggaucuguauuaagacaucuagcaaaucuccuuuucauuaacagcugcagaguuucauugugccaugauuuauggaacagauccucuguugauggauauguagggcagcuaaaaaacagcagccauuaaccauucaaauauauucacuacugaaaugaccacuuaugaaauuaguuucccugaaacaucccucccuauugaacacuguuguuucucccuauccaucuuaucccuacuuguaucucugcugacugaccucuuuggcugucucuugucaaccaaagacaauauaaagcacacacaaaguaaagaggaacuuauaaagaggaacuguaaaucuugucaaaauaggagauuucaucaaguuaaagaaaaugaugucaaaugauuucucaaauagagacugggcagaguagaccaguuaguuaaucaguugaagaggaaaccaagaucgaugccuagauaagcauuucagaggacagcaggggagaugauaauugaugcagguggccucuuggucaagcagugaaaccaugccauacuucuacaaaaaaugauccucucuguggaagugcugccaacauccucugccaaguauaaaagaugcccucagauguuaccauauaaugcuuuacaaaagacaaaccaaaauccccucuggauuuguuuuuuucuaaaacguguacauaauuguaacucuaacaacuguuauugcauaugagauaaaauaauauuuuaacuacuguuauuuuucaaauuaacuucccaaucaaauaucucuauuguaaaauuuuggucuccguuuucaguggauuuacuuuaagagauccucccuuuccccccauuuccagcaggauuaaaauguucauuuauguugugauagauacugccaaauaagggcuguaccauuuacaucacuuugacugcacaaaugcacuuucuucccccacccuuaccaaguguauacucagguuuuuaucuucauucauuucauagaugagaaaugguacacuggagcuuuaauuuacauuucuuuuguuggaaaugagguuuuuaucuuuccaaaugcuuaaaaucauuuguuuuucuuucuugugaacuauuucuucauacccuuuggacuuuguaaaauaccuugucuuacugauuuguagaaacuugcuuugucauauucauugaaaauauuuuauccucauuuuccuuagguguuuuggcuuuuucuauaauauuuuucugguggcagaauuuuuuuaauuucacauagucagcugugucagucuuuuaugguuugagguccuuaucuuaaauucugaaauaaccucucauccugaaauuguuuuaauaaauucuuccauguuuucuucuaucauuuuuuauuucauuuuuuacauuuaaauccuugcuuuaucgggauuuugacagaguaauuaaauccaauuugguuucccauauauuuguccaguuguccaacacuauuuauuugaguacaucaucaucucucuacuaauuucaacugcuaccuuuaucauauuucaaacucucauuuaauuuguguccauuucuagacucuauucuggacugcugaugggccuguugauaggccagagcucaguuauuuuaauuauguaacuuuaugaugcacuuaucuguguagcaggacucccccucaucuccauuacuuaagagccaauaaugggaagcucauuuucacaaaugcagucaaccaggggaauucauggcauggccuaagaucuaaacacucuuaagauuuaaacacaggauuagcucuugaguuagacaggaagcugggguguuugggacugaggcuucaucguggcagcuaauaaugucagggagcaugagcacuuguuucuuccaaggcucacuucaaggaaggcagaauccaggucgggggugcacaggaguugccagcuggacccaaggaccauuucguauacauguaugaucauacuuucagggcaucuuggaaaaacugaauuugcuaacucaauagagaacaaaagagcaaauaggccuaauucaagaauuuuuaaaaacccgcaauaagaaacauaaucuaaaacuuguagcccagccccuccuccauaccaaccaccaaaaaaacccacuaacaccauaaagugucauagcuagagcuagagugcuguuauaagcugugcaggccaaaaugguuucauggcaugaguugggcagcagcgacucaguuuccaugucugaguuaggccaccuguaacaaugcagccccauccaugugaagcugguccagaggacuacagcugccugucccacccuuggcugugcucuccuuuacuaauccauagccaaagacaggggcuaauaacagggucuggagucugaacucauauccuaauuccacuacuuucuaccugcuacaccuugagugagucacuuagucucaguuucuuuauuuguaaaaugggaaucauaagaguaccuuccucagaggguuguuaggaggauuacacaaauuaauaauauaaaguaugcagaaaagugccuguccuauaguagugacacaguguuacuuaaauguauugcuauaccucaugauggccauuccauccauuguaaucauguguaccaugcaauucacagugccugacaaagcugauggggaggcgaguuggaaugaauaguaucagcaucagaaaaaauacaagugcauccucauaagauuauuuaggaugcauaggaucccagauuagauuuuuuuuaaaucagccguucucuguauucuuguccagaugcuguggacagugaugaugggaaaauagucccugcugcacacuagggccuguuaggccaguugagggcuagaggagcacaaggggccagacugcugcuacuucugaauuuuauaggacaugcauuuuuuucauauaaacuuagaacuagcacgccuaauuuuuuuuuuauuuuuauuuuuuuugaggcagagucucacuuugucaccuaggcgggaaugcaguggcacagucucggcuuacugcaaccucuaccuccuggguucaagcaauucuccugccuuagccucccuaguagcugggacuacagacaucugccaccaugacuggcuaauuuuuuuuuuuauuagagacaggguuucaccauguuggccaggcuggucucaaacuccugaccucaagugaucugcccgccucagccuccuaaagugcugggauuacgggcgugagccaaugcaccuggccucagcuugccuaauuaaaaaaaaaaaaaaaaaaaaaguugucuaucuguguguauauucauaucccauuggcauuuguuauugaaacuucauucaauuuagauuaacugaugaagaauugccuuccccaccucaaaaaaaaagucuuuccagccacaaauagaagcaguuuacccacauguucaaauccauugcaacauccuuccauauuuuuuuagaucuuuguauggauuuuggacauucuaaaauucauuucuggguauuuuuaggaggacuacugauuuuuuuuuaauuugggcauuuuuuaaaauaaauuuuuauuuugagauaauuguacauuucucaugcaguucuaagaaacaacacagagaaaucuuacauacuccuuuaccuagucucccccgauaguaacaucuugcaaaacuguaguacaauauucugaccaggauauugcauugauagucucacuacaggacauuucuaacucuucaagaaucccucaugucccccuuuuauagcuacccccaauucccucccacccuacccuguccuuagccccugacaacuacuaaccuauucuucauuucuuuaucauuccaagaaaauuauauaaauggaaccacauagcaaaucaccuuuuugggaucggcucuuuucacucagcacaauucccugaagauucacccagguuauuguguguauccuugcauuuugguaugacccaauuuggguuuguauuuuuaaagcugauggacacuauuuacuaguguuuucaagauugcacugaccaucauaggugaaauagguauguguucuuuuauuaugaaagccuccucagauguggacauuagugaaaugugggcuccaaaaagagacuuuggaagauuucacuaaugaugugguuauuuuuuaaauagaugccccccaaaaaagcaccuaugaaaaaauucuuacauagcaauucuacuucugaaugcuaagaggguuuggaaaaagucauuuuugcaguguuuguguucuaugaagaguggguagaaggaagcaggagaguauuccugccuccccaggagagagcuucacuuucucccuauaccuuccuguccuaccagcccaccugguucucugucucucuccaacugugaccgucuuuuccuuguagcucccugcucacuccauguggaggauggcucuuggggcuggggugacuaaaggcaaagaauggggaucccugugacagcucuaggggauuuugggaccagauaaccuuaauggccucaggcucccuagaugagaaaugggacuuaguaaagucaaacugguccagguuaagccagcccaugaugccuggaaggaacuuacccuuuucuagaguaacuucccuuuucaggaaguuucuagcuugcuugcucacucgcucuccccacccccacccaaccucccccaaccuaucucucccucucucaggagaaggugcucccucacccuuaaagaccaggcugccguugcuucccaugugucuguuccucuauucaguauugugggcacugaucacacaccagggcacugugggggcccugggaccugggaggaccagaauggguacagucccugccuucucagguuauggucauaucauccaugcuccccaaacaucaagguacuccaaaggaggcccagcacuaccaucuagguggggagaaaacacaccggccauaaugaacacacguuuaggcugaagaauaaucuucaaaugauacuacuacuuacacuuccuguuugccaggcaaauauagacaucauuucacuaauccucacagcagcuuuuaacacaagaauauuaucacuccuguuuuauagauaaucuccuaaggguugagggauugagucuagggcccagggucacaaagcuagggagccguggaucugcaggagaugucccagcucaucaaauauucuuucaguauuaaacauaucaagcucucuccugaccuucucuccccuuccccaggccaggacugucuuauccugugguucuuagcugaaaugucccuuccucagaggagccaauuucuaaagcuuaagacugggcuguaaaaaaucacauaccuccccucccauucuuaauguguaacuguguguuuauuugugguaaaggguuuacuggcuggcuccuucuaucacauucaaggagcaugaggguauaggcuggcuguuucuauucaguguuuuaucuucagugcuuaauccauauggagccugucacggacccucagugaauguuugacgagugagugagugagugagugagugagugaguacuugugcccaggucaaaccaggugcuaggacccuggcagggguuccauaaggcuaugcugggguucaggcaacccaaggcuggucuggagaguguaaggcuugagagcucuucuucaggcucagucaucccugcuuccccagggcucauguccacaugcuauuguccauagaagcugggguccaaaguugaccagaauaucucuagucauaaagaaucucuuccccuugagcccacucaucucuguugacauucuagaaaugcagggaaaucugggcaccaugaaaugcagugacuugcagugauccuccuggggccuuguauagaagagaccaucucaguuuuguagaccaggaaacugaggcuuggggauagcagauguucccagacagaaaaugguggcaccuggagaggugcucaggucuguguggaagaaaggacaggaguccuucugccacccagacugugcauucagacaucucccuugugcugugcagccuuaguucugccuccugagagaggugaccuucucccacuucuuacaggcaaggcucuugcuagccugaggaccaggagccuucagauuuucuuguucccaggauauaucgcaccaacucaggaggguguggggaugggcuagcauuaggaauggguauuagcaucugcauuaaaaggcucccacugacagcucaugcauugugauggaacuagaggugagauacagagcaggaguccauggcaccuccagaaccugucagccugaguaugggcaauggcguuuuaguuugcaaaaccagacacauagaggccagguuucccccgcucaacacuaggccacugugccugccacugcugucugcaaaugcagguuccuggggcucugggugguuuguccaauggcuaagcuuuccccaggaauggguaacuggaaaaauguaggaauuacauaugauuccaucaaugacaguuuuccuauuaaaacauaacuuguuaaagcauagagcuuaguucagaguaaacauuucuaaaaaagagguagaagccccuaccuacugacuggcaucacaaacacugcccugaaaugccaacucauuucaaauacugcucuagacaacugggcccugcaucugcugcaaggaacaucccuuacuuucccaucucaauacaacugugaaaagccuagccugggacucaggccuuuccuuacucccucugguuaccuagcuuuagcucugaggcagcccagaugacaugggccucuaaggcuggcugcucuuacucuauaccccaaaaucccagccacuagcuugcagaauggcuuuguuggauuccccucccuggccccacacucacugcuacaucucucuuccaaaucauaaaugcaaaagauggccaaaggugcaugcucugugacacguuucauagucagacaaaaccagcugacugcuuuuacuuuuuuuuuuuuuucauuuagaagaauuuccuuggcaacuccgucucuccuuagucaacaucagcuaacuucauccucccccuuuaucaagacauuguuuagaguaaauaauucauuaacugguacagcaauuucagaacccuuucacauagauucuuaaggggaccguuucccuugaagaaugggguacaccagaggacuuaggaagagaagcgcccacuggggcuuggucagacucugccaggagacaggcagcugucuguuaacugacccuacccaguaccuucugggauuggauuaacaaaaggggaguugguuaggcuggagcauugcaacucauuucuucccugcagucucucuccugagguggcccagguauguguuugaggccugggacuugcugccagcaugagacaagcuccagugggguccaucccccugauuccucagugccccagcaccaccucuuucauuugaaaacguguucuuuuggcaaaaagacuaugcuccagaacuuucuggcugaguucuccuucuauuccuccuauuccacuguuagguguuggaaaagcaauauauuugaugcuuucuccaugucccauaaaugacuuucuggcagaggagagugacuguccuuugucuguggcccuggauuugaggcuaagccuuccuugaagaaggaacaggaaagaaaggcuuguuggaugugcagggagcuaguggccaacugagcacuugcucaggcggaggggccuggagagaacccaggguaggucugccugggagaaaagggguaagggaggacugccucccagccuucccuccccacuggucugggcacauuccaaggcuugaggucuccuagucaaggccuccuguuauuggcuuccuccagggagucugcugagacaaaaguuuuagauucuuucacuacaucauaagguagguaaguuugugucccugauccaugcagcauguuaucuuuguaccugguaaggagugaaauggcuuccaauuuuacggacugguugcuuuucauucauaucuucuugccaucccugucucaugggugagcacauuuccuggauuuaaaauguaugggacagccugugagaauuacagauuccagggaaggggcccuuuuggcacggggggucugauggucagagcuaaucagguguggaagaagcugccuggagaggauccccaucugcauggaaugcccccuucguggggauggcuggcacagcucacacacggaggcacuacuucaguccucccauuaccaaacuccagggcacacgugccacugugucuugcccacaaacaugcacacagaguaucgaucugucugauguuucagggacccagccaugucauggaggguacaugggcagguaccaucucugccugguacaugggcaggggauagauguguuuccaugggucuccuucacauagaauugucaccugaacgagaagcccuuauccagaagcccagugcaacucccaucucacaggccaccagcaaguugcucacauccagacaggagacgcuaguccuacaggugcagugggaggaucugcagaugacuacagcucuuggcccuuccauacagcacaugacaggaagcuaggaggguugcagcuggcuguugccauuccacucaggguugaggggacaagcccacacagguaccagaaguucaggggucccauguggacuucaggccuucggucugggaccccagggagggugcucugacaguccgccgaaauggccagcaggcaggcauccucccagguggcagugagaaagggcccugcacagucagcguuccugagaaugcgauuccuacuagaacgaggcuguuucccaggcugccuccugcuucacccaggacucagaccacaacuagacuagggaagaacuuguucuccacggaugagccugaccaaguucugggcccacucucccauccuccugcugggucacacggaugaggccuguacacucugggccucagacuccacaccaagaagagucaggggggcucacucuaagccccgccagcucgcaccaucugauggggcaggggcaggggaaggacagggccagcauugaguaggccugaguugauggcaaaguguaggccuuugcccugucucgcccccuugcuucugggguuugcuucgccuuucugagagcacagcaaugccuacucauccugcccaaaacccugcuccaaccuagcugugugaccuuuaggccuugggauagcacacagcaaaugucugccaccccaguacugccacuggcuugggaggccagaccacagaccacacuagugucaccuggcccgucccaccuguuccaagcugggggaggaguaugcucacuugggcuuaucagcagagccaggguaccccaaccccugacuaggauauuguggauaccuaugcccagagccccuccacugccaaguuuccacaauuguuuugaaauaauucccaacagauacccccacccucacccaguguugagucucacucccgucacggaaaugacagcucccagcccugggcaaugugcuccugcaaggacagcuguggugacuagaauggcagcuuggcuacuagcacuuuucacaugagcguggcugcccucaggcccaggcugcacagagcauggccgcuggaucaagugugggucccaguuggaugacaaacccauguucaaggcugggaaguccuacucggccccacuucuacccaggaccaguagcuuucaauuguaaaugugcauccccugugauacacuaugaugcacaagcagccccugcucaccccuaaagagcagcacaaguaacucagagccacuguccccucuggccagaggcccugguuugugucugcccagugaccagccugaagauagaggcaacccaauccagguccaugcaggucuccgugaugcggagcaugcccagcuuaccauccugaugcagaggcaaggacaacacugggcccugacuugcuaagaugggagcaagagcuuagggcuaaaacucagcagucccagcucugggggacaaggacccacaaagugaugcaagauauccugaguugggugugacaaguacaccuugacacacaaacugcacagggaggggaggaaucugagccagcuuccuccacaaagcacagaagucugccaaaagcccaggcuggauagggagcaucacacuguugggaaaugugcaauuuucacucagccagcaucacuaccagcuccgggcuucucuccucuggccucccaccuugcagcuuugagaucccaggccucucagggcucuggcugagggcugugagccagaggcugagguagccaggucugccuugggcugucacucagggcugagcucugcugaaggaucugggaggucaguaggcaccuguguccacccagcuguccauacagaucccugccugcacaagagcugcugcagcauuucaauagggccaucccaggcacccuaggacuugagaccagccuccucuguauggucccuucccuggugcaccuaccacagcccacucugaugacccccugucaaggaggugugacugagaaaggaaggggcagagaucccuucuccauuccucucaggccccuguaaaaauugggaccuguccuugccagccaggucucagggagcucaggguucaguguuggaaugggucugggcccagauuucaagccaguaaccagcaaaucauggggagacugagaagaggagccccuuagcaggccuaaccacaccccuaagccacccagccuggccccccuccucugccccaacuggcuccaggccaaacucugguuccugaggagccucaaaggcuggacuuggggugucccgcggaaauccuggugggauggaaaauccccagcaguugugaggcugcacuucucccacccgcugugggucagccaggccgcugcuuccugcuucccuuugaugucuccucgugcgagggaggggucagcaccccucuaggcuugggcaggcacacacuccacucagcugcagccauggaguuggugcuucuagggccuggguaugcuggagucaggcaggggaccugguggggguggggauacaggcugagguggagagaccccacgcagcucccuaggccucugcagacagcucccaagcaagggggcaggaggggcugcacugagcccaccaaagguuguagccacucauacagggcuguuugaucugagagggaggcgccaugaccucuguuuagacaaggaaaaugaagacucuggaaaaucuaagcacgucacacacacagcuuccaugggggucuuccucucgugucuggggaacuuccccguagagguuucaauaacugccauccuuugcugauccucuguguaggcacugggccccagccccugccugugccaucacuauuucacaggagaacaccacacugaggcucugccucugguugcccugcucugggugaugagguagaggucacacagccaggccaguggcccuagugucaagguuccacaccacagccucauagcagccagugcucgcucacugaggccaggcacucaucuugugcugugccugggugagcucuggaccugccuccuaaacauagggcugccugcuucguucauuuccacacaccacgugccuaggcccagcuggggcuggcauacaaauuggguggcccggcucugagcugcugcugguuacuguggcaguuuccaccuauaccacaccuauauacuugcccucccccacacacagcccaccuggcccaucccacaaagagagauggcacuccagguggagagggcugggccagaggucaugcagcaaggucagguuggaagcugagguggggcuagggccaccccacacaggccugucucacaggcugucacccacugggccuagggcucugagaguaggggucugaucuggagagcaggggagccugcaggucccuggguuggaauccuggagcccugggcugcaggguuuugaggggcaguuaccuccuccuccccgguggcacauccggccuggaaguuggguagucuggcccaaggccugcccuggugugaaagccugagacccuaaggagagcuacagguggcucaagggccugcuccuccuccuuuucugugcaaacagcucagcuugcugacuuugaugcagugguuuaggccaagcuuugaagucagcccuuggaggacguuccuaucagccuuugcacagauaucucccacuccaacccuaagacucaaugccaccucaggacugccccuauccgcagagcuugaggccuuuaggucagccuugggaagaggugcuugagugggguggaagaagcccacucuugggaaauggggagcauaggggaggaggaagacacugccuuggaaugacacucccagagaccucugcucugccuaccugcauucugcugaagguuuugggucaccuuguuuuauggucccugucccagcaugaagcuugcacaggaagaacagaaugaaugauguggaaaucuguuagcaguggugucuucuagauucucaaggauccggguauuuuaggaacaaaacaagccagcaggugcagaggucacaagccuccugagagggccagggcagagugaguagcugcaggggcagcuguccuuugcaccugggccuagagugccagagacuuagucucauuuguuuacaggagacugauggguuccugagcagccuaggaggggaggggaagcacugcguucucaguguggugcuuggcccucccaggugccugguuguggccugccacuuagcacccaccccugccuauccagccccaucccuggggaagguucccaccugcuccaacuucugguacucccaggcugccucacccaacgaugacagugacuagccucagagccuggcugcuuggaagaccuuugcccaagcagagaacuguugaggaaggugagccuuccgagggccagcccugccucuccuccccucuccuagccugcuucugucugggcugaaggcacagcagggacaaucgcucuuccgggguuagaacugggggagcagggacaaaaagcgggcagcccuccccagcaugacaggauguggaaggcuggucucuccagagacugggcuaaacucugcugugucaagugccuggugaccucaagcaagucauuccauguggcugagcugcuccuugcugcaucugcacauauguguagugucuuccucccuguaggauugucacaaggauuaaaugaugucaagucugaggcugcccugcagcugcuguuuccacuacuuggcauggaacaugugccagaccaaaagagcuaucucucucccugcgaaaggcugggguccugggagcuagagcuggguuaagauaagagcagagacuggguccugggaacagccacugggcccagucgggggggucucagcaccuaucacaaagaaagugccacugggccuagggaaggacaagaaguaacaugucaaagaugggacagaacccaccuccuggcagggaguggggcacacauaugugcauguucauauaugugucagaaugcguauuugucaguguaugugugucagugcacauagguauaggggcugucucucagaauuccugagggcuuuccauuugaucccagugguugaagauggaguaugaucccaaaucccuuagguggauguggccuggcagggggucagcaggagggaggucccugucuccuuggcuuccagcuuccaggcucuggcacucccacuguuaggaacagguaccuuuagggacacaggaguguaagccacuguuuccgucuggguuuugucauguguaggucccagcggcuuuaagccaaccugaaagguucauuugggagucacggguaugugucaacaaaagcccaccagaccaucaaugaagugggcaaaagcucugggugaacucuuggcucagguaucaggauaugcugggugagggaaauaauggaggcaccuuuguucuagaugccugcagauuccugacaacaguagggguggaggcugugcagaccuggugcagagucugugcuggccucuggccucucacagccuugggaggggugcucagagcucagcuguguuuaaaaauuagcaaguggaggaguuagaggaucugcaguuaaccccuugagucucggaaggcuguuugagccacuaaucaggaaggagagcugacaagaaaaaggcgaugucucaccccugagcuacaauccacugcacuuacagugaccacccauccugacaucuugggcucaggccucugggucugggcauagaagcccaggaacugcugucuguggggaguccacugaagcucccugcccccacugagucucugauguugacagccucuuuguuuuuucaucucagccuauucaaggccauuuuucagcuugcuuggcuuugcauuaaaguuggggggauuucucuauccugagguuaugaaauaccucagcaaggacgaggccucccugagggagucaaccuagcuuguucccugcacguacuguggggagguccucuuuaccgccacaguuccaagggugaaacagagaaccagguggggaaggggucucuccccaucuguccaggggagaggcagcccacagggagccacacaggcaggggacauuccacuagggccauuugcaggccaguggccauccacugccagcaaucagagaaucacaagcacuggauccaaugugaccucugccaggaccaugaccccuagguccucuuuuccaucccuccaguucuccuggcuuucuugccaucuuucuggcucuauccucagucuccuuggcagguuuucccuucuggcauggccacuaaaugccagugccuuucucuaugcaaaccauuucccuaagcuguucccucagcaccaagggcuuccagaccaccugugaggcccugaccccccaaaugucucuccaacccagccagacccacauuccagucaccugcccccaccuccucuccacagccuccaucauuuuauagcccacucuacugaaggccccuguccuuucagugucacccauccuuucaguggcacaagucagaaguucuggggucauuuccgauacacccgcuuccucaccaccugcccaucaccucaagcccaucaccaagccaggcuuacuucacccauccauaguucuagagguucccugcuucccuccaucccuauugccacuguccugauaggccaccauuucucuguacugcaggcaucuccuaacuggcauucucacauccccugccccauuccaaucaauuaucuacucaguggacagacauccuuucaaaguuuagagaccugugggucuugcuuaauccugcagcugccuuucugguaguucagaugcuuggcuucuuuccaucccaggugcucacaggcucccuaccaccagagggcccuuggccugccccugccacuuuccccaagggaguuuuucagaccccaggcuaguuccaguggguuccugcuauacaccugcugugcucccaggccucagcacuccccucagggugcaaacgguccuucaacauuaguuagucuuucuccccuuuguccacuaacccugggaggguaggcaggucccugcuccuaucaaaucccucccucugggccagggucuaguaccugcugaguguuugacaaauauuucuugaaugacugcaucccuaacaugaggcaaugaucauuccccugccuguuagacauaauucacugccugggaaggcacugugcuguguagaugcagcaagcuggcuaaaaucaacuguagcauggccuaugucccaagcagguuguccugcccauacgcucaauaaugaggcccacugaacucuccugguuuccagaagccucauaagcaagcacgcucagugaaggaacaggaaguccuuucuggagcagggggagagaaaggcauccaguuagccauagaggggaauggcuccuuacucuuuaagagucauuugccccaagacuacuuucugucaaucaccagauagcccucagucuacacucugugauccacucaugaauaucuggucuggcucugcguuccagucagacccuuuucugagaggaccacaagucauagcccagggcuaccuguacagcuaccaggcuuaacaacucagaugcacacccuccacaacugcucuuagcacccacaggccugggcccucucucccugcccugaagccaaccagacccugggugggggccgagucuggccaagcagcaguguguggagcugggccugggccuaagcugggaauaagcuuguuuugccaggcgcuggccccccaucgaguccccauucucuaaugcuaauugcuacaauuagcaggagaaaggccuuuuagauccauuucuucuccuggcugaggcccgggcugcuagggagguugagcccaaggcuuuucggaggagcagggauucuuccauaaaugaggccacauuuaaauugcaaacaagagcuucgcccagccguaggaaaggcucugggagaaaggcuuuuaguuccgcagacagagcagccagagacugggugcgcuccagccucaugggccuuccuggcuggugugacuggaacccuggguuauacaggcuccugccaguaaccuggacaugcuggggccggccaguucagaggagcauggcacaggcugauaaaggcaccggaaggaaaggcaguauuagaggccaccccuugcccucccauccaggccugcucugagggaaacccuacucguccuccuccuggaguguacugcaaaccuggauccgguauccgcugagaaccacucauucaucagucugcacuaacuggagaaggugagcaggcccagcccggccucucuaggccaccuccaacuuggucaagccacaggugcccaugccauagauggcugagggacggcagcugacacguaguuccaacuaaaccucuggguggcagcccauagguugugggacuggaagugcuugccaaacaaauuauacugcugaccagggaagaggguacucugauuggccaggccugggccagggucuuucucaccgagguggugaggcuauagguguuagauguggcaggaugcaagccagggccugcugccuuuaaagagccacagcagagacaccaucccagucccaagagcuguucuaaggaagugguugucaucugcggugccccccaggggacauauggcaaugucuggagauauuuuuggcuaucaugacuaugggagaauuacuaauaucaacuagguagagaccaggcagggugcuaaacaucuuacaauauaaaugacagccccucacaacaaagauacauccugucccaagcauuaccaguguggcuggcuaagaaacccugguugcaaggggucagauuuugacaugcuauuugcuuucucacugaguugugaaaauggaggcacacuuuccuggccuggccucuuccuucguucaauaaaugaaugaaaccauucaacagaaaucugugacacacccaccaugugcggacccuauacggaagacagauaugcucucuuggggccucucuuccgguggaagagauaggcagccaacaaauaaguagaugucuaaggaacuagaaaagcguagccugugcuuugcagagacucgaaagguagucgucagcuagugagugacugaaggggaugacagauauggcaggucagagcaaaauuuccugugagauuuaaauaagaagaaggaauugucaagggaagaucaccagaaaagacaagccaggcagagguggugaaggccuuggggcaggagggauacuuggcagauuuaacaaagaagaagaaggcuggcagagccaaagcucagugagggaggacaguggucagagagguaagcagggcagaucuuguaaaaaccugauggaauuugaauuuuauuuccuagaaauagaagccacuagaggguaucuggcaggagagucauggaggcacauucauucguugguucuuggcuuuugggacucugcacagaguugaucacagcccucagccuaugaaacacugucacccuguaagggucugcauaaagucaccgcucucuuccucuccaugcuuuuccacuucaucucuagccucuauccuugcucuccucccuacacaaacagcuucuccaggguaauuuauuuauaucauugugugugugugugugcacucacgagcacucccuaguacugcgugucugggugguguguaauuuuaauuuaaauacacagucauguacugaggcccucuuucuguuuggcauuugugucacucagcacuguguuuccacgcgucucuaucuugugaaguguacaucuaguccccugcuccuaaccacagugaccagcuccaacugcccaccccuaugggccaugcugcccugagcaugcacacacacagccucucguuguucugggugagaacugcuccagcauguuuacuuaggagggaaacugcugggccacagguauaaaauauuuuauuugaggaagaaguguuggccagcucuucagaacgucugugccugucuccguccccaccugcagcacacagggaggcuuguuccuugccuucugccaacacuuggccuuauccuacuuucuaaugcuucuccuaugaagaauagcuguugcuuucauuuacauuucucugauaacugauuagcuugggcaaauuuucaucuguuuguuaacccuccugcaaacuggcaaucuuccuaccuuuuucuuaaugauuuguggugcuuucugguauauuuuagcuguuguucccuccucagcuuuaauuguuucaaauaucuuguaaugagucauggcaaaguuacauucaugaguguaaaagugaaaaacgcaaauuguuuccuuaguauuauuaugaaaacagucuugacccuugccaugauggauuuauuuaacagaaauccuuaauccauaaucauuaaugcauucaaguucauacauuuuagucuugagguuugugcuuucuggauccuguuuaagaaccccacggccacccuggcccuggagauuauucauuuuuucuccuauuaaacaaauggcaacuaccuuuugcuuucaaauauuuaguccauuuggagucuacuuuuccuaggggcucaguuaggaauccauauuccuauuccuccauuuuagggcuggcuuuccaacaucaucuucugaacaguccccacugauauguggugccaccuuuaucacauguccccuuccucuagacuuggaguuaccucugagcucucuucugggccucugucaccacaccgcucugauugcugaaguuggcgugugcccugguaucugccagcagaaguccucugcucuccuuuucaaaaguucaguuggcauuuacaaauauuuuucuuccacauacauuuuagaauauguuuguuaaauuacucaagcccuccaacuggaaguuugaguggaguccuguugaacuuaacagauuuggaaaauccugacgucauucuaaugccaaguugcccuguucaagaaaauaaaaugucucugcauauggaaagaucucccucuauauccuccaauagaguuuuaaaauuuuuuccauaaaagucgucgucuuuguuaauuccuagacugguauaaauuuugcugcuauucugauugcuguccuaaucucuauuaugcuuuuuuuuagucaguugcuauuggcauaaagaaaugugguuuguuuuuguuuuuuguuuugaguacacugaucuuauauccaaaaccucucugaaaucugaaaucucucuuuaguuguuaaguuccuuaauuuuuuuuuuccauguagcccaguaauuuucaaaguguagucuggggauuccagagagccccccagacccuuucaggaaaggucaaaaacauuuucauaauaauacucgacauuauuugccuuuucuuucauucucacaaagauaaagaguuuuccagaggcagcacaccaugaccccaguggaauaugugcuuguauaguucugcuuuaaacauuucuuaguuuuaacuucuaagaugguaacuaucaacagauagaaucucuaucaagaaaagcccuuuggggguuucaauaacuuuuaagaauacaacaagucguaacaccaaaauguuugagaaucuuuauggagaccaucaacccuaugagcuacacuaaguuuuaucacuuccuaccugauccucacauccccauuucuuuuucuuguauuaggguauggccaggaugacauccuuggccuacuccuuaucuuaaagagaaugauacacuuuuaauuucucuaucaaguuuacugaaaaguuaaguuuugguuuauaacuuguaucaaguugaagaaguuccucucuaguccuggcuugcuaagugguguacuccacuaccccaaaaucacacauaggcguuaaacuuuaucacaucauuuuuuucugccucuauugagggaaccauaugguuuuucuccuguagccucuuaaugugaauuacauggauaaaguuucugauauuggaucaucuuugcauuccuaagagcaaucccacuuguuuaagaauuguuguuuaauacauauuauuggauucaguuagcuagcauuguacaaggaacuucugcaucuacauucauaagggaaauucuuuauaguuuucuugugcuuucuaucugaauuuggacaugcucugauucgcaauuuuaaaaaaucccucuagcuggagcauaaauccugaaacagacccacuuuucuccucagcauguuaggaaacacauuaaaauacacccauaaucaagcaacucaauccuuaaauuuuucuccuacugaguaucuggaaaacaggugcagaaauggaucauuugagacaccauagaaaucugguuaauccugccugccugcuuuccuucaaguacugacugaguaaggcuguguaucaggcucuuggcuggguacagagcaggcagcagaaaacaaaacagaguuccucguugggagcuuuuggucuagcaaaaggggcaccacaguaaagaaagaacugguaaaugcacaucaaauguggauauuaucaggaaaguuuuuauacuuugugauaaucuaagacagaacuauucuaccuggaugaauuauucucuuucauaaccagaacagugcugugggaaggcacucuuacucucaauuuuauauaaaaggcuauuugaccugcucagggaccacagugggguacugggaucugaacauagugguggcccuucaagccuacuacccagacugagaccugcaucugaucaacucucaucuccaauaugaccaagagacuucuaccacuaccucucaccuggcaggugaucaccacccccaacucagacugcaaccuuuacuucgcccccuaauuccugacucagaauccccaccuagaggcagaacuucgacuucaauuccugacucccauaccccacugagaccucuaaccccaaucccaaucucuuaacucagagccccccauucagaaccucuacccaaagacagacuccagacccugacuccagucgccaacucggaccucccuuggaucucaacucagagccaugaugcagacuccagaccgggauucagguccccaacucagacucccgauccucugucccuaaugaggcccuaccuaaaaccaccaugcggacuccagacccggacugacugggaccccaacuacucagaucccaacucaggcaaacucccagccaggauguggacccuagacccgaauucugaucccaacuaggauaccuaacucagaaccacaacggggauucccaccuccgauccuaauucgggcccugacucagaaccacuaaguggauuuccgacuccggucccaauucgggcuuugacucaaaaccacaacauggauucccaacuuccaucccaauagcgcggacucagaaccacgaugcggauuccagacuccaaucccaauucagcccacucugaaccaccaugagaacuauagacccggaauccgauccuugggacgcggccaggaacucggaccucgacccuggccacgcuguccauaaggugcagaugggagcgcacugcccaggccaggcugcacugcugacgccugugaucugggacggccgcggggcacacagcucaccucagcaacgccagugaucacccgucccgcgccguccgcccagguccgugcugaccguguucaaacccucccagagagauggggagggccgcgcugaggagagucugggagaaccgcacugaggagccgccgggagagugccgcgcugaggagcccccggggagagugccgcgcugaggagcccccaggagagugccgcgcugaggaggcccagggaggaccgcgcggaggagaaccaugcugaggagcccccggggagaacagaaccgcggcgagaggcccccggagagaaccgcgccgaagaacccccggggacaaccgcgccgaagaacccccggggagaaccgcgccgaaaagccccgggugccccgaggagaacggcgccgaggaguccccggggagaacugcgccgaggagcccccagaagagcgccgcgcugaggagccccgaggagaaccgcgccgaggggcgcgccggggagaaccacgaugacugacgcaccgaggaggaccgcgcugaggggcgcaccgggagaaucgugcugaggagccccggggaggaccacgcugagaggcaccccggcagaaucgcgcugaggggcgcccuggcaggaucuugcugaggagcucccuggagguccgugcugaggcgacgcggcgaccguucugccuggagacugcggcagcgcuccgacugcccccgccgcugccgacguggcgaccgccccccaccugcugauugggcggcagcaggggaaggcuugcggcgggcugcugcacggauuggcugggugcggaaagugaugugccguguccugucauuggccgaaagagucucguuuugaugccacccgggcucagauuggcccagcggguccagcgccgcaugaggcacuggcugggugugagguggcgcgagccgccgcccucccugcccccacccgucgucccugagcaccaccgggggccggggccagcgccagccucagcguuggcaucgccggggugagcuggagacacgggccaguucucugcgugauguguucaccaccccggggugaccgcgugaggacagcggccgcaccccgacacugcugugggcccucgguguggaggccugugggcguccaggccacgcccgagaccagccccuccgccggcgccgcugcagcgacccucgaacccgggcaaggucuccaccgccguggcaccgggugcgggaggcguuuuccccccucccagcggguccaugcaggggaucgggauguucugaagcccccacugcugugccuggaacacccgugucugccgcucaccccugaggacuugggaccucagggggugaguggcagggguggccgggacaugccaggccacccaccuggcaaagggcagcgccgagggcgccccgcgccugccagcgcccggccgggcccgcccugcccaccucccaucccccauccgggcgugacacuugaccgcgucugccggccccuccccuuguccguccccuccgcgccgcuggcgcgcgccuucugaaugccaagcauugccauaaacuccggggacaaaagccugggucacaaaagcccccucuagaaguucacacccugaggcuucccuggcaaggcugggggccguuuggcccuuccauguggacugcaaaaacaguguuggaaugcaggacucuggguauguucucgaaaguuguuacaaccccaacccaggguugaccucaaacacaggaggaagggggaggcuggagccagccaagcgagccagccguccccccaccaaggcacgcaaggaggccauucaucuucacugccucugccgaaaauauacgucuacgggagagccaggaaucucucuccaagggugaccggguuggggguuuuguuguucuucagcccagaagagaaagagaaaauggugucauuuuuucaggcagcaagugauuccuuucaggccuucagcaacgacgcccagaugaguccacucccugccuccugcucagcccacaggcaaucugggcacaagugacacauccccugggcgccugucccuucgcacuggcccagggaguucaugugucugaucagagggcgcaguccacccucacuaucuagcugggaaguuuuugucaucugccuguccgagaggcagcugugcaaccagugccaucacucagagccagugcucaggugcaccccagacucaggguuucacgcuauaaugucacugucuugaaauucuugauaguuacuaucuuugaacuuguguuuuagaagugaagucugaggggaaaauggagcuuggaacuucagcucccaaguggcuuucccaccuuccugccuccucaggacagauuaucagcugccugucugccugcuuccucugugcccagccucucucuugacauccaaaggaucacaacucccacucagugaccacuauuauucucugccccugaccaaaaagagcagggcagggcuggaguccugacccuggccuggacucugcaaugcagagauaccugcaagucucauuuccccgccuguaggauggaggugaugcugacagccucuuggagccauugagauaggaaacgagagagauuaugugagaagacagggucaggaauguugaguugaggguggccucaggccccuguccugcuccuuuuugcugcuuggggugcagcucaauuccagccucacuguggcccccaggccuccucuggccuuccucagccuuccucaggaggccagaauccuccccugaucacccucccugcauguccauuucuaccuccccaggaggucaggggagcaggaucccaggucuucagagucauuucacagauuucaccagaauaaaagucccacucaugugggguuuacauucuggugggaaagacagauuuucgaaacguggccauuuuucuuugggccuuuguuagcugcaucagauggaggagguagccugguggacuccuucaguccucgcucuuggacacagagcugucucccagccuuuguuguuguguucuccaaggaugucgaacacaggcugaaaagcucccuaaaucaauuucacuuaaaaugguguccacccuccuacuaaagagugacaaaggguguugguuaggauuuuuaucuugaaaacugauuuguaaagucaugaaaauugagcuuauuuggucuuacacuuaacaaaacuguggguucuaauugugggccuggauggggacauaucuuacaaguaguugauucauuuauauagauuuucauguucugggcuugccuccacccucuaccuaacccuggaaccucagaccccaagcuccugggcacuuggauuuuucccugacaaauuccccgccugugauauuccaugggcaccucaccuugugugcuugugugaggucuccuugaguacucuuagcagugggguugccaggccaaggagccugucacuauuguuugugaccagcucaccagacguggucaggaaggacaguucuguguccuauguccucugcuccucacccccucgccacacacggggugccgucaaucagccagcgccgccugccagcccagcgcaccuguugugugcccccacucccgccuccucuaguccuuugggggaagaguggagaggaaaacaggccgagacugagagggguuuguugucucgucgggcgacaagagacacgugggaauuggcuagagaagcaugugaggcugggcggacuccaggccagccccagaggcagaugggggcugccaggcaggcugggaggugagcccagggcuggccuugggcaccauggcagaauucugggagggggcugcagucacggccagcucccuuucugaauuguucuguggguuguggaaggcuuugaaauuuggcgccugcaccuugucaccuucuugggacucaaggcugcaggggugggugugagacagagagccugggcaccugguggccacucccugagcuccccacgugacagagggcaggucccauucuccuuuugugucugguuugccucaucuguacaugguaggggcugagcuagcguuccuugcacucccuccagcuuuacucuuugggguucaaaagguucccuugcaagccugugcacccgagagcacgcacgcacacacgcacucacagcugaagagaauuaggcucaaaacguccacucggcuuuucucuugauuccaagguauuuagagugggggugggggauuaggggaggaaguugcugagcuaauucuuuugcauuugccagcacagaagugcagauggggcccagagccccggcggugucccaggggaaacaccaguccucuucugcagugcaaggcaggagaaagaacugcugugggagccccucacccaagcagcaggauguguggcaggcccuggccaaggaguucugugggccucaauucucucccuacccugcccccacccucggagucuaaggguggaaccaucuucagacccagccagguucccaaguugcugcuucccucggaagcugagaggcccagggccacguggcagccuccgcaguccaucugaagaaaggccccaccccacgcugcucucaggaguggacaggaacgugggggagugggggugguuaggaccucaggguuaucccugaguggcugaugcauugccaggaagccugcucuuaaggucagcccuugcaguuggcagucuguggccccuccucgguccccuucagugaggcuuuuugcaugcauugguccacacacccaccacugcagcuguccuggguaagggcucugugauccugcaacgcccaccuucuuccuucacuggucauagguuucugcugacccugcagcccauguccuuguuccagaaucuuccgccuccuguggccugugugucgccugcaccugcauuccacuggggcuucccuuccaacuugaugguuucagguacaugggccuguugucaacucuguucccacugagcccaugagacggcuauuccuuugagacauguuuacuugacuuccugccccaggucucugcuguacccacagguggcauggacucauguccccacccaaaucacauccccaccaggaugggcaggcucuggguccuuuugggccuuguaggcugucgucagaggggaggcacaguggggagucucuaggagguuuugggcaaggcagugccaaggaucagaucucccuucuagaaaggucacucuggcugcugaacagagagagaacugaagagaggcagcagggugagggggaagacuacgggggacuugccgucacccagugagagagaugggaggguuggagaaagcgagcaucuguggaggugugagaagugccaggcugggcucccucaggcggcaacuuugucuagacuucuggcugaggacagggaggagcuuaagguagcccucagcauccaacagggguagcagccuagugcauguaugaccacgagcgagcccaagggaaggacggguuuggaggguuucugaagaucuggcuuggauauaguggggucagacccuaucccuccacccagcugcagugacaacucuguggcucuggggcacugucacccuguggcauggccuguuugugguguccauugccgucuuagcuacccaaggcccagggagaggcacacggcucaggcugacagagugugacagaugcagguccugcucccucagggaaucccccauuccaggacagucucagcccccaugcaagagcagccucagcaugggcugcucggggaaugcccucagacaacagugcuguguuagggucacucccagccuguccucacaggcagauuugcguuccugcauuuggggucagugauaacgugaggccagacggguggggggucuggaguucaggcggucuccaugaguggcagcacggggugugggccaguucccauugggagggcagcugugcuguguguguauauguuugggcauugcucagccaagccuugauuagccgaacccaacucucccagagcccccacuucgacgcggguuaacucagcagcugucuccugagcaccugcuuggggccugguugggugccaggcacgggggggugggaaaaugaagugaacugggccugccagacccauugccugcagggccuuuucuaccaccaccuuccagaggcagcuuccucccacaaagcaucccaagcucggggugugugccccccuuccugugcaggccugccacuuccacagcugccccccagccaagaacaauccccucagccugccagggaaaagugggcccaggccuuugaggacauugccacagccagggccaaccugggaaguuguuucugauuaucucuugaguccugggagagguguuaacaaaaagccccaucccugucgcucuggugguuauaguuuguuuuacgcauuaaaaggcccuggaucgguauuuguagugagaacagauauuugcagagagccuacuccauucccagcucuguacuuguagagggugaggcugcugaaaugaaacccaccaggccucuggugagcagugggugcagagucauuggcaguaaagguccuuagagaaccugaagagaauauucuaaucaagcuaggcaggcucagaagauggauguaauuuggaggaaaaagacaagaaugggaaagaaagggaaaccuaccugggguaccguguggcuguggugguuuuaguaugugucuacaaggccuuugacaauccguucuuccggaaguggcacuuaauuccccucuaauuaaguuuuggcuggacugugauuugcuucuuucaaauaaaauauggaagaagugacagagcaugacuuccaagacuaggccuugcagccucccugcccucucacugggaucacugauuuugggggaagccagccaccauggugugaggacacuagcagcccucuggagagguccuguggugaggaacugaggccuccuauaaauggccuccuguaugagcuugggaguggauccuccagccccagucaaaccucugaugagacagcagcccuggucuacaccuugacugcagccucacaggagaucagaaccacccagccaagccacccccagaucccucgcccacagaaaccaugugggaugauaaaugugggcugcuuuaggaaugaagcuguagggugacuugucacacagcaaaggccagcugacagagccacccacucucaccaggcuuagucugacccuugucaggggcagcaaagugggcucagccuaccuguuggcuuuuacugaugguugguggcucccaggagaaagaguacugugcccagguagcaugcccaccccaggcauacauagcaugucuuugcucuugcagaguuugaacucugcccaccagaccaguggcucuuaaccuaggcuccucgugagaaccacuccccggugcaggucccacucccagaaaggagagcgguuuugacuccugcagucucuaaggcagcagagagcuguggcauuuuggguggaguggguggagagggugcgugaugggugggagaaacugacaguuggaaugugauuuaggaaauguaacgggugaccuuuucuccccaagagaacaccaaauccauuuccuugggacauggauaaggcuaagggcagcacccacaaggaccaggagcgggguucucaacagccacuucugucccaaauuuguuuucuaugcccaggaaugucaaagggcccucuuggggucagccacagagaagggggagcaggugugaugggguggugaugggaugcuguagguggaugagaaguagcaccaaagcucacuacuguuuuucucuuaucccugggucuuggggacaggccugugccagaagcagggauugcuucugcuguaacguccacuggaauaaaaagcagacauugcaguguugagaaauuccuuuagcccucaggaggcaaguuacagaacaggacagaacugcccuagucaggcccugccugggcacagagcugccaccacucuuccaagagcccucccuuuuggggacugugcccccaccccacccccaggcagccccugccuccaaccuuacuccuagcugguguucugggccgucaguucauagguccagcucugagaccugccaggcucucagagcagccuggacccaggagagcgauaaauggaugugcacuggcacacuccaagcagggaggcuuuguuuaucucccaauuaguccuguagcacuuaguaugucaggcaugguucugagggcuucauccacacuaccacccacuguagagaugggaaaacugaggcauagcaaggucaagggauugggcaggccuuaggauguagaagcuacuagagcugggcugcaccuggguauccuggagccagggucuaucccucccccucugccacacggccuuggugugagggacacagccccuguuugcagaggcagcuccuuucauggagcaugggggacagggcaggugugccuuggcccacauuuggcuucuugagcgccgaaccugcaugugccaccccccagaguuccuguguguggccgggugaaugugcacaggucgaggagguggugugggcagccaaccucccaaagcaccaggccccucagggcuguuccccuguuucccaagauuucccaaacagauggccaagaucgggggcacccaggagaccacgcucaugaauuguuccacuugaacacaacauuguuuuuuauggaacugggcuggggaguccucugugacucuuuccucaguagggagagagcuccugaacccaccgugcacacuucuucagcagccgcuuuggagacuugacuuugacacucuucucaacaggaucccuuuccucacuggugucugcggcccgggccgcuggcauggcugagcggaacuuggcaaagcagugaauugggagcucacuuaggcacgugguccugaggcuccuugcuggcguuucuguuuugcucccugcuccuuucuuuucuuuguaacuucucuucagggcacccacagcccccgaggaggguggggcugaggaggcuggagguggagcccaggcuuaucccccuggugggccaggcaggcagcaaagggaccaaccccaagagggucggugcggagaccccuggggugcacagggugggcagugaccagaagacucaccccagggccucuaauuuugacccuugaucugggucuaagcaccucugagcaagaggugaggguuucaggcagccucagcucuuaggaggcagaagauacaguuuauacgcggguugcggggggcgguccauuuccaucucccuguucucuccccaggccaauggccagggcuaaagcccuccuugggacaugucaauagcagcaaacauuuuaaagaugugacauguucgaagccuggcaacaggggcagcuccagcugugcgagaacauggcuggauuuacgucugcggcaaagcacccggucaccuuucucugcuuggagugcaaucuuuuuuuggaagcccugcuggaaaaucugaaucuugugagccaucagcuguuuauaaucagagaagcauauguuuaaaagagcugaggggccuuauaaacuccgugugcaaauuaccuuuggggcugccugcuccaccgccccucccugaggcugccaucacuggcgagcggcugagugugcugcacagaauucgcuguaacccuguuguggcacggggucuguuuagcuuuagucacgucagcuuggcccuggagcgugggagccuccaucucuccugcacggcuuccaggccccccccacccccaccccccagccccagcugcagaggacuucuggcucccuguuccugggcuuucagcaugagaaauaucaaaccugggaaccgugcagcaagaagcgggcagaggcucagacgccaggaccugcgggggcuuccuggaauugggagccacucucggugucugcucuggugcuacgguccugcagggcuguuuuuuuuuuauuuuguauuuuuugguguucauuuuuguuuuuguaacagcuuuauuaagauaaaauucacauaccauacaauucacccauuuaaaguguacgauucaacgguuuuuaguacguucagaguugcgcaaccaucacacuaucuaguuccagaacauuuucagugccccuaaaagcaacccugcauucuuuagccgucacuccccacuucccuucucucauuccccagccccagucagccacggcucugcuuucuaucuccacggguuugccuguucugaacauuucacauagcuggaaucacacacuaagcagacuuuuguggcugacuucuuucacuuagccuaagguuuucgagguucauucaugcuguagcauguaucaguguuucauuccuuuuuagggccaaauaauaugccauuuuauggauauuaucacauuuuauuuauccauucauucauugaacacuugggccauuuuuacuuuuuagcuauuagugaauaauacugccaggaacauuuggguacgaguuuuuauuguggacauagauuuucauuuuucuugaguauucacagaggaguagaaacgcugggucauauggugacuccauauuuaaccuuuugaggaucugccagacuguuuuccaauguggcagcaccauuuugcauucccaccaguaguguaugugaguuccuaucucuccacauucucaccaacacuuguuacugucugccguuuucauuuuagccaucuuagugggugugaagugauaucuccuagugguuuugauuugcauuuccccgaugacuaaugauguugagcaucuuauuagccauuuguaucucuucuuugaagaaguauguauucaaauucuuugcccaaauuuuaauuggguuguguuuuuauuauuuaguagaguucuuuauagucuagauauaaguuuuuuauauucuagauucaaguuccuuaucagauauauuuucuuccuuuuuguggguugucuuuucacuuucuugaucauguccuuugacucacaaagguuuuuaauuuugaugaaguucaauuuaucuguuucuuucuuuggaugcuuauguuuuuggugucauaacuaaauaacaacauguaaucugaggucaaaaagauuuaccccuauauuuucuuccaagaauuuuauaguuuuggcucuuacacuuaggucuuucauccgcuuucaguuaguuuaacauauggugugagguaggggucuaacuuuauucuuugucauguggauagacaguuaucccaacaccauuuguugaaaagacucuucuuuccucagugaaggauguugauacccuugucaaaaaucaguugacaguaaauaugaagguuuauuucuggauucucaauuuuauucuauugauuuguuugucuauccuuaugccaguacuauaucgucuugauuguuauagcuuuguagugaguuuuaaaauuggaaaguggguuuuccaacuuuguuuuucuuuuucaagauuauuuuggcuauucugggucccuugaauuuccauaugaauuuuacaaucagcuugucaauuucugcaaagaaaccaucugggauaccaauagggauugcauugaaucuguaggucaacuuggggaguauugccaucuuaacaauguguuaagucuuccaauccaagagcauguauuucauuguauuuggauuuuuaaaaauuugguucaagaauaucucauaguuuucaguauaguuuuugcacuacuuuguaaauccuacaggguuuugugugacagugacuggcagccauacuuccuccccauguacuggguucugcccauccuccagcccaucucccuuggagucucuccccgacuccagggcucauggccccuuucaggcccuuggcuucugguaaugcuucuuuguggucuccugucuugcgcacuaauuguugcccaagucuuugcacauccugcauccugccuggaguguucucucuccucccuuuucugugagccgucaugaaacaccuccugugggcuuacugagccaccaucuuauccaagugcucuguggcagcuuguggaaucuucucaaccuugggugucgccugcccagaacggggcucucggaggccagggugacuccacuaucccaccaaccucuguaccccacggccaugcacaaggcacagggucccacagagggucuguggguacaauggagcuauuucccagucagaccucacaaucgguaaacugugcuuaaacuaagugagguaucuuaaggcuuuaccaccagggaaauagaacuuuggcagcuuacaaaggaguuuuauuuuucaaauuuccuuucaacucgagggucucaaauccacucagcagacuuaggagggaggguccuggcacugcuucugaggagggugccuuugaggggaggcagaguuggcucacgggaaaggcuggcccugaggcauggcagguggcagguggcuggggcugcucaccugcucaccuguguccauccccuugggcagcacacagccaaguccuuuuggaccaaauuggaucacugccaaaugguaugcccagccuugcugaaucucuacccaucuguaaaaaggagaaaucguuucugugcucccugccucccagagagccagggagaggccaggauccaaggagguaacggcuuucuagcccuuuggaaaccugagugggguuuugugcuugcaucucauuuaagccaugaacacuugccggcucucuauucauccacacccccugcauuuauugagugccuucugggugcccggcccucuacuagaugugggaguuaccgugugggauggacugacacuggugaccccugccugggggaagcagacucuagcugggcagccuggccucaggagaucaucacaacccucgcuggggcuggggugcaaauggggcaggaacaggaguccggccugggggauguuagacucaccagccauccccuggaaagcuguggggagacucagagcagagcccccaguaaucauagugagguauuuagggauagaguggagaucucgcccacauauucccgaagccaccaggccagacaccgccccagcugaaugcaugcuggcggcccaaauguuagacacucuucucucuuaggugguuugaggagacuuaggggcuuccauauuccccuuggaacaugaagaaggggcuggcuaaggcccccaucccugcucaggccuacaggagagcccuguggacacuccagccucagccuuccuugccauccgcaaccacaccaguggcuggaaagccagaguccccuggcuccugcacuuuuucugcacgggacucccucacagccucuggguugggagcacacauggcaucuccuagagaguuugggggcuggacacagggaggaggcagcaugggaaauggaaggacugcagcccccgccucccuccaaggcaguugucagagcaagaucagcucccuggaagacacccggguuguaaacaggguggggcagggguccugguaaguaugaggaaccagagaccugguaaguaugaggaaccaccccuuggcauggggcacccagaaggcagcaggcuaacgacuccccaugaaauuaacaacuuugugaagcauuugguauuugggggauuuuacauuaggguuaaugagccucugaaaugagaucccggagaggggccaggaccaugccugggauguggcuuccguggacugagcagccuggagccccuacuugcuuggugucccgagccagccggaccugcaucccgcuccuccuccgcucccuggaaacguucccugaaucacauuguucacugcgcuucucaggccuucugggcucuuccucugcugcucgccauaaaaacucuccagucaucuuuuccgcugugguuuuuauuguuuuauuuuauuauuccagcuauauuacguugggaagagcuacagaaaugguuucuucucccccagauuccagaacaagucacagccauuguagauuuugauuaaucgccauccccauuauuucuucacuuucuccagcugaauuuuucccacugugggaagggggucuggaggacaggcacccuuguuggccguggauagguuucuguucucccucgacccacccagcaagagaaaaaagugagcugacauuaugggucggccccuguucuggaggccacagccacaggcucugcgggccucuggccgagcuggguugcaggagaagccaagugccgggugaaggccuggggaggaaucuggguucucuuggcugcugguaagauuauccauuaaauccauauuccucacuguagaguucauggauucagaggauauaccguauucuggccgucuuacauuacugcaauauugcuuccagaugggcaaacgcgcgcucggagccuggcccugcagacacgauggcccagcacgccgcucacugccgcgccuuuguucucugcuuccugcucgguuccugcuaacucagggagcuccagguggcugccacucagggguguguggggggcgccuuggggcacccaggccugcagcccucccccacacaggcagucuccacagagauagagcgccaaggaugcgggccaggacucuuuccgagccucuccuguugcuggggccugcucccugaagggcacaguccugggcaggcgcagugcccaggcuggagagguccugcgucuccaucucauccacaggauaagucaaaugggagcauuccagcauuccgcaucucauggggggguugggccucaccucccuggcagcccacucaccucacauggccugagccgcaaggucagcccccucccaggcccgugagaggcagcaggcacuaugggcgagcugccugcugggccacaggcucugguacucuccuggguuggggcucccgggguagggcuaagugugguggcaguggagucagggcagcuggacagccccucugccaucagugagaacugucuucucucugcuuccccugugcacuucugaauccccagggcugggcacagggcugugacgccauaggugcucuagauagauggaggagcucacagcugcagggaguguuggguggacauaugggguguggggggcgaggccaggcuucacagagguggaaucucaaaggaggaagcggcaugccagguggcggacauagcaccugcaaacgccugggaggugaaggcaccagcuguagccagcaucccagaaagggacacgaagcccuuggggccggggugguagggguaggagagcaucuugaggguggcugcagcaucgucgucaucuuuccaaugguggcaucccuuccccaagcaagggaaugaugcagacagaggugccuuucagaaagaauggagguccuggggaccugacuucugggucccucaggacacaugcucuccagcucgucaguguuaccuggauacucuaaugggggcacaaagccaggggggagccugcaggaggggccuagccagggccaggugucacacaagcagagcuccagggugcagcugggcagauugccggugguuggugcuggugaggaguagcagggugggguccggcgguaaugccacugaugauacuuggcgaggaugaccgcaagugucuugacccaaacaugagaugccccucacccauccucccaugaaccucagcaugggcaccccaugccacccgcuccauuuacagccaaggagccucaguagagacacagcuagaaaguggccagcugggguuuggugcugagccucugucugacucucugcucucuggagagcucaagggaaccuguaaagaccugcgggcugugucauggagggcccuuaccccggaggagccaggaagguggacagagcaggcaggaguggggcaggagggggcuuugcagauuacccagacccuuuguuggccagugugggaauggggggaggccagggaggacccccugcagccuggcucaggcaggggcaugugugaaggcccagggggaagagagcagccagguagacuucguuuccagccggaguguaccuggggaugccugugcccaagccuuccucuuccaccaccccugcugggguccccugggacccauccuuccaagccccugccagccuuggaaccugugacuccccagguggucaaacacagaaggaccucuugggggaaggggaaccagcaaaggggguauggggagcccucuggggcacccucauaucacacccugucccucuggccacauuccagcuggcccugccugugaggguugaccagcuggagcagccccgcaucccacauccccgcagccuugcgcuggucuaaaugccucccagccuccugagguugaggguggccacaccagccagagcuugggugauugaguggguagaggggguggccagagugggaaccauggugaugcaaaccauaaaccugucccccacgucaccuccaaacccuuugggcuggccucuuggugaggaauggcccugggagaggcugcccugccuuugaccucucaugcacugagaguaaugggcaagcgcugucugcagagcacugaccccaccgccggggucggagccccuauuccuagccucccuugagcguuuugguugccggauccucauuaauggcuguuuguaucacuuaacaauuuuucacuuuuggaggggucgugaauaaccccaaagcaacauguacccucuccgggccaggcucaagcgguccucucacuagggaaagaagucagaaaaaagcuccaagcugaagcgcccacaccuacccucugcaucagaugugcugcggcucucaaggaacccucuagggcacagcuuuggggaguggagcugcguggucagcuggccaagccacagugggaaaagguggcccauuggccagaacacaguccccaagccuccucagcuaggcucucgaggaauggcuggguguccuuucucagcagaaaagccuuguccccagccuccagggccaggcuccagcuucccaggcgugugcuucccacccaggcucuuguggguuggcuugccaagcgguguuaggacacgcagcuucaguucugcagggccugguggaauuccauucccugccucccagaaaucuuaucuugagggccgcucagcuacaguaggccccaagccccagagacuccagauuccccacuacggaaggcagccgugaaaggcacgggcagcgcggugcuucuccuucaggagguggaacuggguggcccgcauugaacaggccaggagcacugguguucuggauccaaagcaaccaucucuucccacauuuggagggagccgagggcaggcaggagccaggacccagugcauccugaauacugggugacuggcagacaucacucuggcccaaggccaggccugcaguaggagcucugugcauauccccuaugugaguacaggaaccucaguggugccuguggagcuguucagugggcccuguauucgccagcacagccaugguccugcugagugacaaacagccccccagauguccugcccucuggugcugcuuguccaccaugaaguggccggggcucugcucagggacccaggugcucuugcagacaacccaagucuuccuuccuacuccuggcagggcaggcaauuccacugauggcugcagugcgacacagacugggccuggcauggugucccucagaccccacggcuuggucgggucaccugggccauuucaaaggcuguuggggagcaggaaucacaagcuggaugucagcuugaggguuaccccagagugagagccucgacagccaggcccucccaggcuucugugaucgcagcccacaccucugcgcacaguaugccaauguuccccaaaaucuacauacugagaagguagacagcaaagccacagggagacuucuggguagcccagguggaauucuucccuuccuguuucccaguuuuccacccuuuucccuggcuuucuuccagaaccuuuuaaugaaagugccucugccccaccagggccuggcuuaggaugggugagggagaggagcuccgggaggucacggccccacccaggaacguuccugucccaauccucccauccccauauucaggaaaguuccccaggcccguaugaacuggcuucuuaauuuuguuuuaaacacaagcuuucagaagagcagaaacggaaagacagauggcaggaggugccgcagggcagcacuggggagccugagauagagagcggguagacaggaaagcagcucacagcggcuggagagcagggagcacacgccuguccaagaccuugggccagaggaacccccucucccccgauggcccacucgccccagggccuccagguuugagccccccgggguauuagcccagcauuuuaggggcugccguggucauggaguaaagaccacaccuggcauggcuuccuugguuucugaaggcugcgaaagcugcgucugucgcagaagugaaccuuguuuuguuuuguugauggguguagucucagggcauguucaaugucuguggagcugccucuucuggaagagccggguugacacccgcgugccccguccuggcuuaaacacuuugaggcccucccugcccucgggggagcugagagccccacugcagcccagaggcccuccccugacagcugccuuccucugcuccguccuuccccacaucccccucacacaccuugugcuugcucugggcuucaggggccugagccccagguagacccccacacuuagggugccucaccacacuccaucccuagccccagacuggcuucccugcaucuggcugacccccuccucaccugccuguuuccaccucagggccccuccugaagccggaacuugauccccgcagcaccagccccuccccguagccucauggggcacagcucugaggauguggaugagcagaggggaggacagggaugaugaaccccaggaauuggcuuccaguggaugcaaggcugacucguacaugucauggaggauaguucgggcaucugagcuagcugaggcuccuuggagcacaugcauggccuggacuguccagaagucgucuacgugcuuuguguagacgcaugacuccccagcuggcuccguacuagaugaccugggcuagggccacuuauaucugucaggggaagggcaguugcaguuaggaccacacuaaaagguuaauguccacgcugguguugaccaagcccuggacccugcugugccaggcacucccaucagcauccaggugcccauuuuacuacagggaucugagagcuggcuaggcaggcaucccgggucauuacugggccuguaagggccuucaugucugcacccucccugccaugcaccuuaaggucaggaaguccauucaaaugcagauuccugggcuauuccaagaguuacugaauccccacccuggggugaaggcuuggcgucugccagggaccauagaccacagauacucaucuacgcuugugaccccccucccgccccugagugugugcuggggcaggaggcccuguggcaaguggagccccaaccgcagagcaccaucuccagccgugugcucucgggugcagagcugaccucccaagucucaggcuucuugucucucauuggggguaacaauggcuauguacauaagauuaggagaacacacagaagguggugcuggcuaaagccauuaucacaggcuggugccuauagucccagcacuuugggaggccaggcguuagagaccagccugggcaguauaacgagacucugucucuaccaaaaaaaaaaaaaaaagagccauacaagguggugcgugccuguggucccagcuguuugggggcugagaugggaggaucgccugagccugggaggucaagagugcagugagccaugaugacugugauugacguguugaccaggcacucaaaaacaaacaaacaaacaaacaaaaaaaaaaaccauuaucacccccugcacacaaaucccagaguucagagaacacagaucaaaauaagaagucagagaauccucuccagcugaaaacccucauuuguuaucacccaaaugcugccugcuggcuggcgagccuugcuggugguggaaggcccagcaguagcaaaggaaaccagggcaggacaguguaggaaguccugcccucggaucauuuggggaaauuggcaccuguguuucucaccacacaguguuggguuggagaaugggccugggugcagagcuucggagccaaacaccgugcugguuucagagaaacaaacagcccugauguagcuguggcccuuggagguguccgaauaguccaucauuuucagugacagaaagacggaaauggacacagaucaaaccugcaucacagauguauagcuaggucagcgaaccacucaaaagaccccagggucugaccccuugcacgccugggcggagguggagccgcuucaccauacaugcaaauguagcaaacugcaaaaugucccaaaacaagucccuuacuguccgugucccuccaugccagcucacuggaggggcuccugcugaaagaggugggguucaguucccaaacccacuggaggguugcaaggagacgcuucuaguauguuagacagcacagucuuccaaauggacugugggcaugauggauguguaaagaaucgagaagccaagugcccuugccauuuguuaucuuuaaaaaguaucggugggcucaugggggcuugaguguccuggcagcucuccucauccauccuauguguacacucaggcacguacucccuggcucagccgccuuccggggcccggcuacagucaggccuccuucgugcugagcaugugcuggcccugccuggggacagcugaaggccaggaggaagcugcuggccucaagaaggccucucgaagcagaggcagcccccucgaagcucaccuggccucucucuguaaggggagagggacccagggcugaccagagcaagcagugugccauuaaccccuaccuguccagaacucugagcuccuguggguccuucucugaguguccuauguugggggugucagccugggugucaaggcugaagaggggagccuccuuggccacugaaacggaaacagcauuagccaccaccagccccuucccccuuuugcagggcggcucccagaaccuaggaguccaugcuaccugugggguucauagugugucccucucagccaaugggaagucgugcccuuggaucauuuggggcaaaugguccucguuuucuucauuauaugguguugaguuggggaacggccuugcugggaguuggggccuggccuggaccucgaggccacuggggacuuggcuaccugagggagaugagguuguucccaggguuuccucaucccaggggcucucagauuuccagggacucgggcaggcacagcuuuccaggccagagccauggacggucccuggacaccugcagcagccaggccccagaugcaagaaaggguauuuguuucuuaaagcuuguaaagaguuucuaaaagguggggaggggauuggugggggccugucucauguuuuccauucuggacgccggggggacauguugcuggggccagaccaacuccagggagacaacucgacaaguuacgaaacauccagcagcauccacgacuaauuucuucccccuguuuguccuaccguggaggucgaguuaaaaggcagcacuucggggguugaaaagcuacccgcaggggucugcucgugagggacccccgggccucugcagccuuuguucagaggcagcuaauaagccgacucccgcugggcgcuuuguagcgaggccgcuguucccaguccuagcucagccucccugccucagagggcuggcagaucagcaaauugcugucuccagcucgcaagaggggcagguccagggauguguuucacccccaaggugugaguggaaucagcaaauuguaucaagaaauauuucuagggauuuacauuccggcggucagcagccuuugggaggcuuuacuccgccugcaggggugggaggccucgcguagaguuggugggggcagcagagccuggguguuucaggaggacccacucacucugggccacuucugaugcugcagaucacgccaggcaggccuccggccguuugucucuuccgacagcagcgguggugaugguccccucggccugccuggccugcagcagcccuggcuggaggcugaccgagccuccgaggagguucaccuggagcugucuguccauccauccaucugucccuuggccccuuuaagaggccuuguccccuuugccagugcagggagaccccaccguggacuucucauugggacuuccagugagacccaacuccacugccuggggauacccucaccccaagcccaaggagccugucccuacgcacacccccugccccugggaggcacaugccgagcuuuccuguccuccauuugguggccgccucaccuccauggggucgcagggcccacacagacagccuacuaugguccuggcaggcacaggguaugggaagcccugugccccugggaucaagcuuggauccugagguccugagcuuggugagucagggcuggggagccacaaagccagcaugcuccugccuuuugggggucccaggugaugugucaucuuaccagguguugacagguggagagagguaggcugggugaagauaggaaaggacuaugggaggccagggcgggccucgggugcaugccucucuguggcagugacauuuguacagaacgaggcaaggccagcccauccugggagcugagugcuggaccaugggggcugcagccuggaacugagcccagagacugcagcauucagaggucagggaucaaggaggaccucacaaaggagaucgggaagguggaggcuuggucacccccaggaggagcuuuuucuaaggaaggagaggccagcaugucagccacggcuggugggucccacugaagcugagaauagaacuggcagugggguuuggccacauggagguccuaggggagcugaugagagcgaugccguagccagggucggcaguggcggaccgagagugcuucccuucucacgugguugggagucaugaccuguuuaguaaauaggcuauggcagccucuuggaacuuagugagguggcuaagcugccccuagauagcugugcccugugaccaagacccuuccucccuccuucccucuaccccaccaggcucagccaacugacaccagggcccugugaggcaguaucugagccacccuucugagugggagcuauggcaagugcugccuuagcggagugggggugggggcaugugucacucccaggaccaacuggcagaugaaggucuuugggcacugcagcugccaccuggggugccucggggcaggcucaccucacacccuugugggccagcugcggcccaaaagccuccuggccuccauucccgugccaggguggucugagcggagaggacaggggggaucccagacggauccugaaaacaggcuccgccuuccucuguggcucugccuuccucuuggcuccgccuuccuccgugguggccugagagggguguggugcugcuuguccguggugcuccacacaccugccacagcugcuuaccccacucccugccgcccuggacaaggugcccacggcccugucccauuuaccguuggggcaagugagggacgaggaggcuccgcagccucccccgggacacugcaacccucaagacuccuagcaagccccuccgucucagagccuugguguccccaucuguaaagugggaugugacaauacccuucuugcugaaugggcagggagagaggagcuguuaggugagaccaggugguacuuggcagcuguggcacguggaagcccuacacaggcagccccacaccugguccgcuguucuguccuuacuguagcagugggccuggaggcaguggcauuuagagaggacccugaaguccaaagaggggaugccagccucaaacucagcagcucgaaguagcaacagccucgaaucccucacaccuagcgguuggcugggcagguggacugguccgagcugaguggucuaggauggccuugcucccggagaagacccuuggcagacagccucuccucuacuagcuaguggggccucacuaaccgcugguggccgcaggguucccagccacucggugcacauguacuccagccucucugugucccauuugcucaugacaugguggucaaagcaagucacggauuccagggggaccucgggacgaggaagucacacguugggggaugugccgcagggauggggcaucucagccuuuguaucugccgugggcguggaggcauuuacucuuuucaccgggggagcagaaaucagaacauggcucucugugucugacacagagcccuguacuccaucuaugcagcccccaccaccucugcacacagccccuccgguggugccugggggcccaggcuuuugauagagaaucacaucuggaccaggacguucugguaagaucgccagggggccgcgacaaggagaccaggaaggaaagacagaaagaaaaacacgcacagauccaggcucagaugauauacaguccuccucccggcucaggaccccuuugcggugucaccuuucggcauguaaccacuuauucugucagggaggagagcccucccgcuccaccaggugacggcccuaaauccucaggagugacagcguccucccgcccggauuggguuucugcacaguggaauggagcuggcagccagggucccugucccgccagcccuaggccucgaacccucccuggcaagcuaacacugcccuuggaggaaggagggugggagggcaaagagagagaagugguggguggcagcgagcaggcuguccugcaaggccguggcugcacugagggcagaaggggccuugucaccuaggaaggaccccacuaggaaccccuucccgcggaaacacagcuucuccccuugggugccauugcagcugcacccaagccuugcccuucccucucacuucgcuccccaggaggcgacacugugauuguccugggcucacagaggaggacguggggaccugcccaaggagacacaggcaacagaaccagggcucagaguugggggaaggggccaguucacccacagaggguggagucacugggcugaagcuucuggccaucguauggagcuggaacaaggcacuggaagguaccaggccucagcguucucaacugugaaaugggaacacgguggucucugucacaggguagagaugacugauccaguaaccuggacagggugccgagggcagggucugguguggcuaucaggagccacuggauuggaacuuggugugccaccagggucccuguccguuuaagaaaagccugugggcccaauagagaagcacagggucugagaagcaucagacaaugacuccuaaacaagcucacgucuugaagcagugcuggacccguuucagcuccaggggagagccagggcaggguggggcaggcacggauuccugacguggagacaggaggaagccgacggccaucugugcucagacccaguggugagccuaagacaaguucccagaauccauccgggacagacggcuggacuugugaaacacuccagggucgggggcucagccacgggaccagcgcuugccagaaauguucccagcuuuuuugaguucgugaguggcugguggauacuuagugguuuggcuuucggguuccugccuuccaaaacaggagaggcaacuuggccugcuuuuuccucagaagagcccacuuuuugcguggaggugaccugccauuuguccgguuggggguccccaaucgucuucgagcuacugauauagaaccucugcguuuagcugugguuuaggaagugcauucacgugaagucgccaaguucaaagggcugccccuggaacccaagucagacuugcccucgcccccuucccgaacguacccuuuccaugaggcugggcgcccugcccugccuucagugccaaagccccaggcccacaggcugugcacuccagccgagggcagccuggggaagguacgagagaucacugggcuuugugaaaccugucagcuugugugaaagcuaucucccccaggccccacccccgcccccacccaaagcacaggucaccugccugguuaaucauccugggcucugagagcucccuggggccccacaggccaagcguuuucugacuuggagaggcaggaggccaacuccccgcuccucagauucugcugaacuaacugaaacccuaaccuucgggcuuccccacuaauuugugauaaggccucgccaagaaaaacagcaggcuaaagaccccugauuucuucaugaauuccagagcacuugguucacuccggcagagaaggggccccaggcagccaugcauacagagccaccucugcgugggugaagggcuggggacggccucuugggagcccacuaaggaggaccaccugccugcuccaggcagauugcuuccagcuggccagggcagaggagcaggccaagggugggucccgggcaguggcccagagaagcugagcucgcucacgagaugugugcugacguggcaagaugggcgggagucuucaugaaggaguggcugccuggcccccugaccugaggauccuagggccccuggauggguuugggggaacugcagcauccucagaucacagacggugugucgagugaggguggugcucuuccugggccagcaguagguuuccaaaagggcacagacacagcucaggagauggaugcugcccugucagaguggggaaacugaggccccaggcggagacaccacccacugcagguuccagccgucccccaccccaccccugccccaccauggcugaugugagggagguggccagaaguccagagggacacugggugggaccccggugaagaucugguggacugaggccagagaaaaaggggaugacccauuccuagcagggaggaauaguaguuuauauuuucccccaaaauuuuauuuuucugcauuggccugaauaggagcugacuuuaauacgggggaaauagugauuuuaaagccggcuuucccauggaaugugcuucuccugugacugugcccaucuccucacugcuuggcagagagguaucccccgugccccacuggcaugggcgccaggucugcccuuccagaggccccucccaaguagcucccagcagaacacuugaagcccaaaagcagugagaaagggaacacauuugccuccaauccugacucuccaagcccugucccugcccccaggugaaggguuggcccugggcauggaggucggcagcagggaggggacacuuaagccacuugguuggggguuugugcuaugcccuuuccucugcccuguuagguuugcuucuaccucuuagguccugugauauaucugccccuguaggagcgagacagacauaagccagauuucaggaaggagcagccauggggcaguggggcucuggagcaacagaggccucaaaagcucagcgucuacagauguuagggacaaggaggcagcuugggggaugugcucaggcccuggaggcagacacaucagggucugaaucccagcucaggggcccagggcagcucaagcccucucugagguucuguuucuucaucuguaaaacagggacaaucacgguagcuacguguggggcgcaggacggcacccaaggaucauuccugugugagucaggugucagggaccaccaggccuugugcaggaacaugggguagugucccugggggaaauccuaccccagacucgaggaauaaagaggaggaggagguugccugagcuuaacagaaugauggcugucugacaugaggcucacaacuggccccagcagcuccacggcagggagcaggagcagacaccccggauccgcucuccucccuccuugccuccugccagggguccaguuggcuagacccaaucugaagcccugggccaggagcuuguggacauaaccugcagagaucagccuccuagggcagagugagcugaauggagaagggcuguaugcagaagggcgagcagacagagcccaggauuccacaacggugucgauguacaacaccaagcaccuggccuggugugggcucgucuugcacuaugaaggggcagggacguggccaggcauucguuccucugugggcacuguggggcuuugcuguggaggcagagggagcaucugauggcccccggggccgcgcuagucaaagcgcuucauuuccaucauauguggugcaaaaucuaacccucuuacccugcgugagguucaugugaccgcucccgcucaccucccagccucauugccucccuguuccccuccucccuccccagccacucuggccuucuccucguccuucagcuccuuccagaguguucuugcccagggccuuugcacaaaucccuuccaggacuuccgaugguucuguccuccccucacacaggccucaccucuuuugcccccuccaccucuggagcggccacucgcccacccuucugcccugacuucucuguggcuucccaaggcucuuccuggcaccucguaggguaaguccgaccccagguggcugugcucugaggccagggccaggacucuuguucacagugcuaugccugacccggcgccagcccucaggggaccacagccggcugaacgccaacugguuagcugcuuuuucuauaggaccuaccgagcguuugacucuagaaccggggguuggugcuuggugacaagagcuaggcuggcuuccuacuaauucugcagccucuggcuugcuagccucccgcccacuaggguccaggucacuuccucuaggagauucuaaaacacucuggcacagcccaccagcagagccgggccuugggagcgugagggcacggggccugagccuacugcauccucccagaagcuggccuacaggacggaggcucaggguggccaguugggcaugggguucugcuggcccagagugccagggggacaggaagucccugagggcuccagcugcaggaggagcaucucaggaggagcugaggccggagcagagcguccuccugguccuggcagcccuuggccccucagcaccccagagggccggccgcaguggaugcugcugaaccaccagaaacuuaaucuauuauuacacagaaacuucugugcagucagggguuugaaguccccagaaguguuugccugauuuggggcagauagcggggugauuaaugcucgugauaagguguugauugguucugggagccacugcagacacaggggcuguugugcaugcagggcuggcaacuguagucacagaacaauagcccguuuauguagcacacucccaccccccgccugccccaggcgggcacaaagggcgcucgggccaggaacccaugagcugggcucucccggggccgaggguccagaccuguugccgagaagcugcuuagcaaggccuaggggcaagggcuggucuggccuagcucuuucucccuugagcccccugccacagggcuaaggccaugcugcgggcucgagugacugcccuggacgugacaaaucucugugccucggugcccacaccuauacaauggggguaauaaaguccccacauuguagcacugccagguggauuaaaugaaagaagauagugaaguccuuaaagugagauguguuggcauuuacuccacaaauacugaaugccugcuccaggugccagggacagcagugacaauacaaaacugauacgaaauuccaaagggauguccaccaaugggagacguauaagggcucugcauccauggauucaaccaacuguggauggaaaauguuuggaaagaaaguugcaucugugcugaacaucugaacuuguacaggcuuuuugucuugucguuauucccuaaacaauagagugggucacgcagcauuuguguuguuagguaucguaaguggucuggagaugggaggauguauguggccuccaugucaguaucacaccauuucguaucgggggcuugaguaccuguggauuuggguaccugcgggagguccccaugggugcugagggacagcugcacuuuaguauuuaucuacagagugcuuggaagggaaaacaaagacaggcagggcugguuuggggaaggggccuguuguggauggggucguggaggaccuuacaguguccccaaagcgaggugaaucucauggugucagggcuaagagcauuguggagagaggguacagccacagcaaaggcccugaaguggggaugggcccacaggcuggcaggacagcaaggagacccaugugcugggaccccgagagcuaggacacgugaagcccuggcuggccccgagugcggugugguuggcgcagauggcaacagggucacucuggcugcagagccaagaauggaccacugaggggcugggacagaccuggcagaccaggagggaggccacugcacuaguccaggcggaggauggcagcuggaccaggagggcgaggaggaaguaguagauucaggacuguuuugagagggaccauuuuagcuucuuacggcugcuguaaugaauucccacaaacuuaguggcuuuaagugacacguuuauuaucuaacagcucuggaggucagauguccgacaugggcuacauucaaggagccagcagagcugguucccacuggaagcucaaagggaggccccaccucccuuggcuuguggccuuuccccacggcccccuugucucugcuucuguccugcgcucuucacaaccucccuuccucccucuuucucuuauggggagugcaggggugaucuggaggagccggucaauagcagcgugguggggucuggcagagacagacugcagggggccugggaggccccaggaggcagguggacuuugucccuaggcauccagugcagaggugagaccuguauggccacagagucucccuauccaggccccauuacccugggggaggcggauuaugguaugaacugcugcaggugguccaagaggggcugccccugggagacgcaggguucuucaguaauggugguuucgaagggcagaggagggaagaauggagggaugggggacagacgcuggagccguuuugguggcaggccucuguggcuguggccagaagcagggcugggcaccaggccagauggaccagaggcugcccccagcugaaccaacuacagaaaugagagccccggcccagccuccucccagccgccgcucucugggagcccagcuuugcucauagaaaaggaaggcccuuguugcccugcauugggagcaaacacuuccuuuggccucacagcucaaccuuggacccaaagguccucagggaccugggggaaagagagggcagccaggcaccucuguucacggcaggggcugcguugcccagccuggcagagggaggcagccccuagguacaguccccugugcccacucgagggggugcugaauuccucaaggccugagucagaccuggugcagcuucauaaagccaaggguggcaggcggaauccaaggggccucaccgcccaugcaccccacuguugcauggagagaacaaugcccaaaugcccucgucccacagucggcaugccagaccccucgggaauucaggccuuggugagucuggcacauuccggcugugugucagcgggagaggccugggaaagggagccagcacugcaggccgcccaccacacgcccacucgggcaccggacacagggaaggcggacacccagggcggccaucucucgggacaggaggugcggcuccagguucucacccaggagagggcuuuccucccaugucagaguccccuucgcugcuugaggcaagcccuccggaacagacccaucuuuugggggacccuguggucauggagaucagguuccuagaaucacccccagcagcgcacacaggagggccugaggcccagagaaaggcgccugaagcaagggaggggagggcugguccagagucccuguccccucugccagccacccaggaggcuccuauggccccaucucccagcucuuccggguggaagacagugguggguaacucacucagcuagagcgucugaucacaccacugcagcggcugcucacagccuucaccaucaggaccacaauucugagggcccuuuggaugaagccaucucacagagcugucuccugcagagaggagaggagagggaggccgccuugccagcaggggaccagcgagguguggccugcaagccgugggcuccuguguuccuuccucccccuucagaggaaugggaggaaaccaggcuugaguuccugauuuuugcccuuuaggguuuuuaaauugugggagagccaggagugccugcgugguggccucugucgacuccauuugcucugaagcggggcugcggccaggcagugccucucagccuucuguuuggugggugaggacgaugcuuggucuugccucaggagcauugcuggcaccucucaugugcuccugggccucuccccaacccucaccuuggcaucccccaauauccaaacaauaguccacaaaacaagcugccccgugggcacugcgaagacccucggggccagagccacucccucagggugcugaggccaccagcuggggccuccucuuuccacacuauuccugacgccugggcugggcaggggacuccuggcuucguuucuucccucgccuuugcugggccaucuuucagaccuugccugguaccuucucuccccgugccaaggccuggaggugauguggaugcagccgggcagugaggagcgcaggcgaauguuacagcaggcgcgagcgaaggggcccgaggcaccggugcuuccgacggggcccgagggccgucugaccuuuccggccacggggcagcaguugcgugagcaggaacaaucgccccagugugcaaggcacaagcggccuuuucuuccucaccgggccggcgcacacagcucccagccuggcuucccuugaacaaacauauuuauuguggccgccaccgaggccucgccuugcagccggagccugggggccucugucccacccacuggggcccagggaggggaccccugcccuggcggucuccccugccccaugggccccagccccaucuugccugaggcagggguggcucuggucccacccacccucuggaggcccagaaacucgaggcuccugcugggggcuggugaccacccacaggcagcaagccagccaggguccugggaagagggggucugggacacagccacaccugagcccauccuccaccuggagccagccccuuaccuucuggagccucaguuucccccucuguaaaauaggaggcaucacccagccuugcacgucuccagugucccucagaacggcucuggccccgcagcuggggucugaagagcagagcccugagcucugagauccacucccacccccacccccacccccaggccucucucugccuucccuagugcuccuuuguguguccagagggaaggggcauccuccaucagcacugaccccacucaggccucucagcugcacucaacacaggggcuccccacacucgcccuccuucacugcgaccccgacccucacuuucccacaaacccucagucuccuuugcucagcuuccuuccagacaggcuggcccaggcccuccccacggcuuggcuucccugggcggugucaggcagggacagcagccauaggugguaccccuagugagggggacucauucuaguugcaaagauacagguagagcauagggaccccaaagaguagcaggggacccccgagguugcugcuggcagcuccuagggagacagucgggcacggugggcaccuugagaggaagaacagccaggccugggcagcccugggggaggagccaggccaagugugcugcccucuuggccucagaucugaagcuauagagccuccuggagggcagaggcaguggagaggggucuagcgggcaggagggggacuucaggccuuccacacacacacacacacacacacacacacacacacacacacucucucacucucucucucucucucucucucucucucucucuccccccccacuucagggccuucgcgcccgcuguuccccugcccugccaggcgcaccacccccgaaacaugcacacgcucuccucuucccugcuuaauccucuugagucuucaggccucaacccacgcuuccccugaacauccuccucagagcaguugcgcgcucuaaaucaggaccaccuugcgguucucccagccccagccuugccuuucuagugguucuggccucugaucacaggcacaguuucaagcuugucuagcacuggcaggggugguccugcuccggccccagggcccgcaggugugugugagaggugcaugguggacguccaaagaauaaacgaaugaaccauccaaagcacaggccagaggcagauugggagggucagguccuaagaggccucaggccggagcccagcugcagagcagggcagggguggccaaaaggcgccuagaaggcuggacuuuccgugagguggcggggagcaccaaggguagaggcaggggagcaauggauggguugaaugaggaagcuucacagccccccggccaccgcaggucgggggagcacuguccccggggccccgcagccagcugugcugggcaaggcaggacgggauccuuggugaugggcagaauguggggagcaggguaggacgggccccuuggcugagagccagauguggggagcggggcugucgaggcugaucucaggaugcuugcugcggcugcugggugggggauaacagggguuuuccgaggcccugaaggacuggagaguaggagcaggucucggggguagcuuccugaagagaugagucaggucccaggcacauucagugccagccagggaggugagagguaauccuggaagcugcuauguagacagaagcgagggcaagaccaccgcuccuccgccauaaaccguguuggaugggccuccugccuccuccagccucaguuucccccacugugaaauagggaugaccuccugugcuggggccuggcuguggcuucccaggccccggcugggaccaccgcagaggugaugucuccaggaggcuucugggccagcagcauguuccagugcgacacaugugccccggaguggccgcgugcccagccggcugugcacgcugccccaggcuggugggguaagcgccucggagggcacacuaacaagaggcacaugugccagggaagcccugccuugucaucaccugugccguggcugucagcgcgcaucuggcuuacauugaacucccccauaaaacgugugaaaccugacagcagcgccgcagcaggacagggagggacugugugugagagccagggaagggcugcucagggggcucuccuugauggugacccccuaugagacgccacuugcccugaggcccugggggacagccuggccccuggauggccagagaugccuggggcccuggggugggagguggggacaggcuaauggcaauugaggcccugcccgguggagggugggccauggccgcccccaccuccccucccgcaagcuucuccccuuccuucagagcccaaccacugcuugcuccuucccaccccuccuaggccagggaugccugaagccacacuccacugcauucagccaccguccugaagugccccucacccacccauccacaccccgcaggcauccuagggccuggcccaccacccucucccuccucaccauuuucuguugagcacacuugaggagcacuuggaggagcugggggaugacaugaguccacuccgcugucaccaccaagaccacaguggggcaguuuaaacagcaggcauucauccccucacagcccuggaggcuggaguccaaggucaaggugcugcagggcuggguccuccugcagccucucuccguggcuuguagacaucaccuuccccgguguucucauggggccaucccucugugugugcccgagucaccuucuccucucauaaggaccccagucaggugggauuagggcucacccuuauacccccauucugcuuuaauuacuucuuauaagaccccaucuccagacacacagucacagucagaggcaggaggaggugggugagaggaccccacgcccuuccuccagugugucuggagccccuucccuguguacaaagggacagagaagcgagggggcuccuuggcccuccaguaugugugugcagaaggcccaugagcugccugggguuggggggugguccuuauacauacuuuagaugccagagggggcucauugggcagaaccuaccugggaaggggcccaggcuuccugccugcccuucaguuuacccugugcucccaaaucugaaggaagccuuuccuaaccagcaguccaggggauuagaggacugggaccaguugaaacuccauucuaagucuuggggaccuaaugggauuaaaggcgaccgagcuugggccguaucugggaucuggggcccaccgggggcugugaauaguuggagcccuggagugccgagggcccaggucccaggccucuggggagucuggauuuuuuggagucuuccugagacuugugaccagugggcuugggagagccugaggggccucugggguuagacgguggcccccgugccuggagagaaggugcacuuuggggaugggaggcgcuaggugccaauggcccuaggagggggcuuuggagcuggacccuugagggagucaaugccagcucaucgccauagcggcuugcuuagggccgucccucccaccccccaguuacacagccugcaaaccccaaccuagccccuuccaggugucccuugugaucuuccgccacugacauagguguggcccagagcaaagggcggcuucccauuucaccugcgcaucugcagcugguaugcggcugcccugguggguuccuggcuggcuggcaugcgcccugcgccucugcugggccugguggggccuaagggugaaaacucggucaagauaagaugcccacggcucagggaccccacagucacagguggggaguggcgcagagccugggccugccucgggcuacccugaagugccagccgaggguggcugaggaagcccagucccgacccccaccgccugccuucccaagacauccugagugccccucgccagcacucccugcucggggaucccauuauuccaggaggaggagccagggguaccacuuuccauuaguggguccagaagagaucccagcgggaaggggcagccuucaggguagggcagcggauuagggaggacucccccaggagaggaggaggcaggcagggaaauucuggggggaguguauuccacaggguaagcagaggcuggaucccgagagcaucuggacuuguucccagggcacccagcacagaagugaaggggugccgguggagagggagagccccgggcagcugcugccguguggguggauguccggccacugcccagccaccucucugucccaggaagcugcucuccuggggcaugugcaccucaagugggugcagcaggcccagacccacgggggccccuggaggccugcuggaugcccgcgagcugcaaggaguuaauuccuggccuugugggcuggcaaacucugacucacagagcaauaaaauucuuguguuuuaaaaaucaguauauuagcuuaauuuuauagauuucagaagugcuacuugaaaauaaaagucuccuaauuauauuuaugaucccaacgugagugaauuugacuccguucacggcgaagaagcuuuguguaaaaugccgggaagccuucgugcugacucggcccucgcagaccauaaaacacggcugguggguccgagcccggcagggauauggggucacagcaaagucccuauuaaugccauguccaccucgcugccagggagaguggggcugcagcagggugcgaccgucacagcccuaacucugugauggaugccugcuguugugaucauggacaugaggaugugaggcggucauaauacaggagugggcuggaggcagggaaagggguuggugcccccugcccaggggaggcacaccugggggcacagaaugacacuggguccucucagcuucauccauuuccugcuccaggcagggcccugggccugggcugcagggauucaagggagaaccacacccuccuccacugcugggaggggccgagccuggccuggacugcuggccccaggagccugggccuguggucagggcaggaaauggagaagaugaacgaggaaaggagaaacugcuccaaaugguggggagggaggagagacgagggcagaagugagccccuggcucggugggggugggcuguggagugugggggcacagcggguuccuuacugagcccagggggaggcagggucuggagugugggggcacagcggguuccuuggccaugggggugggcagacguguuaucaugaagccgggagaucaaggaaggcucucugagggaggugacauuuguaccaagcaaggaaagaggcagaagauccuucuuccaggcuaagcgccaugugagaaugcagcaggucggggccacuggcacuagcgugugugacaagggaaucucaggcuucugcucaccucugcugggggcagagacccuggccagagccauggccaaccuccccccacucccagccaggccuagagcagagugcccuuggaggcuggaggaggccaagucagccugucccaucccuccugggcccccgagucaccaggagaugcagggcuuagccuggagaggggccugugcgguuccuggguguucaggggugggguggaugucugcuuuuccugggggccccacagcugggccaggcuguccucccagcagaacgugggcugcagcacuggccacacagacagacccuggggggauuguccuucugccaccugggcauuggcacacuggccuuccgcagacacucagcaggccaaagagugggcuaucaucagacgcuggccccaggccugcccuguuguugcgggugcagugaggugccugcggccaggugggugagcgaggugcaggcugucacucaccagcaggguuggggcuuggggggacccugguacagguggaguccaggggucugcagaggauggcucgagcccugcuaccaccaugcugcuuugaaaaaggacugacuucucugcugccuccgccucccugugaagugggacugacauccccuguccugggguggccuugagugugugcagugcgucuggcacaggcagguaccccacaugugugcccagcaugucugggagggccagggucgcagcagggcccccacccauccuggcuggcucauacuuggccacuggccacaggugacaccaacccagccccugugugagguacugagagcccaucacacagauggaccaaccaaagccacagaugacagguggcaggcccgagauugccugaggucacaugguaacacaugugcacccggcaguuguuucugcccuaucugugguucccagccauuuggaugucacagccccaucaaagguccgcuacauauucccccacccccaaagguggauggacauaggugggcaacauuuuuauuacgcaaaaaaggacauuucguagaacaacauuacucuaaugaaauaccaccauuucauucuagaaaggcugaggacuccaucucagaccaggggcuggugguguccugguuuuuuaacaagaacuuguucucacucugccccagcguuugucagcccagccauggcuccuauccacggcacugggcccgcagagcuccaggagcugacaugcuccgucuuaaggcaggucggcugcuccgaggacugccggcccugucaguaugguguccuugcccagcugguauuggccaaguugaccguguccaggggacagagagaggggaggggcagguuguuggaagccuuucugcagauguagcuuggagcaguguccuaagggaggccagccccuaugggucgggacagaggccucaccagugggauccagucacuggggcugaggccugggugugcaggugggguggugagccaugcggcaguagccccuggggacuagagcaggcuccuuguggagcugugcggagcuggccggccugguccccguggcuucacccugagcgugcugcugccuaggcccugaacagacagaggcaagcccugcauggcgcccagggugccagugacucugguugcucucaaaccaugagaaacguuagaacuucuuuaccccucugugagaugggcugggccuggccucugaggagccuccaggaauggcaggagggagggugggggauggggagugggugcugcugcccaucgacgcugcugggcaacuaacaaauucagcaaauucuucuuuuuauuguguauguucgacaacugccuucacuuaaagucacuuuuuucuggcucuccaaauauacuuagauaaggaaacagagucuauuuaaggaacaauguuaagcaaacaauaguacagguguucaaagauauggaaugagugacagauggggcgagggaccccgaugcagccccacccagaggacagcgcacgcgggcuuugaaguccuuccuggcaggccccgaaugugagcggguggacccaggccuccugggggccucagcucagcuggagccagggucucuggaggggccuggguuaguuuccuguggcugcuggaacaagucgccaaaauuuugguggccuaaaaucaagguguccucagggcuggucccuucuggaggcucuagggagagucccuguccugcaguuuccugcuccuaggggcgcccacaucccuuggaucauggccccuccuucacccucaaaggcggcugcggcucauggcauccucacaucacagacucugugcguccccugcggccacgucuccuccucugacucugauccccugccucuuucccguaucaggacccuugucaucacauugggccacccagagaacccaggauuuucuccccauugcacgaucagcugcuuggcugccugaauuccaugcagccuugauuccccuucaaaggaaaucaaguggcaaaggggaauugagugacgcaugcgugaguuccaaggauuagggcauagacuccuuugggggcgcccuggggugggggguguuccugugucucccugcagccccugcuuggacacaugaccagcucaggcagugcugccuccgggggaagucaagagucucuggugagucucagacaggccucagagugucucaggguggccucagagacaggggaggccccuaugagcuggagggagugugaggacagggccuccugugagagggcagguuugacuuuuacucugccgcugagugacuguguggcccaggcagucaccccagagaggucugacuggcgcuugccgggguggcugugugcagcaggcauuggggcccuggagauauuugcucuuucuuuuuguuuuauuauccagacuugcaaggcccugugugcccccucggggcugcacacguguacgcacaaacgcaugcccagugugaccccuguccacaccuggugccuguccccugugccccuguuuaucccuucuaccuacagccuauccccuacccaggcccagcccucccagcucacccucuuccaacccaggccugagcucuguucgggucucuauccuccugcccuuuagccuccucucuuacugauagaacauuccagagcauuccaccaccacuggccugcaauuaucaccccaucgcugugagugggggcaggcugaggaagcugugcucgggccggagcacagccggccuccuugcaggggcagcugcgggcgcgcagacagcuggggcugggagccucuuccagggauccuccgccugugguuuuccuccuugaccuucuuaggaggguccaguuccuucuccuggccaaggccccacucucugccaccccaggcagggccagggugggucaccaucugcagaagcccucaggggcccccagcagcgccccuccuaucccccugccccagggcgggcugccgccuuguaacccccagaacucuuggcucucauguauaugagucagcguugacuguuuaaccuguugcaagacacucugcugggugcugcgacaugguuagguuuucuccacauuagaagguagaaggaagaaaaauaaguucugaaagaaacagacuugcccugccucugcccugaccuugaggugaacagagguuuugcacagaacgaccaucccugcagcggguggcuugggggguaccaccaugauuugagacccuggguggugcuggccagaaucagccucuaugagaugggcagggcaguccagggcaggggaagcccugugccccaagaucagauacaucagcuacaaugagaggcaucaggcggccucaggcccucaagccgguccccaugugcccauuugcagucugucucauacucacggccaccuggccacugcacccugauacagcaguggggccuucaugccuguggggugucugccugcccagcugugcccacucaugugguggauucaucccaaugcugguccugggggcccugggcuccccccggcccuuucucggggcaguuuacacuuugcagcugaaucaaucaggggcagaaaugccuggcaggggaauguuuaccgauuugguuuucuggggcugaggaugcucgguguuuguccaggcucuguccugcuggcuccucuaaagcuuugcaaacaagagccucggagagaaggaggccuuccccuccccaugugcugaauucggggcgguccugacagccaugcgcgggggcccgcuguggccuccucugcacggcugcugagggaaugcaggucaaacaaaguaggccagcggcuuagggacccccgaguaagcaggcagacccacaggaaauccagugcuccgagcccccacaccugugguguggcagccacccagcaagacuggaccgagaggccacgugggcagccacccuugccaggugggcacagggagugcaggugguuuguucuugccucagauccaggagagcagcuuuuuugccugaacccacucgugaauuuuucauauuuuuggagagcuccuugugaggacagccggccugagcaggcuuugaugaacauuagagcagguggccacaauugggcagaucugggccuggagacccaguugucauguuugagagggaaggggcauucccagaaaucacagggaugacuggugugagcccaccgcccaccuagacucccguaccaugcggggccccucauugacuccgagggucuucaaggcccugugcuccuccagaagguggggucugaggugcugcugggugucucucuucaccucuucagaagcauucaugagguaagaccccaccccuucaggcccuggcacaggccucagagcaggcccaccacccaacucacugguucacuuagggguagaaauuaucccagcuuuuacccagagcucagggcccaagaugucaguuugccugccggcuguugcucugacuguggccucccucccagcuccccggcaugcagcucccagagggagaacuugagcagggaagggaaggggcucgaaucccuacgccagucccugcauggcccuauggggacuugcgucuccccggaggagagcagcccugcgcagcccucucuuacugauuccuggagucugcacagcuacauagggucagauucacgaccucccagcuuuaaccagccuucuugauuagccgccaucuaaggcccaacugugcuucgugacaggccuuugagccuaaaaggaguugcccccagcaaugacaucggaugccuguuuagucagcggacugccucagaaaggaaucucacaggcagcggguucuucugguagggugggauauuucagcgggagguaaacagguguugucacagaacggcagacuggggccuccccuggugggccuugagggugcuggccugcagaccugcuccugcccguucuggccugauccggggccucuugacugcaggucucucgugggcucucagccccaggugccugcccucacccacguagcuugggacaucaucagcccauugccgguacccaugguaccuucaccacccucuuggccgcauucugaaaaucaauguuuagucccuccuugaacuuaaaaagucaaacuuaaaaagagauuauuacagggagcuggggacucaggcuugcacccugccuguuuaggauaaaaggccaccguguguccacucuagugucucugcucaaacaggagacgauguggcaucgggaacaccaaugcggcacucagagaaggcucuuagccagcuggccccugaugggcucacuggcugcaccagcuuguguagcagcugagcuccugcagagccuucugggagggaagaauguguuucuugcuccaguacugcagagcaugugauaccugcaggggugcaagaggugccugagagcaggcauagccaagacuuguuugcgguugcuccugacgcagagccggcacaugagguggcguucccucacucucucauucauucauuuauucgccaguguuuccugggccccaugccaugccagguaccuuacuaggcccuggggauaaaaaagaggacaaaagagaugagaccuucauccuagagcuuaggaugugaacugcguccuucuuuaaauggaaauuucuaaauuacgguguaccgaaugcauccacccuuggccucgucacaugugcuguugggcaguauuuuccuacauuuucuucugugaaauuuauaauucagccuuugucauucaggccugucgucguguccaggugcaccuuugcauucggaagaauccagauuccuuuuccuccguggagugacuccccuuccccaccugcccugcagccauuccauccugucuaugguggucgauggugucaucuuuguggucuaguguguucccgaguauacaagggugugugaucggggcucccucuuugcacugauagucugcuggucggaaggacaauggcggcaccccaagaccugaugcucugguuuagaaacggguucuaaugcccagaagagcuccuaaaccccuauuuauaauaaucucuuuuuaaguuugacuuaucuguuugggaccuuuauuccuccaugccaacuuuaaaguuaaguuuauugcauuucuuaaaaauuucaacuggaaguuugcuugggauugccucgaauuugcagguuaaauuugggaaaaacuggagucucucucauguugcguuuucuccuccaagaacaaggagucucucugcauugagucaggcccucuuggaccucuguugccaucuuuuccugaaagggcugguggggucuugcuuccauuauuccuggaugagaccuucuuuccccugcuauuuuggaauuuuuucucccaggaguuuauugcugguauaaagaaaugccauugauuuggggggguugaucucacaccugacaaccaugucauacuuucuaucagcucuauugauugaucuuuugauccugcugauugucuaaguggaucgguccuaucaggaggagucagcgugaccacaggcccccauuccccagccccuaauguucuugccucaugucuucaggugcggggcuggcagaggcugggguuaccugacacuugucauccuucugcugggccucagcacccggcggaggcaggggcuuccucugacacgauacagggauuugcugacgguuccuugucugcucacuaagcgugccuuggagaaggccgcucagcgagggccgccuucaggccugagcccggggccaggaccaggagcaggcggcagcagcaaggcagcucauccucggcugccucuucucccucacuacuauuugguuuuuguuuuguuuuguuuuguuuuuugagauggagucucauucugucacccaggcuggagugcaguggugcgaucucggcucacugcaaacuccaccucccggguucaagcgauugucucaccucagccuccugaguagcugggacuacaggugugcgccaccacaccuagcuaauuuuuguauuuuugguagaggugggguuucaccaugcuggccaggcugaucucgaacuccuggccucaagugauccauccgccucggccucccaaagugcugggauuauaggcaugaggcaccaugcccagccucuugccgucauuuuuuuuauuuuaaauaaacuuugauuuuagaauaguuuuggaauuacaaaauucuuacacagguggcaccaagaguccccaggugcccuucccccagcagcccuauuaucagcaucucacauuaguaugcauuugucacaaggaaacaacagugcuacaugacuguuaacugaguccaugcuugaugcagauuuccucaguuucccuacugucuuuuuucucuccccgggccccacccagggucccaugugacauuccucauccgucucccugggcuccucugggcggugacuguuucccaggcucuccuuguugguggugaccuggacgguucagaggaggacaggucagguguuuguagggugucccuuacuaggauccgucugcugcuguccucacgauucgacugggcugugggugugaggagggagagcacagagggaaaugcccuucucaucgcccuguuccgagggcccauccugucgguguggcucgucaugggcgaugcugucucugucuccuggcucugaggccguggcugucaaucucuucaacugugauuuguucuuuucccccuuugcagacuguccuuggacccgccagcauuuggcucuggggcccuagagagacccugggauguggaucacacuggugaccccugugagccccacuggggacagauccaggaagggaccuccugggaaugaggucuggccucugccuggaucaaagccauggcccccauuccccggggauagggaagcugugcaggcagccuggguaaugggccaccgccccaggcaggcgugggaauccacacauggcccuucucaaagacgggugcugucccuggggcucuggcgggguccuggagccucucucauugggcacauccgagcccagccuggcccaugguggaaaugcaaaucuaauuagucuggcauugagcccgucuuaaaaguauuaacagagccuuaaacugugcuguuggacggggaugaagaaacgccuuagaaagaaauuaccggauggugacaaagccccaauuuauuagucuucuccaauggggacugugcaaaggacauuaauuacuuuaaugggacuuauuuugcuucguugcccaaaguaauugguuuauuaaccucuccuucccuuuagggagggagggagggaaagacuggggccuggggguggccccgggaggggcucguccagccuucugcuccucugcccagcggugcagccuugcacccuggggcagccggugcuuggucccugcuggccugggcuggggcugccccagugcccacugaucuauucuuguucacuaggcauccaccgugugccagucacuggaauacggccaugagaaagacaggacccucaagaaacaaccuguucccugaaggccauaaguucacuguugucacaggugcccagaggaaaggaagauggcuuuggggguggacacgucugggcaggcuucuugcagaaaggccacaggcuaggauggugggaaggcaagagaaugccgggaaagggaggacugguugcccacagggagugggggucaugggggcagguuccagagaucagaaggagguggugggaagaggcacgcagggugaggcuggcuggaggcaggugaggcagcccagccucaggagccaggaaccagcuuccccgggcuuuaccagauggggagcgauaagggcuguguuucaaaacaaucccucuggcgugaagcaagccgucuugaaaacagaccagaaccggcugcuuccaccaccagcagaauacuucaagaagaccacucgggccuagggcucugcaagcaauaucugauuuucagaaaaccauggcucacccacacucuacccuaggaaagggcagguucccagggcugggcuuguggccagugcagcacuauccucaguggccugggacacccagaacuggccaggaaagaccccuacacagacccccagcucugcagucagcccugucuccuuguguccccagaccucgggcgagggagaagcaaguuccccucaggaaugcuggugaagcuggcaugcccccacccccuagcucacccuggguccacgcagggccugcucccagagugaaucccagaggugugccugccccaccugucccaguaagggugguuguguguguuggguagauguggugaggugugcugguggggagggucccuaucagaugccccuggguaccuccccaggcagggcccucagcaccugaugccaaaccaggcuccacucuuccuccaggugagcccgagggcccagcugggcguccacguggagguguggggcccgggugggacaagccuggcaaccaggacccagcaugaaacugcaggugcaggagccccagccagccuggaaugugggggcucagaggccacccagagcccacagcagggacuccccacgccaggcccggcuggaucacagagcuucggguccagccagcugcugcugccccucccucugggccucaagaccaucugucacgugacaggggcaggcuaggccuuucuugaacucacugugagcuacagagacuguguucuggccaggugaauggugccccugggggccaagauccccaccucuggucuggcagcugggugugcaggggcagccccagaccuccagagugcccucuuccccucuuugcgguugucacccuguccuugagucuaacuggggcugugcugccuuugacgugagcuauucaaaauggcgggaggggcgaggccucuggagcaaggaaagagagugguggcuguguccagcaagucccuguugccacugauagcauaaaaaguaacucugaaaccugguggcccuacaguugacacacauggggccgcaggaggaaggaggcucaggccaggccaaacaucagagaccucaggucugucuccuuuaccaaauggggggcuguuccgccagcaccccaguagggaggaugagaggaugccaugauuuccaggguggugucagaaccugucugccagggcucugcagggagggguuugggguugagauugggagaccuagaaaucgaggggugucgggggccucggcuggggggcaagcacagaugaggauggaagcagcucagugucacucagucugcacugggaaugggggaucccaaggccagggcucugccuggugccaacugugugacccugggcacgcugcugagccucucugggccccaguucccuuauucguacaacgggaaugaucgaggaguuaacauguguuuaaaagcaccgaggcuuggccgggcgugcugccucacgccuguaaucucagcacuuugggaggccgaggcgggcggaucacgaggucaggagaucgagaccacggcgaaacccugucucuacuaaaaauacaaaaaaaaaaaaaaaaaaaaaauuguccgggcgcgguggcgggcgccuguggucccagcuacucaggaggcugaggcaggagaauggcgugaacccaggaggcagagcuugcagugagccaagauugcgccacugcacuccagccugggcaacagagcgagacuccaucucaaaaaauauauauauauuagcuggauguggugguggacgccuguaaucccagcuacucaggaggcugaggcggggaaacacuugaacccgugaguugagaucaugccacugcacuccagccugggcaacagagugagacucugucuccaaaaaaaaaaaaauaaaaaguacaggggcucuacacggcgcccugagaauuguguguaaaugagugaaaauggggugagagggagggagugggaacagccaagaggccaggaagcggagccugggugcaggggcaucuugcuggugaagcuggggagagaccugcgcaaccccaccugagugaggcacugugggcccagaguccaggucagcgccaggggcagcaggggcuggaucucuggggaaguugaggaaugacauguauuccagggaagaauugggccggaggcugaaacaggacgacagagcccucagcccagggcggaggacaugggagacggggguauagcuguugggcuuguggcuggccuggccuaaccaguugggggaauccaugggaggcuuuagcccugcucugugaacugcugggccuuccuuaggggcccuggggagccuucccagcagaauguccaggcuccugcuggcccaagcuccaaguucucuggcucccagggucuguguggaauccaccgguuucaccccacgucuuuuccucuccugccugguaacccucucugcagaggcccuggcuggaccaguugcuuugcaauucacaaggcuuuggaaggcagugcucacaaaucacuuuucuagacgaagaccaguaagaagcccaugucauucuucugagacauuagggguuuucucucccuuguuuuaaucaaccaguucccaauaagucauuucagucaggccauuaccaauggcucauaaucuccugggcugcugggcgaaaugggauccccuggcucuuucacugaaaacacuuuucuuguuuucuuucuccggcaugcuggaagccggccaacucgccaguuccauuaacuuaaugagggcugacagccugcgacaaacguccucauaaucuccccaggauuuaaacgggguccuccccagcugccugccuacaccccaaccucgaggcucuuuaccucugucugugcacccacccagccccuccugggaaaaagccaggacaaagauguauuucuucgcuagcuccuuccugguggcucugugcaggcagccucagaccuguaggcccucugcccaauuugggucacccacagcccccgcaccccacagcaauuucuugggagcugaucauccccaaagcuuggaacuacaaggcagugacugguuuugccgggcuccgcucgucccucugagcggagggucacccuggucaccaugaaaacuuuauccucauccacaccuuucuuucuccaacuagcaugggaaucaguuuaggguccucccacacccucauccaaacccucaucucccaccccccacuugcagagaaagccccacgcucucagcagaaacggacgccagcguuuaggagcgggugggcucccggaagggggcucuaugggaaaggggaggcaaggcugagcagcugcccaaagugagcaucugucccacguuccacccccaggaaacccucucuccugacgcggggacuugcgucucagugcagagggcaguggagggacagugcagcuccgaaaugagcaucugaguucacugcuggugggcaccaucccggccaacaggccacuaguguguucucccucuuucaaacggggcggcgacccucgucugacaggcggcuguucugagagcgguggcugucccagggaagcccucggugagcguagcguuaccaugguuuuuaaauuaaagcaucugcagaugcgcugugucccugcaagggcaggcagaucgggaccccagggacugguccccauagccaagguguucagccgcccuguccccuacacagagugccucucccacuggcucagggugagggcaaaauggcacuugcagaacaugaggcccggccagcuuugcccuauuccccccauagcauggcugaccuuccucugagccccucguggaugcccacacacggcaagacguuuccucaaagaugcucuucugcaaagcugcacuuucucgguugccgcugccaccuuggcaccucucugggguaccuuguacugcccuguccuccccacgcccugaggggccguccuaggcagcacucacccuggucaucccuguuuccaccacaagacuguuuguagccgagcuugggaguuguguuguguaguguugacuugaguugcaucguguuguguugacuugagcugaacugugcugaguguuacugaguugaggugacuggguugauuuuagcuucacaggugaucugaacccagcugaguggcuuccauggagcugaucugaacccagcugaguggcuuccauggagcugaucugaacccaguugaguggcuuccaugaagcugauccggacuaagcuaaacugaguuucauugagcagcuuguuuagcuggugugugccagguggucucucgggggguccgaugggauaccuagugucuuaaucuguucagucugcuauaaccaaauaccuuagaccuggugauucauacuuaggaauucauuguucuggagacugggaagcacagggucagggcgccagcagaucuggugucugguaaggggucugucugauucauggaagucagcgggcuguguccucacguggcagaagaggcaaaaauaaggugcaaacaagcucccucaggccuccuuuccaagggcacgcauccucuuccugaaggcucugcccucacggccgaaucaccucucaaaugcgccaucuccuaacaccaucagggcugcggguuagcuuucgacauagggacuuugggaagacacacacauucagacuacagcaccuugcuccuggggaaacagaggaaacugguuccuuucuuucgguucuggguuaugucaaaaugaguucccuuugcugaaucuguuucagccaccucucccgaggauccucgcacaauuucacugccagccaggaaggucugcccuggcuggucugggcuugaggaccagcacgggaucguucuccucugugggucgcugauaugaaaacaaucucacaaagacguaagaaccacacaugcuuagugucaugugugaugcaucaacccagggggaggagagaacgugcauucacgcagaacucucucagccacaagcucuguuucuguugcauuugggccagguugcgaggagccuggcaggccacccggccaguguggaugucauuacaugagcaguaggaagccauacaguaucugaggcgggggagucacgagaucuucagucugucccucggaaagccccuccugccgccacucagggggauggguuggaaggggugaggcuggagcccaaauagggaguucagaggccuccgugucugcccagggaaggagggaggccagcuucagcugcuguccugaggguuccugccugggucccugaucccccugagaaagggcucccucccagaaaaggcaugugcccugggcagagccaggaaagcuggggaugucucaaagccucccuaccugcucuguguccccucccucuggagccugccucucucccgagcaaaguaccugccaccugggagugaucugggacagucagaugcaccuuuugaaguauacaccucaguggcuuuugguauauucagagucaugcaacuucacgacucucuaacuuuagagcauuuucaucacccucaaaaugucccuugcaucccagguacaaagccauaccaggccccauggggauggcuugugacugcugcacauccugccccuggaccuuacucuaguucuucuuucauccacugguguauuccuuuggccggggacacacacauuugagaaacuucccagcuucccucuaucugaggcucacuccauuacaacacaaggaacugagacaucuguggcugguuuuuuuuguuguuguuguuuuuccaaauuguauaucugauaagggauguguauccagaauauacaaagaggucuuacaacucaauaaugcauugacccaauuaaaaaaugggcaaaggacuugagcagacauuucuccaaagagcagauacaaauggcaaaugaucacaggaacacaugcacaugaacacacgcucagccucagcagucauuaaagagaugcagaucaaaaccacagugagguuuacacccaguaggaugacuaaaacaaaaaagacaauaacaaguguuggcaaggauguggacugccagagcgaggcuagccaugccauguaucuggaggagggcccuggaggggugugcccauugcaugucuguguguucccaugcagugggcacaggcaguggugccagaaagagccucugcugggcuuucucaccaccccagccucucaccugcagcccaggcauccuccaguggguuuuucagggaacuuaacaugaugagucuaaaauuucuauggcugaauaaagaacugaauaaaaauaaccaagaagaucaaggaagggcccugccuuccagauaucaggauguggaagaggcuauacuaacuaagauguugcaguguaggcacaaggguagacaauuagcccauuaucccaguggacaagacagagagcccugaagagauccauacaaaugugggacauuggcaugugaccaaggagguguugcagguugcuggaaucaaucauccuccagaaggaaaaagcuagaguugggcccccaccucaugcaaucuauaaaaacugacuccagguggaucuaggaauuaaauguuaaaagcaaaccuuaaaacucuuacuggauaauauacguuuauuaguaucuuuuauaacucggcauagggaaauauuuauuuuacaagacacaaaagcauugacugugaaagaaaaacauuggucaauucgauuuuacaaaauaagaaucccucaucauccaaagauaccuuaaagaacgugacaaguugcagacuggcgauugcacuaguuuucuggcacugguuuaacaggugacccccaacacacaucagaauaacagacguuuacucucuuucacuucugucggucagagguccaaccccaggucugauggggcuggagggcgucauuagggcuagagguccuaggggaggaucuguguccuugccuuuuucagcuucuagggguugucugcauuccuuggccuuuagccccuuccucuaucuucagagccaucauguuccuccucucugacauuuuuuuucguaaucacagcucucucugaccacagccaggaaagagccuccacuguuuguuguuguuguuuuuguuguuguuguuguuguuguaugguuuugcucugugacccggguuggagugcacuggcgcaaucauaguuuacuguaaccuugaacucccuggcucaaacgauucuuccaccucaacuuccugaguagcugggacuacacgcacgugccaccgcgccuggcuaauuuuguuuaauuuuguguagagguggagucucucuauguugccuaaacuggucuugaacuccuggccuuaagugagccucccaccucacccuuggccuuccaaagcacugggauuauaggcaugagccacugugccuggccagggccuucacuuuuaaagacuugugguuaauugggcccaccuggacaauucaauaugauuuccccaucucaguguucaugaccuuaauuacagauacaaagucccuuuuccauauaacguaacauauucauagguucuaggacaucuuugggggagcccuuauucugccuaccaaagaaauggauauucacaauacaaugaauugauaaagaauugguguauguauaacuaauacauaacauguauaauguauuuauauauguguguguauaaccaauaaaaucacuaauagaaacuaaaauaacgaaucaauaaauauacaaauuaucagacagaaaaauggccaaagacaaagacuuguucugcccuucauggucgaggaacacauguggccagugaguacgugaaggcaccauuuacagaaaccauuuacaccacuccauuggcauaaaccacagucugaccauugggagcgguggcagggauguagggcccagggucucuccuacauugcugaugggaguguacagugggacuaccacuuuaaaaggguggcaucaccuccaagguggugaauucacauaccuguugacccagcagucccauaucugggcauacaccaaaagggaacucugguguguggacgagugagaaugaacaggaguguguguugcaacgcuguucacaagcuccacgugcaaccagccacuugccucccagcaggagggagagugaguaaacauggaaugcccauacaaaagagaauuuuaaacuaauuaaagcaaacaagccagagugacagacaaccaugugggaaggcuuggcaauauaauaccaaggaaaagcccacugcauucuuaucaaguuuaaauuacuaaaauuaaaaaaaaaaaaaaaaacaugacuuuugggacacauauaguuucaauaauauuauauuaaaaaagaaagcaagggagagaggaacacaggauucagguugaugguuacccaggauaggggagacaaggauacaguugggguggagcugucaggguccagcauuuauuuuguguuuuguuuguuuguuuuuguagagaugugguuuggccguguugcccaggcuggucuugaacuccugagcucaaagcaauccgcccaccuuggccucccaaagugcuggaauuacaggugugagccaccacaccuggccgucuagcguuuauuuugaauaacgaguccuugggagcuuucuacauuguuuuuaaaaacuaauuauaugacauuuuauaagaaaauuauauuagcacaaccgggagagauuuauucuagguaaugcaaggcuaguuaacauucaaaacuuaauuaaugugaucuauuauggaacuuucccaacuugaucaagagcaucuuaaaaaaaaaaaaaaaaaaaaaaaaaaaaaacccacagcuaacaucacaucacacuuaauagugaagaacagaauacuuucccccuaaaauaaaaaagaaggcaaggguaucuguucucaccacuucuauucaauauaguacuggaaguuccagccacugcaauaagacaagacaaagaaaugggacauguagauuagaaaggaggaucuaaaacuguuucuauuugcaaagauagaauugucuauauagaaaaucccaaggaaucuacaauaaaaauaucuggaacuuaggaguucagcacacaaaaaucacuugcauuucuauacacuaacaaugaaccugugaaaaccaaaauuagaaacaauaccauuuacaauugcgcuaaagaaauuaaaauacuuagguauaaauuuaacaaaacauguaaagauguauauacuaaaaacuacaauaugccaaugaaagaaaucaagaccuaaaucaauggagagauauuccauguucaugaacuggaaaacucaaaauaguaaacauuucaguucuccuuagaauuaccuauaaauauagcauaauuccuaacaagaauccuagcaagauuucuuauggacauggacaaacuuguucuaaaaucuauauggaaaggcacaugcuguagauuaaaacaauuuugaaaaagaauucagugggagaaaucacucuaccaauuuuaaggccuacuauacaguaaggaaucaauaugauuugauauuggaggaauaagcauguagcucaacagaacagaacgaggaauccagaaauagacacacgcaaacaugccugacuaauuuuaagacaaagaugcaaaauucagcggaggaagacuccucuuucaacacacgguacaggagcaguuggucauucauaggccaaauaaauaaauuaaaacccugaccuaagucucacacuuuauauaaaaauuaacucaagagccaccuuggacuuaaauaugaaguguacaacucugaaaccuuuagaaaaaacauagaggagauaguauuuaggauuuaggaagggcaaacaguucucacauuggaugcuaaaagcaugaucuguuuaaggaaaauugaugaaauggaccccauuaaaacuuaaaacacuuguuuugugaaagccccagugaaggggauaaaaaugcaaacuauagacuuggagaaaauaugugcaagccacauauuugacaccuggcaucuagaacaugaaguacucucaaaacucaacaguaaaaaacagccuguccaacuagaagaugggcaaaagacacgaagagacauuucaccaaagaaaauaaauagggaagaaguacaccaaaagaugaucaacuucguuagcaaagauggaaaugcagauuaaaaccacagugagcggucacuacgcaccuaucagaauggcuaaaaugaaaaguaaugaugacaccaaauguuggcgaggauguggagaaacgggauugcccaucuguugcugcugggaauguaaacugaugcagcacucggggaaaauaauguggucguuucuuauaaaagucagcaugcgacuaccacacaucccggcaacugaacuccuccugggcauuuaucccaaagaaacgaagacucauauucauacacaaaacuaaaugaaaauuuauagaagcuuuauuccuaacuagcugaaagcugagaacaaucuauguaucauucaacaggggaacaggcaaacaguggugcaucccuacccugaaacacuacccagcaguagaaaggaacccacuaucgguacaaccuaagcggaucuuacgggaauugugcugaggagaaaaagccucccccgaaaggucgcaugcugugugauuccguauagauaacauucucaaaguccaggcuguagggauggagaucagauggugguuccugggguugggaauggugagggugggagugacuugcacaggagacgcagagggggucuuucugguggggaggacuuccauuccucguugcugugugaaucugcacgugugaacacaaggcagagccacgcacacuguaccaaugucaaucuccuggcguugaucuguuacuccacccaugcaaggugugaccgucgcgaacucacguagagggcauacaggaccucuugguacuuuuuuuuuuuuucccaacuuccuaggagucuauaauuguuucaaaauaaaaagaagcaaaacaacacacugggaggugcaggaaaccacacacgugaugugcuugugucugcugacauaagugcucaaggaagagucuggaaggccugcaaggcccucaugccuacgagguggcugcuagggggaugugacguagagugacuucaguuucccucuucaugucuccuggguccuccagcacucuggguuuccucugccaagacccccacccaucugccucucuucaucucacaagccugcaugugugcagagggcagggguccccaggggauguuccuuccccaaggcgcuguggccacuuagagggucccccaagcucgggccuuugaagacagcucugugucuccuaggacgcacaggugugggaccucacugcgcgggagggaguugcaaagagcgacaccccagcaugugggaaggaagggagcgagcucuuauuuccuuauuuucuuuccaucuccacucccaggcaaagcugauaaauucuuccuuauuccagaguuagaggauccuccagaaggggccgagagcuuguccaggcaggguggauacaaggggcuugcaucugacuuaauugucuggcugggggagaggggacagagguccugggaggggcugaaggcucagggacacaggugaggccagccccuccuccacccugggcaucuccaggcccagccccacccugagcuguacuggacccaagccccaggacccccuggagucaccuccagcccucccacaugccagccccuacccugggccucaggaucugccuggauggaggccaggccgcugagcugcugggaaucuguuccacaggugggaaggucggcccgccaugggcagcccaguccgggaaacuuccugccucugcuuucccacaguguccuucgauggcccccagugacguguguugaauguggcgcuggccccuugggcagcccagcagcccccaccccagccagcccagccugggcagcacugggggcuccuggcuuugaauuugaccuauccagaaacaacggcuccuucagugggcucagccccugagaccacucagccugggcugugugcccagcggcacuucauguacguggacggggcaggcgggcaggcgggcguggaggagcuaauggguaaguuaggcagcacauuaacaaaugaaccagcggauggggguggggagcucaucucauucaucuacaaauuauuaacaauaacuuguucauuaaugaaugaacaggugagauacaggucagugggugcaugaaugagugaggagaugaaugaagcgggucuuuucucagcagcugacccacggccaagcccccgcugggcagcacgucccuuccuccucucccaagcuggguggugcgggcagggagaggguccauccgcccuucaguaggugaggaagccacgggccuggaggguggcccagcccaggcaggagggcaccagccccgggcccucagugccuuccugcaaccaggguccaggggucacuuccuucacggcccagugagcccaaggccuccguccugcccccugucucuuaccagcucgcuccugcaucagugcuacugaaaugggaaagguuuccuugucccccuugcaggacaugugacagggguguggcucgcuucuucagugccccacuacucaaaguucuaggggagcauacagucggacagguuguggggcuccgaccccacagcagcgucuaggggugaauguuuacagcugaagccccauggguguguguuacagggugcucuuuaguuuagccguccauagacagcuugcguuagucagcucaguuagacccccugccuuacggcaagggcagaggucuuucuguaucccgagguucuugccuuggcguacuggaagaaucagaucacacgugggcuuggagaaugagugcaagguuuuauugaguggagguagcucucagcagaugggggagcaagaagggagauggagugggagggugguuuuccccuggcaucaggcggcucagcagccugggcucuccugcguccaccccagccaaacccuucaucguuccuccggucaauggucugccggccugucggugccuguuggugccugucggugugcuccuacgcugguguguuccucucgaccuacccucaacguccagccgcuugugucuucuucugccgauguguuccucuugauguccagccgcuugugugucugcccacuaaggucucgagaucuuuauaggcacgggaugggagcauggcaggccaggguguucucgggaaaugcaacauuugggcagaaacaccgaaaugucuguccucaccuggguccgugcacauaggccguaggguggaacccuagccagggacccgcccuucuccucccagcacuucccugccccucuuccguaucacuaccaggaaaggccacuuggccccaucccaggccucgcccaagacagagagagagacaccacccccugcaaaggagcaagccgggcccuucucucugagaccacaggguggacuguguucagcagaaaagccagguagccagcgcugucaccagagcaguggcugacccacagcauggccuggacagagcugggggccugggcuggcacccucagcccuggcugcuugcagucccggccggcuguuugccugugaaggcuccggcuguguucuagggaguuggcaggaggggaggcccgcagcagcuucuagcggccugugaagcagccacggggcauggcccucugugcagaacaggaucugaggagccccgaguguucucacuggauguggggccgcauccagaccuuggcggucauggccacaggcucccaaggcccuaagugacagccagugguagacccuucacggucaggcaccuaugacuccccguucccugccugcucccaggcuguuuggggugauggaaagaggccaggacgugaggccaggguaauaguuccucucgugugucaggccugggaggggggccuucaugagaccaucacggagaucuuggggccuccaauuugucaaauaguuuucuguuacaguucauacuguuugcguuccuuuaaagacgucuuugcccaucccaggucgugaaaauauuauccaacuuucuucgacaggcccgauugccucauaguuaggccugugacucucccuggguuaacuuugugaccggugugugguaaggaucaugguugacauacuuucacaggugcauccacauuguuccagcacccuuuauugaaaagcguauccuuccgccagcucgacggcaaaggcgucuuuucuaugaaccaguggccacaggaggguuugugugucuaauguccuauuccacggguccccaggccacagaccgguacccauccauagacuguuaggaacaggaccgugcagcaggaggugagcgguuggcaagugaacgugaucaccugagcuccgccuccugucagaucagugguggcauuagauucucgcaggagcgcgaacccuguugugaaugcacaugugaggggucuaggcuguguacuccuuaugagaaucuaaugccugcuggucugaacuggaacaguuucauccugaaaccaucuccccccaccccaccccguccacggaaaaagugucuuccacgaaacuggucccuggugccaaaaagguuggggaaccacugcccuauuccgucagacccccacuguucaucugucugcccacacgcucuuaaucaagcccuguggccucaugaaacccuaggagugucagaccucugacuuuguuguucuucaagaucgucuuggcuauucuuggcccuucacguuguuaggaauauuuuagaaucaccuugucgguuuccaauaaauaaacaaacaaacaaaaagcacugugauauugauuggaaucauauuuaauccacaccucaauuugcagaaaauuaacaucuuauaaauauugagucuucuuauacaugaacauacuauauccccaagucaaguuagggcuucuuuaucugucucuccaaugcucagugcuuuucuguguagcagucuuacacaucuuuaaacagauuuauuuuagagcuggguacgauggcucacaccuguaauaccaacuacuugggaggcugaagugagaggaucacuugagcccaggaguuugaaaccagccugggcaaaauaacaagaccccaucuuagaagaaaaaaaaaaaaauaagaaagaaagaaagaaagaaagauugugaaagcaagacaguaaagaagaaacaaaaaacuuuuuugaaagauuuauucuuaaguuucuggucaaguuuaugguuauugaugcuauuguaauugauauguuuuauuuucuaauuguuacuagcauauagaaauauacauauacauauuuuaaaggcagggucucugcauuccaggcucagagcuuacagcagccuugagcuccugggcucaagcaguccgcccaucucagccuccugaguagcaagaagcacagguacacaccaccaagccuggcuauuuuuuaaauuuauuuuuucuacagauggggucucacuauguugcccaggcugaucucaaacuccugggcucaagugauccucccaccccacccucccaaaacacugggauugcagaugugagccacucugucaggccuagaaauauaauuauuauauaucauccuuaaaaccggcguucuuguuaaauucauguauuccaacaguuuaucugaggauucuuagggauuuuuuuuacauguaugguuaugucauuugcaaauaacaaauguuuuauuuuuuccuguccaauccuuguaccuuuuaucucccuuuuccuaccuuuuuaacauaccagcugggaguuucuggacaaugugaaauagaaacgauaacauccuugccuugcuuccugucucaggaggaaagcguaucacauuucacuauuaaguaugaugucugcuuaggguuuggguuuuuuuguuuuaguuuuugucuuuuuuuuuuuuagguaauggaguuucuauuccuaguuugcugagaguuguguuuuuaauuaugaacaggucucgcuuuaucaaaugcuuucuuacaaucuguuguguugauuguauuuuuucugacuuauucuguugaugugaagagugacgcugcuugguccuuagaggguaaacucagcaugcacaaguggauuaaaccacauucgagcauguguuugggcacagugcuacaugcagcuugcugguggugguuaggauauuugcacguauguucacgagagagauuaaccugugauuuuuuuuuucuuucuugaaauauccuugucagauuuugauaucaagguuaugcugccuuaugaaaauacuuguauaaaauugacauuauuuuuuccuuaaacauuuggaagaauuuacuggugaugucgucuagauacagaguuuucuuugccagaagaucauuaaaauuccaaauuuaacuuauuuaauuaauauugggcaauuuggauuauuuuuguuuuugugucuacuuuuacauacuguguuuuuaaauaauuuguauauuuuaucuaaaucaucaaaaguauuuuuguuuguaauguccucugaauaaauguuucugcaccucuaggucuauagugacauuccaucuuuaacuccugauggcggucauuuguguccccucccccaucugaucagucuucccaaaagugugucuguuuuauuagucucuucugagaaccaaauuuuggcuuuguugauuuuccuuaaauaauguucauuuuuuaucucauagacugugcucuuaacuuuaucucuucccuccuacuaucuuugguaggaggcaaaugguaauuugccauuuuuuuaaccgcuugagauggauuucagccuuuccucugcucugagauaugcauuuaaagccacgagguucacugucugugcuuauuucacuguacuuucaguaccuauuuggcuaugaauuuuaauaccuuacauuuuuauuacuauuuaauuuaaacuguuguuugauucucauuauauauuuuucuuugaccccuggguuauuuagauuguuuaauauccaaaauacauggagauucccuaguuaucucuuuuuauggauuucuaauuuaauuguacuguagucagagagcauaauaaauaugauuugccugcuuugaaauuuguuggaacuugcuucugaagucuugcauauggucucuuuugguacauguucugugugcacuagggaagcuuauguagucuccaguuguagggagcaguguucuguauaugucaaguugcuaaucaggcuguucaaauuugucucugacuugacaaagcuuugacugcuuuucuaucaguuacugacgagguguguucaaaucucccaccauuuucucuuuuagcuuuuaguucugccaguuugcuuuauguauuuuaagguuauguuuuuaggugcauacaaauuuagaauugaucucguccugcugaauugacacuuuuauaaauaggacauauucuucuuuaguaauacuuaaagucugcuauugguuuuccuuuacuaguuuucauuuggcuacaccaugaccuaucuuuuucuauccuuucccaacauguuuuuguaucguuauauuuuaaaguggauuuauauaguuguuuuuaaucaugacaaucuugaucuuuuaauuagacuauuaauccacuuauaauguaugcaaucuaccaucuuaugcuucuuuuucauuuguuucaucucuuccuuuaagucuauuuucuuuucaugcuccaagcuggcuauuuucuuuggguucacagcuauucuuuucuacucugucgucccugcuauccaacucaccuauugcauucuucauuuccauuaugguccuuacuuuucuggaacuuccuuuuuauguaucuauaaauuuuauuucucugguaaaauugucuaucuuuucaucuauuuucuugaaccuauuuaucaugguuauuuugaagucuucaucuaaauauucugaagcaaagcacaaucaucuguuagcucacaaaucuaugggucagcaaucugggcugcccaguuggguggucucacuuggauucgaugacauggcaguacuugcauggugauguggugguggcugaguggucucuguuguccucacgugucuggagccacuggguugucagccagggucucucagcucuccuucacgcggcuguuccagcaggcuagcucagacuuguccaugagccaacagaauucuaagaggguaagaguagaugccacaagguccuugaggcugagcuucagaagacaugaucauuuccaccaugguggagauagacucuagccugcaaugggaggaaccacaauggauugugcccaucuuuaauuaaucacagucugcccucuggccauaacuuuucgcauucuccccuaugcaaaauucacucaccccccucccgacgauaccuaaaauucucacccaauuacauguggcaucaugcucaaaguccgacaucuugugaucugccccuuccagccucuguccaauuccuugucccaaaauuaaugcuguaaguuuuaggauauugauaugacauuaccuauuucuuaguccuuauuucuguaucaguuaccuauuguugcguagcaaacuagaccuaaauuuaguggcuucaaauauuuucuuugggccgggcaugguggcucaugccuguaaucccagcacuuuuggaggccaaggcggacagaucaugaggucaagagaucaacaccauccuagccaacaugaucaaacccugucucuacuaaaaauacaaaaauuagcugggcaugguggugugcaccugcuacucaggaggcugaggcagaaaaaucacuugaacccgggaggcggaggcugcagugagccgagguugugccacugcacuccagccuggcaauagagcgagacuccaucuauauguguguguguguguguauuuuuuuuuuucuuugcuuagcuaggagguuggacuugguucagcuaggagguuguucuguuggugcuggcuguuagcugaggccucucucuucuccauguggccucucuaaucagcaagcuuguuugcagggccacauuccaaaaggacaugaauuauauaccguguacauuccccaguacucuuucaucagugaagucacaaggugaccccaaauucaaguaauaggaaaacagacuccaucucuuaauggaaggagcugcaaguauuuaaggcuguuggaaguaccacaccuuuagaucuguaugaucucucuuuucccuugccuuuuagucuuucguguauaaaauuguagaugcucgaggguauuaucucccuacagauaauuuuauuuucuucugccacgcgcaaagcaccuuacuccaguaggggauugagagaggugggguuaaugugauggaaaguuggcauugcuuaguuucuggggcugccuucuagauagcuucuaaaccccaaagcuucucuccacagugccaugcgucuacugaguacucugcuuagcuuuuaccccuucagcaacugcuuuuugcucaguuucugugauucucacccacccguguggcuuaggaauucacaaguguuuccagaggaaguugugugaaagguggcuagaggaccagaaucuuuuucccucguguccuggcuguccuguggcccuggacuccacauuuuuaucacuagcccacugggcccccacccuguugggugucagugcuccccaaacugacaagugcccugaggaggaaacgcucggaugcaggcgcagcucaguucauuuccuuucuaugugggauccucaccuucuaugucuuucuuggucuccaaagccucacacagcuguuccuugcuguuggcaucacuuagucucgcagucccugguguuuccaucaggaaagucaggcaggcguuagcuucacugccaggagggaaucuccuguggccuccauggcgcuguguuuucuuccagucuuuuuucuaugcacagacacaucauccccuuuguuuccuuuugugaugcuguuucuaaaaggaucuuuauuucuagaagaaacuuuaggaggcaaaaacagcgcagcccccuuaacagaguggcucugguggcaacuuucccuuguuaauuuguccuguagccccuacuuucccaagcgcuugcuguuuguggggcuacaggacacagcagcugaaaggggcugugggcaucgccagcauguacccucuuaucccauuugcugacaaggauccugaaggcccaagcauagaaagaaguugcuauggcugccaugugucagcagcauagccauggccaacucagggcccugacuccuaccugacccccuucugaaugacacucaagguaaggguccccuucccacucacagaugaggugaaacauuucaccuugaaaagccucuugcccccagccuccccucgagcccacacugggacauggccuaaguaucuccaucccauggaguugaacacucuccuuguuucuggaaggauccagucugcgugcuccucaggcagugcaggggcagugaggggaugaccagcacaggguggccacucacaaucuccucuccucucuccacugcaggcugcgggaacaccaucgggccaccauuaaggucauucgacgcaugcaguacuuuguggccaagaagaaauuccagguaagcccugugcugagccuuccugcccucagccugccccucgcagccugaugcagcugcccacaccucuccuggguucucuccugcccauaguggagggugucaaggccuccgcccccaagccacacaggcaggccuaucugagaccugacagugccuaccccaccgaaccccagacagcaggccccucagaggaccuauccuuggaggcccggccuggaaccagggacacaugcagugucuucuucaccaaguagaaggcagcagccguguagcucacucaguccucccguggggugggucgugcaaggcagcauuagugagagaugugagggugacaucagaaugacucagagauggugcggagccugcccugagucaccaagcugggaaggcaggucccccagaccccccagcccuguccuccacuggcucagugcucucauucccugcuccuccacccucugugaguugggaggauggagggaggcugggcccugcucuguaagaggugggguccccuuggccaggugaggcuggagcuccagggcuuccauaagcugcccuaacuucuccaggggcauguccccccuacagaagccccuuagagcccccagaguccaugccccgcagagaaugccauugauggcaggcaugucuccccuccugccuuggggacauuccucggaugaaggcgguggugggggguacugaguccuggcuuggaaauacauguguaggugugggaaccccguauccucuguggugggugauccagaaggcaaaaaucacaaagcagggaaggcuggggggugacuugccugagucccuuggagcggggggcgugugacgugcuugagugagugcgugucugcaggagcagggcaggguggggcuucugagcugggggccccuggcaccucagccacagccucaccagucauaaggcacagcccaggaaggcucagcaauguccgccgaccaccaggacccacagucgguggcaucccagcccaccaagacuuauccuggagccacugagcucccugcuagggucuggucagggcuuaugggggccuuugucaagaggucguugggucgggcugggaagaucaucuugacuucaggagccugagaugagccaagauaaugcacagcccauccagacggacugacaguggcauucaagucuggucccccugcagccaugucuuucacaccaggccacaccuuccacuccaggccccaggauugacacaggcccgcccacagucuccuugguggagcccccacccaucugggcccuggagccaccucagccuccagacuucacagggcggucugggugcagacccuggcacaggcagcccugggcaaguucuuccccagcugugaggggaaugagagccuaaggguuuggcauaagaucauaugcacgugccucacccgggccuugcccccagcaaccccaggccagcacccgcuaggcucgucgucacucugagccccaagagcagcccucggccaggcccuugccaagagcaguaugcgggcccucguucuggccaccgggccaccaucuccagggggguuucgcaugcacagcccucccacagugguguuucucagcuggcccucccaccugcauccccccagggaagggggugguucaugacucaacugaaccaaguugugucaaagcucccagcagugccugggaccucuugcagucaaaauaaaagccauggcaaaugccacugcuggccagugcccggagaucugccuggcauguucuaggggagaucugacagccccuguggaccagggugucuccauucugggaccgucuccucucucuggugcuggcauggagggccuugcuggagcagggagcucacucgggggcaauggaagagagaggccagccuccuggcagcaccagugcucucccagacagggaaggggcugcgugaaccccuuugggacucagaucugggcagggcagucccccgagggcagaggagaccaugggaagggccagggugugucaguucgcuggagaacagcauggucgugacagccgaagcagcugacgucaccccagcaguagagcagagggacacagggagccucccaggguggggcuggugucuggccugagggugcagagcaggucccagcagggcagagccagagcccaccaaggcuugcagaacugcgccacuugggcauccugggggcugcuuccaaggucugggggaacccagcagagcaugcagacccugauggcuccugggcaggccuagcuccagggguggugugggcagcuuccagcucaggucaagagaucauccagccaucccuuucuccaucagccaggaaggacacuggcauugagguugauaucaaggauaucccaucgugauaauaacuaccauggcuuccagucuuguggugaaaccucagaugcguagccuccuggccaagcgucugcaauuucauguuguuggagcauucguugaauaccugggaguugcagcucucuguaaguuugauguggcugaaccaagaaaaaaagcacacgauuucuacagauauuaugaugccgucaaagauuuugaggugaugaggaaggcuggcaucuuucagagugcaaagugauuuuggaauauaaagaauuucuuuggguugaauuaccuagaagcuugucagugaccuguguuccugaacugugaaacaugaauauaugggccaagaaaugguuucucuugguaaauaagcaauuaacaaauacaaaaagagagagagggagagggacagagagagagagagagaucaucugcgccagccccagcaggcccugucgcugagccacaggugaaaaagcuggucccuggggaggaacacagugagcccugcacucccuuccagacaggagggaguggguccccuuuccugucuuaggacacaggccgggacccugagaauggcccaggaggcuuccugaagcagacugggaaacccccaccccacugucugcuucuccacugcucccuggcccugggagccuugcagaaaccuggcaacagcaggauccucgcagggcacagaggcuccugcacaaagccgcuggggcucccuccgaccucaccagcuggcucuuauugcugggagcagcauggagggguggggccagggugaggggagcaguagcccguggcagugaggagcuguguguggcuccaggggcuccccuagcccaccucucaggaugcuucccuuccucgacgccugccugucugcuugcuugcaccccaccccacccccgcuggccucaggggcugcugacauggcaggugaccccucugccuaccuugcuggcugauaaguccuuggccaaccaccccugugucuggcccaaggagccggagccucuccacccuucaagugugccuugaacucccuguccaccaucagucagucuggacaggccugcauuaucucggcucaucucaggcuccugaagucaggaugaucuuuccagcccaaccccagaggaccacuggacaaaggcccccgugagcccuaaccguauccuagcaggcaucucaguggcuccaggauaagucucugugggcugggaugccaccgggccguggguccucauggucugcgggcauugcugagccuucuugggcuaugcccuacaccagguaaggcuguggcugaaggugcagggagcucucugcugauaggcccacccagcccugcuccugcagacgugcacacacucagguacauaauacuuccuugcccacaacaggccuguuuggaagcacucgcaucugcagaggcugcuaacacacacaccuacacccaccuggucacaguggcccagagacuccuagggcuugguuuuccccugcccugccucccuucaccugcccacaccgcacccagauggcuggaggugccccaugcuucagcuucacagagcucuguggucugcaggaggcucaccaccaugacucaugccauguucaauguguucugaagagaggcuucggccacagcuggcugugacucuggcucuggcauggugcuggcuuaggauucccugaccuuucucaacucccauccuaugucauccucacucccucccuuaaggcagagcaaggcagugcucagcaucccaucuuagagaagagagcguagaaucuccaucauacagaagggacauacggaagggagaaacagaguucaacaacccguccuacagaaaggaagaucaaggcucaguaucccaucuuauagaagagagaggcagggcucagcaucccaucuugcagaaaggagcuuagaaucuccauuauacagaaaggagaaacagagcucagcaacucaucuuacagaaaggaggaucaaggcuuagcaucccaucuuauagaagagagagacagggcucagcguccaaucuuacagaaaggaggaucaaggcucggcaucccaucuuauagaagauaccaacagggcucagcaucccaucuuacagaaaggaggaucagggcucagcaucccaucuuacagaaaggaggaucagggcucagcaucccaucuuacagaagggagcucagcauuuucauccuauaggaaggagaaacaucccaucuuccaaaaggggggaucagggcucagcaucccaucuuacagaaaggaagaucaaggcucaguauuccaucuuacagaaaggagcucaguaucuccaucuuacaggagggagaaacagggcucagugucccaucuuccaaaagggaggaucagggcucaauaucccaucuuacagaaaggagaaucaaggcucagcauuccaucuuacagaagggagcuuagcaucuccaucuuacaggagaugcuaccagguacaagagaugcuaccagaugcuaacagggcucagcaacccaccuuacagaaggggaggauugaggcucagcaucccaucuuaaagaagagagagacaggguucagcaucccauauuacagaagggggaaucaaggcucagcaucccaucuuauagaagacagagacaggguucagcaucccaucuuacagaaaagagaauuaagacucaacaucccauuucauagaagagaacucaguaucuccaucuuauaggaaggagaaacagggcucagcauccccuuuuacggaagagagagacagggcucagcauuuuaucuuacagaagagagaagaaggacuuagcauucccauauuacaggagaaacugagaccugaggauguuauuacuagccuguacauaaguacgguuuuuacgggccagagggucugccuagaguccaaccccaugccugccucuaucacaguucuuggugugucauuucugggcaaugccggcgauccuggugcccaguguggccccaggagcagcaggcccuuccuuccauggggcacagcuguguugugaggacacgggccccaucccagcccuccugaucucaggaucucccguucagggcccagagaguggcuaguguugccagugagggcccuaccugcuugugucagguggaagaggaacccccugaacuucugaggcccagccuuugguagggaggaggucucugcccugucuugggauuccugggguccaaaacaauguugggcgggcuguaagaacuccaccaagccuccggcauugguggcagaaccccugggcaugucagaagugugucuagagcugaaaguggguacauggagaccugaccucagggucuccccaucugggaacuugcugcuucccaggguagaaguggcugcauccucagauuaaggucacccuggucucaggaguaggaccccaaagagagguagcaggugggcagggagggcauguucccagacccagcccgggcccucaacgguaccugagcuuccuccuuucucauccugggccucaauugccucccucugacuugggcuggcccugccccaccccuccccaccaagccgcuuggcucgucucuugggccuugcaaauuccccagcaaaaggcaggaaagccacuagcucagugcuaagguggcuauuugagcacuaaugaugacuacccugggccucacccggucacccaguggccucucgggauagaggcagucuguuguccuaugugcuggcuugccugcagggccaaggccuuccuaggccaucaaaccccugcucagccuggcugcuccaccugagugaggcccuugggagcaaggccacaaauguggcuugggguuuccugauaucaugagaugcuuuguuuucucuguugugguuucaagaugucaccugagucccacuuauaggcuuagagcuggcaacaagccugggagcccugggguccccugcccugccucacauggccccagccccacugugggagcccaagcagaugcucgucacccacagcaagugcugcaggcuaaggccgucaucuggggccaccccugcugccuggcacaaacugccaggaacgaugcagaggagacccgcucccuacccugaggacaguggcggcugcagccagugagcaugucaagggucagucuggggcccagguagguagugggcaugcagagcugugccuccuggucagugccuggcacugugcugcuccuugaccccuugggggggccagcucuuccugaagccauugagaaccagaacugguagccugggguggugggggguggaagggaggagacagcaggccccugccggugaguagacaggaagcugggacccagagaggccgagcugauggcccaggacuacccagagacccauggccaagcugauggggacaagcuucgcuacugugcacgcuuggaaccaggcuuaugccaucaccacauaggcgagcucccaggucuucacaagccucccgagggcagacacugucacugccugcacuuugagccacauggcuggggcacagggaggagaagugaugcgugucuuuuugucccgcagcaagcgcggaagccuuacgaugugcgggacgucauugagcaguacucgcagggccaccucaaccucauggugcgcaucaaggagcugcagaggaggugggcacggccaaacggcagcggggagggugcccagguccugcccagcccggccccagcugcaugaucagcggugccggaggagggaggggcugagacccugaguucuugccucucaaccacccccuucuccucaccacccccagcccugcagagggagggcagcuggccacggccacgguucacagccagcccaccaggcagcucuaccuuguuccccgcccggaucugagaugaugggggaauugggguaggggaggcgcguaggggaggcaaacacccgccuccgucccugcucagguagcaacaccagcuucacacuccccacaacuucaggacacucggcagccagcccacccgccuucccugucaccucugagcaaggggccaggcccagcccugggaagacacugccuggugccaggccccaccgcacgggucucccccagacuggccuggagcuggagacccugacuguggggagcuaauguguucccauggagcuagcaccauccucccgggccugcacagacucagagcagcugugccuccgagaugggcucgccugggaacuagcuccguguguuacagggcauggcugggagcccguguccauccuggccacaggcgaggggucaggcugccuugcccauggcugauccacugccucccacuccuacccccagggaggaagucugagaggcagcccaccgacucccccuuuccgagaucccugcucagcccccucgggagcauggcccucugggggguugggagugaccuggcaggccuuagggucggggguguccccagaguggguggacaguccacugucuugccgggcacgucaagcugucugucccacagacgacagugcaucugcgcagugccagggccaggugugaacuggugucuguguccuucucuccaggcuggaccaguccauugggaagcccucacuguucaucuccgucucagguggguuucugugucaguuacucugggcccagcagccugcaauggacucucccgcaccucugcccuccuggcucuccccaugaugucagaaugggccauugcaccuccaaagugcaugacaugaaaugaaagccagggaguaaggggagguagaccccacccuuagcaaaguggcuccaaaguacauuuuacaaaggaauauucagguuucauaagaaccuaccugggucccuuuaaauuccagggcguugagguuaggcucuagguguggaaacaugaacccagggcaacuuugcagaagggggugauccuggggugggguuuggguggggugagcugccagcccagaauucaagagacuaugggugggggccuugcagggcucaaguugagagggacagaagcaccuggcugcagccugggggcugguuuucuggcuccuugaccaaauuccuuggguccccuggacacggggcugugagucauuccggggaaugacagggaaaaggcacauucccugggguuucccuagcccagaugcaaacagcagccacggcucauagugugggcugguguaacggagcagcggaauggcugugcccccagccuggagucaggccugugucgcccugggaguggaauggcaugggcuugcacagcuggcaguguggccagcuuaggcagcccccuagggcucucagaggucagagguggagagcguggagcaggauggagcccagguccccagcugcagccaugcccggccaccguaccaccccugguauuuuugucauagcaugcuuuuuaaaaauguccuaguagguuuaggcauuuugacucucagcuaccucccccagcccuaccaccccacuucccaagcccagcugggguccccggcccaccccagcacuuggcccugauuuggguguuuuaucccccauagaaaagagcaaggaucgcggcagcaacacgaucggcgcccgccugaaccgaguagaagacaagguaggcucacgcgccggccugcggugguucugguuagcguccuggggccagcaggcaccucccuguggucugcgugugaacgugaagcuccugcaggccuccccaccuucccgccagugccuacugcagccugcccagcaacucccaagaggggcccaggcccacugcccaccuggcggggcauuggucccccauggaaggagccaggccaggcugguuucucauccucugacaaguggcgucuuuacuggcagguggcaccaagugcccccuccccccagcucuuucccgcugccucucguagucugcuuugugcucugcgagccuccuggcuguguccugaguggaggguggcagaagcuggccucacaucccagccuucuccugggcccagcugucuggggccuccacuuggggccggccgagggcucagggaggugcagggcccagcugggauggguucaugggaagagaggcaucuucuguucaccccgaacccaccaggcccccacuccccaccaggcucugugcccaucacucggucccucaggccggagccucucccccaggcacccugggagcugccgggggaucugggcggugggagggccuuucucgggcccauggcugagcccaccacugcccuuugaagucucugugguuugaagcgggcuguuaucuugccgaacagcaaguccgucuacauggacuuuaucugaaaguagcugagaggcuaaaaauagaggaguuucaguugggcagggagugcgucugccgcccgguuucccuggcaacgccuggcucuggccugcuuccaucucggcugcagccgggcaggcggggcaggcacagcccggcccaggcuccugcuccugccccacccguccuggcccccaggaccugcagcgucacccucuccccaccuggcaccaucugcccauggccuggggcggccguggggcccugagaccagcaaauugggucaugcagaaagagcgaaggcugguguucaggugccuggccccauggggcugugugaccacaguacccugagucccaugggccuggccacccucugucagcacagaccugagcagggcuggugcagaccuuugccaggcagauggcccagugggagauagcgcccaucuggcaggacaggaagcaagacccgggagaggucagcucacaggauuggcaagcucagaggcccagaagccuuggccucucugcugcccggggaacacgguguuucccuggcuuucucuuugcgcaagggcugggugacuccuggcuggcacacccaguacagcagggccggguacccuguguuguuggcauggccaggaguuucuagacaucaaggaaagccgugguagagacagggaguggcacccaguuccccagccuccacuccugcuuccaucucggcugcagccaggcaggcggggcgugaacaucccugacgugcaggagugucgguggcccuuucuggacagcacaggcuggggacagcccccgccuuuccccgccacucccugccaagcucugguuccauugccuacacuacugucccagaccuuucuuacggcucugccccugcuccaugggacaggccacccucuaagcccagaccuggagucuggcauccugcgggggugaugguggguggcagacagggccuccugaagugcaauggccccuuccugacgugcacagcagccguccagcagccugcuggggccugggaacaaggacacaguccucagucagccaaggucggugugggggccugcagaggggccagcgcuggccuugaaggcacaaaauuaugcacccaauuucuucacaucugagcaacaaagggaagcauuuuccggagucccugaucccuagggcaagguuuaagaacaaggcuggggccacauccuggugcccugucaggcucugagccggggccacgaggauucugguagauucugcaugcacagcccuggugggcccuggcucccugccauuacauucgaguccucugccuggggucucugagguggugaguggcacccacagucgacacuaaaucucagccccgcugaggggucuaccuggaaccuggcugcccaucaaggaguugacagagcugugcugaccuagguggguaggugguagccuacccgguccuugcccugccacugacuggugcaccccucagggacagacccuaggaaagggccuggcugggccuggagggcuugguggcacagccuggcucgaguuuucuccguuaucagugcagccaucgggaccguaaauaccccaagcgcaauccugcugacuucgggaaguaggggcaggaaauccagcagccgcccggcccucggaggcccagcaggcgugcagcggugccaaugcccgccggcccugccaaccccagccagagccccuggccuucccuaccagcacccucccccaccucaucccgcuggucuggcugccugccggaagggagucaaggccccagccuccaacuguuuucucagcucagcucagccccucagcugggcugugcagugagucccaccccaggccagcuugccuagccauaggaugagaggucuccgggaugcacagcuggcuggcaccccuccagggaggccuagagugucccccugcagggaguucaccagugcaggccagcugagcuuguucagggcugccucaguuucccuggcagggagcccucuucuuccuugguguccuggccagggacccacauuggagagaggggucugggggucucccuucucgucacaguccugcgggcucgucaaaacucuugcuugacagugcagugucugcuccaacacagaccucccaacuaccuugcaggacguccccauuccagggaucccuuccaccccugugccuguccugguggcuuagguucugccucacuccaggguguggagagcagaaacccacccacacccgcagauccaggggccuccucacagcgagucuacuuccugcgggccucccuccccugucaaaugagaggguuugacuccugcuuguguccuuagggucaaaagucacaaaagcugccucaugcccuuucuguuuucaucuuagauuauugucuucuuuauccuggagaggacucuuauuugcucaaaugcccacauaaauccucuuuuacagauggggaaaccgaggcucagagaggcugaguggucgccugaggucacacagcuaguuaggugaagagcuggucccaaggaggacacagacaggggugggagaugagguagagagagcaaggagggguuucauaucacccaaaguccguauggagaggcugaggaggguugaggccaggggcaggcugggggcaccagcagcagggcccagggccuucagugugggccagggaccaaugcaggcggucgggagagguccggagagagcuggcccugcccacucccccucuggccccacugggcuuccugaagucccacacagggcuggcagucugugugggggcugcauaccccagacauucugaggaaucgauggcagaggccgcuccagcccuccucccccagcaaguauucuuagcuuggucuccaggaccugccacacuguuuacguugggcccuguuuauuuugcaagcuaagcucauacugcuuuugcugauaugaggagcacagugggcugggagaguuucuuucuucucuguuuuugccggaaauguucauggcugagagccggacacaggggaguccuggguuuccaugccgcaguucagaaagcguugggcgggaaggggcccccaccaccugacacuccuuucacugccuccggucgcagaauccaggccuccaggaugagaaugccccccaacccaggacucccaaaaccacacccugcccaugccuuuaccaagcuucgugcaugaccccaaccuccaggaugcaggcaggcccagccucccagaauuggguguuugcccccagacacugcuacccuuucccucauuccagugugacuccuccaucaaccaggccacaagcuggaccccaaggcuuuuuugucuugggcaguuccccgagcugcacccccagagccgccgugcugcuguucauccucucccuuuagcccaaccccugcugaguucaggccuuuaucaucucuuacuuggauuauuuuuccagccauauaugcggucuccggccucuccucacacccaccaauccuucacauuguauauuauuucuuaaacacugcugaaaucucacuuacuaauauuuaauauaucagaauuuuugugccaguauuuaugugugagauacauacaugacauaauuuuccugucuuguauggucuucaucaggcuuuggugucaaauguaugugagccucacagacuaacuuaagaaguguucccucuuuuccuauauugggauauuuuguauaagauuagaauuuuauuuuccucaaauguuugguggaauuuaaagguaaagacaucuaggccugguguuuucuuugugggaagauucaucauuccugauucaaucgcucuaauaauuauggacuguucagguuuucuauuucuucuuguaucaguuuugauaaguuauauauucuaggaauuuauacauuucauuuuaguuuccauguucauuggcauuuauuauaauuuuaauguccguccauuagcauuuagucccauuuuuuauucucaauauuauuuauuugugccuucacuguuuucccccuuaguggucaaacuugacacuauuccccugucuuauuaaauguuucguggacuucuggcuuugcugauccucucuauugugauuuuguuuuguuucauucacuucuguuuauuuuauuccuucuauuuacuuggccuuaauauacuguucuuucucuaaccucucuaaauuaagaagaggauaauucuuaauuuucaggcuuccuaaauuuccuuuucguuuuaauuuuucuaaccacugucaaucucauggcuuucuaaauuuuuaagguaugcauuuaagguuauaaauuuuuccuuuaaauaucauccaaacuacaucucccacauuuugauauauggcauuuaauuuuaaucuucauucacuuuaguauuuuucuaaucuccauuaugaucucuuguuuauccuaggaguucuguagcaaugugguuuuugucauuguuauaauuguagcacagcuuucucauaauguugcccucuugucagagaaagcaauccauaugauauuaauccuuuagaauguuuugaaauaugauuuacggcaaaaauguggucaauuuuuguaaaugugccuucuguacuugaaaacaagguauauucugacauuguugggugcaguguuauguucauauccacuggaacaagcuuguuaguuggucuguucaaaucuucuauauucucauuggaauguuuuuaucugcuugaucuauuauuacugagaaggcauagggcaaauuucuguuuaacuuucuaagaaacuucuaaacuguuuccaaaggauuuauaccauuuugcuuucucaccaguaaaguauaaagguuccacuuucuccacagccuugcaaauacauggucuuuucuauuuuagcccuuuuagugaguauguaaugguaucucauugugguuuugauuugcauuucccuaaugacuaaugauguugagccacuuuucaugugcuuauuagccauucauagucuucuuuggugaaauguuuauucaacucucuugcccauuuucuaauuaaguagucuguucuauuauugaguugcaaggguuuuuuauauguucuggauacaaguccuuuaucagaucuaugacuugcaaauauuuucucccauucuguggcugucuuuucauuuccuuaaucacaucuuuuaaaucacaaaaguuuuuaauuuuaaugaaguccaauuugucuuuucuuauauggcucaggcuuuugauguuuuaucuaagaacucugccuaauccaaagccauaaacauuuucuccuguuuuguuuuggguuuuuuuccuucuagaaguuguauagaauuagcucuuacauuucggucuauauuuacuuugagguaauuuugggguaugauaugaaguaaagucuagauuuguuuuguuuuauucuuacuuauggauauccaauugccccagaacauuuguugaaaauaccccauuuccuccuuugaauuaucauggcuucuuggucaaaaaucaauugaccauaaauuuauagguuuauuucuggauuuucaauucuauuauguuggucuauaugccuuucuguaagucuauaugccuuucuguaaacccauacuauacugucuugauuauuguagguuuacaguaaguuuuaaaauuaaauuauguaaguuuucuaauuuuguucaucuuuuuacaaauuguuucugucuauucuaaguccuaugaauuuccauauaaauuuuagguucaaccugucaauuaaaaaagaagggccugcugggauuuugauaggcauuguguugaaucuauagauccauuuggggaaaauugacaacuuaacaaaauugaguauuguaaucaaugaacaugguauaucccuccauuuauuugaucuacuuuaauuucuuucagugauauuuugcaguuuggggcauauaaauuugguacuucuuuuguuacauuuacuccuaaauauuuuauuugucaugcuaguguuaauggaauuguuuucuuaauuucauuuugaauuaauuguucauuacuaguauauagaaguaacauuaaauuuuuauaucaaucuuguaaacugacuuuucuauucuuggcuuuagccauuuuuguuguugcuauugauuucuuaagauuuucuacauauaggaucaugucuuguggcaauaaagacaauuuuuacuucuuuccagucagaugccuuuaauuucuuuguuuugccuaauugcacuggcuugaacuucaaaaaaaauauugacuagaagugcuagagcagaucuucuggggaaaaucauucaaucaauuuccauuagcucugaguuuuccauagaugccuuuuaucauguugagaauauuuccuucuauuuuuaguguguugagagcucucauuaugaauggauauuggauuuugucaaaugcucuuucugugucuagugagaugguccugugguuuuuauuccuuauucuacugauuugguauaauacauuaauuuucagguguuaaaccaaucucacauuucuggaauauauccuaccugggcaugauauauaauccuuuuuauaugaugcuggauuugguuugcuaauauuuuguuaagaauguuugugucuucaaccuaggaaagcugauugaaagaaaaaaaaaagaauguacuuuauauucauaaaggauacuggugugguuuucuuuucugacuuugaugucagauuuuuaaauccuuuucuuuuuaauccuacaaccguaggauuucagguuugucuuuuguaaacacuguauuacugaguuuuuaaaaaaucauuuaauacauuuauauuuaauacauuuauauuuaauauaauuucuaauagauuuggauugaauucuagcaguguauuuugugcuuuccacuuguacuaaaucuguaauauuuauuuuucuccucuuucuugccucucauuagauuauuacuucucauucuacuuuucucucuacugguuuugaaguuauguauucuacuaccauccuuggaaagguuaaccuagaacauuuuaaaugaauauauaucagaaguaauugcuauaucuacccauaucuguaauaaaauagggauccuagaacacuuuaacuucaauuauucucccccugacuuaguacuuugcuguuguauauuuuaguugaacuguguuuaauuuuuaacucacuaauugguaguguuuuauacaaucaauauuuguuuaaauuuacucacccauuugccucuuugucauuuguuauuucuuuuuuaucucagaucuuacaucugggauuaccuuuuuaugugacugagggauucauuuaaauuuucuucagugaaaaacucucagauuuuguccgcaaaugaccauuuuacugucauguuaaaaaauauuuccaccaauuauaaaauuauaggccuuagguuaucaaaauucuuuuuucuuagcacauuaaaaauguuauugaacuauccuuuggcuuccacuguuaccguugagaaugaagaugaugaauuguugcuccuuggaagacaaucugucuuuuuucucuggcugccuuuaagaucuuuccuuugacucuagucugcauuuucacuaggauauguuaauagguuucuuuuuuucugccugagcuaccuuacucagugguuuggugucuuucaucaguucuagauuauucucaguuaauacuucguaagauuucacuucagucucauuaucuccuucugaaauuuuuauuggccaguaguagaccaccucacuccccuucauaucucuuaaccuuuuuuuuuuuuaaaucacuuugucucucuguacuguauucuggaauccaucuuccaguucacuaguuguuucuuugacuguguuuaaucugcuguuaaaacuguucagugaauuuuaaacuucaauuauuauuauuuuauuuauaaaaguucuguuggguucuuauucauaucugauaagucauuuuaaucguaucuuccucuuuacuugccuguucaaacuuuaaaauuuucuugaaguguauuaaauauggcuauucuauauugagcuucucuuaauuccaguaucuaaaguauuucugaguucaccucccuguuugauuuuuucuucugcugacucucauucaugguguuucauuucguuucuguuuuuuuuuuuuuuuucauuguaaacuuauauaucuuaaaauuuaucugugggaauuuuugaagucuggugugaaguugggguccucagggaggaaucauguuuaccccuuccauugccacauauguggguguacugccagccuggacuuuuaauucuaggcucaaaguuuucuaggccacuuagguaguaugaauucaagccuccaagcugagcauggacuaacuugugaacaugacuuuccaggacagaacuuguucuccuucucuuagcaguaaugcaguuuucuuuacaaucuucucagggaguaggagauuuuucauuggcccucacaaugaaagcagagcccuuugagggucccagcuuuguguaagucucugcuaugagacuuccuggggcaggccugggcuuugacacauaaucaucuauuccuggugaaaccaaagcucaaguucaucucacucaucaaauaccuucagggccccuauuaccucugggguuccacuuucacugaguuuucagccucuaaccucccuuacuuccuggucagcucauccaugcuagccacagauaucauuuuaaauuuucuaauagccacuuuuuuaauuuaaaagaaauaaguaaaauugauuacaauaauauauuuuauuuaacccaauagauccaaaauaucauuucaauauauaauuaauauuuuuaaaacucuuaaaauuguugacauucuucuuuuucauacugggucuucaaaagccacugcauauuuuacacauuucaauuuagacaccgaguuuucaugagaacgacuuggucuguauuuagauuucauaaaauuuaccauugaaaaaggagauucccaugccuaagucauuucaaacauacugaaggguuuucuaauaaccgaaugaaggaucuaucuuuaaauuuuaauuuuaauuuauuaaaaugaaaauuccauuccuggaucucagucaccacuuuuuuaagugcugugccacacagauucagcuaugggacagcgcugcuuuggacgggcauggccgugcgcgcguguggggaggugaguguggcucccccaacguuuacccaggccagccccaaggaaaugcucagugagugcccauagaauguggugaauguggauggcagggaccauacgggagagcacacuccaguaguugccaucucauggccccagcgccccucuccaccccaugcccccaacagagaugcaucccugcagaccccuccugggcuccuucuccacagcauccuccccaaguuccccugccucgaguccccagagcucaugacccacgccuccccgaggucccuaaggaauguccgcuugggauucugguucuuuuccgguucucugcagccaggucuguucccuggcguagcuucgcaacuggaaggugcugcucagcagacugugagaagugugugucggugcaggcaggacacacuuccaggcugucccagaggccagggagcaccuugccacugaagggcugguugcaucagaaaguuaggcagccuggacugcccuggcagccccagaccugccucuccucggcagcucccccuccccucugcaccaccccccgccccccacacccaacccaacacuccucucucugcugcugggcugcucuugagugacagggccguaaauaggcaaaggcgggggcucugacugaucaaagggcucccuuuagaagccgucauuaguuugcuauucugggaacugguuauuuuaagguuaguguauuuuuucuuuccugaggagccgucuuaguggauggcggaguccggaggggcugcccuucagucaaaccacacaagcccuguuuugucugggguuccaaagauaaaccuauaaugaaagcagcguuugacgcugagcaccgccacccuguuccugcacaggggugggugugucugccagggagucccugugcccagcaagcuccggggaggcuugcaggaggccccuggggccagguugagucugcucccagggagccugaggugggaggucuucagaccuggcauucucacagccaucauggcuugccuggccagggaccgaggccccguacccucccccaacuucaggcuacccccaaaggccaccccuggaaccaggcucagcaggcaccucugaaccgcagcccagcucugcccagcaccuucuuuggaaagacaguggacccaccaguggccaggggaaugcacaccccuaaagucaaaauguaaggaaaugaugauacccugugcuggcaugggugcggaagagcagacgcucuucugucuuacuaggaggugggaauuaaugaaaguaacaacuccuggaagggacucuagcacugccugugaaaacuagaaacccgucaucacuccuaggaaagaaaagcaccagggucgggcuuugcaugcaagcuuugucaugugacaagcucaaagccaucuguuuguccauagagaagcgugguauauacugagacaccucgacgccgcagccccagugcccgccacagacgagcuuuugccggcagucauugcucgggagggauauuauugauguguugcucaguaagaaaccaaaguugccaaggaacgugaucgcaucucugugcagccacagcacccaggacgcagcugggaagggaggccaggggacagcugcgcuccgggaugcuggggccgucggccucccccuucccaggcccagcuccugggcacugggaccaccgugggcuuggcucugagauccaccaugaguucucgcuuuguccaagauugagaugcgccagguaguuggugugcucauuucgagguguuucuuuuuccccccaguaaagugaugucacguggaggugagugugaugggaaagggaaccucagaaacaaggucccaccuugguccucuggucuccccugggaggaccacccccaauccuaacauccugugagguccuccccacucagaggcuccucucugugccacccauccucggauagguugccaugagguugccagaggcuggcaaagggcacuugucagcugcagauuccagcccugcccugggacuuggaggggaucauaucccuuugaccaccaggucaugacccccagaucauaucccaaugacccucugccauaccaugagcccaaaugacccucaaccugccacagagacagcccccacuaacugccacugggugaugggaccguggagagugcccagcucagaggagaagccugucugauguggcucccguccuccucugcugggguugucuacacuguccccacucggugacaccaggagcuggcauugccucugguucuacugcucuggacagcccuggcagcagugcccuagccuggcccagcaccuacugagacagccgggccaagccccauccugcaggugcagucucacuuugucacucuugguuacccaugggacccugaaccccauaggaggggcucaucacucaggguccucauccagguguggcccauccacacccagcauccagcugugcacacagggccacacacagaccccuuucccauccccccuucccaucccacacagggcaaaagccugaccuccucucacgccuuuggagccaguggcuggggugcaagcucugcccccuacacgcgauggcugugagacucggcgagucacgugggcucucagcgccucagccuccuggcccccaguggaggggacaggcaccauuaugccgaucgcucgcgugcaaaggcccuguggcgugggcagugucacaagcuccuggcccaggaggccugcuuggcugauggcagagcucagagggugugagcaugaggauggcaucaggggucucucugcaaguucaaguuccgccucaacccuacuacguggcccuggccaggccuccugaauccaggucuugcuuuccccagcuauccagcggcuuccugcuucucuuacccucagcaaucccccaagaacuguucuuuuccccacacuagcgucucucuuucuugggguguuucucucuuagccugccugugggggacaguugccacccucaagccucuccugaaugacucuauuuauaggccuccaauauuggccagagaggaaauuuaagucuuuuuaaaaauucagcucaagugugugucaacuucugugagugcaacugcuucagagagaggcugggauaggacagcaggcggcaggggcgugucaggugcccgagcaggacgguggccggagcccgcagcggccgagcccucacugggcaccgugugcggaucuauaaucgacagcaucaauugcgggaguccggcugggcuggccgccugcaggggccagggcgugagggcggugcggagccuugucugugcggcaaacccugccuggcugcccuggccaaccucagaaaaacauguauuuuggucaaaaugggccccuuuucaaacuugucaccccgugggucagggcacagccugcccccagccgguucugcauauuaagcaguggcuuggucaccaucaaaaauagaugucccgacccgagccuccccucccucccggggaggggaccuggccgugccggcugggcugggaaaccgcgggcggggaaggaaggacggggcgaaccggcggcacaggcccagcacgucccgggcccuccccgucagguguggaccccgagguugugcgggggcuuggcggcagcugcggguggggguggggggcccgggccucccgggcucggguucuggccccaggucagagguggcgcuggcggcagguggaugcccagguccucgccgcgccgcuccgggcggugggaccggcuuccugcccuggcuccgagcccgcaggugggggcuuccgccucacuuuggacgguggcguccacaaaauggcugacgcggcgcacggccgucccugcacggagccgguguuuacuuugccgcgcgaacagccuuucguugcccggguuccgagugcuccagaggcagauggaaauuuuuguggauuaaacacggggccgaggcgcgcugggcuguuuggguuggcaaccugagcccuccccaccccguuccgcguccgcugcuucccgcccugguccggcgcuuccauucaugccuucccgggucccuccgccaccccugcaggcccggcguccccucccgcacucccgcggccuccaggggguggcccugcaggcccagagcagcgugggccugaaccccucuccacguguggaagacgcugcagcaauaggaaggggcugcuccuuugagggcccuucucaaaccuggagccccucuggccgccagaucuuugucugugaaacagcagccaguguguggaccaggcaggaguggauggggugugugcccacaaguccagcacccagaaaacccccagcacacggucccuuuuacaguggccucugcucucaggaagguggaaagcgccagguggauaggagggacggggccgugaccccucccucugcccaagagaaacucucucccucaggucagacccaggccuuucaagaagagguugcagggugugcgggcugccaggaaaaggucugugcgggugagggagcgcauccuauggauaucuagaggaagagcguucugggcggagggcacagcgguuguggggugcgggcugaggcagugccuggaccaccuuggcaacagcaggaggcacuggccagagccacggacaagggggagccugggggcgcagaccacccugugaggccucaauuagaggagaugggggcuuggggccccggagggcugagauccagcucauggcuuuggcagcauuguucuugcacguucaggauuagccgaguaaggugagccugacagcggggccagcacgcagcccccugccccucgcccccucccugcccccagucccccacauaggugucaaagugcacagcacccccucucuuccccgccccccgggagccgcaggucaggcacacaagagccaucugugugggcggcaagguggcugccugucugcugcccgcaaagggaugcuuguccagcagggugaacaccccgucagggcaggagcugcugaggagaugcugaugccugggugacucaugcuaccuggccacccauccucgcugggcuacaaauggguucagccucaugggcaucaggcagggcccgccugggugcacccgacaaacacaagggcucuuguucuaaggcucugugauagccccucuuacugagagggaccauauccaauaacggguggaaauugcacuagcagggucaugugagggcuccgagcuuucuccagaacccaggaauauccucaaaacugaggcugggcacaguggcucacaccuguaaucccagcucuuuaggaggccaagacggggggauggcuugaggccaggaguucacgaccacccugggcaacauagcgagacccugucucuaugaaaauaaaaauaaaaaauuagccaagcgugauggugugugccuguggucccggcugcucagcaggcugaguuagaagaaucgcuugagcccaggaguucaaggcugcagugagccaugaucacaccacugcacucuagccugggcaacacagugagauccuaucucuaaaaauaaaaguaagaaguauuuuuuuuuuaacugaggcccuucuggagggauggagggaccagaagucacaaggagcagaaaggaaaaaagcaaaggaauccuucugaagcacugugggcauuuauucauucaccuugugccacugccuggggcugcagugugaguagggugggcuggccccugcuccuuagaauguacagccccauggcugggcagggggacgcacauagugacccguaauuacauaucugucugugugaaggagaaaguacucgguuuucccagucaguggagucaggagcccagagccaaccaggagugagugaggaggaggagggugacacaggguggaagaguguccagugugugcagccuugcaaaggcccuagggcacgagggcacauccuccugaggccaugagagcaggugaggcagagcuggugagcgagggauggcccggccgggccaaggauccagggguggcuccggcuucgugggaggaggguuacaggcaggugaggaugcaguuccaggaguggugaggggcugcugugggaugagggagagcaucagcacuuuggacuaggguggaggccuuggggccagcccccagucugccagccccaccgaugagaacaagcagacugaggggagaaagguuggagaaggaccccgagcuucugcugugagcccccacguggggaugcuuugcucggaggggugcugagguaggagggucaggagggucuggagcuguauuuggacuuggcaggcaaccaaaaccccagugcuuagagaucaaguggaaaagaaaagaggaagaagaugggggagugagagagaugggaaggcagugagggaagccuuggggaggccguggucaggggcggcacaggggagaagcaggcucaugugacucagcccugagcccagccgggcccccaaagaugcuggaccuuaaagacacaaagaugugaugcauguguguucacagauuagcggggagcagaugccgcauggaggggcgucagggaguacaccgccuucccaggugaggguguccuggaggaggcacaaguucugcugggcuggacuggacccagcaagagagccugagccuggaggaccccucuggcccccaucucccacuuucagcuucagcucugaagccaccacccagaaccacauaccuguucuucccaaguuugcucucccuagcggagggaaagacgggagguccacagauuaccuugucucuugaaagcaagaugccaccaguggggaccaauguacagagaccaggcccagccuagaguggguauagcucaucacacccccagaagcugugcggggaggaaggcaagcaggcagcacagucaagaccugaguuugaugacucagaggguccucugccugugguuggcggggguccaaggggucuucccaucuaacucgccaccuccucccacgucccacucagcuccaccccacagcagccaagaagccagggcaucacuugaccuuccgcugcgucagucuccgcaucucgccuccccuacccccgaccucucgggugcuguagggaugagguaggagugguggcuaugaacuggaggccuucgccucgggcuggagcucagagcagucccugcugcugccagaccugcaguuggggcacugcacccaugucuggggaggccacggacagggccccagggucucaggugaccugucuuguguaucccacuucguuucucucuuucccuaaaggugaaguucuggagcaaaaagagccugagcugugagccgaggggcuccuccuccuccaaacugacacccagucacagagcaauugcuaaagacacagucaugcuugggcccagagugggccccacggagcuucccccaacccagccuggcuugagcaggccccugaucuaaaccacccuaccccacacccacuggggcucaccugggguuuggccagcaucccuagaaaucagaagcccgccccuaauucugccagcuucuggcuuuccguugccauggugacacccagcccccagcuacagaucccgccaacucuucccugccauuuugcaagaaacaauauuuuucugcuccacaaacuuggcgggacccugccuuuccccggguccaugaggaaccccacggguuccuugcccuggagucucuccagcucucauccccugagugccuccacaagcaggggucccauggggcgggggccgggggaacaggggguaaguguggccaaccccuugcacagggcuuggagauggaggccccuccccaggugagaccggccuuuggcccccugccccacucacacagggacacccuuuguguuuuuccacaucugagagccaccgacauuucuuagaugacguuuucuugaacccaccgugcuuggugcccguuaaguacuucuacugcagcagccuagaaccgacacgugugaaaccauuggcuuauggcgcaaugcacuuccucccggcaugcaugaaaacauaaauguaaauaccaaaauacacagggacuauucggacaccaccugaaaucauuccaugucccaccagaagccagcacggccccuggcccccugccaggugacgcugccccauggcagccacagugcugaugaagcucuguuugagaucaccgccuggcuaaggccaaggcggccacgucaguucucacggcuccucccaaacugaggagcauggaggacccugggcauugauggcaggguggcaggaagcacccaucgcuuuccucucccggaucuucccagcacccuuccaccuucagccuuuauaccccgagaccaggcgaggccucccacugccgacccaggccuaucauggggccugagaaguaguccucauuuccucacucucacaccccgacacacccucuccauggggaaggaaaacgugccccgaaggggccuguguccagguuccugcccacucagccccucggggccgugucucccugcgucagagcugggccugaagauaaugggcccacugaggugcaggcgguggacagacccaggaagaccucguggguuucccaggaagacagagacugggagccauucuucccggcggcagcggcucucggccuguccuuguccccacacaagcccccacugcugcgccgucccuccugcgccaccugacagauguggcggugagaaaacgauggggcagggaaacguucgccauucggugccaauaaaggccgccuuuaucccgaccguaaaugguuucuguguggagugagacugugccugucccgggccuaaccccccaagggccagagaggcgaaauuagauccguggggagagauuuuacaacguaugggcugguggcaaguggcggcaaaccguccccacggggccacaacggggcauuguucacggccucaccugggcugucuccagcaccccaggauuuacgaggacucggcccagagccucgaugccggccgcuccgggcagaccuggggggguggcgggggggaggcccugugaagaggaggacagugcugggggcugggccacggagaggccgggcagcgcuggccccagcccccagcucccagcuccccagagacagccagccaggaacgggccccaaccugccugcagaccaagcggucacaucgcgaaugaguccucaugcugugcgucccccacugggcagccagaggugugccugacggggccaggaggcugaagacaaccuuuccuugggcucucagcgaugccagcuccagcugcugugucaucaaggucgggcugggcuggccucuuccuagcagaccuuccaaaaccccgcagacucccguggcuguaccagcccugcaccuccuggccaccugccccugcguacccaccacccuugcuccggagcucgagggcccuuuccccacuagcaucugaccgccuucuuguaugucuugaagguucuuugccuucucugugcagcagggcccuuuacaguguagucuggccccuccuccucccccgggccccguacuuccuccauucugccccuucucaggugugcgggaccuuuuuacagcccccugcuugugccugcacucccuccccugggagccugccucacccugaccacauggccuucggcacccagcuugagugucccauccugugaagccagccgguucccccaggcacaggggauaccucuucccuuugggcaccugcccugcguacugugccagccuccagguuggcccaggcagcccaggcugcucagggucauggccaacccagggcaccgcggugggcagaugcagccccuuuccaggccaaguucagcccucucacccucacaggggacccaauugcacagccauccacagcggccuugggacaauacugagucuugaguuaggggugucucuccucaacccugagagcagccccuuuucccacccucagugcccccacuuguggcccaggcccaagcaagccugcauggugcaaacccacauggcagcccagggcccaggaauggcuguccaagaggaaggggcuggaccguccacgcccuggguucccaaccacccuuccccuccuggucaccuuucggcuuggcaucaggagggcuugaagaagacuccucagccccaccugcagaccuagcuaguugccaaccaccugggguugugcccaguccucagaacucaccugcccauggucaucugagccguucccacaaaagccuuccuugggauccucagccgucuggggggccuccuuacuggggucaccucaaaaacagcuguagagggguuugcggcagcagcagcagacguuuuuaaacuaauucauuggugauggcaaaauuaugccgaguucccugaaaaaaaaaaaaaauacccacucuauuuccucauuaacauaauugcaaacagaacgaauuuucuugauuucguguaaacaacagcuugaaauaguuuauaauccuugcagguaucaaauuaaguucuuacuuauggucuggaaauuaauuacccuugcagcgagacaaaugugaaaacuguguauuuuugacaagaaaaugaagcagcuauuggggaaaauguaacuuaaucguagcagagaaaauuguuuauaaauuggucgcguuguuugaacucucgccucuguggcucagggcuggguugaucuaugcauguacauuugccuaauuugggacaggggaaggggcuggaggagcaggaacaggacgggggaaggagaggaagaagaggaaggagagcagaggguacccgcgugaaggguacccacgaggaaggggacauuagacaagaaugcagguggucaggcggcacuuaccuggcaggugaaaucuaaacaggcaccuucaaaggaggacaaagcagcucccuuggguaacuaggaagaggacaccagcuggcgaggggcaaagcaaaggaccugggacaggcacgugccuggaacagaaagggagccagugugucugcaucaaagugagugagagagcagcgcaggagagaaacucucagaggcaggcaggggccggaccacgggggcgguggugcucagauuccauguggcuguccauccauggugggccaggaggucacuguuguggugacaaccagcgcucuuuggaauggacugaaguggaaugugauguuuaacuucuguagcuguaaguucgaguguguguguguguguguguguguguggugugguguguagcaugcuugcaugccuggacacaguguguguuggcauguguggugugguguguuuguaugugagggcaguguguguguuuuguuguauguggugugucuucuacgugugagugugguguguguugugucugcauguaucgugugugugguguuugugugugugagugugguguguauauguuguauccaagacagccaaagggaaguuccaaggggcucgugcacucgguguccagggagcagcaucugugcugucugcagguagucaccguucuccauccuguuacagcaaauacccuccucugcauuuuucccuuguguuugauuugccaggagcagaauuucuggguuggaaucgggaacauuuagaggagcuucucaguagaguuguacagaguggaaaugagucggcaggcugcaugggggguuccagucacagcacagaggguguguguuuucggugccugcccuccugagcuccaagugucccacgccugcccgucaguccucaugucuaccugggcgaccccauuuugaagaugcagaacugagguccggagaggccuggguagcugccuaagggugggguagaagcauggugccggcucagccacccucaggucuccaggcucccagccaagggcuccgauaaggcugcugggaccugggggcugugagcagaugcagacguccacaguucccagggcucugacccugcccugucuccagagcccacagccccacccaaaaggccaggaggucacagaucugggauccuuucccgccaccuucaagaagggaauaaagccacuuccugcuccaucccaguggccugagggugugggagggacagaggccucccccagcaggguaacccugcaaagagggggcugacagccguuccugcuuccuacugggcagaggcuauagaggagguuuccagcgccucagugcaggcagcugagcccagaccccugggcuguccuuggaaccacucccagccccugccagcuuuguagccucuuucuuccccaccccacuugccucaccucggcccaaaccuggguacucccagcugcagcccuccccacuuugccugcucugaggcuguguagggcccagggagugggggaaggggccugggucccgcacaggauugagguggcguuuacagaaccgggggccagagcagcuguggccgugaagguuccaagcuugaaguggaaaggguuuugaugccaagguccaacgcccagcuuaucauuguguaaaucugggcaccacacauagccucucugugacucaguuucuucaacccuaaaauggggacaugcuugcggggguucaggagauccccauugagcacggagaagagcaggugcuguccacucagugaccaucugccgucaccauuccccaaguuaugggagaauucagcuaugguaagagcagagaacaggauggcgcuggggcaggaggagaagguguggcuggcaggcacucaugaggacagggucucagagcccauucuagagaauguuccagaaggcauggggaggcaggagaccaggugugcccaggguggggacacugguaaugggaggugccagagcuggugacagaagcaauggaggugggugcagggcuggggcagggccaggcaguggcuccuggggugcugguggcccagacagacuagagaugguggaaggguagagugcagucagguuuggaguggguccacucuuugcacagaccagcccccuagaggcuccccaguuccaacaggauacugggcuccauggcugucacguggagcugucuguagguggacuggcuucugacccacucggggugccggacccugcccugugccuguaggggcgggcacucaccugcccuugcaguccccucuagcucuccagcuuccugcuggccagucguaucagcuggcucagcagcaaaggcuucagaccaggggacuuaggugagagaaauuuauuccucacaguucuggaggcuggaaguccgagagcaagguuguggaagggucggcuccuggugagggcccucuuccuggcucauaggcugggcccuuccucugugcuuacacaucccuggugcugccgccuucucuugcaaagacgugaguccuaugggaccaaggcccugccuucacagucuccuuuaauauuuaucaccuccuaaaggccucgucuccaaacacagucacauuggggauuagggcuucaacaugugaauuuaggagggcacaguucaguucauaacacaaguccuccgucgggccacuggagccuggggagaugcccccacugcaugcugaagggcaggaagugagggaggggagagcuuguugcggggguguccuugccucucagggccacgcccacugccugcgccagggaagaccagcagugacagggaugguguccccgcagccccuggguuaacacugccuccucccuugcucuucuuggcagcacagaccucagaaggcuggagccccgggcaggcccaagcacagaaaaagccagagcagggucuggggucuuugccuccaguaggguguugggggagcuuuguauucucuguggcuggaggcgauuucgccagcugcggagcggggcgcggugggcacauucacccagacucacaccggcccaggacgugcugaggguguuggggcccauccacccuccacuccgcuuuuccaggggucaggcagggggaggccacagggugcccagcuucagccacacccgccuucugacaaugcgaagcccaccuggucugugagcugucgccucuguccucacagugacagagcuggcuuugagggcagcaggacagggguuuagcccuggcuccggcccugucgccagccggcagcacuggggccaccagcacagccucccagcccucaccaguauuaacugucaucccaagggggccacugaggcagcggggagccugcccuggaaugugccauccucgggcgcaggcagcccuucaugggccugcccaaugucuauuaauuaagcccccuggagacuccaggagcugggggccuuggcucagugcccucucauaaaguucugcucucuggggaccguggcucuggcagccacccugccucucaggagccagccuagugccuccuggguccccaggguauagggccagaccccaaggcuuaguggcaagaggcccagcagaugcucauucucccggucaaaccccuagaugacacucacuggggaacagaggggcuggguccaggaaggaggcguuugcagggcgggguugucuccugaagacugcgagcuagaggggagaagccacugcaugcucccagcccuucaccucacagucccggaauggggaagcugaguggccacccacccuuggacguucccugagcauuuccccacucagaguccagaagcccccagccccagcagacccuacagcgcuaccugcaaaggccagaccggccagccagggaggugggcuagacagugcccuggccaccacagggcaaccccucagcuccacuucgccacccagaggagcuggcccuggccacucucucagagcaggaggugacaugaagggaagguggcaggaugggagugcccaucagccggaaggccacgggagucaauggugaggggcagagugagcaaggggcucaggguagcccagaaaacccagccgggcccccccccccacgggcacccaggaaccgcccuggcuuugcuggaggaccugccauggcuuugccagaagacccugggacugucuggagcauccucccaaggacucgccccuagucaggaaaaaauagggccccggagucagcaagggcuuccugggggcccaggucagccuggacgguggcaggacucggcgagguggggauggggcuuggaggauguggcagaguucccaugguguguguagaaugauauucccuccagaccacggugccuucugggcucuggagaaugcaccuguguucccaggagcuuuagggguacccagguggugugauggggagcaggagccaguuguucccaaaccucgcccuuucucccugcaggcacuggcagagcugggggugauggggcuucaguggagcccgccaggacuggggacacaagccuaggccuguaccgucugcagccccaucuccaggucccggccugccccagccugcccacccccagccugucccccaaaugcccagggcuguggccugcccagacuugccagggagcuccugugcccuucuuucuccuggccucucagaagcacucccugauccucuccccacuucccuccuccccucucauccccaccucgggcccaccagcucccacccugcuaugcccauggaccccagggucagcuuuuaugcacacucagguacucaggacaccccacaccagccauuggauggggccgccucugccaccugcuccagccaccuggcagaucccacucggcucacacagagccuuggccagcauguggccgcagccccaacugcagcggaagguaucggggagucgaaggcagaggggaaaggacgggauggcgggugaaccacacggggaggagccuggagcuccuucugcauuuucuuaggaagugcugcagggacccacuggauucucuacagcgcccaguagcccauuagaagauacagaggcagcaauauucacagggccagaaacaacugcaguucacccaugcugugcaccagcucccacaccacccaugccacgugccugcucuccaccgagcccugcaaaugccucggcacaucagcaagcacaggccuccugcaacgucauuuugcagaagggaaacugaggcacaaaauacuccacugccaccaagucacccaacucagugguagagcugagaucugaaugcaggccgccuggucaagcccaucugugaacuagaaccccgccgcccugggcagaaacaaggcuguauugacggugcugggagagaugaggggagggagggauggaggccggaacagagccggcugcuccccucagagggcugggugucaccccaguuuugucuguggguuuguggagagcaucacugaaauuucuaacuugacagagugguuccagggcucauauagaagcauaaagaggugaaaauagcugauauuucuaaaggcaaaagcuaacgagugggguugcacugcccagcgugaagcugcagccaccauucuccacacucuccuggcccuuggcacaggaugagccuugcagacggaggcgacaccaaggccuuccccugcgcccacacccagcgucuggagcugcuggaaauauguguccccaccaugaaacugaugcugcuguucaucccauuuuguguaugaggagacugaggcacgggcccacaguugccagcugggauuugucccaggccaccuggcucaggucaccggaacaugugacaacacauguggucagggagaggcagcaccacagucagauacaaugcugacagggacggcagaguuccacaggcaaugaggcccccgggguaaaaaugaagcaguuugaaaacaaaaccaggaagagugucuggccaucccgggccugaguuucugcccaugggcagcugccggacaagcccucuggugugucagcgggucaggcugagccagacguggagaugaggcugagagccggaagcaagggcuuugucucuagaagacgcaggggugguucacaggccgcuggggacccaggucacagagccuuucccccagcuccagccuggcuggggagagcaaaggcugcagcugcacagggccccucccugccugcccaaagcugcuaccagacagcaagcuggggagaaaacugcagccgacgacggagagggacgacauuuugcaagugaaaacucaaaucuaugagaaaagcacucgccccgcaguaggaaagcaggcaaagaacuagaaagacaauuuacaaaaggaucugaagguccucacugcacucauccuguaagguggacuuggggccucaucuggccccgcugccuguuuuuguaaauaaaguuuuaauagcacauagccacgcccaccgguggacacaucgucccuggcuaaccuuacaccaccuuggcagaguugagucguuguaacagagaucgugugaccaacgaagccagaacgauuuacucucuggcccuuuagagaaaagcgugcuagcccuugcucuaagaguuucagugaagagacgcaagaugcagaaaugaaccuaauuguguggucuuccgugcuggggaagccgaggagaaauggaaguaugagccgguucccugcuccagaaaucgcucugaugacacguaucacggggauuaaaaaacauuccuccccccuugaccucauaauccuccuuccaggauucucucccuaaagaacaaaucagaguuaugcacaaacaagcuaaucacagccuuauuuauaauagugagaaauuggaaacagaccgcaugugcagcauuugcgggauguugguucuuguuaugcacauuagggacaauuaugcagcuuucagucaucccucagugacccaggaaaaugccccauguacaagguuacuggagacaaacauggucccaguuucuggggugggagguggugcccaaaacaucaccuuacagaaaaugcccggaaacgugucucuggaggguggacuuagagauauguuuuugaaacagauuuuuucauauuuuucaaaauuucucccguaagugguucuuaccuccauaacagaaaaagaguaaacaaucaauguggagugaggaagaagagaggggagggagagaggaagggagggagguacgcagggaggcagcaaggggacuucccugcugaggacgcuagccccuccguaauuugucuguccuucccagccugccuggggccacaugggccacugugcccagugaagccuggcuuccuugucuguggugccagccaugugggaggguaggcgacccgccuugggcuguguaacgcaggcuugccucuuccuuaccccgguugugccaguggcuaggcaccagguaaccugucugugcuccccaccgagcagcugggccgugucugcuuuccgaggaggcugcagguaacccuucucuaaccugcucagcccccagcuccaucuuccaccuguccugggggauccccauucauucucuccgugggcaucaucagaggcucagcuguaccagaccacugcccgggaguacguucgggcucagguuucccuugaggguggcccccaccugaccccuccccgccccucucuugugcccugagagaauagcgugcccccagagacaguaaaagccuggcuugcgugcuggcuccggugacacacaaaggccucugcuucuccacucucaggccagcccgagagggacggcaccaccgggacagcaccagcgggggcauggggaggggugacagguugggcggggucccuggggcuggggcguagccccucucugcaggccccacagucugugaccgugcagggagggugcugggagucucggcucuuucggaaggcgccaguguuuccuugucacagaaugaaguaaaugggacgaugaaggggcaguguuuaaauggcugcuuuagcccguuuggaagucugcuaauuauucucuugaggaaagaaaugcagguucauuauuauaaugagcuuugggcaaaauauuucaucgagccugacaagccgcagcgacgccucgaacguggccggcucugaaaggccuccuauucugcuggaagcuaauuggcccggggucuucccagcccugugcuguuugugugcuauuuuaauucgcuuaugaaaagcccccgcuuugauguccgggaccagauaaggccgggaggggacccuccauggagagcgggacugugccgcccgcggucgcugcacugggccuccucgcccccccacuccgggcccggggccagcgcgaugucaugagguaacugaacaaacaguccugcugaaaaauaugcuuuuguuucacuaauaaaucccuccucggaacacucccgggccgggcccuccucgggcccagccuaccaggccuucccgcccagugccuccgcaacccgcgccaggacagccggcggugggcacaggcgggcgaggggcacccccacccccuccagggccccccuucccucagccuccuccccacccacccgagcugccugccuuucccgcacucuccucccugacuuccucccaccuaccggccucuuccgaccucucucugccucuuucccccaucacgauacuccaguggccaccuucccugcccaccaugccuccuggcccccaauccggucaccaacuugaggcugccccugacaagcccuggcugcagcaugagggaagcagcgguagagaaggccaaguuugggcaccuugcacagccuccuggagccucgguuuccacaucuguaaggaugagacaggaacggucucucugggggcagggccggugguaccuggagcccuccccacugagcaccuggcccagugcccggcacguggcaagugaaggcggcugcuucccgccccucucauggacaccacugugggcaccacuugggcacccugugggcuuauuuucccugcccacugccaagcaccagaccaagaucugaugccaucugcccagggcauugagggugaacccauccaggcuggcccgccuuccagcccucccccagcacccaccaagccccugcgauaucccaguggaagauaauggagguguuacggggaugggcuagaacucgguccuggcaucacagagcuaccccggucaaaaauauaccauguaauuacagaccaggaaaauuacugugcaggagcaaagcagggcacugugccggagaggaacagggguggucagggaagaccuccgagggaggggcauuugaaaauagcauucagaguugcuauuaauaggcucugaugcagaacugagcagagaagaaaacaaaagaggaccauaauaucuccacagagaacuaucauuaauuuuuuaaaugggaguccucagguagguugguugauugagugauugauugauugauaaucuugguucuauuugaauuucuagaaaauuccaacaguacagaaaggucugaaaugaaagguaaauaccuucaugaccaugcccccuuucccuaggauaccccuuguuauccuagaaauacccauccuuagugugaggagagcagcauuccagacgcuucucuguauguugcauagaaaaaggaugguuagauacaugggcagauuaauggauggacagauuguuguauggaggauuaggggagggauaaauggauggauggaugaacacauggacaauggguggguagaugggugaauagauggguggacagauggaaggauggauggauauauggaugcauggagagacagagaaauagaugcagagauggagggagggagggaaggagggauggauaaauggaggaauggaggaauggauggauggagggguggguagguggguggguagguggguggccagacaauggaugugugagugaguagaugaaugagugggcagacagacagacacaccaucagaagcaaauauaaauauggaaucaagggaugccugcagcuuuugaauuguugauuuuuuucuuuuuuuaagaagaaaccaaaguaaaacagaaggaauugcugaauucagauaaauguuucuucaccaaaagagaaauucauuucuaaaugucacuuucagguuaaggaaaauaaaaugugggacgcuggacucaucguggguuuuugcggucuucucucagcuuugugugguagccagcgacgcugcaaccccgcccccgcagccuccuggugcagcacguguucauuuauggguuguuguuaccguggcauugguccagguuugugauacuugugcacagcuugggggcucugcuucccucuguuuguucgucuuggugcuguguaugaagguggcaacagacuccccauaguccucucaccacagacaccucuucucaguucuucguuuccaguuggacucaucuccugacugguuggguuucugccucggucgcugacuccagagggccccacggcucaugccugcuucccugcuauccuccugugcacuguuggccuuuaucaucuccaccacgugcucaacacuccaggccagagcccuucucucaaauccccuuugguucuagccauguuucccugagcucuucccucucugucucuaauugauguguuuuccucccaaacccuccuuccuugcauaauucugcaacugaccuuuuuucuggccauccuagauuggguuuacuguucccugguacucagaccugcuuaaugcucauuucuucaguuuucuggggaagccucaggggccuuacugauaagaacuguguggaagguaagcauucaaaguucuuacauggugaaaauaucuucauucaaccauggugcccuauugauaguuuaaguggguauagaauuuggagcugaauguaauuuuccuucagaauuuugaagaccucguccuaugguuuucuagcauccagacuuacuauucagaagucuuauacuugcuuuagucucauacuuuuguaaguggccuuucuuuucuuccuggaaauguuuaguaucuaccaucuggacucagggguuucaauuucccagagaaguucccuguggauggcuuuguucauugacuguucugggcacuuggugggcucuuuggaaacuuuaguccuugagcucuggaaaggucucuguaugauuucucaucauggaggccaccaucucuguucucucuuucugaaauuccuuuuaagucagacugaagacauuuuuaaugacacuuugaugucucaacuuucuuccccuuuuuuauggcauuauauucuuaacuuuaucucuucagaguucuaggaaauguuuuuagcaguccuguuuuuaauaucccagagcacacgcuugcucucugaccguggucauggcauuccgcccucauuugaugggcacgacagcuccuaggaucuuucuggagacuccagauacaucuuauaucuuaaguucugcuuaauuccuugaucuucuguuuauguuuggccagccaggccccucucucucauguucugaauguuuuucaauguuugcucgggaucugugcauggaugggccugcuggcauuuaggauguguugacaaugacugggggaggugccugucauuacacugaggaaccccauauguuagagcucugaggcugcugcaucugagagcuugggcucgagguacagggcuggcagccgggagucccaccuguaggacgcucugcuguggcagagggacaggacauggaccucaugcucagccccuucccaucgucuuggugcugugggccugaugugugccuccacaaggacucccgccuucccagcauggcauucagagcagcagauggcuuagacucacccccgcccagucuuggcacccuuacagccccggcgagacccgggugggcguggacccuagcgucccuucacccucaggcugugcaccuccgcagugccguguccugucuggagccugucacaccccuguacagcuaccccaauccaaauggagccucccccaggaagccccuggugggaauccguccccacgaccccuguccggcuucccuggcucauugucccuguuacaacccagauuucccuuaucgcaacugguccuagccugugaccuccugggguggggaaucaucucugcaaacacagcuccuccacccuuaucagugcuuugugaaggcagcagaacguucuccugagccagugucugggucacuugagcaauggcugccaaguccaugggccugcacgcaugaggcugugccugugucugugccgcuggagaccuucuugagguucacugcccuaaaggccgcaugaggggacagaaggugaacacagggcccugcuuggucugacaagcccaggcggggcccuugccgagcgucaggguggcuggcagccaccuucugugaucguccuccuucugggcugcggucuagggcugcacauucaggauggggaugucccagugggcgcgcagcacaagggucagcagaccccuggcuggaggaggucaguguggggggcugcgugggagacggugcagcagugggccugggagcugagcaacgguggcugggauggguggagaccaccaaagaggaggggccggcgaaagccaggcuuccugcaggcucaagccuggaaaacggugcucagugagcaacacauucccguucuacaguuuccugagcucccgagugcccgccgcaggaugacagugggacaguccucacaggggcaugcucaggcccugccccaggcagaccccacgcccuggcacgcagccccaccggcugugccgccucucguuccuguccuccuggcaccgccggccaccccucagcccagcccucaugguucucuaagccgccgccuccucaggaagccucccaggcacccaugcucccugcacugacccccagaccccagcuuuggccaugcacucccagacggcugguccccacacaaacuuucuguuucaaggaacagaaacaccccugaaacuugucuaagaaggaaaugugucaacucacauacaugaaaagccugagucccuccucaaaguccuccccucccuccuucucucuccuuccuucuuucccccuucccuccuucccucccucucugcuuccuucucuccuuccucccugagaccugggacgccgaggaggguuccguucccucccccacccuggcagugcucgggggcuccaguugaaaaugaugggggacacauuugcaucacagccugcccggccggcucuguggccccugaucuuccuacugcagccucugccggggccggaagggcauuuccgggaggcgggaacagcauguaugaaggcagagcuccuucccggagaggagggccagccccguccccaggggcucccggcuuucucucucccccuacauuccugucuccaugcagcagccagagggacuuuaaaacauaaaccagaccacagcacugccugcucaagccccccauggccucccucuucccuaggaagcaauccaggcacccuuccauggccgugggccccacgcccccgaggccccacgcccccggggccccaugccugcccuugcaacauccccuuccugacuccacccagccuccugggggcuuccgccucaaggccucugugccugugugaguggcacccugggguugugccauggccagcccucaaaccaucugaagucugcuguuggcaccugcccucuccuggcugcaaagcugcccccucauggccucaggucucugccccagccuccaaucccucauuacugccccagccugugccugugccuggaggcuguggccuggcucuccagcuggaacagaagcucugagaagacagagcuggccagcaccaucucuccugugagaacccugugccuagaacggagccugguacagaggaagaacccgacagacugugagcccugucuuccucuuggcaccaugagucaccugucaaacugaggggcuggcagagcuggagggaguuccaucccagccccaaggugccuggaguagcuuauggaggucacugauggccucaggaugccagcaggcccucugaugcccagggcucauucaagggcaucugcccuguguccucaugcaccuccauucagggaaccugggcuccccacucucacagggguggagaccugcaccucuuuuucacccccaaacccgccugcccgucagugcuuagagcaaaugccccucccccgccaucuuuucaugacucucccccuuccucaacccugcgccuggucaccaaguccugacaacaccuccagccccugucucuaugguccccuccuugaucuggagccauucagccacauggaguauguccucugucgagggggcagggacucaaaggaugagagaaggaacagaggggaggaccaacaucucggcugauccuggucuauuuuuagucgguggugggcugucacuccggaggccagugacugcgucaucagugccuuuugaucuuguugccgcaagauacacaggaggcagcugcucacugcuuguggaaagaaugagggcgggcacauaggccugggguguggggagcauuaaugagugugagugaguggcggaugaguagguagauggacggggagcugcagggagggaggguugcagaaagggaugcguggaaggaugguugauggauggaugguuagauggaugaagagauagaugaauggauaaagaggugaaaggaugaauagagagauggagggaaggagggcugaauaaagaaauggauggauggauggaugauggauggauggguguguggguauguggauggagagauggaugaaugguuaaagagguggauggaugaauggagagauggagggaaggagggaugaauaaagggauggguggauaauggauggaugaauggguaggugggugaauggauggauagaugguugaguggggggguagauggagagaugcaugaauggauagagguggauggauaaaugcagagauagagggaaggagggcugaauaaaggauggauggauggugggauggauggauggauggauggauagauggauggauggaucgauggguguguggguggguggagagauggaugaauggauaaagagguggauagauaaauggagggaaggagagcugaauaaaaggaugguggguggguggauggauggauggggaaaugaagagauggguggguggauggauggaugaguggugaaugaauggauggauggggagauggagggaagggaaggcuggauaaagagacggcugggugggugagcugauggagaaaugauggauagguggauggguagauugagaaaugauggauagguggauggguagauggauggaaggagacaaggaaggaaggaaggaaggaaggaaggaaggaaggguggagguaagggagggagggagagggagcaagcaggcuuggaugaguagcuaaagcaccucaagcaagggugucucccuuagaaauacaugugccuccaaguccucgaggcuggcauccccuccugcuccaucugccucugccugcugggcagaccagucugcuguccuaccaaggccuaggucuugacucuggacucuuccaugcucaucagaggguacuguuggagcuuccuggucaggcugacccagcugccucuggagccuggccugggaucuggagagaaagcaccugugcagacggccccagcgcuaugcccuucugaggccugcucugcacacacagcuuuccucaucccggccucaugcacugugggcaggaguuguccuagcaaccaucauccaggcaccugcugcgugcugagcaccaugcugggugcuuccugugcucucaacagccuuauguggucaguaccaaucccuccccaaauuacccccaugcucagggugucacugagggucccaagucugggguggccaggucacagcuugaaccugggcagccuuuauucucuaggggccuugggggugucuaggcugccaccacagcauccacacuccccacuagagcccacauaggucuuaugggugccacagcagggaccccacuggaccucugugcuuucugguggggggcuugucagggagcucaugggcaccucuggguucuaagaagcuaugcugaggcccacaggguaguucugaguucgggggacccucuccuggcccuguggggucggaggagguccugggagcccaccuccuguagauccaaacaccugaucucagcucaggaucgccacuccagugccccaucccagagccuuugagaguggggacaggguguccuguuguaguugccaagcccaagaaagaugaggcacccaggaugccugacaguagaguugcaggggggcaggcaccaucgcccccagccccaggcugaccccagucccucccuaugcaggcagaggggcaauuggaagaggcuggagacuauucaggagagggugggagcagacacgggaguaggaugggggcccuggagguacuggguggagcugcccccagcccuuccugcuggccuccccagagcuccaggcucugaggccacacccucacccaaggcaaguugcucagggggucuccaggcuguaucuaacagcugccugugccgaaaaauuaagcaccgcugagucgccgcacaccugucaggguggaggggacuugggggaccagccagcuggauauguucccuugcaggcgggcagggcucuggggaguccaagugugcgcacaguccugggugagggcuccguuagaugaauguggacggcuggcggccggggcuugggagaucaagaagucccugaggaagaggacaguagccaggggcaagaccucacacgccucugcccauccugggaaacucaccauggcauugugguugaagggucaguggccaccagagaguuccugcugcaguguggaaaagacaaacaggcgagugaaguggauaaagauucagguugugggagggagacuugaagggcaaguuggccaagacuaaaaaguggagucaagcucagugcuggugacgauguuggggagaggggccuccagcgccgugggggagaauuucaagagccuuuugugaaaauggucaggcugcugaaagugagaccacacucacccugugguccagugaucuccuucugagaauccgcccuggagcaguaacacccuugggacugagaauggcuucuggguugugcgucaucgcuguccaggaguggugaaaagcuggacucugacugccugucauccagagggagcaaacagccacccuguggugaagccacaccacauaugaugaggggcuggaggcagcagaaagggggcuauaggacccuuugacucaagggcuaaccaugauguuucauuaagggagaaaugcacuugcugcuccuggaacauucuggcucacucccgccucaggcccacugcccuggcuggacucccugcacugaacgcuccucccagcucaugcuuuccaaaguccccugcucaggaggccuucccugagccccugcccccuccauuucagacaucuccaucugaugucugagcccugaacagacacaggugucuguucagggcuccucaaaugcacaaauacaugucugugaccacagcccaaccccugggcaguggcugccccucugccucuggagguccccuccaaaaccuuggucccuguccgcagagggugucagggcuugaggucaacagggaggucucagggcaacagagcccaguggcacuccugaccccaggagacagagggaacccacccucacccuaguccacaugcccgacccaugacccaggccuguggcgccagccugcacccggcucugcuccacaggccaacucugcgcacgcuccuuucaaggguuaacggugcaagcuccucacggcaccagugcgcuugccuuugacaugaaaauguuuuugcagcaggcucggaugccagcauuuuugugguugcagucagauguuuuuaacuacguuggacagaacccacggcggcccuuuccguggcuucagccaguuucugagcgcuaccuugaaccccuguugcaccccaggaggagaaucacaccagugcccccugacccccagccuugugcagacacugauacccuuaggaugaagcugaccccagucguggcagccaccccagcagucagggaaggaccugcuggggcauuucagauccugagcagcauguacccugugaaagaacagguuccccaauuuugguucaugguaccugagaugacggcuucagaugaugucccuggccagggagguggaggacgcugggcagagcccugggcauuaacucagggccaucacagagguggugagagcuaccccgggucuggggacuguuagcacagaccugagccgaggcccccuucucacaggggccuacccacuuacgacccaccuccucuccuccauggcaaaggugauacauuagacucaaagagacaugauauccccuugggcugcaacuuaaauuccaaggagagauccugaauccagagucacauguauguuagaaaccucuggcacucuccccuccccagccagcaccuaccagcuuugcgcaaaugcuccacauuugcauuuuaaaagcccugagaaggccugcagugaaaaaaacuaacuucguauaacccaacuauucccaaacucuaucuacaaaauauuuuucucuuuuaucauuaaagaauaugcauuaacaccuaaaacccacuauccuggcaaaaaaguggcaggauugucugaaaaacacauggccagccacccugcacccugaguuccacaacaucuaaacccagugucugcuggcccucagagugggagcgcgugccccaacuuccgagcccuaggaaagggucuugucugcucuuccccucagugucaggugacccaagagugugggggucaggaauggcguccuugugcccuugucacccacuccuguggguacacagcuucccuuucugcaaagucacaccccaagcccuggcuugagcauguacacaggcugcagcccguguuccuggagccaccgucccagguguggcuaaggcccccacagagugugcauccuaaggugguucagagguccucagaaagugccaagaggccuuccucagaggaagagcaaggguaggugccucuggcaugagccagaugaugggagcugucacaggacuuugccacccggggugaggggccuagaaaccccucuccaccagaugccuuacaccccccauccccacacgcacacagcuuggaggcuggaagcccccggaaugcggcccacccugucuccaguuguucccuaccagcccagcugcuggucccuaaccgggcccaccuguuggguccuuagcaccagcugcccagagcccccagccccuacccuagucugaugacccaggccuuucccccugcccaggcuagccuugugcucagcugccagcacagcccccaccacacacuccccaacaggugucuccacaacugccaggagacagcucagcuuagcugcucuucccccaacccccaggcccagcagaaucacaucuaggagagugggccacaugccucuuggaaggcagguggcacaagagguucaucccacccuccagcauuacccagccccacaggacccacauccugcucccagcuccagccugaaaggagcuaguccucuccagccccuuugaaaagaccagcuggacauucuccagggagauucugcccuacaggauuagggaguacccucaccuggccuuuguucauugguucauucauucauucauucauucaacaaguauuugccaagcaucccuaugcuccaggcaucagugguaggccagacagccaaagucccuccucccaagggcuguggcccacuaggaggacagacaaugacagagcauugugugcucuaugccugcccaugugcugaggaaggagcaggagaggaagacaaaccagaguuuaagugaggagugggcaaggcuuuuaugaggcccagcccacccuccccugggcaagcuggggauuugggaaugggagacauccaacacgugucagcccauacaugaggguagaaguccaguugaaaacacaccugaaacagcaggguccaaacaccaggugccgagagccuuccugacauugaaccuuccuugaauuccugagguaaaccuuaugugaucuugacucaaguccagcugcugaugcauuuuuagguuuuagcaucuguguucauaccugauuugggccuagaauuuucuuguguuugcuugagcaguuauggugccugggguuuuaccuugucagauaaguugagcaaccuccccuuuuggcuagugcucugggauggaugggauggaugucgucugcuuuuuuagguaauuauagaaaucacccccaaaaacuagacuggaaaccuuuuagaggaggguagguaacuggcauuugugucuccccaauggguuuauguuucuuaggauuuucuaccacauaagccacuuuugguauuuuuugccuugaaacuuauccaucauauuguguuuucaauuuuauugauaugaaaguauauaucauaaucacuuacaauuauucaauucccucgguagcaguaguauucauuccuaauucuuauuuguuacuuuauuugcuuaagguuuaucuacuuuacuggcucuucaaacaaccugcauuugguuuuauuggucaauucuuuuucauaaaauauuuuucuauuuugcuaauaucuuccuuugacuuuguucauucuuuucuuuguauuuguuuugguguucuuuuucuagcuucuugaguugaaagcuuagcacauuuauuuucaaucuuuuuuauuuucuaaaauugccaucgauacuucuccaaauacccuauaggaagcaucccacacucuuggcauguaaucagcuccuuguaaauccauccuaagauuuucucucugccuuauuuucucuuuaaucaaagaguuauuuagaaggguacuuuuuaaacuucaagauguauccaucuguugcuauuuuuauuaauaauuuucuauuuuacaucaagguacagauuuuuagaaauuuauggaguuuuccuuuggugccuaauaggaucauuucugugaccuuuuuguauauguguggaggcgguggagucuuuucuguuaauuguguuaaacuuguuaguggaguucugcgacuccuccaccuccugacuuaccuugcuguuuguuuguuuguuuguuuguuuguuaguuucacccacugugguuugucaguuucugagagacaggcacuaggauggccaauaauauuguggauuucuugauguguugguuuuguucauuuguuuuuccugccccauccucugggcccuuaaagccugggcacauguguccucuccuuacgucuggggaaauggucuccauugaggguuugagucugcguggcuuccgccucccuucccuccugcuagagccccucuggaagcugcuggaagccauguccuccacauccccuggcucuuccuucaucccauacuuucuucucccugacagagcugucaaggggagugccuacaccccaccuccauugcugcucacccuccccuggcccgugcugggccucggccaucucuggggcuguuucuaggcccaucuaagcgagggguuccuuaaccugccuugcuuuugcagcugccugaaccucccucuaaggacaucagcacucuucggaggccagguccggccugcucugcugccuuggugggaagcuuucgucccugcaggguggggugggucugucaaguguucgguggccccuggcuggugcuguagcaacacgggugucagagggcggacaccgaagccuggugcucugugcgagucccguuuccucgccucucagcugugugacuccaggugcagaggccccgcguggggcaggagcacugcaagcgagaggaugggaagguggccgugggccuggcaaggguuggggaauauggugagaauggugcccauggggucacgccagccacacacacuuucucgagaaguuucaaguggagccacagggccauuguguguccugaaucauugcucuggcugagggagucuggggacccaugagggccagauggaugggcucagauggagugggaggccauugggaaguggcugguaaaaagccucaugagggcagagccccacugaccccacacaguuacccaugguguccccuuccccacgugguaauucuggacuguucacaguggcuuccaaggccuuugggaugggccuugcgugcugcccuucugcuggaaacccucccagccauuugagguccugcccucugcucaccuuguucccugugcccaugacaucuccccaccuuuuccuggcugcuauguacugguccuauagggguuccuuaaagggugcaucuuccaagccacuccuguugcccuccucugcagccacaucccugcucugcacacccccaccccagcaagugugugugagcucuguagucgugucauggccccagugauguccucauucuaucccugucccuucauggcagaguggacuuugcagggugacuaagugaaggauccagagauggggagaugauccuggguuauccaggggccccgaaugugaucacaaggguccuucuaagagggaggcaggagggucagucagcggagaagacagggggauggaagcagagcucagagaggcugaaggugcugugcugcuggcuuugaagacggaggaggggccacagcccaggaacgcaggcagcuucuagaaaaccggagaaggugaggaaugaaucagcccuagagccuccagcagguaucagcccugcugacaccuuguuagcccggugagacuccugaccuccagugcugcaagaugucacacacguguugcgcuaugcuugugguaacauggcaccacagugcaggaugcugacacaagcaccagcacagcgccaggcccugggguauaguguggauaagauggacuggacccuacccuccuagggaugucccucuaggagguggagguggggaaauggggacagauauuaggccauuauggcagaaugcaaguguuuaguuagaacugugcuaagugcguaaagagagcuaaaggcuacauaauaaguugugagccuaccuaggguauuagcagaggugucccaaggaagcucccugugagccgaaccccaaaggauggguggaaauuagcuuaacuaaguggagaggugggauagucaugggccaaggccccaaggcaggaaggaauaggccuggucugugggucugagaggauggagagggcugaacacgggccaaaggagaaaguuagggagggaagguggaguccuuggcaggggcucagcucagaacagggggagccccaaaggaugugaggcaagggagcaaugaacaaaucucaccauuguaagaucugaaauucagaacgguggcauaggccagaguaggacauugugaaaaagaaacaauuagagaagcagaaagagugcuuggaaaugucaauuaugcugcugaauuaaaaaaaaaaaaaucaguaaaagauggaaguaaaucucccugaaaguggaaugaagacugaaagacagaaaaucagaacacccaagaaacaugcagacucaauccaaggacauccaauauccugcuauuggaaguuccagaaagggagaugagaggaaauagagacuaaagaaagggcccacugagaaccucuagcagaaaagagcagccacugugucaucaugcccuucaggaacagcagagauaaagacaacauucuagaaucuucucaaagaaguaacaggugauuuuccaaacaugggccucugaacagaucagucuuugguagagaaaauuuaugaagagagaugccuucaaaauugugaaggaaaauaaaauucuauaccuagccaaaguaucuaucaagggugaggauacaguaaagacauuuucagauacucaagaacuuauaaaauuuuuccaagucacugcaggaaaaaaguauagaauuugcuuucuaucccuuuucuuagaagguucuggagaaugcacuccagcaaaacgugggaggaaaccagggaaaaggaaggcaccaacaacaaggaggcagaagacccuacacagacagaacagggagguccaagcccagcagcuggcucagggcuacaggccuccagcccaggcagcccaggcaggagcagaggacaggauacuccugaagaggccacccaggaagagaaaauaggugggacugggaagaaaaucugcaacggagcuuccaaaacagcggaggaucucccugagggagguguuguuagagaagagagcagagaagcaggagaacccagaaaggaaaugugagcacaguauacccccuggcucugugggggacccaggcagugggcauagauuucaucaaaacaauggggaagcugugcuggacaguuagaggguggacaaagccgaggguggggugagagcuuaagccucaccuucauacaaggaagauucuaguagcuaagauugacaagucgagaaaccauguggccagcaugucaccaaaagcugauaagaggaccagugaugggcuucccgggaguggagcugggcaugcacacuaaggccuggaggcuugugcuuauccaucauauagcaggccugcccuuuccacagcacaaacaccuugacacacaccgucacacacacccauauucgacacacacauucacacaaacacacccagacacaugcaugcacauggauaacuaacucuuccagcaagagccacccccuggcugaagugugaggcuguccauggaggggccagaguagaggggaggugggugaggaggcuacgcagaggcccugggaggagggaggcuaggcccagggguggaaagaagacagauacgagaggggauuuggagacacaauccccagacuuggggacgagcuggauaugguggugaaggaggggagucuucaggaaagacccccagguucuggcuuggccauauguuggaggcugaaacgauucauccagacaggagcagggaggaggacacgcagggccugaaagguucugagguguccacguggagguguuugcccggcaguuuaggcugcaaggcucagcagggagauuggagcugaaaacagaggcugcaacauggaggugguaccugaagaagggguguggaugagguugccuggcaagagauugcagggagaggagagagugagaauggggccacucaaggggugaacagggccuugcaguacaggaagcagcuggggguggcgggaagaagacagucaggagcuugggcauccuagaggcccccgggacagcuuugaggaaggaacguccccuggguuccacaccacagagccauagaauucuguacuuggccugucucagugccgugccgcauccauccugccccuggcaccggaggguacacugaucagggacacgaguuccccugccgggcacagagcagguucccagugaguucuggggccucagugacugggcaaggacaggggcguuuggacaggggaggccggguguggauggaagcuguacgauggggccugggccagggauugugggccagcuccgagcucagacauuggucugcacauguggcuggugcaggaggcgcagugugcugggccucagccuggacacggcugucccaugcgcagagacagggucacgguggaaagagaguccagagaacaugggaggugccguuucccugcggcgggacuggggcuggggcccggcuuccccgacccugcugucgggcgugugccuucauagcccaggaagccaguuccuggcagggugggcucugcagccaggccgccagggugcagacccagaccaaugggaggccaagggaggcccgcagcccagaccuuccgagcccucagccugcucagcucaguguccuuccagggaaaugggcguuuccugugggaaggugccaggggccccgggugcuggaagagcaagcaccacgcggggggguaggggcgccccagcccucuacuggccagugucccuccagucguccagcccuugcugccaggggccccgcccaugugccuggaaucacacccuggacgcuuccuucuuuggguuagaugucgucgucuucaacaaauauuuucugaaugucugcuauguacuagacucugggaacacaggggaaaguauguggaccugcccaugaggaagucaguacaguggggccaugaacaauaaacagacaauuaauuauccuucgcggagcugcgcgggggcagcucucccaaagcagucagucauucacacuucaguaugaaugagucuccggguacuuugcucaguaacggacuggaccagcgcggccuccacgccagggacuggggcaaggguggaguuuggaguaaagagagaggcagggcaaccccuuuccacagacacuuuaccaccuccccacauugacaagcuggcuccccagggccacccggagccccuuccucagauccuguccccauuggcauggucucagccccuccugccccaguacccucuccccgaggccucguccuccccgccauccuggaaacgauuuuguugucugcagagauuauguguaacugccugugaguuauaagccuccacagcaagcagccuguuaccuaaccaggccuggcucaugccaaugucuugaguaauuauuggggggcgggggcuguccagcccgcagcagaaccucuccgagggagugcuauuguuuuucaugucagcugcauuuuaaggcuacauuucacgucagcugugacuuggaaggaaagagggcccggccuuugaaaaaugaagaaauugagccgggguugggggcggggagggcagguuaacccuucgggcuccaguauuccccagcuucccagggucuccuggcaguaaccaggccagcugggggucagaacccgcggccaggcccagcagccgccucuuggcagcgcugauggaaaccgccgugcgguuccgcgcagacagucacggaaacucaggcagacccggcguugggugcgccaggccggugugggagcacuuucccccgcccccuccugcugcugcuuccccgaaggccuccccagcagaccugcagcugggcacccacaggguagaaaugcccuggauuggcuguggcacaagagggcuggcccagcacacccagcccaccacugugcucccagagggagaacagagaggggugcagagggccagagaggcacggggcuccccugggcaccccucgucuuggggccccugcccugccuccacucagaaucccacuaugugcuuggagccaugcugggugcuggggagacacacuaaccacuuccccauaugcucacagccagagagacacacaggccagcagccuguaaaccacuggguguggggugucugguccuggagugacaaggacagggaggaagaaagccaggcagguggcccaugagccguggaguagguggggaaggggacaucuccaaggaggugacaucggagcaguccucuaaggaguuuggagucauuuucagucacucacaagccacaggagggcuucagccugaagcucagaggugaugugcuuagaugucacagagccgggaggggaacaggcugggcugcagagaggaggccaggcacagucaccucguguugcugucccccagguaggagauaagggaccagagucagggcaggugggagaaggggagguucuugguucagcugcugcugagacagugacccuggggacagcccaaauaagagagaacuuugccacccgcagggucccagaguagcagaagcuucagggcugaugugugccuggugaaucagccuggccccagaccuccucucucugcuugcuuuccuguccacaauccagugcuucuguccuaugguccccagcggcugcuccugcauucaccaucacaucugcauuccagcagcaggagggagguaaaagacaugaaggacaggccccacuccuguaaaacccuacacagaagcggcccacgucaucccccuuucuguccacccgccggaaugugacgcacgccugagucgcugcaagggccccuggggacggagucucuauuccaggcaggcaaacacucagcuuaauucaggguucuguugauuaaaaaaaaaaaguggggucgggggggcgggggagagcggcuauggagacaaguggcuguuuugccagagggaaaauuccacauguggcuuggaggccagaccagaaggacucagauaggaguugggcgcuugagggaggaaauggggguacacuucagcggcucaggccaggguguaaguagcagguauguggugguacuguuuuccggaaugaagaggaaggggcgggcagaaggcagcgagagcuuuguuuggggugugucgaauucaagaugccucugagacauggaaguggugaggucaggggccgggaacccuauggugguguuggcccugaguccaagccaggcaccaccgggcacauagaggucuugaaagcucgaauguggggaggccagcaacagagggaacacuaccugcaaaggggcgagggcaggacaaaggcuggcagcaccacacaggagccagcagggaaggggccacagccgggacucagaggaggcagccacgugcagaaaggcacccaugggaacauggcuccugggagcuggaggaccucagcaggcagggacuagcacccaagaagaaaacucugagaagucaggacaggagauggugucgucagggggcugcuggaagguuuggugaccggagcagcaggugccagagcugaaagcacugguuaaacgugauggguaaacacaugucuauuucagcuucuuugaaucccacuaaggugacaguaaaggcaugaaaaacauggaaacauguaaaucaacuaggguaaaguggucaggagaaaagaggagaccaaaaauauguugacaaagguuuggaagcugggaagcaggaggacagauggagacuggccuaggagacuggagaggguagacaccaagcccugcaggaagaagagccaccaagaaugaggcaguucccaacccaggacccugacaggcaggucucaccccagcccaugaagccagaugcuacugauucucaagcucagcuagagacagguugagucuccagaaaagcugagccugagagguucugaacuuggagccaccaggagcaguuguggguggggcaggagcucucgugaugaaaacaacagggauucaguaaaugcauucaagcuaaaaaggaagaccuccucccccacuucccucaucaacucccagaaugcccgguggggcacaccauuguuuucagaacaccagcaauaaagcagacacuccacauuuccagagagaaaaaguaagucacacacaagagaauagaaaaucaaaacgguauccaauuucuuaacagcaauucagaaagcuagcacauaguagagaaaugccuucaaacaucugagggaaaaaaugauuucccauccagaauucuauaccuagucaaacucucagguaugagaauagaauaaagacauuuccaaacaugcacagucaaaaauuguaucuaccacaugccuuuucucagaaaguuacuugaggacgugcucuagcaaaaugagaggaaaaaacaaagaaagagaaacacaauucaagaaccagggagacuccaacaccaaaaacaaaaggccaagagaauuuucaacaugagugaaagaaguucuagcauuacagcugcucagcaugccuacagugcaaacaguccugcuaagacuccaggaagaaaucccagaagaaaaaaaaaaugaaggugauagacugccaguauucucaauaggaugaaagaaguuuuacaauucuuacagaaaguucaagaaugaauuagugacagaugcaguaaaaaacaagcaaaaccuaaggccauuuguaacccaagggaaaacaagaagauguaaucauaacagaccacaggacacagcuaaaaacagugauuacauagugacauaaagaguuauauacuguuuguguaaaaugcaaacaguaaguacuuauuuagccuagaauucuaauuuaacuguguuggaaagauaagggaguggggagggcaggggcaugagaacaaaaucuugaucacuucucuuccauguuaggcagucacuagauaaugucuaaagugacaaaauuucaaggaacagcaauguaaauguguaguuuggaaaugccaagguaaagccaagagauagucgguaggguugaagggcugccucugggaacagaaauuagagauagaagaucuagcgcccagggaaggcuguuuaaagaugggagagcuucacggguuuucucacuaaggguaagaaaauuuaagaaggaagugauggugccagagaauagggaauucugccaauacccugguggggagggggagggggagggggaggaggaugagaaggaaggaggagggaggaggaaggaagagggaggaggaaggaggaggaaggaggaggaaggaggagggaggaggaaggaggagggaggagggaggaagagagagaaggaagagauuggccaaggagcucugagaggggaaggugggugcaugccacccuggcugggaacagcagguguguggugaaggggaaagaccagcaggcccuuuacaccgugggcacaggcucaggacuggcugggugcuacgcaggagcccucugacuagcuggggcuggggcugugcaggauaaggccagugagagaagaggacucacuggugggugccuccuccccaccuuuagcaaggguugacagagggaucugggcucuucccugggcaggcaucccagagcuaugaccugaaugauaucuuagaugaucuccaaggccccgggaucuaagucccuguuaaguccccuguuaaaggaccuagguccucccaauggccugcaaaccacacccagucuagucagcauguauccccacaccccagucccagugucccaagaaccucuuccuccagccccgggagcaggaagggcgggcugggagcugcaggauggggccugaaucucucaucaacucacagggucagccugggccaggcaggcugggggccagcccaggaccuccuuccuggguggagaccuucccacccuuccacucaccuuccgagcauugugggccuucccaggaacccccacaucuccguggcccucagaccucugaccucccaagggcaccccacgugugugcccuccagcacccuggccacagagccacacaccugggccuuccccucuccccaucaucagguaacccagcacaggcuggcccaaccccucucuaggccucagcuuuccugucaggaaaaugcaggguuaggagcugaccagggagucuuugaaaccgcaaggguacccuugggagaccccgugcaggucuugucaaggcaggacagggaaguggugaugaugagaggcagcuggucugggugcucagccccaccccagcacccgcccaaugggcccccugagggaagcugcccaugcucucugcgccccauuuucuggccucuggcaugcagagggcagcccugccugcuucccaguauggcugugaagccaaaggcggcgaucaaugggauguucucagaaugacaggugcucugugaucagcagcagcugcuacagggauggccaucgggugcagggcaggaugucccugaggaggcaccucagcagacgugaugggugccugugcccacaguugggccaugagaagaaguauguggcccggccugcccuacaccaucagggggugcuuggaccaguggcggcuggaaauaacccaugaacaggggagagaaggggugaaugccuuguaggccuggaacacuguggggcugucgaaggugcuucugccuccaggaagcccucccugacuguggagacacaagaagcucuccaggucucugggucccucugguacucugugcccugaaccaccacccuuaggcccagaucuauuccugauccuucucuagacuucagucaguuuccucuugauguccuggauggccacaaccauaguguccccuccgcuccucucucccccgcuuccuuccacauugccccuccuccccuuuccccuuccccaccacugcuccccuccuuccuccagcacccuucuccccgcugcccuccccuccccuccccgcugcccuccucugccucucuccguugcccccuccucccucccccaccagagcccuggaaggcuagguacagcgaggaaguggccacuccaugacccccagugauuucacuucucugagccucaagagucucaccuguccaggguccaugggauaugccugacucagccccuggcacauggucuugcaguggccugagcuggacaugccccugguaggaagcuggaaaggaggcccugcccguguaccaggagccucugcuccagggggguggccugaggcccaggcagaccuccaccuccaggcagcccugcagguggacagcugggccucaggcuuaggaccugggacaacugccuagacuacccccagccuuccugacaggugauagcuucauuguccccaggacacacaccagcccgguccccacccuacccuuucccagcaccccugagggaaggccuggccccucaggcacaguggggguugcccggcaucuuggcagaugggcagcguuagagaagccuuggaccuggcccugcaaauggagguaccagagggcugaacuagaugagggacuugaaggcucagaugccugugcgggaccuggcagggugggggcuuccgggcugggagacuaggacagggugccuguguccccuccugggaguggggccgucagagcuccgaccgcacagggucauggggagcaagaggaaccaggauacccacaagcugcucgcucagacgggcucugcgacuccacaacucaccuuccccuacugcaagaucagggagaugggacgcaguccccgcccaugcccagggccuuggcagggucaggagagccagugcaggcaaagcgccaagcacccugcugccugggagaccacaguugcagcaggaagcccuccucaggucugcccgccuccccggagcauguucccucuguagcucccgguagggccuguguggagaagguugcugauggcaucacugagcggcccagcuguggggugaaaggcaaggcuggggcugaugcuccccaaggcaggaggagaccauggucuggcuggggcugccccaggugacaacuguaggguguggggaagguggcugccaccgccgugguccacagggccuggccagggcuccauggggcagaagccaugcccagcucagggggcuucacuccacucucccacuuugaccuggucccuccccucucccccagagugaccuggacacuagccuccucccagugggagacagaugugggcaaugcagcugcuguucccugcucagggcaggcuggugcccaaggacugcccaccagaccaggggauaagagguuggcagcaucguccaugguuaucccacagcuaggaggcugugggugugggagaacaugcuggguaggggugccugugugccucuggagucgaggcaauuagaggcccuguggaagccccugcacgcaaggggcccacgcgccagggcagaggacauagccccuucuugcuucccugagggacgggaggccuguggacuucuggacacaauggcagagucagggcagccaagccgggccagugcccuggagccgaguccuccccccaccugcccacaugccccaccccucuccaagcuucuccccucauaggaucccagagccccuugggaccucugugaagacugcauagaugugagggagucucagccuuagggugggcaccugggcgcagcugucaggccccaagucagccccaggcacguggaccugggagccagccucaagggcagggguccccgagcauccccacugcugccccgccagcaaccgugucacugggaggcaagaggcuggguuccuggggugggcaggcuuccccgcuucacuccauuugcagccccugucuugcagaggcaaaauggagguucagagaggugagcaaacaccaggucccauguuugcaccuggcugugaccgugcaguccacugggcccagcagcaggaacuggggcaagugccccgagacgggaccgagacaacaguggggaaggugggacaggcagcugggggaaggccagaguguccagcaccagcgccaggggccguuccgacaggcugaggagcggcggggagcggggcuugccaaauauguccagauggggcuggagccccagcaacuuccugcccucccagccugcucccccaccuccucacccccuucccaggcugucagcaggggcuggggggcagcagaaccccacuuagccacaaggagugcagccaggggcuggcucccgggaggacaugggcagaggcuuagguccccuuacacacacacacugcugcauucgugcaggaugggcucagcgccugcugugccuggcguggcugugugcauggcauggugguggcauggugggagugguguggcacaugguguggcacauggcauggcuggggcuggggcuggguuguguagcauguggaguggcaaggugcgugacaugguguauggcaugguagugugccccucgagccauguguccagguggggcagaucauggagggcgcccaggugcggugcugaggcugagcaugcacuggcuggggagggugggcagagcaggaggaaaucccuuguucuccggagcuggagagccagaaagagcccugcagccugggccucaucaucacaccucgcccucaaggccuccaggcacagcauccacugccagccucugcuccugccucugagggucugucuccaaggucuuuugggggcugccccagcucccccaacacagacagcaccagagcugggcccaccugugaggugcugaguuccccaucucagagacugugcgagcagaggcagggaggcgcuugaugucggauggagaaaggacaggggagggguguggggcucagggccccgccaggugaaggaacaagcuuggaaggguguccuuaugucugagaguuggggagacacccccaagccccagaugggccucgaaugccaggcagggccaagcugggcccagaagugggaaggaucccuuggcugccccaggaaugcagguuccggggcaagaauccagcccuggcugguugaaguccaucccaagucucccuccccacgaggcuccugcagaugccaggaauggggcuggauuccagauuccaagccuggccgcccagccccuaucugggaccccagcccagggcccccaggccuggccuccaaccuggccccagccucaggggagcugaauucagagaauccuguccuaggagccagaagcgggggagggagggagggcggcccuguccugggugcaggcccgggggcugggggcugcccgcccgucugggucagccgcagcugcaaaccggcccuggcugagucauggggccuccaucuccaggccuggcuugaggugggaauagcagugagguuggacauccaggcaccuggagggugggcagggcucccugcggcugggguggccaguggcaccuggcuguugccccccugcaccccagcccuuuggcccccaagucucugccaccucccugggguucugcucccauauuccucacacccagcacagaacccagcaugucuccuguagacaccugcauauaaacccugacucacacacacacacacacacacacacacacacgcacacaugcaggccaggcuccucggccagucacccuaccggcagagcucuagacauuucuggccucuggugacuauucuucaggcagcucacccugcaagucuuuauugagcaccuacugugugccaggcagugguacagcaagggcagaagccccaccuccaaggagcugacccccugccguggcagagacagaaaacaaaggcagcaccacagcgacgagggccugagaggaaaguggagcaggagccugcagcaugcuggggcaggggugucuuuagaaaggguacugggagggcccuggcaagggacuuaaguaauuacuuaaaggagggaaaggguggccuggggcucacagaggaaaagccuuccucauggaggcggcggggcagcgggcucagccugcaguguccaggagcgacgggaagccucguggggcuguugggagacagcaagaccugggucagcagagcaccgugugggguaagcagaugacagggcagugacagggugaucgggcccggucaguggucccaggggucggggacaggugggaaucgaagucauaggaggcggggcaaaggccacggggaaagggacagagcugcucccaaggacgcaccaccauggggugccccguggcguggcgggggugggggucaggaccuuuagcagaagguaaagaugagaccaagaggcagauggguggaagaguugaaagcagccaagugucaccaaggcauuucugagggagagggacacgacuaguggcucaaaucuuuagaaaugaggggaugggucugguagagcaccccagauucaaggcggguggcuuggggaaagcagggagaagggucuggaaacugcugcugagcaggagcccccacacccacagagcaggugcagggaggcccaucuguccauccgucugucuguggggaggcauggugacguuucaggccggagguagaaguuuucacccaggagguagagggugaggccggacugcacuccaaggggaggaggugggagagcacagccuggcugcugccaccaagcuccccagaagaggggaccccuccccccgaacaccagcacauguaggcagaaagacuuggccuguggagcccucagccuccacgcccaccagcagggacuggguggugaugucagcaauccccacagaaaggagggcugcacagccgucccaggagccagcacuguccccgugauucuacgugcagccuccacaagugugucgcauggaaacaagcaguggagagccacaugugugucacaucacgccucgccucacucgugcuaaaccucgcugaccaggcagaaccaggcacgagcugcguaucaaaguugcuggaaggagaaacaucagaucccuaagcugguuaccuggcaggcaggggcccuagagggaaauggggcaggugaaauggagaugugucuuugaaaugucuuuauuuggcgggagaacgucuucauaggguacuuauaccaugaaaaacccuguacacagacuaauuuugaagcaaacaugugaggcguucacagaaaggguucaggaagacaagcaccccagccgcagagagcccgugggcugggggcacggggcauggcagcccucuccuggggaugggcaggauggggcacguagggcggaggaagaggcucacauggugugcguguuugggagcacccugggcagccucucgaguguccagagagaggacaccgucuugagccagcagggacagccaagagcgcccggggagaggccuggguggagacagaacacagcaggcugugggcguggccaauguugagggacggagguggccagaggccucucaguggugcccagggagcuggggacgaggggccucauccuuccccugagccccucccuucaggcccagggaguggccuggggcccaggagagcccgcuccgcgcucacagccuccguucccagacacgcccgggccugagcccccaggcugcacugugccacagaacagacuccccggccccucccugcucgagaggugaccaaggcccagggucucccagcgagcaagaggccauugaacuguuguuggcugugcagugcccugcccucggggaggcggccucuaagaagcacacaccaccagcaggaaccgggcagacagaggugggggauggaaagcaggggaaguggccacagccaaaccaggagggggaagggagggggccucaccaaggagacccucaccuggggccuggagaaugagaagggucuggaggcuaaggagagggguggaugcuccaggaggcagggccagcccaugugaggguccugagguaggaaccagaggaaaccggcucuggggcgagaagggcggcgcccagggggccacaggggccggcggcgagggacccucagccgaggcugguaucucgagaacagcagggaugccucaaagguucucgcccagcaaguggacauuguggugugggagaucagcaggugccggugcuuucucugucugcaggaaggagagggggucaugggccccagaggccucugucuuagagaaaaaugguggcaacgugggacagacugaggaagccagcccagaaacgucccgucccaaauucaggaauauuuaggguauaccugcugcacgccaagggcaguuucaggaaggggaccuacuucugagaagcaaacaccaccaguagggaccaggcagacagagguggggauggaaggaagccagacugaccucacguggcucacagccacuggcagggucgggggacaggugccaaacuauccacaugcccgucaggcaccuggaggagugugaaacggcaugcagaaagaaggaagcaggcuuggggcugggggccagggaccggcgcgccgggaagcaggcugcagagugaggccagggaugggggcugggccagaccacaggguugugagcggacucuggcauugauccggagccacugaggguuagagccuaugacugacaggggucugacuuccagugguauggggccacccugcugggcuggggaagggaggcgagaggaaguaucuaaggucugcuuguggacuuccggggacagcgagggguauugcugggguccuaggggcuggugcgcucagagguuccagauggcccagcaaguggcugagggcccaggguaggggaggaugugggggcagcagggccgaugugggcagaccuggagcaaugacacgagaacggccaggcagcccuggcuuccccugcccaccugcccccguggccgggcugggguuuggcugaggcagcagagcgcucgcuggcugcccgaacaaaguguucugccugguguccccuggccuccgggccucugcgggcucgccagagggggcagcucaggaggcagcggcagagaaucaaaugcagguggggccugugcccaccgccagcacaaacacggcuccugggcccccagccugcccgacguuccugcccgccuggcccccaaacagaggccgaugggacgagcccugcccgggguugcacuaggugggcaggugggcaggugggcaggugggcagcugccucgggcucuuggacagagccgccccugccuggcgucugccggcaggaagcuccugaggccgggcuagggauaggccagcccuugggggaggcucgagaccccaucccagccuggggcuuccccacccccucccaccugccuggcagugaggcagcucccuggccucugggugcaccugggccuccugcccaggccccuuccaagggaagagggcaaaggggcuccagugccacccagggaguguugugccacgugggccccccuggcucugccacugacucccuccaugaccucuguccccacccugaaguugacaugaauguccgcacggagcagccucugcaggucugugaggcuguggaugugacagcucuggcucuggcacaaacgucagccccaacccagaugcagggagggagguggcugcguguccaggagcacggggccauguggcaccggcucaugucagcagacacggcacacauagacccccugggggcuaugacgaggugagggcugagccgagggagaauccaggaaggcgugcgggccgagaggaagaggaagggaggcucugguggcuggagccagcugggggagggaaggcagcaggggcugggaucccucagcccccacagccguggugcggacuuuguuguuugcucagaguacaaagaagaggccuucuccggguucuuagcagacgagcgcgaccucuccgaccagggagacagacaagaggggagguuaugaggucaccugggagagguguggguuccagcucccgucgccacuccccgacuggaugccagaacgagccugucgucuuucaccuccagacagcagggcccuggcucccaguaucaaagcauguacaagagcggucucuagggcaguucugcguagacgccaaaguacaggaagacgugcaggaacuuugugccgucgacccuugaacaaugcaggguuggggcaccgacccccgaacugcccagucaaaaacccauguauaacuuuugacuccccagaaacuucacuaauagccuccuguugacuggaggcccuaccaauaacauaaacaaucaauuaacacauuuuguaugcuucauguauuacaauaaaguaaaguaaggaagagaaaagauauucauucagcauaagcagaucauuguaaaggucuucauccucgucaucuucacguugagucagcuggggaggaggagggguggcucuuacugucucgggugacagaggaggaagaaaauccacguagaagugcacccacacggcucaaacuuggguuguucagggucgaugauacacaaaaaggacauucuaauccaguggggaaaagguccaucauuccauaaguggugggguaucagcaggauaaccugcaaaaguaagucuguaggucagaaaucaaucccaggcgauucaaagauuuaggggguaaaacacaaaucaaaaaaguauuaggaaaaaagauuuuggcguuggaauggaggaggcccuuccaagcacgcacaggaugagaaggcauaaaggaaaagauggauggcuuugaccacgugaaaaagugaaaacauaaguaagaccucuguguggcaaaacaaaaaaauaauaaaugccauaaacccauacacgagacaaauagcacacuagggaaaaacaugugugauguguacuugacaucuuucuuaacauagaguccuuacaaaucaaugaacgugaaaaggcccagucccagccucagcuucucugcucagcacccacccugggagggagugggcuuggggggcuucuacccccucacuccagccuuggggccccgggaaauuggccggggccucacuuacuaauucaacaaacauuugugcagcgccaacucuacccuccauguauuuacugggcaccuucuaggcuccaggcuccaggcucugggagacugucuaggguuaagauggugacugccuggccuagagcugggccuccagcugguggcaaaacaccaagcaaggagaucaauaaaccgggacauuucagggaguggugaaggcuuacaggaacauggggagagaugagacgaggaggccgcccaggauuuugagcuaagguuacaaagcagcagaggacagcgggugcaaaggccccagggcccaacugagaugggcgcucagaucaacacgggcaugcucagugccggagaggggccagcggagccucugggggcacugcaaaaggagacuggauuuuacucccaguccagugggaauucugcagaaggauuuggcccaggcugggagggaaggcucagccuggcuguugccuggaacaagcggggaacagguugggggcauagccaggcagugaggugguugugacaguccaggcagaagaugcugccagccugggcaaggggcauggggggcaggcucagagcacaugcuccagaccagagagccacagacaccaggugcacaccagggacccuggguaguuggucgugcccuguggauacaggauucgggccggcuugggaggaaucugagcucccgcugggacacgcugagcuguggggcuguuggccugcaggccuuggagccccuggagagagcaaguagcugacggggacauccuagcuagccgaggucccaggaagggaacgagggucguguggugacgaucuugagauauucccccacagucgucagccagggacauggcgccccugaggcccuuggggggccaagcauccgucagugggcagaggcugguaaaaguggaugucagcagcagggggaagggucuuucuuucaccaucuugggccucucucagagggaggcaaccccgcuccugggggguggucagugagggccagccaggcagcggcagccccaggaaggguguugggguggagcugaccaggccucugccgcaugguugcgcugugccgaggacccgcugaggacauaaccgaccaugagcgguguggguccccagccgcggcagagcuuccucuggcugcucggcagacaacagacaccagggacagagacaagguugaggauuuggucugcagccucugagcggacacacucacccucagugccugccaauucagccccaccacaggcgccagucccgagccugagcacaggggcugccacgacgcucgacucucugggccaagacucacacacagccuggacacugcccgggugaagggcucugggggacagggggagcagcugguaugugugugaccaugggucccagacucagugccaucugucuccccauuaggagaggacgccugguaccugcccaagcacccaagccaugggaguugcugcuugcucuccacgcagcuuugucccagcagcacccccaacuccugugauggguugcagggggugcucaccucuguggcacacacaaaggcccaggggccugggggugcaggcaggugcacuccaacccuugggcagcccagagaacaaccuaauggaaagugaagggaauuguacaaguguguacaagggugcagggugguuccugccuucuugcacgcacagucucccacacucauacagccacagguucguacgagguacacauaugugggcucaccuagcaugccucccgugugcacagcagugcuccuuuggccucaggccacaggcauacaugugcaacuguacgugcacucuaggaaucccuaaugaucauggccaucggguggcucgcagugcacugagcaccaugcucugucccuggugucuucaugccucaguccacuugauccccucagcauccuccuggggaaggugcuacagcugcccuguuuuauaggcagggaaacugagguucagagaagcaaagugacuugcccaaggucacccggccaggaagcggcagaggcaggaucugaccccagacccgcugcggcacacacacgccugccugcacgcucccgugaggaggugcuuugugcccaaggcccugcagcagugugggggguucugaggccaucucccacuggccacagcacagcaagcuccagcagggcagcugccccaaggccuggcgguaaaaccucagcagcgagaaacacggucgacuuuuguccaagaacugaagcacuaaagcaaagucaaacacaaucgcuccaugcccugccacgaaccgcgaccuuaccacgugcugugaccuauugccacuugugcccagcuccacacaggagccgggucugacauccgauugcucagagccugguaugaaacauucuagguaccgcccugagaguggcuuaguaacugcugguuccucaggacagacaggaggaaggccaaggugaccuuugcccugcgacccuacagagggcccuggggaggcccugccuggucuuuagacacugcccaacaaggaugcuagaaggggcagugaguuuucugccuccuggggaacugcagcccaggcagagaacaggacccccacccugggagcagcgggugugcccggccucucccgccugucccuggccagucugccauccacgaggccagggccuuuggcgguccuaggcggggaucaaggccgggcagguucugcaaaaauuucccuugaaagacucuuuuucaagauuuucuuuugaaaacaaauucauaaccacaucaaacaggaauccccguugccuuggguuugaucgccggccgcccggggcucucuaacuagcuguuauucuaauugcuuuuuucucuuccgagggcugcauaggucucuuaugguuauuaauuuggugagugcaggccgggcacaaagcagcuuuugucugccuugccuuuuaaucacuaucaaauugcaaauaaugguggaggcugagauccccaaaauugaucugucccagcaguucuuggggaaccggccccagugccuagagcaugcacugccuucccccagggcggcagcuccccgauggcaccugcccggaugcaccuccgcauggguggggucuggccucggccaugggaggugcuucucaggcuccuccaucgccaaaaaaaaccaaacgugccagcgagaugaaggcgcccugcccgcagagugguggggugggacucuucagggacacgugcugugacaagugcuugagucagagcuaagacucuggggcugccgaggagccaccuguagcccaggccugggcccuucccacaaggggggcagcagcaugaugcaucagacuguggacccgcccugggcauccagcccacauccuggcccacccccggggccucugucaccagcagcugggaugaugagagcaugucucuggggccagagacccuagccagucccucaaagccccaguuggcacaggcagcaguugaggugagccugggaccagccagagccaggcaugggcugacgcuggcccaggcagcuucagggagcccuucaguguccgucggaggcaagcucggcccuguggcugccucccgaccccaaagguggcugagugccucucuacacggugccgggacucccugccgggaggagcugucaccaaaguggcucaggacugagcgcugauuccagccacacccucagccugcacugccugccugcggcccugacacccacugucucuuucugucccaagaauccccugugaaggccuccacacccauuagcacaugugggacuuggacagauguucgagugccauaaugugaaaauuuaugaaaccacaaauguucaucugugauguauuuggugcuuuaauuaaugccaaaccaauugauacccaagcuggggccugcacaguuagugacaguaagccacgcggggcaaaccucguuccacacuaccaguaugcggggcccagggagcugaggugagcccuaggacacaagcccaggcuuugcccucaaagacccacgcuggcugcaccuuugaucugcuacgcucucguaggucucugggccucaguuuccucaugugcacccugaaggcugagagaccucccaugaccccuaccaggcaugagcaggucgugggacugagagggcugguccugccggcagcaggagccacgggggucaggguguggcugaacaagaacgagaccucaggccggucccccucccagaggccccgccccacccugcccucugcuuucgccggcucccuaccugacacacuguguccccccauauggcagcuccguggucucgagauggagccuuggggugggagcuguggggacaggaugggagacauggcacuuucagccagugacucugacccucuuuuccugggccucagugucugcaucugugggauggagugugggccucuguggcucguccccaaguggcuuugcagagcacugaagugcuggcggguccuugggugugagagaccccgguggauggcccugggccccugccccugccaaaccacagaaguccugcaccccuuuccuccauagucugggccucacaucagguuuaucugggaaaaauaaaacauggggcucccucuggccuggaccgucagaccucggauguacaccugcccuuguguucaggacaguugggucucagacucaccccauaccugcaaggcagaaccacaggggagccagggagccuccacacugcagcccccaccacccagggcuggaaguggguccccugggcuccugcucugggcagggcacagucccacccucccagguggaggcugcccaccuagcccucuagacagacgcucggccccacucaggcaggcgccccccucucaucucagccucucacagcacccuguuggccgccucuuccuuagccugcucagccuccgugguaggugcugugggugacgaccacagcacccagccuuugaagcuggcccggguccacccagacccuagcaaacugguugcucccucucuggccaucccggggcuugugcccacgucacccagcagcaucuucccugggguugucucacccgcacagaacccagcccuggcccacaccucaccccaagccuauccggcuggaucagcaguggggccgggcgcaugagggaccaggcccgcccggcgcagccuagggugcagaccccuggagugcacggccagguggaccgggccagcucccgccugcugccugugcuuagggccagugguugacguugcuguggcugagucaucuucgugccucucucuggagccauacguuucccugaagcagcucugcuguucagcccuuaucgcgugcugaucuguuugccccucccccaccacuucuaggucuuuccaggccuccagguacccacggugggggagggucuacuucauucuccacagagcacgcugaggggcucuccugcaagaacaccgcaggcugaaggaccagcccugucuccuguggccaccaacagagcugugcgcccuccccgaacccucacucaugcuagggcccccagguccaaccuccuagggagagggguccccaaccuggacucccucaccugcccuagucugccccugggguuggcccugcuccacccagcaccugcucugagggugccagggugccggccugccggccagggccuuccagucuccccaucaaggcuggauggccacuucccacccggggcgggcuccagccucauuccccagcggugcuguccuuccaaggagcucucagaucaccuggcuguccacucguuuggggcuucucugcugccuccgcagcacugcgaggccucugaucaccuacucucugugcugggugcauuucggguucuguccugccuugaccucccugccagcuuugcagggcagccacccuggcacauagcucacugcagaaccagccccugagaagguggaggccacauggcuagccagagggcacgcucuagggcacugcucugaccacagaaugugggugcagauggugucugggaaaauagugguguccccgcuagguuaaagacauggcauaaugguuccugggggaugacaaaaaaacccacccccacccccuugcagaaagcaucacagaggcacaagcccugugcccugcaagccccuccuggaaguggcccagcaggggcauccccugcacacccaggcaaagcccaagcccucugccuccucaaccaccccaggcccugcccaugagccagccuugcugaacucugcccucuguccaguucuccuccagacacaguagacauagcccccagccuuucuugacccuuaacccaaauguccccaagccuggccucaagaagccaaaggcugccgcaaacccaaauauuucagguccgggucccuggugcagacccugccaugcggggauguggcacagaaggccggccagccuggggagcagagaaggaggagaggagagcuccuggcccugagccugaaugccuguggacacauauagggacucccagcacgcacgggauggacuccaaucggcacacaugcacauuccuugcacacacacaggcgcgaccgagggccuugcagacauagggugcacacgugcgugccgccugcauacagcaugcacuugcagagacgguuggcaccuucccuucucuggccccaaaccugggcccugaggcugucugcacaccugggugcuucccaccacugacucucucgucugccuuuguccccgcaggugacgcagcuggaccagaggcuggcacucaucaccgacaugcuucaccagcugcucuccuugcacgguggcagcacccccggcagcggcggcccccccagagagggcggggcccacaucacccagcccugcggcaguggcggcuccgucgacccugagcucuuccugcccagcaacacccugcccaccuacgagcagcugaccgugcccaggaggggccccgaugagggguccugaggaggggauggggcugggggaugggccugagugagaggggaggccaagaguggccccaccuggcccucucugaaggaggccaccuccuaaaaggcccagagagaagagccccacucucagaggccccaauaccccauggaccaugcugucuggcacagccugcacuugggggcucagcaaggccaccucuuccuggccggugugggggccccgucucaggucugaguuguuaccccaagcgcccuggcccccacauggugauguugacaucacuggcauggugguugggacccaguggcagggcacagggccuggcccauguauggccaggaaguagcacaggcugagugcaggcccacccugcuuggcccagggggcuuccugaggggagacagagcaaccccuggaccccagccucaaauccaggacccugccaggcacaggcagggcaggaccagcccacgcugacuacagggccgccggcaauaaaagcccaggagcccauuuggagggccugggccuggcucccucacucucaggaaaugcugacccaugggcaggagacuguggagacugcuccugagcccccagcuuccagcaggagggacagucucaccauuuccccagggcacgugguugaguggggggaacgcccacuucccuggguuagacugccagcucuuccuagcuggagaggagcccugccucuccgccccugagcccacugugcguggggcucccgccuccaaccccucgcccagucccagcagccagccaaacacacagaaggggacugccaccuccccuugccagcugcugagccgcagagaagugacgguuccuacacaggacagggguuccuucugggcauuacaucgcauagaaaucaauaauuuguggugauuuggaucuguguuuuaaugaguuucacagugugauuuugauuauuaauugugcaagcuuuuccuaauaaacguggagaaucacaggcugggcugggcacugcucucaccuugguuccuggggcauccauggggucucucacagacaggaccccugcaguuccccuggaagcagugcccagguggcuguggaauaggaacgcuauguccguguacugaggaguaggucaggguucagaggggcugcaagaugccaucgaaggcucuagcuuagcgacgucgcuccuguucugggcccugggcuggcccuggccaugaagugcagucacaguguggucacugccugucuuccagcagacucuaugcccuugcggcagaugggcucugucugggccucucugucugccccucccaggccaggguggcccuucaucaaggacccacaugcuccacucugggagcaggccccacccaggcccauuccccaggaugccaagggcuaaacucuggagggguuguggugcaaggaaggccuggggccccugaggcucccauaugcucaccccuggccuccuccgggccucuauuuccccauugguaacacgaugcucccuuagccuguccaguucucugagugggacagaggggccaccacccugcucgcccugacccuguuccugcagcuuucugugaggcccgccucuccuaagguggaaagagugccucacucucggcacagacacacucaaccggggcaggugcaucugcugugcccccaccucagcuauuggaccguuucucaguccuucaggacugcagccgccuucuguccucuuuccagagcccaucccgaagucucaggauaugagggcuuggggcaucugagauaucaaggauggggcuguccugaguccacugggggcaggaggcggccagcagcagguggcagggacaggggccccagguuucuguguggaguagggguggaagcccuuguuagagggaaaggcccugggucccaccuggugccaagcccacugggcccgugcccccaacccaugggucuuggcaucuggccuggccagcacugaccgggauggacgagguggaggggcagcacggggcuucccaggcuucccuggccugcaccccuccgggaggagcgggagcagcaguuacugaaaggcaggaacuguuguuuccuuguuggguaaauauuuguggaaacccggggaugccggccggaaagcagggcccuccacagcgcccaggccccccagccccggccgcccaccccgggacccuggcccacagggagcuccguggggccgcccaucugggccgggcgcggccccggcacccagcccgccuuguuguccauauuauggacugcgcacaaagugcccgaggacuccucuccuggacgggccauugcagcccucucgggugugaaaugcaauuuaccugaaauaaagcccaauuauggaauuagcuaauuaaagccauggcggaggcugggccuggccggccgagugcucaaugcccgccggugcccguggacugagggaacagauggcgccucggcccgccgugccggccgcauuccuucacucugucccccgauaagugaccuagacagcacacgaccaucugguguguggcacguccugcgggccccggacaauggcccggcagaccucucugcgagagggccgucgcccgggcaacgguggcaugugcagccccgacccauucacggccccucccgcagccccuuucuucgggcccuuuguggccucaccgcggcugccuggcugcucuggcugaggauagccaugaguguuuguccccagagccggccuuugucuccaaauugggcucccuuauugagguccucgggguccaaugggugccaggagcaucugcugggggugacugggggaggggcugcuccugcuuccuggggcacccaccuccucugccaggcucuccucccccguugccugcccccagauguccccucgugggugcugggcguggccauggggaagcccgucucuagggcuggcacuggccaagcccgagguucucccaucuucgggccagggagccaggaggaggaggagucaagggcggggccgaccugcagccccucagcucccaccccaguccugucugcgaaauggggaacaguaaaagugcccccuagaaggggcguacggggcaggggcuugauggagaugagacaugugagcacacaguaggugcuuaauaaaggaagccaaacaaaccaccugggugggugauacugggcucugccuccuugcugcucuccugccuguugccucggagcuccuuucugaggccccuccugcaucuagccuuaccccaccaagcucccugccccucggugccagggagagcuguccaaacccaagcuggcaguuccccauccugcucucaagccaaccaugacuccccacugcugagugggccugugaggccccacaggcugcaacccugccacucacccugggcaucccccgccaugagcccagcuuccccauccucacccuguacuugacguccagccccccucccuacucaggaccuccucugagcaccaucuuggcaggcagucccccaccagcgugguggucaggagucaggcccaccacugggagaggggcugugcugggccuuugaggccccaaaaaggagccggggcuggcagugccuaguacaagccuggccccagcugggugcucaggaagugccaguuaaauuaaggaauaaaaugaaaaguuggaaggaggcugcccagugcugcaugugcagcagagguaccaggacccaagcagggcaucaccaggcgucccuccaauggacaggagagggguccacacccugcgcccugaaggagggaucaggccagguguuuugaucuggggcagccagacagcugggggaaggagcaggaaggcagacaagagccagggcuccuggggccaccacacacagcacccccaucuccaggggauuugcugagucaccugcagggaugaagacugcccuuucucaacuauaucaagucccuaauuuggagugcccaucugagcugugccaaagccugcuccccccagcaccccagccuccucucagcacagcccuccgggcucuaggacccagggguuccuugcgaaucuuuuuuuuuuuuuuuugagacggagucucacucugucucucaggcuggagugcaguggcacgaucucagcucacugcaagcuccgccucccgccauucuccugccucagccucccgaguagcugggacuacaggcgcccaccaccacgcccggcuaauuuuuuuuuguauuuuuaguagagaugggguuuaaccaugucagccaggauggccucgaucuccugaccucgugauccgcccgccucggccucccaaagcgcugggauuacaggcaugagccaccgcacccggccuccuuggggaucuuaagcgugucucagccucaccauucucggcccccaacugcaccaaccccgcucuugccucuggcccuauucuuguggcccuggagggccagcuaguugggagaucaggccuguggccugugucccagcacccuucaccuuuccuguccccacccaggucagccagggucccaggcagccaggccuggaggaugcuuggggcagccaaagccaaacagagcuucaguuuccacuggccucugagugcagacagccggggccagggcccccuggaagcugacaggucccaccccggcccuucccaacuccacuguggagccuuggugaggaagccuagagggcccucagucgggcagugcaggagggcugggggcugccaccccagcccaaggccuuagaggccaaggccccagccugucccacccaggcacuggcuggguaauaggaggcggggcauccacucugcccucaagauccuucucccucaguagguccugcuaugaccuccuggcccuccucuucagcaccccguaccaggccuccuacaacuccccuccccugcagcccccacagcucaaggcaccugagugaggcagagcguaaaggagauggacagccuggcccagggcagcccugcuggacuccaggagaugcuugggcccgcuccccacucuuccuucuagacccucacccauggcucccagaggggacgaggccgcccuuaauucccagagccaagcccagccccaccgcccaccuauccccaggcuuggguuucgcacacguacaggcagcgagcccgaggcccaggaagacacaagccgggcccagagguggccauggauggcucaguggacagaauccauccuggugccuucuggggccucaaacacacagcuccuuccacuucccgggaguggccccaaggugcaggggugggggugucgagauggaguccagggcuugucacuugggcacagugauccccaccugcaugacccaugacccuggaaaccccccccaccuucuccucuccccacugccggccccuccacaacauuccccgugacaugcuccuuuccagccugcaggacgcauggggucuuucuguggcauugcagcugagcagcaucagggcaggaggugcaggcucugggaaccaggcucacagcuucaucucccuccugggccugcgcccugggaagccgguggcagcggcaaacccacggagaggaguuaacaggugcccgaggacagagaagacucaugcugaggggagagaccccagagcaaaaaggccucagagcucgugaagccccccacccgguacagacagggagaccaaggcugggggaaggccgggccugugcugcgccuguuugugugacuuugcauuggaaaagccucagagaagaaauggggcuuccacagcagagaagguagcucagccaggaagccagagggcaggaaugaacugacuggcugaaagcaagagcuggccuugccagaccuuuggccagagaggccagaucugaggaagagauguucaaaauuccaggguggucugagcacagcuccucugcuggcccacacaggccaagaagccacaaagcacugugccugccugauacagccaagggucaggugggccuucagaacacaccgacuggcuccaagaaggcugcuguugcaccugccacacagaaaaucucaaacuucccaguuagauccucaagaaacucuguuacagccugaccgcaaaugugauucaccaaaccccacugaaugacuuuugguuguuucuuaaccacaucccuccccuggccaaugcugacacacagcuacacacaccugcacacacacacaccuucacacauaccuacacacacaccuacccuacaaaccugcacacacaauacacauacuuacacaccuacaccccuacacacaccuacacauacaccuacacaccuacaccccuacacaccgacaccccuacacaccgacaccccuacacaccgacaccccuacacacacacacaucuacacaccuacaacccuacacacacacacacacacacaucuacacaccuacaccccgacaccgcuacacacacacacauaccuacaacacaagaagugccuccacuguguguguggcacgaggcagugggaaugaaggaaaagcugaagccagaagccagggauccccucauucacagccuggcucagccccucucucaggugcccuggggcaggagccaggcuucucugaguuucagucgcucacugcaaccacagcuccacagaacugaccccaggauccucaguggaagagaagauauugcaaaagccggcgccaacgcaagaccaaacagcaaugacagagcucacugugcucagggagaaccauguacugacguccucuucaguccagcaaccuggagcuuugacacacaaacagccccugagacagaggucuccgcagcaaauccacccacgggacacuucugccaggcagagccugagucagcacaggugaccagagagggaagggccccaaaugccauccaguucucccagaacagccgagggaggucacaaguggcccaggugccauggggaagaguggccccauagcaaggccaggaugccgcuggugucagaagccccccgagcacccagaggggcagaggaucugugggaggagccuucaggugggcacucagggagcacucaccccaacugugcccccagccaccccaagaaggccuggccggaagcaucucugccagggacaaugggagcaaugggcuagagguggacuggccaggcucuggaagaggaggcuccagcugggagaggccacaaccccgggguggggccccuccagggcacuugaggguggaacugugcagccccugaguguugaugggccuggccugggccgaccccagagacuccagcagaggcccagggagcuggaccguagcaucgcccagggaaagggcccguccugggggugggcaggaggcugcuugagaaaggcuucuaaagagggguugucaggaugguggugaaugccauuaaauaauuucaaagggucuuaaucaaauccccucucgguccacgagaucaugucaaaggacucuggagaggaaaagaggggcagacacuucccgugcgucuuccacuugacuggcuggcccugcggcgugggggccugcgggcucucgcuccgccuguaacuccguuuuugaccccagccaagccugucuccucucugggccuccaccucauccuuggggugaacccacacugcccaguucagggagcaggcaccaccucagagggggucugcaagggaaaugucucaucucaccgcuuuaggaggaggccucagcggcaucuccaaaccaucgacgcagcugcugagaaccaccacuuacagaaggggaaauugaggcauagaagagccauaggauggggaggcucuuucacagcuuccagagccugaauuuccugggaacuugggccuggugcuugaccgugcauugccuugguuucucaucuaucaaacaggcugagaccacauccuaccucacaugguuagggugggcugugagccaggcaacgcagcacaugugauaggugcuuccagaauguucuacggugacaucucaagcccacgguccucaaugguccuguugggcuccuucagaauccccccagaugccccacaucaucugcccuggacuuuuuuuuuuuuuagagacagggucucagucuguuacccaggcuggaguacaguggccugaucacagcucacugcagccuugaucuccuaggcucaagugguccucccaccucagccucccaagaaguggggacuacaguacaccaccacgccuggcuaauuuugcuuauuuuuuuguagagacagagucuugcugugucgcccaggcuggucucaaacucuugggcccaagugauccucccaccucggccuuccaaagcacugcagguaugagccaccgcucccagccgccuugggaauuuuuucaaaguauagacacaaaaccuucguauuguguguucccaaaugucccacagccguaggcuggacaaagcagggccauucaccuccacaaaaccuuccuauuguguguucccaaaugucccacagccguaggcuggacaaagcagggccauucacccccgccacagccacacaccucucccaccuggguaguuaaccugcaagugcuaagggcucugaaaccacacagcagcggccugugauccgaauuguucugcagcugucuguccucacccaucugaugcuauggaacccaucuguggagaccuuccuguucuccugaccuucugcaaagaguuucucagacagcugugaccuaacuguguccagccucccuaugcaaauggaaauucacccauucuggguugagcugagauucaaacucacacccagccaccccacaugcacccuaagagccaaaaucacucucccagagcuguucccggccccaucaagcaggugcacgggcaacaguccgggcucagaagcugccuccucucgggcucccaggcccggccacuccucugacaccacuggcuacgaccacuguucuggggcaaagacagccaggugggcauacccagguugggggcuguggauggaacaaaugaaccagugaaagcugggaacacucccaggaagagggcuuugugugcccccagcccuggucucaccccuucccuggcccugggaugaggagagucaccccacagaggccuuccagugcaagugccagccggggccccucaucgacuaccugaugcuaccaugcccccagcugaugggacagagaugaggcccuggaagcucagcccucguccaagggcacccagugaccaaccgcacccgcuggacuucaaacuuggagcucugugccaccaggaagcccccucacccccaccacugaaggagcucgagaaacgccagacuaugcugcuuugggauguagaccaccuggagcugcaggcaggagaggcggccgccaggggcaucggcccagaaggccccucaccuccuccgcugagggcugcccagaggcaaugugggucccaggggacuuuucaucugcaucuggagaccaccgucacucaugcucccucccuggcccucccacgacuggugcagcccccaccccagaagccccagccccuauuccucucugugguugggaggacauauaagcuuaaaucaccuugcccuucucugggugucacgcuuuguggccuucccucguacguacauaaugaaaauuauuucuuuccuucugcuaaucugcucaguuuaacucguggcccaaagaacaagggcggggggcaagacaauuucacucccugcacuaccaggagcaccugugccuccggaggagccagcagagagggccggccccagcccucaucucagcagaagccaggcugcgcuagggagcagagaggccagugggggucaguccccaggccccuggugccacgaacacacuccucccucccucccccauggccccccugccaccauccuugaggugaagcaggcagaacugugucccgaaaacgcuccacagcccccgcguguguccagguggcuucaguuacccggcgccuggcuggcccagccugcagagagcccugccaaggccuggcaccgcugucccgagcggccccucuugccgccagcgagcccaagaggccucagggcacaggcagacugcuuuccccuacgcggacuggccccugcuccccaggaaaaggcuucauugucucccaccccccggccaccgccuggcucaggagacacgggggcuccaagcugcgaggucacccggccuugcagaauccaccugcagccgcaccaguccaggaaaccaaaucccagcggcagaugacagccgaggguggcaggacagagugcccauucagccuccgcuggagccggccuggccugaccuggcggccgccuccccuaccugggcccucuggugccugagcccaggccucacuuagccucugcugaccagagagagggcugggacgugccccacccuggggcacccacaagugugaggauggcuggugaagguggcagagacccugccccacaaccagggccuccugcagcccagagugggcucaagggagucuccaagccaagcauuaacagggaucuccuuugaacuugccaagcauugcugccccaucuuacguaugaggagccugaggcugggaaccaacucaccuuucagcugggugcagccaagcuggagccucgcugacucaggggucccuccucagugagcagauggagaagguggccuggaaagggccccaggcugcacagcagccuguuguagggaagaggagacgggccaaggcauggggacacauggacccauuucacagacaggcagcugagguggcagccucggcagcaagcugacaagaagacaccaggacagcccuugcgugaguugcaucgaagacaggagacccgcccacccuccccuccuuaccauccugcaggaccugagaccaccagccauagcuggucccucaucgccucccccuauccccagcccuggccucugcauuugggcaaaggcuauggaggaagaggcuuuggcuuuuuggcccuggcuucagccaaaucccccaagcaccucguggaggagaauggcugcaccugggagccacgugggcuccauggaggcccuaaagagaccaggccucagccccaggugaggcuuaauacccccucuccaggcagaaaguaaccauuucuuuuccagugguucuccagcuuagggucuccagccagacuggccgcuuaugggccagguguaaagagagggacagagggggcagggaagugcgaguguucucaggccacuggggcccguccccacccacacccagucaucagccccagggacagccaggcccuccgcagugcaggguacaccccgauucugcagccgggccccagggcccagugcuuccuccaggcugccccgggcucccuccugaguggcaggcccaggcccggacucuggccccaacccgcaggcucagaggcagcccugccuuccacagaccaggccacgaguugccugucacucagcucuucugccugguuggucacacugaaaagagcaucccguggcugggaggcauggauaucagcuccaacucggcucaggaagcaagagcuggaaacccaggcgcaggaggcaucuucaggcccggcgcaugcuguggcagcugccccagguccucccaaacgccaccugccaaacuggcccuccuccccaucuggguuuagcaaacuccuacucauccuccaaagcccagagcgaaagggcuccucuuccaugaugcuccucuuccaaaagcagcccagggucuccccuacggcacucagcacccaccgcagacacugucuguguccuugaagcugaucucccugccagacgggcagcggcccucgagggcauugcaaaugggaugccugacaagaacaacccuugaggauuaggaaauaggggucugcuggaagccaaugcaggcuggaucugagaccuccugaagacaaagcgcagggagcugugcucaugcucacacugggcaugggguucacacugucugcugagggcugcuucccuguccuggaggaugggaaggacagaggggaaagaggggcucacccacauccugcucucugcacagugcccccuccagcgccuguccacacagaccagccgcacugcagucccucagaagcccuaggguuccaccccaucuaugcacccucucccuggguucaugccugcuccccugggcccaccccacccaugcgccuacuccccccacagcccacccauccccagaacccuccuugcccacaugccacagcaguauacuuuugaaggcaacacugaagguggggaguuucugaaauccucugugcuuccaucuccucuaugggcgcaccccaagagguugggagagcgaggugcuggugcccagcccagcacagauagaugaggccaccguccagucuacuucguuuuuccagacaucucacacccauaacuggccugaggaaccucauuccagcuuccaaagaacacggagugccaagcaccaccacaccccaggcuccacaccucccagaacccuugugguaggggaaggaggggguuacucugccccauuuaccuaagggaaacuguaaggccuggauggagaagugcccccccuccagcucacacggcuaccaggccagagaccuuugccccaccacacauguuggcccacagaugaggcggugagucauucagccacaucacagacgggagauccccugccccuugggaggagcuggaguccccacaccugggauccagugccaggcuuuagcacggaccccugugugcccacacccacccugucugaacc

SEQ ID NO: 12626 - RNA, 425538 nt, Homo sapiens
gguucagacagggugggugugggcacacagggguccgugcuaaagccuggcacuggaucccagguguggggacuccagcuccucccaaggggcaggggaucucccgucugugauguggcugaaugacucaccgccucaucugugggccaacaugugugguggggcaaaggucucuggccugguagccgugugagcuggagggggggcacuucuccauccaggccuuacaguuucccuuagguaaauggggcagaguaacccccuccuuccccuaccacaaggguucugggagguguggagccuggggugugguggugcuuggcacuccguguucuuuggaagcuggaaugagguuccucaggccaguuaugggugugagaugucuggaaaaacgaaguagacuggacgguggccucaucuaucugugcugggcugggcaccagcaccucgcucucccaaccucuuggggugcgcccauagaggagauggaagcacagaggauuucagaaacuccccaccuucaguguugccuucaaaaguauacugcuguggcaugugggcaaggaggguucuggggaugggugggcuguggggggaguaggcgcauggguggggugggcccaggggagcaggcaugaacccagggagagggugcauagaugggguggaacccuagggcuucugagggacugcagugcggcuggucuguguggacaggcgcuggagggggcacugugcagagagcaggaugugggugagccccucuuuccccucuguccuucccauccuccaggacagggaagcagcccucagcagacagugugaaccccaugcccagugugagcaugagcacagcucccugcgcuuugucuucaggaggucucagauccagccugcauuggcuuccagcagaccccuauuuccuaauccucaaggguuguucuugucaggcaucccauuugcaaugcccucgagggccgcugcccgucuggcagggagaucagcuucaaggacacagacagugucugcggugggugcugagugccguaggggagacccugggcugcuuuuggaagaggagcaucauggaagaggagcccuuucgcucugggcuuuggaggaugaguaggaguuugcuaaacccagauggggaggagggccaguuuggcagguggcguuugggaggaccuggggcagcugccacagcaugcgccgggccugaagaugccuccugcgccuggguuuccagcucuugcuuccugagccgaguuggagcugauauccaugccucccagccacgggaugcucuuuucagugugaccaaccaggcagaagagcugagugacaggcaacucguggccuggucuguggaaggcagggcugccucugagccugcggguuggggccagaguccgggccugggccugccacucaggagggagcccggggcagccuggaggaagcacugggcccuggggcccggcugcagaaucgggguguacccugcacugcggagggccuggcugucccuggggcugaugacuggguguggguggggacgggccccaguggccugagaacacucgcacuucccugcccccucugucccucucuuuacaccuggcccauaagcggccagucuggcuggagacccuaagcuggagaaccacuggaaaagaaaugguuacuuucugccuggagaggggguauuaagccucaccuggggcugaggccuggucucuuuagggccuccauggagcccacguggcucccaggugcagccauucuccuccacgaggugcuugggggauuuggcugaagccagggccaaaaagccaaagccucuuccuccauagccuuugcccaaaugcagaggccagggcuggggauagggggaggcgaugagggaccagcuauggcugguggucucagguccugcaggaugguaaggaggggagggugggcgggucuccugucuucgaugcaacucacgcaagggcuguccuggugucuucuugucagcuugcugccgaggcugccaccucagcugccugucugugaaauggguccauguguccccaugccuuggcccgucuccucuucccuacaacaggcugcugugcagccuggggcccuuuccaggccaccuucuccaucugcucacugaggagggaccccugagucagcgaggcuccagcuuggcugcacccagcugaaaggugaguugguucccagccucaggcuccucauacguaagauggggcagcaaugcuuggcaaguucaaaggagaucccuguuaaugcuuggcuuggagacucccuugagcccacucugggcugcaggaggcccugguuguggggcagggucucugccaccuucaccagccauccucacacuugugggugccccaggguggggcacgucccagcccucucucuggucagcagaggcuaagugaggccugggcucaggcaccagagggcccagguaggggaggcggccgccaggucaggccaggccggcuccagcggaggcugaaugggcacucuguccugccacccucggcugucaucugccgcugggauuugguuuccuggacuggugcggcugcagguggauucugcaaggccgggugaccucgcagcuuggagcccccgugucuccugagccaggcgguggccggggggugggagacaaugaagccuuuuccuggggagcaggggccaguccgcguaggggaaagcagucugccugugcccugaggccucuugggcucgcuggcggcaagaggggccgcucgggacagcggugccaggccuuggcagggcucucugcaggcugggccagccaggcgccggguaacugaagccaccuggacacacgcgggggcuguggagcguuuucgggacacaguucugccugcuucaccucaaggaugguggcaggggggccaugggggagggagggaggaguguguucguggcaccaggggccuggggacugacccccacuggccucucugcucccuagcgcagccuggcuucugcugagaugagggcuggggccggcccucucugcuggcuccuccggaggcacaggugcuccugguagugcagggagugaaauugucuugccccccgcccuuguucuuugggccacgaguuaaacugagcagauuagcagaaggaaagaaauaauuuucauuauguacguacgagggaaggccacaaagcgugacacccagagaagggcaaggugauuuaagcuuauauguccucccaaccacagagaggaauaggggcuggggcuucuggggugggggcugcaccagucgugggagggccagggagggagcaugagugacgguggucuccagaugcagaugaaaaguccccugggacccacauugccucugggcagcccucagcggaggaggugaggggccuucugggccgaugccccuggcggccgccucuccugccugcagcuccagguggucuacaucccaaagcagcauagucuggcguuucucgagcuccuucaguggugggggugagggggcuuccugguggcacagagcuccaaguuugaaguccagcgggugcgguuggucacugggugcccuuggacgagggcugagcuuccagggccucaucucugucccaucagcugggggcaugguagcaucagguagucgaugaggggccccggcuggcacuugcacuggaaggccucuguggggugacucuccucaucccagggccagggaaggggugagaccagggcugggggcacacaaagcccucuuccugggaguguucccagcuuucacugguucauuuguuccauccacagcccccaaccuggguaugcccaccuggcugucuuugccccagaacaguggucguagccaguggugucagaggaguggccgggccugggagcccgagaggaggcagcuucugagcccggacuguugcccgugcaccugcuugauggggccgggaacagcucugggagagugauuuuggcucuuagggugcaugugggguggcugggugugaguuugaaucucagcucaacccagaaugggugaauuuccauuugcauagggaggcuggacacaguuaggucacagcugucugagaaacucuuugcagaaggucaggagaacaggaaggucuccacagauggguuccauagcaucagaugggugaggacagacagcugcagaacaauucggaucacaggccgcugcugugugguuucagagcccuuagcacuugcagguuaacuacccaggugggagagguguguggcuguggcgggggugaauggcccugcuuuguccagccuacggcugugggacauuugggaacacacaauaggaagguuuuguggaggugaauggcccugcuuuguccagccuacggcugugggacauuugggaacacacaauacgaagguuuugugucuauacuuugaaaaaauucccaaggcggcugggagcgguggcucauaccugcagugcuuuggaaggccgaggugggaggaucacuugggcccaagaguuugagaccagccugggcgacacagcaagacucugucucuacaaaaaaauaagcaaaauuagccaggcguggugguguacuguaguccccacuucuugggaggcugaggugggaggaccacuugagccuaggagaucaaggcugcagugagcugugaucaggccacuguacuccagccuggguaacagacugagacccugucucuaaaaaaaaaaaaaguccagggcagaugauguggggcaucuggggggauucugaaggagcccaacaggaccauugaggaccgugggcuugagaugucaccguagaacauucuggaagcaccuaucacaugugcugcguugccuggcucacagcccacccuaaccaugugagguaggauguggucucagccuguuugauagaugagaaaccaaggcaaugcacggucaagcaccaggcccaaguucccaggaaauucaggcucuggaagcugugaaagagccuccccauccuauggcucuucuaugccucaauuuccccuucuguaaguggugguucucagcagcugcgucgaugguuuggagaugccgcugaggccuccuccuaaagcggugagaugagacauuucccuugcagacccccucugagguggugccugcucccugaacugggcaguguggguucaccccaaggaugagguggaggcccagagaggagacaggcuuggcuggggucaaaaacggaguuacaggcggagcgagagcccgcaggcccccacgccgcagggccagccagucaaguggaagacgcacgggaagugucugccccucuuuuccucuccagaguccuuugacaugaucucguggaccgagaggggauuugauuaagacccuuugaaauuauuuaauggcauucaccaccauccugacaaccccucuuuagaagccuuucucaagcagccuccugcccacccccaggacgggcccuuucccugggcgaugcuacgguccagcucccugggccucugcuggagucucuggggucggcccaggccaggcccaucaacacucaggggcugcacaguuccacccucaagugcccuggaggggccccaccccgggguuguggccucucccagcuggagccuccucuuccagagccuggccaguccaccucuagcccauugcucccauugucccuggcagagaugcuuccggccaggccuucuugggguggcugggggcacaguuggggugagugcucccugagugcccaccugaaggcuccucccacagauccucugccccucugggugcucggggggcuucugacaccagcggcauccuggccuugcuauggggccacucuuccccauggcaccugggccacuugugaccucccucggcuguucugggagaacuggauggcauuuggggcccuucccucucuggucaccugugcugacucaggcucugccuggcagaagugucccguggguggauuugcugcggagaccucugucucaggggcuguuugugugucaaagcuccagguugcuggacugaagaggacgucaguacaugguucucccugagcacagugagcucugucauugcuguuuggucuugcguuggcgccggcuuuugcaauaucuucucuuccacugaggauccuggggucaguucuguggagcugugguugcagugagcgacugaaacucagagaagccuggcuccugccccagggcaccugagagaggggcugagccaggcugugaaugaggggaucccuggcuucuggcuucagcuuuuccuucauucccacugccucgugccacacacacaguggaggcacuucuuguguuguagguauguguguguguguagcggugucgggguguagguguguagauguguguguguguguguguguaggguuguagguguguagauguguguguguguaggggugucgguguguaggggugucgguguguaggggugucgguguguagggguguagguguguagguguauguguagguguguguagggguguagguguguaaguauguguauugugugugcagguuuguaggguagguguguguguagguaugugugaaggugugugugugugcagguguguguagcugugugucagcauuggccaggggagggaugugguuaagaaacaaccaaaagucauucagugggguuuggugaaucacauuugcggucaggcuguaacagaguuucuugaggaucuaacugggaaguuugagauuuucuguguggcaggugcaacagcagccuucuuggagccagucgguguguucugaaggcccaccugacccuuggcuguaucaggcaggcacagugcuuuguggcuucuuggccugugugggccagcagaggagcugugcucagaccacccuggaauuuugaacaucucuuccucagaucuggccucucuggccaaaggucuggcaaggccagcucuugcuuucagccagucaguucauuccugcccucuggcuuccuggcugagcuaccuucucugcuguggaagccccauuucuucucugaggcuuuuccaaugcaaagucacacaaacaggcgcagcacaggcccggccuucccccagccuuggucucccugucuguaccggguggggggcuucacgagcucugaggccuuuuugcucuggggucucuccccucagcaugagucuucucuguccucgggcaccuguuaacuccucuccguggguuugccgcugccaccggcuucccagggcgcaggcccaggagggagaugaagcugugagccugguucccagagccugcaccuccugcccugaugcugcucagcugcaaugccacagaaagaccccaugcguccugcaggcuggaaaggagcaugucacggggaauguuguggaggggccggcaguggggagaggagaaggugggggggguuuccagggucaugggucaugcagguggggaucacugugcccaagugacaagcccuggacuccaucucgacacccccaccccugcaccuuggggccacucccgggaaguggaaggagcuguguguuugaggccccagaaggcaccaggauggauucuguccacugagccauccauggccaccucugggcccggcuugugucuuccugggccucgggcucgcugccuguacgugugcgaaacccaagccuggggauaggugggcgguggggcugggcuuggcucugggaauuaagggcggccucguccccucugggagccaugggugagggucuagaaggaagaguggggagcgggcccaagcaucuccuggaguccagcagggcugcccugggccaggcuguccaucuccuuuacgcucugccucacucaggugccuugagcugugggggcugcaggggaggggaguuguaggaggccugguacggggugcugaagaggagggccaggaggucauagcaggaccuacugagggagaaggaucuugagggcagaguggaugccccgccuccuauuacccagccagugccugggugggacaggcuggggccuuggccucuaaggccuugggcugggguggcagcccccagcccuccugcacugcccgacugagggcccucuaggcuuccucaccaaggcuccacaguggaguugggaagggccggggugggaccugucagcuuccagggggcccuggccccggcugucugcacucagaggccaguggaaacugaagcucuguuuggcuuuggcugccccaagcauccuccaggccuggcugccugggacccuggcugaccuggguggggacaggaaaggugaagggugcugggacacaggccacaggccugaucucccaacuagcuggcccuccagggccacaagaauagggccagaggcaagagcgggguuggugcaguugggggccgagaauggugaggcugagacacgcuuaagauccccaaggaggccgggugcgguggcucaugccuguaaucccagcgcuuugggaggccgaggcgggcggaucacgaggucaggagaucgaggccauccuggcugacaugguuaaaccccaucucuacuaaaaauacaaaaaaaaauuagccgggcgugguggugggcgccuguagucccagcuacucgggaggcugaggcaggagaauggcgggaggcggagcuugcagugagcugagaucgugccacugcacuccagccugagagacagagugagacuccgucucaaaaaaaaaaaaaaaagauucgcaaggaaccccuggguccuagagcccggagggcugugcugagaggaggcuggggugcuggggggagcaggcuuuggcacagcucagaugggcacuccaaauuagggacuugauauaguugagaaagggcagucuucaucccugcaggugacucagcaaauccccuggagaugggggugcugugugugguggccccaggagcccuggcucuugucugccuuccugcuccuucccccagcugucuggcugccccagaucaaaacaccuggccugaucccuccuucagggcgcaggguguggaccccucuccuguccauuggagggacgccuggugaugcccugcuuggguccugguaccucugcugcacaugcagcacugggcagccuccuuccaacuuuucauuuuauuccuuaauuuaacuggcacuuccugagcacccagcuggggccaggcuuguacuaggcacugccagccccggcuccuuuuuggggccucaaaggcccagcacagccccucucccaguggugggccugacuccugaccaccacgcuggugggggacugccugccaagauggugcucagaggagguccugaguagggaggggggcuggacgucaaguacagggugaggauggggaagcugggcucauggcgggggaugcccagggugaguggcaggguugcagccuguggggccucacaggcccacucagcaguggggagucaugguuggcuugagagcaggauggggaacugccagcuuggguuuggacagcucucccuggcaccgaggggcagggagcuuggugggguaaggcuagaugcaggaggggccucagaaaggagcuccgaggcaacaggcaggagagcagcaaggaggcagagcccaguaucacccacccaggugguuuguuuggcuuccuuuauuaagcaccuacugugugcucacaugucucaucuccaucaagccccugccccguacgccccuucuagggggcacuuuuacuguuccccauuucgcagacaggacuggggugggagcugaggggcugcaggucggccccgcccuugacuccuccuccuccuggcucccuggcccgaagaugggagaaccucgggcuuggccagugccagcccuagagacgggcuuccccauggccacgcccagcacccacgaggggacaucugggggcaggcaacgggggaggagagccuggcagaggaggugggugccccaggaagcaggagcagccccucccccagucacccccagcagaugcuccuggcacccauuggaccccgaggaccucaauaagggagcccaauuuggagacaaaggccggcucuggggacaaacacucauggcuauccucagccagagcagccaggcagccgcggugaggccacaaagggcccgaagaaaggggcugcgggaggggccgugaaugggucggggcugcacaugccaccguugcccgggcgacggcccucucgcagagaggucugccgggccauuguccggggcccgcaggacgugccacacaccagauggucgugugcugucuaggucacuuaucgggggacagagugaaggaaugcggccggcacggcgggccgaggcgccaucuguucccucaguccacgggcaccggcgggcauugagcacucggccggccaggcccagccuccgccauggcuuuaauuagcuaauuccauaauugggcuuuauuucagguaaauugcauuucacacccgagagggcugcaauggcccguccaggagaggaguccucgggcacuuugugcgcaguccauaauauggacaacaaggcgggcugggugccggggccgcgcccggcccagaugggcggccccacggagcucccugugggccagggucccggggugggcggccggggcuggggggccugggcgcuguggagggcccugcuuuccggccggcauccccggguuuccacaaauauuuacccaacaaggaaacaacaguuccugccuuucaguaacugcugcucccgcuccucccggaggggugcaggccagggaagccugggaagccccgugcugccccuccaccucguccaucccggucagugcuggccaggccagaugccaagacccauggguugggggcacgggcccagugggcuuggcaccaggugggacccagggccuuucccucuaacaagggcuuccaccccuacuccacacagaaaccuggggccccugucccugccaccugcugcuggccgccuccugcccccaguggacucaggacagccccauccuugauaucucagaugccccaagcccucauauccugagacuucgggaugggcucuggaaagaggacagaaggcggcugcaguccugaaggacugagaaacgguccaauagcugaggugggggcacagcagaugcaccugccccgguugagugugucugugccgagagugaggcacucuuuccaccuuaggagaggcgggccucacagaaagcugcaggaacagggucagggcgagcagggugguggccccucugucccacucagagaacuggacaggcuaagggagcaucguguuaccaauggggaaauagaggcccggaggaggccaggggugagcauaugggagccucaggggccccaggccuuccuugcaccacaaccccuccagaguuuagcccuuggcauccuggggaaugggccuggguggggccugcucccagaguggagcauguggguccuugaugaagggccacccuggccugggaggggcagacagagaggcccagacagagcccaucugccgcaagggcauagagucugcuggaagacaggcagugaccacacugugacugcacuucauggccagggccagcccagggcccagaacaggagcgacgucgcuaagcuagagccuucgauggcaucuugcagccccucugaacccugaccuacuccucaguacacggacauagcguuccuauuccacagccaccugggcacugcuuccaggggaacugcagggguccugucugugagagaccccauggaugccccaggaaccaaggugagagcagugcccagcccagccugugauucuccacguuuauuaggaaaagcuugcacaauuaauaaucaaaaucacacugugaaacucauuaaaacacagauccaaaucaccacaaauuauugauuucuaugcgauguaaugcccagaaggaaccccuguccuguguaggaaccgucacuucucugcggcucagcagcuggcaaggggagguggcaguccccuucuguguguuuggcuggcugcugggacugggcgagggguuggaggcgggagccccacgcacagugggcucaggggcggagaggcagggcuccucuccagcuaggaagagcuggcagucuaacccagggaagugggcguuccccccacucaaccacgugcccuggggaaauggugagacugucccuccugcuggaagcugggggcucaggagcagucuccacagucuccugcccaugggucagcauuuccugagagugagggagccaggcccaggcccuccaaaugggcuccugggcuuuuauugccggcggcccuguagucagcgugggcugguccugcccugccugugccuggcaggguccuggauuugaggcugggguccagggguugcucugucuccccucaggaagcccccugggccaagcagggugggccugcacucagccugugcuacuuccuggccauacaugggccaggcccugugcccugccacugggucccaaccaccaugccagugaugucaacaucaccaugugggggccagggcgcuugggguaacaacucagaccugagacggggcccccacaccggccaggaagagguggccuugcugagcccccaagugcaggcugugccagacagcaugguccaugggguauuggggccucugagaguggggcucuucucucugggccuuuuaggagguggccuccuucagagagggccagguggggccacucuuggccuccccucucacucaggcccaucccccagccccauccccuccucaggaccccucaucggggccccuccugggcacggucagcugcucguaggugggcaggguguugcugggcaggaagagcucagggucgacggagccgccacugccgcagggcugggugaugugggccccgcccucucugggggggccgccgcugccgggggugcugccaccgugcaaggagagcagcuggugaagcaugucggugaugagugccagccucugguccagcugcgucaccugcggggacaaaggcagacgagagagucaguggugggaagcacccaggugugcagacagccucagggcccagguuuggggccagagaagggaaggugccaaccgucucugcaagugcaugcuguaugcaggcggcacgcacgugugcacccuaugucugcaaggcccucggucgcgccugugugugugcaaggaaugugcaugugugccgauuggaguccaucccgugcgugcugggagucccuauauguguccacaggcauucaggcucagggccaggagcucuccucuccuccuucucugcuccccaggcuggccggccuucugugccacauccccgcauggcagggucugcaccagggacccggaccugaaauauuuggguuugcggcagccuuuggcuucuugaggccaggcuuggggacauuuggguuaagggucaagaaaggcugggggcuaugucuacugugucuggaggagaacuggacagagggcagaguucagcaaggcuggcucaugggcagggccuggggugguugaggaggcagagggcuugggcuuugccugggugugcaggggaugccccugcugggccacuuccaggaggggcuugcagggcacagggcuugugccucugugaugcuuucugcaaggggguggggguggguuuuuuugucaucccccaggaaccauuaugccaugucuuuaaccuagcggggacaccacuauuuucccagacaccaucugcacccacauucuguggucagagcagugcccuagagcgugcccucuggcuagccauguggccuccaccuucucaggggcugguucugcagugagcuaugugccaggguggcugcccugcaaagcuggcagggaggucaaggcaggacagaacccgaaaugcacccagcacagagaguaggugaucagaggccucgcagugcugcggaggcagcagagaagccccaaacgaguggacagccaggugaucugagagcuccuuggaaggacagcaccgcuggggaaugaggcuggagcccgccccgggugggaaguggccauccagccuugauggggagacuggaaggcccuggccggcaggccggcacccuggcacccucagagcaggugcuggguggagcagggccaaccccaggggcagacuagggcaggugagggaguccagguuggggaccccucucccuaggagguuggaccugggggcccuagcaugagugaggguucggggagggcgcacagcucuguugguggccacaggagacagggcugguccuucagccugcgguguucuugcaggagagccccucagcgugcucuguggagaaugaaguagacccucccccaccguggguaccuggaggccuggaaagaccuagaaguggugggggaggggcaaacagaucagcacgcgauaagggcugaacagcagagcugcuucagggaaacguauggcuccagagagaggcacgaagaugacucagccacagcaacgucaaccacuggcccuaagcacaggcagcaggcgggagcuggcccgguccaccuggccgugcacuccaggggucugcacccuaggcugcgccgggcgggccuggucccucaugcgcccggccccacugcugauccagccggauaggcuuggggugaggugugggccagggcuggguucugugcgggugagacaaccccagggaagaugcugcugggugacgugggcacaagccccgggauggccagagagggagcaaccaguuugcuagggucuggguggacccgggccagcuucaaaggcugggugcuguggucgucacccacagcaccuaccacggaggcugagcaggcuaaggaagaggcggccaacagggugcugugagaggcugagaugagaggggggcgccugccugaguggggccgagcgucugucuagagggcuaggugggcagccuccaccugggagggugggacugugcccugcccagagcaggagcccaggggacccacuuccagcccuggguggugggggcugcaguguggaggcucccuggcuccccugugguucugccuugcagguauggggugagucugagacccaacuguccugaacacaagggcagguguacauccgaggucugacgguccaggccagagggagccccauguuuuauuuuucccagauaaaccugaugugaggcccagacuauggaggaaaggggugcaggacuucugugguuuggcaggggcaggggcccagggccauccaccggggucucucacacccaaggacccgccagcacuucagugcucugcaaagccacuuggggacgagccacagaggcccacacuccaucccacagaugcagacacugaggcccaggaaaagagggucagagucacuggcugaaagugccaugucucccauccuguccccacagcucccaccccaaggcuccaucucgagaccacggagcugccauauggggggacacagugugucagguagggagccggcgaaagcagagggcaggguggggcggggccucugggagggggaccggccugaggucucguucuuguucagccacacccugacccccguggcuccugcugccggcaggaccagcccucucagucccacgaccugcucaugccugguaggggucaugggaggucucucagccuucagggugcacaugaggaaacugaggcccagagaccuacgagagcguagcagaucaaaggugcagccagcgugggucuuugagggcaaagccugggcuuguguccuagggcucaccucagcucccugggccccgcauacugguaguguggaacgagguuugccccgcguggcuuacugucacuaacugugcaggccccagcuuggguaucaauugguuuggcauuaauuaaagcaccaaauacaucacagaugaacauuugugguuucauaaauuuucacauuauggcacucgaacaucuguccaagucccacaugugcuaauggguguggaggccuucacaggggauucuugggacagaaagagacagugggugucagggccgcaggcaggcagugcaggcugaggguguggcuggaaucagcgcucaguccugagccacuuuggugacagcuccucccggcagggagucccggcaccguguagagaggcacucagccaccuuuggggucgggaggcagccacagggccgagcuugccuccgacggacacugaagggcucccugaagcugccugggccagcgucagcccaugccuggcucuggcuggucccaggcucaccucaacugcugccugugccaacuggggcuuugagggacuggcuagggucucuggccccagagacaugcucucaucaucccagcugcuggugacagaggccccgggggugggccaggaugugggcuggaugcccagggcggguccacagucugaugcaucaugcugcugccccccuugugggaagggcccaggccugggcuacagguggcuccucggcagccccagagucuuagcucugacucaagcacuugucacagcacgugucccugaagagucccaccccaccacucugcgggcagggcgccuucaucucgcuggcacguuugguuuuuuuuggcgauggaggagccugagaagcaccucccauggccgaggccagaccccacccaugcggaggugcauccgggcaggugccaucggggagcugccgcccugggggaaggcagugcaugcucuaggcacuggggccgguuccccaagaacugcugggacagaucaauuuuggggaucucagccuccaccauuauuugcaauuugauagugauuaaaaggcaaggcagacaaaagcugcuuugugcccggccugcacucaccaaauuaauaaccauaagagaccuaugcagcccucggaagagaaaaaagcaauuagaauaacagcuaguuagagagccccgggcggccggcgaucaaacccaaggcaacggggauuccuguuugaugugguuaugaauuuguuuucaaaagaaaaucuugaaaaagagucuuucaagggaaauuuuugcagaaccugcccggccuugauccccgccuaggaccgccaaaggcccuggccucguggauggcagacuggccagggacaggcgggagaggccgggcacacccgcugcucccaggguggggguccuguucucugccugggcugcaguuccccaggaggcagaaaacucacugccccuucuagcauccuuguugggcagugucuaaagaccaggcagggccuccccagggcccucuguagggucgcagggcaaaggucaccuuggccuuccuccugucuguccugaggaaccagcaguuacuaagccacucucagggcgguaccuagaauguuucauaccaggcucugagcaaucggaugucagacccggcuccuguguggagcugggcacaaguggcaauaggucacagcacgugguaaggucgcgguucguggcagggcauggagcgauuguguuugacuuugcuuuagugcuucaguucuuggacaaaagucgaccguguuucucgcugcugagguuuuaccgccaggccuuggggcagcugcccugcuggagcuugcugugcuguggccagugggagauggccucagaaccccccacacugcugcagggccuugggcacaaagcaccuccucacgggagcgugcaggcaggcgugugugugccgcagcgggucuggggucagauccugccucugccgcuuccuggccgggugaccuugggcaagucacuuugcuucucugaaccucaguuucccugccuauaaaacagggcagcuguagcaccuuccccaggaggaugcugaggggaucaaguggacugaggcaugaagacaccagggacagagcauggugcucagugcacugcgagccacccgauggccaugaucauuagggauuccuagagugcacguacaguugcacauguaugccuguggccugaggccaaaggagcacugcugugcacacgggaggcaugcuaggugagcccacauauguguaccucguacgaaccuguggcuguaugagugugggagacugugcgugcaagaaggcaggaaccacccugcacccuuguacacacuuguacaauucccuucacuuuccauuagguuguucucugggcugcccaaggguuggagugcaccugccugcacccccaggccccugggccuuugugugugccacagaggugagcacccccugcaacccaucacaggaguugggggugcugcugggacaaagcugcguggagagcaagcagcaacucccauggcuugggugcuugggcagguaccaggcguccucuccuaauggggagacagauggcacugagucugggacccauggucacacacauaccagcugcucccccugucccccagagcccuucacccgggcaguguccaggcugugugugagucuuggcccagagagucgagcgucguggcagccccugugcucaggcucgggacuggcgccugugguggggcugaauuggcaggcacugagggugaguguguccgcucagaggcugcagaccaaauccucaaccuugucucugucccuggugucuguugucugccgagcagccagaggaagcucugccgcggcuggggacccacaccgcucauggucgguuauguccucagcggguccucggcacagcgcaaccaugcggcagaggccuggucagcuccaccccaacacccuuccuggggcugccgcugccuggcuggcccucacugaccaccccccaggagcgggguugccucccucugagagaggcccaagauggugaaagaaagacccuucccccugcugcugacauccacuuuuaccagccucugcccacugacggaugcuuggccccccaagggccucaggggcgccaugucccuggcugacgacugugggggaauaucucaagaucgucaccacacgacccucguucccuuccugggaccucggcuagcuaggauguccccgucagcuacuugcucucuccaggggcuccaaggccugcaggccaacagccccacagcucagcgugucccagcgggagcucagauuccucccaagccggcccgaauccuguauccacagggcacgaccaacuacccagggucccuggugugcaccuggugucuguggcucucuggucuggagcaugugcucugagccugccccccaugccccuugcccaggcuggcagcaucuucugccuggacugucacaaccaccucacugccuggcuaugcccccaaccuguuccccgcuuguuccaggcaacagccaggcugagccuucccucccagccugggccaaauccuucugcagaauucccacuggacugggaguaaaauccagucuccuuuugcagugcccccagaggcuccgcuggccccucuccggcacugagcaugcccguguugaucugagcgcccaucucaguugggcccuggggccuuugcacccgcuguccucugcugcuuuguaaccuuagcucaaaauccugggcggccuccucgucucaucucuccccauguuccuguaagccuucaccacucccugaaaugucccgguuuauugaucuccuugcuugguguuuugccaccagcuggaggcccagcucuaggccaggcagucaccaucuuaacccuagacagucucccagagccuggagccuggagccuagaaggugcccaguaaauacauggaggguagaguuggcgcugcacaaauguuuguugaauuaguaagugaggccccggccaauuucccggggccccaaggcuggagugaggggguagaagccccccaagcccacucccucccagggugggugcugagcagagaagcugaggcugggacugggccuuuucacguucauugauuuguaaggacucuauguuaagaaagaugucaaguacacaucacacauguuuuucccuagugugcuauuugucucguguauggguuuauggcauuuauuauuuuuuuguuuugccacacagaggucuuacuuauguuuucacuuuuucacguggucaaagccauccaucuuuuccuuuaugccuucucauccugugcgugcuuggaagggccuccuccauuccaacgccaaaaucuuuuuuccuaauacuuuuuugauuuguguuuuacccccuaaaucuuugaaucgccugggauugauuucugaccuacagacuuacuuuugcagguuauccugcugauaccccaccacuuauggaaugauggaccuuuuccccacuggauuagaauguccuuuuuguguaucaucgacccugaacaacccaaguuugagccgugugggugcacuucuacguggauuuucuuccuccucugucacccgagacaguaagagccaccccuccuccuccccagcugacucaacgugaagaugacgaggaugaagaccuuuacaaugaucugcuuaugcugaaugaauaucuuuucucuuccuuacuuuacuuuauuguaauacaugaagcauacaaaauguguuaauugauuguuuauguuauugguagggccuccagucaacaggaggcuauuagugaaguuucuggggagucaaaaguuauacauggguuuuugacugggcaguucgggggucggugccccaacccugcauuguucaagggucgacggcacaaaguuccugcacgucuuccuguacuuuggcgucuacgcagaacugcccuagagaccgcucuuguacaugcuuugauacugggagccagggcccugcugucuggaggugaaagacgacaggcucguucuggcauccagucggggaguggcgacgggagcuggaacccacaccucucccaggugaccucauaaccuccccucuugucugucucccuggucggagaggucgcgcucgucugcuaagaacccggagaaggccucuucuuuguacucugagcaaacaacaaaguccgcaccacggcugugggggcugagggaucccagccccugcugccuucccucccccagcuggcuccagccaccagagccucccuuccucuuccucucggcccgcacgccuuccuggauucucccucggcucagcccucaccucgucauagcccccagggggucuaugugugccgugucugcugacaugagccggugccacauggccccgugcuccuggacacgcagccaccucccucccugcaucuggguuggggcugacguuugugccagagccagagcugucacauccacagccucacagaccugcagaggcugcuccgugcggacauucaugucaacuucaggguggggacagaggucauggagggagucaguggcagagccaggggggcccacguggcacaacacucccuggguggcacuggagccccuuugcccucuucccuuggaaggggccugggcaggaggcccaggugcacccagaggccagggagcugccucacugccaggcaggugggaggggguggggaagccccaggcugggauggggucucgagccucccccaagggcuggccuaucccuagcccggccucaggagcuuccugccggcagacgccaggcaggggcggcucuguccaagagcccgaggcagcugcccaccugcccaccugcccaccugcccaccuagugcaaccccgggcagggcucgucccaucggccucuguuugggggccaggcgggcaggaacgucgggcaggcugggggcccaggagccguguuugugcuggcggugggcacaggccccaccugcauuugauucucugccgcugccuccugagcugcccccucuggcgagcccgcagaggcccggaggccaggggacaccaggcagaacacuuuguucgggcagccagcgagcgcucugcugccucagccaaaccccagcccggccacgggggcaggugggcaggggaagccagggcugccuggccguucucgugucauugcuccaggucugcccacaucggcccugcugcccccacauccuccccuacccugggcccucagccacuugcugggccaucuggaaccucugagcgcaccagccccuaggaccccagcaauaccccucgcuguccccggaaguccacaagcagaccuuagauacuuccucucgccucccuuccccagcccagcaggguggccccauaccacuggaagucagaccccugucagucauaggcucuaacccucaguggcuccggaucaaugccagaguccgcucacaacccuguggucuggcccagcccccaucccuggccucacucugcagccugcuucccggcgcgccggucccuggcccccagccccaagccugcuuccuucuuucugcaugccguuucacacuccuccaggugccugacgggcauguggauaguuuggcaccugucccccgacccugccaguggcugugagccacgugaggucagucuggcuuccuuccauccccaccucugucugccuggucccuacuggugguguuugcuucucagaaguagguccccuuccugaaacugcccuuggcgugcagcagguauacccuaaauauuccugaauuugggacgggacguuucugggcuggcuuccucagucugucccacguugccaccauuuuucucuaagacagaggccucuggggcccaugacccccucuccuuccugcagacagagaaagcaccggcaccugcugaucucccacaccacaauguccacuugcugggcgagaaccuuugaggcaucccugcuguucucgagauaccagccucggcugagggucccucgccgccggccccuguggcccccugggcgccgcccuucucgccccagagccgguuuccucugguuccuaccucaggacccucacaugggcuggcccugccuccuggagcauccaccccucuccuuagccuccagacccuucucauucuccaggccccaggugagggucuccuuggugaggcccccucccuucccccuccugguuuggcuguggccacuuccccugcuuuccaucccccaccucugucugcccgguuccugcugguggugugugcuucuuagaggccgccuccccgagggcagggcacugcacagccaacaacaguucaauggccucuugcucgcugggagacccugggccuuggucaccucucgagcagggaggggccggggagucuguucuguggcacagugcagccugggggcucaggcccgggcgugucugggaacggaggcugugagcgcggagcgggcucuccugggccccaggccacucccugggccugaagggaggggcucaggggaaggaugaggccccucguccccagcucccugggcaccacugagaggccucuggccaccuccgucccucaacauuggccacgcccacagccugcuguguucugucuccacccaggccucuccccgggcgcucuuggcugucccugcuggcucaagacgguguccucucucuggacacucgagaggcugcccagggugcucccaaacacgcacaccaugugagccucuuccuccgcccuacgugccccauccugcccauccccaggagagggcugccaugccccgugcccccagcccacgggcucucugcggcuggggugcuugucuuccugaacccuuucugugaacgccucacauguuugcuucaaaauuagucuguguacaggguuuuucaugguauaaguacccuaugaagacguucucccgccaaauaaagacauuucaaagacacaucuccauuucaccugccccauuucccucuagggccccugccugccagguaaccagcuuagggaucugauguuucuccuuccagcaacuuugauacgcagcucgugccugguucugccuggucagcgagguuuagcacgagugaggcgaggcgugaugugacacacauguggcucuccacugcuuguuuccaugcgacacacuuguggaggcugcacguagaaucacggggacagugcuggcuccugggacggcugugcagcccuccuuucuguggggauugcugacaucaccacccagucccugcuggugggcguggaggcugagggcuccacaggccaagucuuucugccuacaugugcugguguucggggggagggguccccucuucuggggagcuugguggcagcagccaggcugugcucucccaccuccuccccuuggagugcaguccggccucacccucuaccuccugggugaaaacuucuaccuccggccugaaacgucaccaugccuccccacagacagacggauggacagaugggccucccugcaccugcucugugggugugggggcuccugcucagcagcaguuuccagacccuucucccugcuuuccccaagccacccgccuugaaucuggggugcucuaccagacccauccccucauuucuaaagauuugagccacuagucgugucccucucccucagaaaugccuuggugacacuuggcugcuuucaacucuuccacccaucugccucuuggucucaucuuuaccuucugcuaaagguccugacccccacccccgccacgccacggggcaccccaugguggugcguccuugggagcagcucugucccuuuccccguggccuuugccccgccuccuaugacuucgauucccaccuguccccgaccccugggaccacugaccgggcccgaucacccugucacugcccugucaucugcuuaccccacacggugcucugcugacccaggucuugcugucucccaacagccccacgaggcuucccgucgcuccuggacacugcaggcugagcccgcugccccgccgccuccaugaggaaggcuuuuccucugugagccccaggccacccuuucccuccuuuaaguaauuacuuaagucccuugccagggcccucccaguacccuuucuaaagacaccccugccccagcaugcugcaggcuccugcuccacuuuccucucaggcccucgucgcuguggugcugccuuuguuuucugucucugccacggcagggggucagcuccuuggagguggggcuucugcccuugcuguaccacugccuggcacacaguaggugcucaauaaagacuugcagggugagcugccugaagaauagucaccagaggccagaaaugucuagagcucugccgguagggugacuggccgaggagccuggccugcaugugugcgugugugugugugugugugugugugugugugagucaggguuuauaugcaggugucuacaggagacaugcuggguucugugcugggugugaggaauaugggagcagaaccccagggagguggcagagacuugggggccaaagggcuggggugcaggggggcaacagccaggugccacuggccaccccagccgcagggagcccugcccacccuccaggugccuggauguccaaccucacugcuauucccaccucaagccaggccuggagauggaggccccaugacucagccagggccgguuugcagcugcggcugacccagacgggcgggcagcccccagcccccgggccugcacccaggacagggccgcccucccucccucccccgcuucuggcuccuaggacaggauucucugaauucagcuccccugaggcuggggccagguuggaggccaggccugggggcccugggcuggggucccagauaggggcugggcggccaggcuuggaaucuggaauccagccccauuccuggcaucugcaggagccucguggggagggagacuugggauggacuucaaccagccagggcuggauucuugccccggaaccugcauuccuggggcagccaagggauccuucccacuucugggcccagcuuggcccugccuggcauucgaggcccaucuggggcuugggggugucuccccaacucucagacauaaggacacccuuccaagcuuguuccuucaccuggcggggcccugagccccacaccccuccccuguccuuucuccauccgacaucaagcgccucccugccucugcucgcacagucucugagauggggaacucagcaccucacaggugggcccagcucuggugcugucuguguugggggagcuggggcagcccccaaaagaccuuggagacagacccucagaggcaggagcagaggcuggcaguggaugcugugccuggaggccuugagggcgaggugugaugaugaggcccaggcugcagggcucuuucuggcucuccagcuccggagaacaagggauuuccuccugcucugcccacccuccccagccagugcaugcucagccucagcaccgcaccugggcgcccuccaugaucugccccaccuggacacauggcucgaggggcacacuaccaugccauacaccaugucacgcaccuugccacuccacaugcuacacaacccagccccagccccagccaugccaugugccacaccaugugccacaccacucccaccaugccaccaccaugccaugcacacagccacgccaggcacagcaggcgcugagcccauccugcacgaaugcagcaguguguguguguaaggggaccuaagccucugcccauguccucccgggagccagccccuggcugcacuccuuguggcuaagugggguucugcugccccccagccccugcugacagccugggaagggggugaggaggugggggagcaggcugggagggcaggaaguugcuggggcuccagccccaucuggacauauuuggcaagccccgcuccccgccgcuccucagccugucggaacggccccuggcgcuggugcuggacacucuggccuucccccagcugccugucccaccuuccccacuguugucucggucccgucucggggcacuugccccaguuccugcugcugggcccaguggacugcacggucacagccaggugcaaacaugggaccugguguuugcucaccucucugaaccuccauuuugccucugcaagacaggggcugcaaauggagugaagcggggaagccugcccaccccaggaacccagccucuugccucccagugacacgguugcuggcggggcagcaguggggaugcucggggaccccugcccuugaggcuggcucccagguccacgugccuggggcugacuuggggccugacagcugcgcccaggugcccacccuaaggcugagacucccucacaucuaugcagucuucacagaggucccaaggggcucugggauccuaugaggggagaagcuuggagagggguggggcaugugggcagguggggggaggacucggcuccagggcacuggcccggcuuggcugcccugacucugccauuguguccagaaguccacaggccucccgucccucagggaagcaagaaggggcuauguccucugcccuggcgcgugggccccuugcgugcaggggcuuccacagggccucuaauugccucgacuccagaggcacacaggcaccccuacccagcauguucucccacacccacagccuccuagcugugggauaaccauggacgaugcugccaaccucuuauccccuggucuggugggcaguccuugggcaccagccugcccugagcagggaacagcagcugcauugcccacaucugucucccacugggaggaggcuaguguccaggucacucugggggagaggggagggaccaggucaaagugggagaguggagugaagcccccugagcugggcauggcuucugccccauggagcccuggccaggcccuguggaccacggcgguggcagccaccuuccccacacccuacaguugucaccuggggcagccccagccagaccauggucuccuccugccuuggggagcaucagccccagccuugccuuucaccccacagcugggccgcucagugaugccaucagcaaccuucuccacacaggcccuaccgggagcuacagagggaacaugcuccggggaggcgggcagaccugaggagggcuuccugcugcaacuguggucucccaggcagcagggugcuuggcgcuuugccugcacuggcucuccugacccugccaaggcccugggcaugggcggggacugcgucccaucucccugaucuugcaguaggggaaggugaguuguggagucgcagagcccgucugagcgagcagcuuguggguauccugguuccucuugcuccccaugacccugugcggucggagcucugacggccccacucccaggaggggacacaggcacccuguccuagucucccagcccggaagcccccacccugccaggucccgcacaggcaucugagccuucaagucccucaucuaguucagcccucugguaccuccauuugcagggccagguccaaggcuucucuaacgcugcccaucugccaagaugccgggcaacccccacugugccugaggggccaggccuucccucaggggugcugggaaaggguaggguggggaccgggcugguguguguccuggggacaaugaagcuaucaccugucaggaaggcuggggguagucuaggcaguugucccagguccuaagccugaggcccagcuguccaccugcagggcugccuggagguggaggucugccugggccucaggccaccccccuggagcagaggcuccugguacacgggcagggccuccuuuccagcuuccuaccaggggcauguccagcucaggccacugcaagaccaugugccaggggcugagucaggcauaucccauggacccuggacaggugagacucuugaggcucagagaagugaaaucacugggggucauggaguggccacuuccucgcuguaccuagccuuccagggcucuggugggggagggaggagggggcaacggagagaggcagaggagggcagcggggaggggaggggagggcagcggggagaagggugcuggaggaaggaggggagcagugguggggaaggggaaaggggaggaggggcaauguggaaggaagcgggggagagaggagcggaggggacacuaugguuguggccauccaggacaucaagaggaaacugacugaagucuagagaaggaucaggaauagaucugggccuaaggguggugguucagggcacagaguaccagagggacccagagaccuggagagcuucuugugucuccacagucagggagggcuuccuggaggcagaagcaccuucgacagccccacaguguuccaggccuacaaggcauucaccccuucucuccccuguucauggguuauuuccagccgccacugguccaagcacccccugaugguguagggcaggccgggccacauacuucuucucauggcccaacugugggcacaggcacccaucacgucugcugaggugccuccucagggacauccugcccugcacccgauggccaucccuguagcagcugcugcugaucacagagcaccugucauucugagaacaucccauugaucgccgccuuuggcuucacagccauacugggaagcaggcagggcugcccucugcaugccagaggccagaaaauggggcgcagagagcaugggcagcuucccucagggggcccauugggcgggugcugggguggggcugagcacccagaccagcugccucucaucaucaccacuucccuguccugccuugacaagaccugcacggggucucccaaggguacccuugcgguuucaaagacucccuggucagcuccuaacccugcauuuuccugacaggaaagcugaggccuagagagggguugggccagccugugcuggguuaccugaugauggggagaggggaaggcccagguguguggcucuguggccagggugcuggagggcacacacguggggugcccuugggaggucagaggucugagggccacggagauguggggguuccugggaaggcccacaaugcucggaaggugaguggaagggugggaaggucuccacccaggaaggagguccugggcuggcccccagccugccuggcccaggcugacccugugaguugaugagagauucaggccccauccugcagcucccagcccgcccuuccugcucccggggcuggaggaagagguucuugggacacugggacugggguguggggauacaugcugacuagacugggugugguuugcaggccauugggaggaccuagguccuuuaacaggggacuuaacagggacuuagaucccggggccuuggagaucaucuaagauaucauucaggucauagcucugggaugccugcccagggaagagcccagaucccucugucaacccuugcuaaagguggggaggaggcacccaccagugaguccucuucucucacuggccuuauccugcacagccccagccccagcuagucagagggcuccugcguagcacccagccaguccugagccugugcccacgguguaaagggccugcuggucuuuccccuucaccacacaccugcuguucccagccaggguggcaugcacccaccuuccccucucagagcuccuuggccaaucucuuccuucucucucuuccucccuccucccuccuccuuccuccucccuccuccuuccuccuccuuccuccuccuuccuccucccucuuccuuccuccucccuccuccuuccuucucauccuccucccccucccccucccccuccccaccaggguauuggcagaauucccuauucucuggcaccaucacuuccuucuuaaauuuucuuacccuuagugagaaaacccgugaagcucucccaucuuuaaacagccuucccugggcgcuagaucuucuaucucuaauuucuguucccagaggcagcccuucaacccuaccgacuaucucuuggcuuuaccuuggcauuuccaaacuacacauuuacauugcuguuccuugaaauuuugucacuuuagacauuaucuagugacugccuaacauggaagagaagugaucaagauuuuguucucaugccccugcccuccccacucccuuaucuuuccaacacaguuaaauuagaauucuaggcuaaauaaguacuuacuguuugcauuuuacacaaacaguauauaacucuuuaugucacuauguaaucacuguuuuuagcuguguccuguggucuguuaugauuacaucuucuuguuuucccuuggguuacaaauggccuuagguuuugcuuguuuuuuacugcaucugucacuaauucauucuugaacuuucuguaagaauuguaaaacuucuuucauccuauugagaauacuggcagucuaucaccuucauuuuuuuuuucuucugggauuucuuccuggagucuuagcaggacuguuugcacuguaggcaugcugagcagcuguaaugcuagaacuucuuucacucauguugaaaauucucuuggccuuuuguuuuugguguuggagucucccugguucuugaauuguguuucucuuucuuuguuuuuuccucucauuuugcuagagcacguccucaaguaacuuucugagaaaaggcaugugguagauacaauuuuugacugugcauguuuggaaaugucuuuauucuauucucauaccugagaguuugacuagguauagaauucuggaugggaaaucauuuuuucccucagauguuugaaggcauuucucuacuaugugcuagcuuucugaauugcuguuaagaaauuggauaccguuuugauuuucuauucucuugugugugacuuacuuuuucucucuggaaauguggagugucugcuuuauugcugguguucugaaaacaauggugugccccaccgggcauucugggaguugaugagggaagugggggaggaggucuuccuuuuuagcuugaaugcauuuacugaaucccuguuguuuucaucacgagagcuccugccccacccacaacugcuccugguggcuccaaguucagaaccucucaggcucagcuuuucuggagacucaaccugucucuagcugagcuugagaaucaguagcaucuggcuucaugggcuggggugagaccugccugucaggguccuggguugggaacugccucauucuugguggcucuucuuccugcagggcuuggugucuacccucuccagucuccuaggccagucuccaucuguccuccugcuucccagcuuccaaaccuuugucaacauauuuuuggucuccucuuuucuccugaccacuuuacccuaguugauuuacauguuuccauguuuuucaugccuuuacugucaccuuagugggauucaaagaagcugaaauagacauguguuuacccaucacguuuaaccagugcuuucagcucuggcaccugcugcuccggucaccaaaccuuccagcagcccccugacgacaccaucuccuguccugacuucucagaguuuucuucuugggugcuagucccugccugcugagguccuccagcucccaggagccauguucccaugggugccuuucugcacguggcugccuccucugagucccggcuguggccccuucccugcuggcuccuguguggugcugccagccuuuguccugcccucgccccuuugcagguaguguucccucuguugcuggccuccccacauucgagcuuucaagaccucuaugugcccgguggugccuggcuuggacucagggccaacaccaccauaggguucccggccccugaccucaccacuuccaugucucagaggcaucuugaauucgacacaccccaaacaaagcucucgcugccuucugcccgccccuuccucuucauuccggaaaacaguaccaccacauaccugcuacuuacacccuggccugagccgcugaaguguacccccauuuccucccucaagcgcccaacuccuaucugaguccuucuggucuggccuccaagccacauguggaauuuucccucuggcaaaacagccacuugucuccauagccgcucucccccgcccccccgaccccacuuuuuuuuuuuaaucaacagaacccugaauuaagcugaguguuugccugccuggaauagagacuccguccccaggggcccuugcagcgacucaggcgugcgucacauuccggcggguggacagaaagggggaugacgugggccgcuucuguguaggguuuuacaggaguggggccuguccuucaugucuuuuaccucccuccugcugcuggaaugcagaugugauggugaaugcaggagcagccgcuggggaccauaggacagaagcacuggauuguggacaggaaagcaagcagagagaggaggucuggggccaggcugauucaccaggcacacaucagcccugaagcuucugcuacucugggacccugcggguggcaaaguucucucuuauuugggcuguccccagggucacugucucagcagcagcugaaccaagaaccuccccuucucccaccugcccugacucuggucccuuaucuccuaccugggggacagcaacacgaggugacugugccuggccuccucucugcagcccagccuguuccccucccggcucugugacaucuaagcacaucaccucugagcuucaggcugaagcccuccuguggcuugugagugacugaaaaugacuccaaacuccuuagaggacugcuccgaugucaccuccuuggagauguccccuuccccaccuacuccacggcucaugggccaccugccuggcuuucuuccucccuguccuugucacuccaggaccagacaccccacacccagugguuuacaggcugcuggccugugugucucucuggcugugagcauauggggaagugguuagugugucuccccagcacccagcauggcuccaagcacauagugggauucugaguggaggcagggcaggggccccaagacgaggggugcccaggggagccccgugccucucuggcccucugcaccccucucuguucucccucugggagcacaguggugggcugggugugcugggccagcccucuugugccacagccaauccagggcauuucuacccugugggugcccagcugcaggucugcuggggaggccuucggggaagcagcagcaggagggggcgggggaaagugcucccacaccggccuggcgcacccaacgccgggucugccugaguuuccgugacugucugcgcggaaccgcacggcgguuuccaucagcgcugccaagaggcggcugcugggccuggccgcggguucugacccccagcuggccugguuacugccaggagacccugggaagcuggggaauacuggagcccgaaggguuaaccugcccuccccgcccccaaccccggcucaauuucuucauuuuucaaaggccgggcccucuuuccuuccaagucacagcugacgugaaauguagccuuaaaaugcagcugacaugaaaaacaauagcacucccucggagagguucugcugcgggcuggacagcccccgccccccaauaauuacucaagacauuggcaugagccaggccugguuagguaacaggcugcuugcuguggaggcuuauaacucacaggcaguuacacauaaucucugcagacaacaaaaucguuuccaggauggcggggaggacgaggccucggggagaggguacuggggcaggaggggcugagaccaugccaauggggacaggaucugaggaaggggcuccggguggcccuggggagccagcuugucaauguggggaggugguaaagugucuguggaaagggguugcccugccucucucuuuacuccaaacuccacccuugccccagucccuggcguggaggccgcgcugguccaguccguuacugagcaaaguacccggagacucauucauacugaagugugaaugacugacugcuuugggagagcugcccccgcgcagcuccgcgaaggauaauuaauugucuguuuauuguucauggccccacuguacugacuuccucaugggcagguccacauacuuuccccuguguucccagagucuaguacauagcagacauucagaaaauauuuguugaagacgacgacaucuaacccaaagaaggaagcguccagggugugauuccaggcacaugggcggggccccuggcagcaagggcuggacgacuggagggacacuggccaguagagggcuggggcgccccuacccccccgcguggugcuugcucuuccagcacccggggccccuggcaccuucccacaggaaacgcccauuucccuggaaggacacugagcugagcaggcugagggcucggaaggucugggcugcgggccucccuuggccucccauuggucugggucugcacccuggcggccuggcugcagagcccacccugccaggaacuggcuuccugggcuaugaaggcacacgcccgacagcagggucggggaagccgggccccagccccagucccgccgcagggaaacggcaccucccauguucucuggacucucuuuccaccgugacccugucucugcgcaugggacagccguguccaggcugaggcccagcacacugcgccuccugcaccagccacaugugcagaccaaugucugagcucggagcuggcccacaaucccuggcccaggccccaucguacagcuuccauccacacccggccuccccuguccaaacgccccuguccuugcccagucacugaggccccagaacucacugggaaccugcucugugcccggcaggggaacucgugucccugaucaguguacccuccggugccaggggcaggauggaugcggcacggcacugagacaggccaaguacagaauucuauggcucugugguguggaacccaggggacguuccuuccucaaagcugucccgggggccucuaggaugcccaagcuccugacugucuucuucccgccacccccagcugcuuccuguacugcaaggcccuguucaccccuugaguggccccauucucacucucuccucucccugcaaucucuugccaggcaaccucauccacaccccuucuucagguaccaccuccauguugcagccucuguuuucagcuccaaucucccugcugagccuugcagccuaaacugccgggcaaacaccuccacguggacaccucagaaccuuucaggcccugcguguccuccucccugcuccugucuggaugaaucguuucagccuccaacauauggccaagccagaaccugggggucuuuccugaagacuccccuccuucaccaccauauccagcucguccccaagucuggggauugugucuccaaauccccucucguaucugucuucuuuccaccccugggccuagccucccuccucccagggccucugcguagccuccucacccaccuccccucuacucuggccccuccauggacagccucacacuucagccaggggguggcucuugcuggaagaguuaguuauccaugugcaugcaugugucuggguguguuugugugaaugugugugucgaauaugggugugugugacggugugugucaagguguuugugcuguggaaagggcaggccugcuauaugauggauaagcacaagccuccaggccuuagugugcaugcccagcuccacucccgggaagcccaucacugguccucuuaucagcuuuuggugacaugcuggccacaugguuucucgacuugucaaucuuagcuacuagaaucuuccuuguaugaaggugaggcuuaagcucucaccccacccucggcuuuguccacccucuaacuguccagcacagcuuccccauuguuuugaugaaaucuaugcccacugccugggucccccacagagccaggggguauacugugcucacauuuccuuucuggguucuccugcuucucugcucucuucucuaacaacaccucccucagggagauccuccgcuguuuuggaagcuccguugcagauuuucuucccagucccaccuauuuucucuuccuggguggccucuucaggaguauccuguccucugcuccugccugggcugccugggcuggaggccuguagcccugagccagcugcugggcuuggaccucccuguucugucuguguagggucuucugccuccuuguuguuggugccuuccuuuucccugguuuccucccacguuuugcuggagugcauucuccagaaccuucuaagaaaagggauagaaagcaaauucuauacuuuuuuccugcagugacuuggaaaaauuuuauaaguucuugaguaucugaaaaugucuuuacuguauccucacccuugauagauacuuuggcuagguauagaauuuuauuuuccuucacaauuuugaaggcaucucucuucauaaauuuucucuaccaaagacugaucuguucagaggcccauguuuggaaaaucaccuguuacuucuuugagaagauucuagaauguugucuuuaucucugcuguuccugaagggcaugaugacacaguggcugcucuuuucugcuagagguucucagugggcccuuucuuuagucucuauuuccucucaucucccuuucuggaacuuccaauagcaggauauuggauguccuuggauugagucugcauguuucuuggguguucugauuuucugucuuucagucuucauuccacuuucagggagauuuacuuccaucuuuuacugauuuuuuuuuuuuuaauucagcagcauaauugacauuuccaagcacucuuucugcuucucuaauuguuucuuuuucacaauguccuacucuggccuaugccaccguucugaauuucagaucuuacaauggugagauuuguucauugcucccuugccucacauccuuuggggcucccccuguucugagcugagccccugccaaggacuccaccuucccucccuaacuuucuccuuuggcccguguucagcccucuccauccucucagacccacagaccaggccuauuccuuccugccuuggggccuuggcccaugacuaucccaccucuccacuuaguuaagcuaauuuccacccauccuuugggguucggcucacagggagcuuccuugggacaccucugcuaauacccuagguaggcucacaacuuauuauguagccuuuagcucucuuuacgcacuuagcacaguucuaacuaaacacuugcauucugccauaauggccuaauaucuguccccauuuccccaccuccaccuccuagagggacaucccuaggaggguaggguccaguccaucuuauccacacuauaccccagggccuggcgcugugcuggugcuugugucagcauccugcacuguggugccauguuaccacaagcauagcgcaacacgugugugacaucuugcagcacuggaggucaggagucucaccgggcuaacaaggugucagcagggcugauaccugcuggaggcucuagggcugauucauuccucaccuucuccgguuuucuagaagcugccugcguuccugggcuguggccccuccuccgucuucaaagccagcagcacagcaccuucagccucucugagcucugcuuccaucccccugucuucuccgcugacugacccuccugccucccucuuagaaggacccuugugaucacauucggggccccuggauaacccaggaucaucuccccaucucuggauccuucacuuagucacccugcaaaguccacucugccaugaagggacagggauagaaugaggacaucacuggggccaugacacgacuacagagcucacacacacuugcuggggugggggugugcagagcagggauguggcugcagaggagggcaacaggaguggcuuggaagaugcacccuuuaaggaaccccuauaggaccaguacauagcagccaggaaaagguggggagaugucaugggcacagggaacaaggugagcagagggcaggaccucaaauggcugggaggguuuccagcagaagggcagcacgcaaggcccaucccaaaggccuuggaagccacugugaacaguccagaauuaccacguggggaaggggacaccauggguaacuguguggggucaguggggcucugcccucaugaggcuuuuuaccagccacuucccaauggccucccacuccaucugagcccauccaucuggcccucauggguccccagacucccucagccagagcaaugauucaggacacacaauggcccuguggcuccacuugaaacuucucgagaaaguguguguggcuggcgugaccccaugggcaccauucucaccauauuccccaacccuugccaggcccacggccaccuucccauccucucgcuugcagugcuccugccccacgcggggccucugcaccuggagucacacagcugagaggcgaggaaacgggacucgcacagagcaccaggcuucgguguccgcccucugacacccguguugcuacagcaccagccaggggccaccgaacacuugacagacccaccccacccugcagggacgaaagcuucccaccaaggcagcagagcaggccggaccuggccuccgaagagugcugauguccuuagagggagguucaggcagcugcaaaagcaaggcagguuaaggaaccccucgcuuagaugggccuagaaacagccccagagauggccgaggcccagcacgggccaggggagggugagcagcaauggaggugggguguaggcacuccccuugacagcucugucagggagaagaaaguaugggaugaaggaagagccaggggauguggaggacauggcuuccagcagcuuccagaggggcucuagcaggagggaagggaggcggaagccacgcagacucaaacccucaauggagaccauuuccccagacguaaggagaggacacaugugcccaggcuuuaagggcccagaggauggggcaggaaaaacaaaugaacaaaaccaacacaucaagaaauccacaauauuauuggccauccuagugccugucucucagaaacugacaaaccacagugggugaaacuaacaaacaaacaaacaaacaaacaaacagcaagguaagucaggagguggaggagucgcagaacuccacuaacaaguuuaacacaauuaacagaaaagacuccaccgccuccacacauauacaaaaaggucacagaaaugauccuauuaggcaccaaaggaaaacuccauaaauuucuaaaaaucuguaccuugauguaaaauagaaaauuauuaauaaaaauagcaacagauggauacaucuugaaguuuaaaaaguacccuucuaaauaacucuuugauuaaagagaaaauaaggcagagagaaaaucuuaggauggauuuacaaggagcugauuacaugccaagagugugggaugcuuccuauaggguauuuggagaaguaucgauggcaauuuuagaaaauaaaaaagauugaaaauaaaugugcuaagcuuucaacucaagaagcuagaaaaagaacaccaaaacaaauacaaagaaaagaaugaacaaagucaaaggaagauauuagcaaaauagaaaaauauuuuaugaaaaagaauugaccaauaaaaccaaaugcagguuguuugaagagccaguaaaguagauaaaccuuaagcaaauaaaguaacaaauaagaauuaggaaugaauacuacugcuaccgagggaauugaauaauuguaagugauuaugauauauacuuucauaucaauaaaauugaaaacacaauaugauggauaaguuucaaggcaaaaaauaccaaaaguggcuuaugugguagaaaauccuaagaaacauaaacccauuggggagacacaaaugccaguuaccuacccuccucuaaaagguuuccagucuaguuuuugggggugauuucuauaauuaccuaaaaaagcagacgacauccaucccauccaucccagagcacuagccaaaaggggagguugcucaacuuaucugacaagguaaaaccccaggcaccauaacugcucaagcaaacacaagaaaauucuaggcccaaaucagguaugaacacagaugcuaaaaccuaaaaaugcaucagcagcuggacuugagucaagaucacauaagguuuaccucaggaauucaaggaagguucaaugucaggaaggcucucggcaccugguguuuggacccugcuguuucagguguguuuucaacuggacuucuacccucauguaugggcugacacguguuggaugucucccauucccaaauccccagcuugcccaggggagggugggcugggccucauaaaagccuugcccacuccucacuuaaacucugguuugucuuccucuccugcuccuuccucagcacaugggcaggcauagagcacacaaugcucugucauugucuguccuccuagugggccacagcccuugggaggagggacuuuggcugucuggccuaccacugaugccuggagcauagggaugcuuggcaaauacuuguugaaugaaugaaugaaugaaugaaccaaugaacaaaggccaggugaggguacucccuaauccuguagggcagaaucucccuggagaauguccagcuggucuuuucaaaggggcuggagaggacuagcuccuuucaggcuggagcugggagcaggauguggguccuguggggcuggguaaugcuggagggugggaugaaccucuugugccaccugccuuccaagaggcauguggcccacucuccuagaugugauucugcugggccuggggguugggggaagagcagcuaagcugagcugucuccuggcaguuguggagacaccuguuggggaguguguggugggggcugugcuggcagcugagcacaaggcuagccugggcagggggaaaggccugggucaucagacuaggguaggggcugggggcucugggcagcuggugcuaaggacccaacaggugggcccgguuagggaccagcagcugggcugguagggaacaacuggagacagggugggccgcauuccgggggcuuccagccuccaagcugugugcguguggggaugggggguguaaggcaucugguggagagggguuucuaggccccucaccccggguggcaaaguccugugacagcucccaucaucuggcucaugccagaggcaccuacccuugcucuuccucugaggaaggccucuuggcacuuucugaggaccucugaaccaccuuaggaugcacacucugugggggccuuagccacaccugggacgguggcuccaggaacacgggcugcagccuguguacaugcucaagccagggcuuggggugugacuuugcagaaagggaagcuguguacccacaggagugggugacaagggcacaaggacgccauuccugacccccacacucuugggucaccugacacugaggggaagagcagacaagacccuuuccuagggcucggaaguuggggcacgcgcucccacucugagggccagcagacacuggguuuagauguuguggaacucagggugcaggguggcuggccauguguuuuucagacaauccugccacuuuuuugccaggauaguggguuuuagguguuaaugcauauucuuuaaugauaaaagagaaaaauauuuuguagauagaguuugggaauaguuggguuauacgaaguuaguuuuuuucacugcaggccuucucagggcuuuuaaaaugcaaauguggagcauuugcgcaaagcugguaggugcuggcuggggaggggagagugccagagguuucuaacauacaugugacucuggauucaggaucucuccuuggaauuuaaguugcagcccaaggggauaucaugucucuuugagucuaauguaucaccuuugccauggaggagaggaggugggucguaaguggguaggccccugugagaagggggccucggcucaggucugugcuaacaguccccagacccgggguagcucucaccaccucugugauggcccugaguuaaugcccagggcucugcccagcguccuccaccucccuggccagggacaucaucugaagccgucaucucagguaccaugaaccaaaauuggggaaccuguucuuucacaggguacaugcugcucaggaucugaaaugccccagcagguccuucccugacugcugggguggcugccacgacuggggucagcuucauccuaaggguaucagugucugcacaaggcugggggucagggggcacuggugugauucuccuccuggggugcaacagggguucaagguagcgcucagaaacuggcugaagccacggaaagggccgccguggguucuguccaacguaguuaaaaacaucugacugcaaccacaaaaaugcuggcauccgagccugcugcaaaaacauuuucaugucaaaggcaagcgcacuggugccgugaggagcuugcaccguuaacccuugaaaggagcgugcgcagaguuggccuguggagcagagccgggugcaggcuggcgccacaggccugggucaugggucgggcauguggacuagggugaggguggguucccucugucuccuggggucaggagugccacugggcucuguugcccugagaccucccuguugaccucaagcccugacacccucugcggacagggaccaagguuuuggaggggaccuccagaggcagaggggcagccacugcccagggguugggcuguggucacagacauguauuugugcauuugaggagcccugaacagacaccugugucuguucagggcucagacaucagauggagaugucugaaauggagggggcaggggcucagggaaggccuccugagcaggggacuuuggaaagcaugagcugggaggagcguucagugcagggaguccagccagggcagugggccugaggcgggagugagccagaauguuccaggagcagcaagugcauuucucccuuaaugaaacaucaugguuagcccuugagucaaaggguccuauagcccccuuucugcugccuccagccccucaucauaugugguguggcuucaccacaggguggcuguuugcucccucuggaugacaggcagucagaguccagcuuuucaccacuccuggacagcgaugacgcacaacccagaagccauucucagucccaaggguguuacugcuccagggcggauucucagaaggagaucacuggaccacagggugaguguggucucacuuucagcagccugaccauuuucacaaaaggcucuugaaauucucccccacggcgcuggaggccccucuccccaacaucgucaccagcacugagcuugacuccacuuuuuagucuuggccaacuugcccuucaagucucccucccacaaccugaaucuuuauccacuucacucgccuguuugucuuuuccacacugcagcaggaacucucugguggccacugacccuucaaccacaaugccauggugaguuucccaggaugggcagaggcgugugaggucuugccccuggcuacuguccucuuccucagggacuucuugaucucccaagccccggccgccagccguccacauucaucuaacggagcccucacccaggacugugcgcacacuuggacuccccagagcccugcccgccugcaagggaacauauccagcuggcuggucccccaaguccccuccacccugacaggugugcggcgacucagcggugcuuaauuuuucggcacaggcagcuguuagauacagccuggagacccccugagcaacuugccuugggugaggguguggccucagagccuggagcucuggggaggccagcaggaagggcugggggcagcuccacccaguaccuccagggcccccauccuacucccgugucugcucccacccucuccugaauagucuccagccucuuccaauugccccucugccugcauagggagggacuggggucagccuggggcugggggcgauggugccugccccccugcaacucuacugucaggcauccugggugccucaucuuucuugggcuuggcaacuacaacaggacacccuguccccacucucaaaggcucugggauggggcacuggaguggcgauccugagcugagaucagguguuuggaucuacaggaggugggcucccaggaccuccuccgaccccacagggccaggagagggucccccgaacucagaacuacccugugggccucagcauagcuucuuagaacccagaggugcccaugagcucccugacaagccccccaccagaaagcacagagguccaguggggucccugcuguggcacccauaagaccuaugugggcucuaguggggaguguggaugcugugguggcagccuagacacccccaaggccccuagagaauaaaggcugcccagguucaagcugugaccuggccaccccagacuugggacccucagugacacccugagcauggggguaauuuggggagggauugguacugaccacauaaggcuguugagagcacaggaagcacccagcauggugcucagcacgcagcaggugccuggaugaugguugcuaggacaacuccugcccacagugcaugaggccgggaugaggaaagcugugugugcagagcaggccucagaagggcauagcgcuggggccgucugcacaggugcuuucucuccagaucccaggccaggcuccagaggcagcugggucagccugaccaggaagcuccaacaguacccucugaugagcauggaagaguccagagucaagaccuaggccuugguaggacagcagacuggucugcccagcaggcagaggcagauggagcaggaggggaugccagccucgaggacuuggaggcacauguauuucuaagggagacacccuugcuugaggugcuuuagcuacucauccaagccugcuugcucccucucccucccucccuuaccuccacccuuccuuccuuccuuccuuccuuccuuccuuccuugucuccuuccauccaucuacccauccaccuauccaucauuucucaaucuacccauccaccuauccaucauuucuccaucagcucacccacccagccgucucuuuauccagccuucccuucccuccaucuccccauccauccauucauucaccacucauccauccauccacccacccaucucuucauuuccccauccauccauccacccacccaccauccuuuuauucagcucuccuucccuccauuuaucuauccaccucuuuauccauucauccaucucuccacccacccacacacccaucgauccauccauccaucuauccauccauccauccauccaucccaccauccauccauccuuuauucagcccuccuucccucuaucucugcauuuauccauccaccucuauccauucaugcaucucuccaucuacccccccacucaaccaucuauccauccauucacccaccuacccauucauccauccauuauccacccaucccuuuauucaucccuccuucccuccaucucuccauucauccauccaccucuuuaaccauucauccaucucuccauccacauacccacacacccauccauccaucauccauccauccauccauuucuuuauucagcccuccuucccuccaucucucuauucauccuuucaccucuuuauccauucaucuaucucuucauccaucuaaccauccauccaucaaccauccuuccacgcaucccuuucugcaacccucccucccugcagcuccccguccaucuaccuacucauccgccacucacucacacucauuaaugcuccccacaccccaggccuaugugcccgcccucauucuuuccacaagcagugagcagcugccuccuguguaucuugcggcaacaagaucaaaaggcacugaugacgcagucacuggccuccggagugacagcccaccaccgacuaaaaauagaccaggaucagccgagauguugguccuccccucuguuccuucucucauccuuugagucccugcccccucgacagaggacauacuccauguggcugaauggcuccagaucaaggaggggaccauagagacaggggcuggagguguugucaggacuuggugaccaggcgcaggguugaggaagggggagagucaugaaaagauggcgggggaggggcauuugcucuaagcacugacgggcaggcggguuugggggugaaaaagaggugcaggucuccaccccugugagaguggggagcccagguucccugaauggaggugcaugaggacacagggcagaugcccuugaaugagcccugggcaucagagggccugcuggcauccugaggccaucagugaccuccauaagcuacuccaggcaccuuggggcugggauggaacucccuccagcucugccagccccucaguuugacaggugacucauggugccaagaggaagacagggcucacagucugucggguucuuccucuguaccaggcuccguucuaggcacaggguucucacaggagagauggugcuggccagcucugucuucucagagcuucuguuccagcuggagagccaggccacagccuccaggcacaggcacaggcuggggcaguaaugagggauuggaggcuggggcagagaccugaggccaugagggggcagcuuugcagccaggagagggcaggugccaacagcagacuucagaugguuugagggcuggccauggcacaaccccagggugccacucacacaggcacagaggccuugaggcggaagcccccaggaggcuggguggagucaggaaggggauguugcaagggcaggcauggggccccgggggcguggggccucgggggcguggggcccacggccauggaagggugccuggauugcuuccuagggaagagggaggccauggggggcuugagcaggcagugcuguggucugguuuauguuuuaaagucccucuggcugcugcauggagacaggaauguagggggagagagaaagccgggagccccuggggacggggcuggcccuccucuccgggaaggagcucugccuucauacaugcuguucccgccucccggaaaugcccuuccggccccggcagaggcugcaguaggaagaucaggggccacagagccggccgggcaggcugugaugcaaaugugucccccaucauuuucaacuggagcccccgagcacugccagggugggggagggaacggaacccuccucggcgucccaggucucagggaggaaggagagaaggaagcagagagggagggaaggagggaagggggaaagaaggaaggagagagaaggagggaggggaggacuuugaggagggacucaggcuuuucauguaugugaguugacacauuuccuucuuagacaaguuucagggguguuucuguuccuugaaacagaaaguuuguguggggaccagccgucugggagugcauggccaaagcuggggucugggggucagugcagggagcaugggugccugggaggcuuccugaggaggcggcggcuuagagaaccaugagggcugggcugagggguggccggcggugccaggaggacaggaacgagaggcggcacagccgguggggcugcgugccagggcguggggucugccuggggcagggccugagcaugccccugugaggacugucccacugucauccugcggcgggcacucgggagcucaggaaacuguagaacgggaauguguugcucacugagcaccguuuuccaggcuugagccugcaggaagccuggcuuucgccggccccuccucuuugguggucuccacccaucccagccaccguugcucagcucccaggcccacugcugcaccgucucccacgcagccccccacacugaccuccuccagccaggggucugcugacccuugugcugcgcgcccacugggacauccccauccugaaugugcagcccuagaccgcagcccagaaggaggacgaucacagaagguggcugccagccacccugacgcucggcaagggccccgccugggcuugucagaccaagcagggcccuguguucaccuucuguccccucaugcggccuuuagggcagugaaccucaagaaggucuccagcggcacagacacaggcacagccucaugcgugcaggcccauggacuuggcagccauugcucaagugacccagacacuggcucaggagaacguucugcugccuucacaaagcacugauaaggguggaggagcuguguuugcagagaugauuccccaccccaggaggucacaggcuaggaccaguugcgauaagggaaaucuggguuguaacagggacaaugagccagggaagccggacaggggucguggggacggauucccaccaggggcuuccugggggaggcuccauuuggauugggguagcuguacaggggugugacaggcuccagacaggacacggcacugcggaggugcacagccugagggugaagggacgcuaggguccacgcccacccgggucucgccggggcuguaagggugccaagacugggcgggggugagucuaagccaucugcugcucugaaugccaugcugggaaggcgggaguccuuguggaggcacacaucaggcccacagcaccaagacgaugggaaggggcugagcaugagguccauguccugucccucugccacagcagagcguccuacaggugggacucccggcugccagcccuguaccucgagcccaagcucucagaugcagcagccucagagcucuaacauaugggguuccucaguguaaugacaggcaccucccccagucauugucaacacauccuaaaugccagcaggcccauccaugcacagaucccgagcaaacauugaaaaacauucagaacaugagagagaggggccuggcuggccaaacauaaacagaagaucaaggaauuaagcagaacuuaagauauaagauguaucuggagucuccagaaagauccuaggagcugucgugcccaucaaaugagggcggaaugccaugaccacggucagagagcaagcgugugcucugggauauuaaaaacaggacugcuaaaaacauuuccuagaacucugaagagauaaaguuaagaauauaaugccauaaaaaaggggaagaaaguugagacaucaaagugucauuaaaaaugucuucagucugacuuaaaaggaauuucagaaagagagaacagagaugguggccuccaugaugagaaaucauacagagaccuuuccagagcucaaggacuaaaguuuccaaagagcccaccaagugcccagaacagucaaugaacaaagccauccacagggaacuucucugggaaauugaaaccccugaguccagaugguagauacuaaacauuuccaggaagaaaagaaaggccacuuacaaaaguaugagacuaaagcaaguauaagacuucugaauaguaagucuggaugcuagaaaaccauaggacgaggucuucaaaauucugaaggaaaauuacauucagcuccaaauucuauacccacuuaaacuaucaauagggcaccaugguugaaugaagauauuuucaccauguaagaacuuugaaugcuuaccuuccacacaguucuuaucaguaaggccccugaggcuuccccagaaaacugaagaaaugagcauuaagcaggucugaguaccagggaacaguaaacccaaucuaggauggccagaaaaaaggucaguugcagaauuaugcaaggaaggaggguuugggaggaaaacacaucaauuagagacagagagggaagagcucagggaaacauggcuagaaccaaaggggauuugagagaagggcucuggccuggaguguugagcacgugguggagaugauaaaggccaacagugcacaggaggauagcagggaagcaggcaugagccguggggcccucuggagucagcgaccgaggcagaaacccaaccagucaggagaugaguccaacuggaaacgaagaacugagaagaggugucuguggugagaggacuauggggagucuguugccaccuucauacacagcaccaagacgaacaaacagagggaagcagagcccccaagcugugcacaaguaucacaaaccuggaccaaugccacgguaacaacaacccauaaaugaacacgugcugcaccaggaggcugcgggggcgggguugcagcgucgcuggcuaccacacaaagcugagagaagaccgcaaaaacccacgaugaguccagcgucccacauuuuauuuuccuuaaccugaaagugacauuuagaaaugaauuucucuuuuggugaagaaacauuuaucugaauucagcaauuccuucuguuuuacuuugguuucuucuuaaaaaaagaaaaaaaucaacaauucaaaagcugcaggcaucccuugauuccauauuuauauuugcuucugauggugugucugucugucugcccacucauucaucuacucacucacacauccauugucuggccacccaccuacccacccaccuacccaccccuccauccauccauuccuccauuccuccauuuauccaucccuccuucccucccucccuccaucucugcaucuauuucucugucucuccaugcauccauauauccauccauccuuccaucuguccacccaucuauucacccaucuacccacccauuguccauguguucauccauccauccauuuaucccuccccuaauccuccauacaacaaucuguccauccauuaaucugcccauguaucuaaccauccuuuuucuaugcaacauacagagaagcgucuggaaugcugcucuccucacacuaaggauggguauuucuaggauaacaagggguauccuagggaaagggggcauggucaugaagguauuuaccuuucauuucagaccuuucuguacuguuggaauuuucuagaaauucaaauagaaccaagauuaucaaucaaucaaucacucaaucaaccaaccuaccugaggacucccauuuaaaaaauuaaugauaguucucuguggagauauuaugguccucuuuuguuuucuucucugcucaguucugcaucagagccuauuaauagcaacucugaaugcuauuuucaaaugccccucccucggaggucuucccugaccaccccuguuccucuccggcacagugcccugcuuugcuccugcacaguaauuuuccuggucuguaauuacaugguauauuuuugaccgggguagcucugugaugccaggaccgaguucuagcccauccccguaacaccuccauuaucuuccacugggauaucgcaggggcuuggugggugcugggggagggcuggaaggcgggccagccuggauggguucacccucaaugcccugggcagauggcaucagaucuuggucuggugcuuggcagugggcagggaaaauaagcccacagggugcccaaguggugcccacagugguguccaugagaggggcgggaagcagccgccuucacuugccacgugccgggcacugggccaggugcucaguggggagggcuccagguaccaccggcccugcccccagagagaccguuccugucucauccuuacagauguggaaaccgaggcuccaggaggcugugcaaggugcccaaacuuggccuucucuaccgcugcuucccucaugcugcagccagggcuugucaggggcagccucaaguuggugaccggauugggggccaggaggcauggugggcagggaagguggccacuggaguaucgugaugggggaaagaggcagagagaggucggaagaggccgguaggugggaggaagucagggaggagagugcgggaaaggcaggcagcucggguggguggggaggaggcugagggaaggggggcccuggagggggugggggugccccucgcccgccugugcccaccgccggcuguccuggcgcggguugcggaggcacugggcgggaaggccugguaggcugggcccgaggagggcccggcccgggaguguuccgaggagggauuuauuagugaaacaaaagcauauuuuucagcaggacuguuuguucaguuaccucaugacaucgcgcuggccccgggcccggagugggggggcgaggaggcccagugcagcgaccgcgggcggcacagucccgcucuccauggaggguccccucccggccuuaucuggucccggacaucaaagcgggggcuuuucauaagcgaauuaaaauagcacacaaacagcacagggcugggaagaccccgggccaauuagcuuccagcagaauaggaggccuuucagagccggccacguucgaggcgucgcugcggcuugucaggcucgaugaaauauuuugcccaaagcucauuauaauaaugaaccugcauuucuuuccucaagagaauaauuagcagacuuccaaacgggcuaaagcagccauuuaaacacugccccuucaucgucccauuuacuucauucugugacaaggaaacacuggcgccuuccgaaagagccgagacucccagcacccucccugcacggucacagacuguggggccugcagagaggggcuacgccccagccccagggaccccgcccaaccugucaccccuccccaugcccccgcuggugcugucccgguggugccgucccucucgggcuggccugagaguggagaagcagaggccuuugugugucaccggagccagcacgcaagccaggcuuuuacugucucugggggcacgcuauucucucagggcacaagagaggggcggggaggggucaggugggggccacccucaagggaaaccugagcccgaacguacucccgggcaguggucugguacagcugagccucugaugaugcccacggagagaaugaauggggaucccccaggacagguggaagauggagcugggggcugagcagguuagagaaggguuaccugcagccuccucggaaagcagacacggcccagcugcucgguggggagcacagacagguuaccuggugccuagccacuggcacaaccgggguaaggaagaggcaagccugcguuacacagcccaaggcgggucgccuacccucccacauggcuggcaccacagacaaggaagccaggcuucacugggcacaguggcccauguggccccaggcaggcugggaaggacagacaaauuacggaggggcuagcguccucagcagggaaguccccuugcugccucccugcguaccucccucccuuccucucucccuccccucucuucuuccucacuccacauugauuguuuacucuuuuucuguuauggagguaagaaccacuuacgggagaaauuuugaaaaauaugaaaaaaucuguuucaaaaacauaucucuaaguccacccuccagagacacguuuccgggcauuuucuguaaggugauguuuugggcaccaccucccaccccagaaacugggaccauguuugucuccaguaaccuuguacauggggcauuuuccugggucacugagggaugacugaaagcugcauaauugucccuaaugugcauaacaagaaccaacaucccgcaaaugcugcacaugcggucuguuuccaauuucucacuauuauaaauaaggcugugauuagcuuguuugugcauaacucugauuuguucuuuagggagagaauccuggaaggaggauuaugaggucaaggggggaggaauguuuuuuaauccccgugauacgugucaucagagcgauuucuggagcagggaaccggcucauacuuccauuucuccucggcuuccccagcacggaagaccacacaauuagguucauuucugcaucuugcgucucuucacugaaacucuuagagcaagggcuagcacgcuuuucucuaaagggccagagaguaaaucguucuggcuucguuggucacacgaucucuguuacaacgacucaacucugccaaggugguguaagguuagccagggacgauguguccaccggugggcguggcuaugugcuauuaaaacuuuauuuacaaaaacaggcagcggggccagaugaggccccaaguccaccuuacaggaugagugcagugaggaccuucagauccuuuuguaaauugucuuucuaguucuuugccugcuuuccuacugcggggcgagugcuuuucucauagauuugaguuuucacuugcaaaaugucgucccucuccgucgucggcugcaguuuucuccccagcuugcugucugguagcagcuuugggcaggcagggaggggcccugugcagcugcagccuuugcucuccccagccaggcuggagcugggggaaaggcucugugaccuggguccccagcggccugugaaccaccccugcgucuucuagagacaaagcccuugcuuccggcucucagccucaucuccacgucuggcucagccugacccgcugacacaccagagggcuuguccggcagcugcccaugggcagaaacucaggcccgggauggccagacacucuuccugguuuuguuuucaaacugcuucauuuuuaccccgggggccucauugccuguggaacucugccgucccugucagcauuguaucugacuguggugcugccucucccugaccacauguguugucacauguuccggugaccugagccagguggccugggacaaaucccagcuggcaacugugggcccgugccucagucuccucauacacaaaaugggaugaacagcagcaucaguuucaugguggggacacauauuuccagcagcuccagacgcugggugugggcgcaggggaaggccuuggugucgccuccgucugcaaggcucauccugugccaagggccaggagaguguggagaaugguggcugcagcuucacgcugggcagugcaaccccacucguuagcuuuugccuuuagaaauaucagcuauuuucaccucuuuaugcuucuauaugagcccuggaaccacucugucaaguuagaaauuucagugaugcucuccacaaacccacagacaaaacuggggugacacccagcccucugaggggagcagccggcucuguuccggccuccaucccucccuccccucaucucucccagcaccgucaauacagccuuguuucugcccagggcggcgggguucuaguucacagaugggcuugaccaggcggccugcauucagaucucagcucuaccacugaguugggugacuugguggcaguggaguauuuugugccucaguuucccuucugcaaaaugacguugcaggaggccugugcuugcugaugugccgaggcauuugcagggcucgguggagagcaggcacguggcauggguggugugggagcuggugcacagcaugggugaacugcaguuguuucuggcccugugaauauugcugccucuguaucuucuaaugggcuacugggcgcuguagagaauccagugggucccugcagcacuuccuaagaaaaugcagaaggagcuccaggcuccuccccgugugguucacccgccaucccguccuuuccccucugccuucgacuccccgauaccuuccgcugcaguuggggcugcggccacaugcuggccaaggcucugugugagccgagugggaucugccagguggcuggagcagguggcagaggcggccccauccaauggcuggugugggguguccugaguaccugagugugcauaaaagcugacccugggguccaugggcauagcagggugggagcuggugggcccgagguggggaugagaggggaggagggaaguggggagaggaucagggagugcuucugagaggccaggagaaagaagggcacaggagcucccuggcaagucugggcaggccacagcccugggcauuugggggacaggcugggggugggcaggcuggggcaggccgggaccuggagauggggcugcagacgguacaggccuaggcuuguguccccaguccuggcgggcuccacugaagccccaucacccccagcucugccagugccugcagggagaaagggcgagguuugggaacaacuggcuccugcuccccaucacaccaccuggguaccccuaaagcuccugggaacacaggugcauucuccagagcccagaaggcaccguggucuggagggaauaucauucuacacacaccaugggaacucugccacauccuccaagccccauccccaccucgccgaguccugccaccguccaggcugaccugggcccccaggaagcccuugcugacuccggggcccuauuuuuuccugacuaggggcgaguccuugggaggaugcuccagacagucccagggucuucuggcaaagccauggcagguccuccagcaaagccagggcgguuccugggugcccgugggggggggggcccggcuggguuuucugggcuacccugagccccuugcucacucugccccucaccauugacucccguggccuuccggcugaugggcacucccauccugccaccuucccuucaugucaccuccugcucugagagaguggccagggccagcuccucuggguggcgaaguggagcugagggguugcccugugguggccagggcacugucuagcccaccucccuggcuggccggucuggccuuugcagguagcgcuguagggucugcuggggcugggggcuucuggacucugaguggggaaaugcucagggaacguccaaggguggguggccacucagcuuccccauuccgggacugugaggugaagggcugggagcaugcaguggcuucuccccucuagcucgcagucuucaggagacaaccccgcccugcaaacgccuccuuccuggacccagccccucuguuccccagugagugucaucuagggguuugaccgggagaaugagcaucugcugggccucuugccacuaagccuuggggucuggcccuauacccuggggacccaggaggcacuaggcuggcuccugagaggcaggguggcugccagagccacgguccccagagagcagaacuuuaugagagggcacugagccaaggcccccagcuccuggagucuccagggggcuuaauuaauagacauugggcaggcccaugaagggcugccugcgcccgaggauggcacauuccagggcaggcuccccgcugccucaguggcccccuugggaugacaguuaauacuggugagggcugggaggcugugcugguggccccagugcugccggcuggcgacagggccggagccagggcuaaaccccuguccugcugcccucaaagccagcucugucacugugaggacagaggcgacagcucacagaccaggugggcuucgcauugucagaaggcggguguggcugaagcugggcacccuguggccucccccugccugaccccuggaaaagcggaguggaggguggaugggccccaacacccucagcacguccugggccggugugagucugggugaaugugcccaccgcgccccgcuccgcagcuggcgaaaucgccuccagccacagagaauacaaagcucccccaacacccuacuggaggcaaagaccccagacccugcucuggcuuuuucugugcuugggccugcccggggcuccagccuucugaggucugugcugccaagaagagcaagggaggaggcaguguuaacccaggggcugcggggacaccaucccugucacugcuggucuucccuggcgcaggcagugggcguggcccugagaggcaaggacacccccgcaacaagcucuccccucccucacuuccugcccuucagcaugcagugggggcaucuccccaggcuccaguggcccgacggaggacuuguguuaugaacugaacugugcccuccuaaauucacauguugaagcccuaauccccaaugugacuguguuuggagacgaggccuuuaggaggugauaaauauuaaaggagacugugaaggcagggccuuggucccauaggacucacgucuuugcaagagaaggcggcagcaccagggauguguaagcacagaggaagggcccagccuaugagccaggaagagggcccucaccaggagccgacccuuccacaaccuugcucucggacuuccagccuccagaacugugaggaauaaauuucucucaccuaaguccccuggucugaagccuuugcugcugagccagcugauacgacuggccagcaggaagcuggagagcuagaggggacugcaagggcaggugagugcccgccccuacaggcacagggcaggguccggcaccccgagugggucagaagccaguccaccuacagacagcuccacgugacagccauggagcccaguauccuguuggaacuggggagccucuagggggcuggucugugcaaagaguggacccacuccaaaccugacugcacucuacccuuccaccaucucuagucugucugggccaccagcaccccaggagccacugccuggcccugccccagcccugcacccaccuccauugcuucugucaccagcucuggcaccucccauuaccaguguccccacccugggcacaccuggucuccugccuccccaugccuucuggaacauucucuagaaugggcucugagacccuguccucaugagugccugccagccacaccuucuccuccugccccagcgccauccuguucucugcucuuaccauagcugaauucucccauaacuuggggaauggugacggcagauggucacugaguggacagcaccugcucuucuccgugcucaauggggaucuccugaacccccgcaagcauguccccauuuuaggguugaagaaacugagucacagagaggcuauguguggugcccagauuuacacaaugauaagcugggcguuggaccuuggcaucaaaacccuuuccacuucaagcuuggaaccuucacggccacagcugcucuggcccccgguucuguaaacgccaccucaauccugugcgggacccaggccccuucccccacucccugggcccuacacagccucagagcaggcaaaguggggagggcugcagcugggaguacccagguuugggccgaggugaggcaagugggguggggaagaaagaggcuacaaagcuggcaggggcugggagugguuccaaggacagcccaggggucugggcucagcugccugcacugaggcgcuggaaaccuccucuauagccucugcccaguaggaagcaggaacggcugucagcccccucuuugcaggguuacccugcugggggaggccucugucccucccacacccucaggccacugggauggagcaggaaguggcuuuauucccuucuugaagguggcgggaaaggaucccagaucugugaccuccuggccuuuuggguggggcugugggcucuggagacagggcagggucagagcccugggaacuguggacgucugcaucugcucacagcccccaggucccagcagccuuaucggagcccuuggcugggagccuggagaccugaggguggcugagccggcaccaugcuucuaccccacccuuaggcagcuacccaggccucuccggaccucaguucugcaucuucaaaauggggucgcccagguagacaugaggacugacgggcaggcgugggacacuuggagcucaggagggcaggcaccgaaaacacacacccucugugcugugacuggaaccccccaugcagccugccgacucauuuccacucuguacaacucuacugagaagcuccucuaaauguucccgauuccaacccagaaauucugcuccuggcaaaucaaacacaagggaaaaaugcagaggaggguauuugcuguaacaggauggagaacggugacuaccugcagacagcacagaugcugcucccuggacaccgagugcacgagccccuuggaacuucccuuuggcugucuuggauacaacauauacacaccacacucacacacacaaacaccacacacacgauacaugcagacacaacacacaccacacucacacguagaagacacaccacauacaacaaaacacacacacugcccucacauacaaacacaccacaccacacaugccaacacacacuguguccaggcaugcaagcaugcuacacaccacaccacacacacacacacacacacacacacucgaacuuacagcuacagaaguuaaacaucacauuccacuucaguccauuccaaagagcgcugguugucaccacaacagugaccuccuggcccaccauggauggacagccacauggaaucugagcaccaccgcccccgugguccggccccugccugccucugagaguuucucuccugcgcugcucucucacucacuuugaugcagacacacuggcucccuuucuguuccaggcacgugccugucccagguccuuugcuuugccccucgccagcugguguccucuuccuaguuacccaagggagcugcuuuguccuccuuugaaggugccuguuuagauuucaccugccagguaagugccgccugaccaccugcauucuugucuaauguccccuuccucguggguacccuucacgcggguacccucugcucuccuuccucuucuuccucuccuucccccguccuguuccugcuccuccagccccuuccccugucccaaauuaggcaaauguacaugcauagaucaacccagcccugagccacagaggcgagaguucaaacaacgcgaccaauuuauaaacaauuuucucugcuacgauuaaguuacauuuuccccaauagcugcuucauuuucuugucaaaaauacacaguuuucacauuugucucgcugcaaggguaauuaauuuccagaccauaaguaagaacuuaauuugauaccugcaaggauuauaaacuauuucaagcuguuguuuacacgaaaucaagaaaauucguucuguuugcaauuauguuaaugaggaaauagaguggguauuuuuuuuuuuuuucagggaacucggcauaauuuugccaucaccaaugaauuaguuuaaaaacgucugcugcugcugccgcaaaccccucuacagcuguuuuugaggugaccccaguaaggaggccccccagacggcugaggaucccaaggaaggcuuuugugggaacggcucagaugaccaugggcaggugaguucugaggacugggcacaaccccaggugguuggcaacuagcuaggucugcagguggggcugaggagucuucuucaagcccuccugaugccaagccgaaaggugaccaggaggggaagggugguugggaacccagggcguggacgguccagccccuuccucuuggacagccauuccugggcccugggcugccauguggguuugcaccaugcaggcuugcuugggccugggccacaagugggggcacugagggugggaaaaggggcugcucucaggguugaggagagacaccccuaacucaagacucaguauugucccaaggccgcuguggauggcugugcaauuggguccccugugagggugagagggcugaacuuggccuggaaaggggcugcaucugcccaccgcggugcccuggguuggccaugacccugagcagccugggcugccugggccaaccuggaggcuggcacaguacgcagggcaggugcccaaagggaagagguauccccugugccugggggaaccggcuggcuucacaggaugggacacucaagcugggugccgaaggccauguggucagggugaggcaggcucccaggggagggagugcaggcacaagcagggggcuguaaaaaggucccgcacaccugagaaggggcagaauggaggaaguacggggcccgggggaggaggaggggccagacuacacuguaaagggcccugcugcacagagaaggcaaagaaccuucaagacauacaagaaggcggucagaugcuaguggggaaagggcccucgagcuccggagcaagggugguggguacgcaggggcagguggccaggaggugcagggcugguacagccacgggagucugcgggguuuuggaaggucugcuaggaagaggccagcccagcccgaccuugaugacacagcagcuggagcuggcaucgcugagagcccaaggaaagguugucuucagccuccuggccccgucaggcacaccucuggcugcccagugggggacgcacagcaugaggacucauucgcgaugugaccgcuuggucugcaggcagguuggggcccguuccuggcuggcugucucuggggagcugggagcugggggcuggggccagcgcugcccggccucuccguggcccagcccccagcacuguccuccucuucacagggccucccccccgccacccccccaggucugcccggagcggccggcaucgaggcucugggccgaguccucguaaauccuggggugcuggagacagcccaggugaggccgugaacaaugccccguuguggccccguggggacgguuugccgccacuugccaccagcccauacguuguaaaaucucuccccacggaucuaauuucgccucucuggcccuugggggguuaggcccgggacaggcacagucucacuccacacagaaaccauuuacggucgggauaaaggcggccuuuauuggcaccgaauggcgaacguuucccugccccaucguuuucucaccgccacaucugucagguggcgcaggagggacggcgcagcagugggggcuuguguggggacaaggacaggccgagagccgcugccgccgggaagaauggcucccagucucugucuuccugggaaacccacgaggucuuccugggucuguccaccgccugcaccucagugggcccauuaucuucaggcccagcucugacgcagggagacacggccccgaggggcugagugggcaggaaccuggacacaggccccuucggggcacguuuuccuuccccauggagagggugugucggggugugagagugaggaaaugaggacuacuucucaggccccaugauaggccugggucggcagugggaggccucgccuggucucgggguauaaaggcugaagguggaagggugcugggaagauccgggagaggaaagcgaugggugcuuccugccacccugccaucaaugcccaggguccuccaugcuccucaguuugggaggagccgugagaacugacguggccgccuuggccuuagccaggcggugaucucaaacagagcuucaucagcacuguggcugccauggggcagcgucaccuggcagggggccaggggccgugcuggcuucuggugggacauggaaugauuucaggugguguccgaauagucccuguguauuuugguauuuacauuuauguuuucaugcaugccgggaggaagugcauugcgccauaagccaaugguuucacacgugucgguucuaggcugcugcaguagaaguacuuaacgggcaccaagcacgguggguucaagaaaacgucaucuaagaaaugucgguggcucucagauguggaaaaacacaaagggugucccugugugaguggggcagggggccaaaggccggucucaccuggggaggggccuccaucuccaagcccugugcaagggguuggccacacuuacccccuguucccccggcccccgccccaugggaccccugcuuguggaggcacucaggggaugagagcuggagagacuccagggcaaggaacccgugggguuccucauggacccggggaaaggcagggucccgccaaguuuguggagcagaaaaauauuguuucuugcaaaauggcagggaagaguuggcgggaucuguagcugggggcugggugucaccauggcaacggaaagccagaagcuggcagaauuaggggcgggcuucugauuucuagggaugcuggccaaaccccaggugagccccagugggugugggguagggugguuuagaucaggggccugcucaagccaggcuggguugggggaagcuccguggggcccacucugggcccaagcaugacugugucuuuagcaauugcucugugacugggugucaguuuggaggaggaggagccccucggcucacagcucaggcucuuuuugcuccagaacuucaccuuuagggaaagagagaaacgaagugggauacacaagacaggucaccugagacccuggggcccuguccguggccuccccagacaugggugcagugccccaacugcaggucuggcagcagcagggacugcucugagcuccagcccgaggcgaaggccuccaguucauagccaccacuccuaccucaucccuacagcacccgagaggucggggguaggggaggcgagaugcggagacugacgcagcggaaggucaagugaugcccuggcuucuuggcugcugugggguggagcugagugggacgugggaggagguggcgaguuagaugggaagaccccuuggacccccgccaaccacaggcagaggacccucugagucaucaaacucaggucuugacugugcugccugcuugccuuccuccccgcacagcuucugggggugugaugagcuauacccacucuaggcugggccuggucucuguacauugguccccacugguggcaucuugcuuucaagagacaagguaaucuguggaccucccgucuuucccuccgcuagggagagcaaacuugggaagaacagguaugugguucugggugguggcuucagagcugaagcugaaagugggagaugggggccagagggguccuccaggcucaggcucucuugcuggguccaguccagcccagcagaacuugugccuccuccaggacacccucaccugggaaggcgguguacucccugacgccccuccaugcggcaucugcuccccgcuaaucugugaacacacaugcaucacaucuuugugucuuuaagguccagcaucuuugggggcccggcugggcucagggcugagucacaugagccugcuucuccccugugccgccccugaccacggccuccccaaggcuucccucacugccuucccaucucucucacucccccaucuucuuccucuuuucuuuuccacuugaucucuaagcacugggguuuugguugccugccaaguccaaauacagcuccagacccuccugacccuccuaccucagcaccccuccgagcaaagcauccccacgugggggcucacagcagaagcucgggguccuucuccaaccuuucuccccucagucugcuuguucucaucgguggggcuggcagacugggggcuggccccaaggccuccacccuaguccaaagugcugaugcucucccucaucccacagcagccccucaccacuccuggaacugcauccucaccugccuguaacccuccucccacgaagccggagccaccccuggauccuuggcccggccgggccaucccucgcucaccagcucugccucaccugcucucauggccucaggaggaugugcccucgugcccuagggccuuugcaaggcugcacacacuggacacucuuccacccugugucacccuccuccuccucacucacuccugguuggcucugggcuccugacuccacugacugggaaaaccgaguacuuucuccuucacacagacagauauguaauuacgggucacuaugugcgucccccugcccagccauggggcuguacauucuaaggagcaggggccagcccacccuacucacacugcagccccaggcaguggcacaaggugaaugaauaaaugcccacagugcuucagaaggauuccuuugcuuuuuuccuuucugcuccuugugacuucuggucccuccaucccuccagaagggccucaguuaaaaaaaaaauacuucuuacuuuuauuuuuagagauaggaucucacuguguugcccaggcuagagugcaguggugugaucauggcucacugcagccuugaacuccugggcucaagcgauucuucuaacucagccugcugagcagccgggaccacaggcacacaccaucacgcuuggcuaauuuuuuauuuuuauuuucauagagacagggucucgcuauguugcccaggguggucgugaacuccuggccucaagccauccccccgucuuggccuccuaaagagcugggauuacaggugugagccacugugcccagccucaguuuugaggauauuccuggguucuggagaaagcucggagcccucacaugacccugcuagugcaauuuccacccguuauuggauauggucccucucaguaagaggggcuaucacagagccuuagaacaagagcccuuguguuugucgggugcacccaggcgggcccugccugaugcccaugaggcugaacccauuuguagcccagcgaggauggguggccagguagcaugagucacccaggcaucagcaucuccucagcagcuccugcccugacgggguguucacccugcuggacaagcaucccuuugcgggcagcagacaggcagccaccuugccgcccacacagauggcucuugugugccugaccugcggcucccggggggcggggaagagagggggugcugugcacuuugacaccuaugugggggacugggggcagggagggggcgaggggcagggggcugcgugcuggccccgcugucaggcucaccuuacucggcuaauccugaacgugcaagaacaaugcugccaaagccaugagcuggaucucagcccuccggggccccaagcccccaucuccucuaauugaggccucacaggguggucugcgcccccaggcucccccuuguccguggcucuggccagugccuccugcuguugccaaggugguccaggcacugccucagcccgcaccccacaaccgcugugcccuccgcccagaacgcucuuccucuagauauccauaggaugcgcucccucacccgcacagaccuuuuccuggcagcccgcacacccugcaaccucuucuugaaaggccugggucugaccugagggagagaguuucucuugggcagagggaggggucacggccccgucccuccuauccaccuggcgcuuuccaccuuccugagagcagaggccacuguaaaagggaccgugugcuggggguuuucugggugcuggacuugugggcacacaccccauccacuccugccugguccacacacuggcugcuguuucacagacaaagaucuggcggccagaggggcuccagguuugagaagggcccucaaaggagcagccccuuccuauugcugcagcgucuuccacacguggagagggguucaggcccacgcugcucugggccugcagggccacccccuggaggccgcgggagugcgggaggggacgccgggccugcagggguggcggagggacccgggaaggcaugaauggaagcgccggaccagggcgggaagcagcggacgcggaacgggguggggagggcucagguugccaacccaaacagcccagcgcgccucggccccguguuuaauccacaaaaauuuccaucugccucuggagcacucggaacccgggcaacgaaaggcuguucgcgcggcaaaguaaacaccggcuccgugcagggacggccgugcgccgcgucagccauuuuguggacgccaccguccaaagugaggcggaagcccccaccugcgggcucggagccagggcaggaagccggucccaccgcccggagcggcgcggcgaggaccugggcauccaccugccgccagcgccaccucugaccuggggccagaacccgagcccgggaggcccgggccccccacccccacccgcagcugccgccaagcccccgcacaaccucgggguccacaccugacggggagggcccgggacgugcugggccugugccgccgguucgccccguccuuccuuccccgcccgcgguuucccagcccagccggcacggccagguccccuccccgggagggaggggaggcucgggucgggacaucuauuuuugauggugaccaagccacugcuuaauaugcagaaccggcugggggcaggcugugcccugacccacggggugacaaguuugaaaaggggcccauuuugaccaaaauacauguuuuucugagguuggccagggcagccaggcaggguuugccgcacagacaaggcuccgcaccgcccucacgcccuggccccugcaggcggccagcccagccggacucccgcaauugaugcugucgauuauagauccgcacacggugcccagugagggcucggccgcugcgggcuccggccaccguccugcucgggcaccugacacgccccugccgccugcuguccuaucccagccucucucugaagcaguugcacucacagaaguugacacacacuugagcugaauuuuuaaaaagacuuaaauuuccucucuggccaauauuggaggccuauaaauagagucauucaggagaggcuugaggguggcaacugucccccacaggcaggcuaagagagaaacaccccaagaaagagagacgcuaguguggggaaaagaacaguucuugggggauugcugaggguaagagaagcaggaagccgcuggauagcuggggaaagcaagaccuggauucaggaggccuggccagggccacguaguaggguugaggcggaacuugaacuugcagagagaccccugaugccauccucaugcucacacccucugagcucugccaucagccaagcaggccuccugggccaggagcuugugacacugcccacgccacagggccuuugcacgcgagcgaucggcauaauggugccuguccccuccacugggggccaggaggcugaggcgcugagagcccacgugacucgccgagucucacagccaucgcguguagggggcagagcuugcaccccagccacuggcuccaaaggcgugagaggaggucaggcuuuugcccugugugggaugggaaggggggaugggaaaggggucuguguguggcccugugugcacagcuggaugcuggguguggaugggccacaccuggaugaggacccugagugaugagccccuccuaugggguucagggucccauggguaaccaagagugacaaagugagacugcaccugcaggauggggcuuggcccggcugucucaguaggugcugggccaggcuagggcacugcugccagggcuguccagagcaguagaaccagaggcaaugccagcuccuggugucaccgaguggggacaguguagacaaccccagcagaggaggacgggagccacaucagacaggcuucuccucugagcugggcacucuccacggucccaucacccaguggcaguuagugggggcugucucuguggcagguugagggucauuugggcucaugguauggcagagggucauugggauaugaucugggggucaugaccugguggucaaagggauaugauccccuccaagucccagggcagggcuggaaucugcagcugacaagugcccuuugccagccucuggcaaccucauggcaaccuauccgaggauggguggcacagagaggagccucugaguggggaggaccucacaggauguuaggauugggggugguccucccaggggagaccagaggaccaaggugggaccuuguuucugagguucccuuucccaucacacucaccuccacgugacaucacuuuacuggggggaaaaagaaacaccucgaaaugagcacaccaacuaccuggcgcaucucaaucuuggacaaagcgagaacucaugguggaucucagagccaagcccacgguggucccagugcccaggagcugggccugggaagggggaggccgacggccccagcaucccggagcgcagcuguccccuggccucccuucccagcugcguccugggugcuguggcugcacagagaugcgaucacguuccuuggcaacuuugguuucuuacugagcaacacaucaauaauaucccucccgagcaaugacugccggcaaaagcucgucuguggcgggcacuggggcugcggcgucgaggugucucaguauauaccacgcuucucuauggacaaacagauggcuuugagcuugucacaugacaaagcuugcaugcaaagcccgacccuggugcuuuucuuuccuaggagugaugacggguuucuaguuuucacaggcagugcuagagucccuuccaggaguuguuacuuucauuaauucccaccuccuaguaagacagaagagcgucugcucuuccgcacccaugccagcacaggguaucaucauuuccuuacauuuugacuuuaggggugugcauuccccuggccacugguggguccacugucuuuccaaagaaggugcugggcagagcugggcugcgguucagaggugccugcugagccugguuccagggguggccuuuggggguagccugaaguugggggaggguacggggccucggucccuggccaggcaagccaugauggcugugagaaugccaggucugaagaccucccaccucaggcucccugggagcagacucaaccuggccccaggggccuccugcaagccuccccggagcuugcugggcacagggacucccuggcagacacacccaccccugugcaggaacaggguggcggugcucagcgucaaacgcugcuuucauuauagguuuaucuuuggaaccccagacaaaacagggcuugugugguuugacugaagggcagccccuccggacuccgccauccacuaagacggcuccucaggaaagaaaaaauacacuaaccuuaaaauaaccaguucccagaauagcaaacuaaugacggcuucuaaagggagcccuuugaucagucagagcccccgccuuugccuauuuacggcccugucacucaagagcagcccagcagcagagagaggaguguuggguuggguguggggggcgggggguggugcagaggggagggggagcugccgaggagaggcaggucuggggcugccagggcaguccaggcugccuaacuuucugaugcaaccagcccuucaguggcaaggugcucccuggccucugggacagccuggaaguguguccugccugcaccgacacacacuucucacagucugcugagcagcaccuuccaguugcgaagcuacgccagggaacagaccuggcugcagagaaccggaaaagaaccagaaucccaagcggacauuccuuagggaccucggggaggcgugggucaugagcucuggggacucgaggcaggggaacuuggggaggaugcuguggagaaggagcccaggaggggucugcagggaugcaucucuguugggggcaugggguggagaggggcgcuggggccaugagauggcaacuacuggagugugcucucccguauggucccugccauccacauucaccacauucuaugggcacucacugagcauuuccuuggggcuggccuggguaaacguugggggagccacacucaccuccccacacgcgcgcacggccaugcccguccaaagcagcgcugucccauagcugaaucuguguggcacagcacuuaaaaaaguggugacugagauccaggaauggaauuuucauuuuaauaaauuaaaauuaaaauuuaaagauagauccuucauucgguuauuagaaaacccuucaguauguuugaaaugacuuaggcaugggaaucuccuuuuucaaugguaaauuuuaugaaaucuaaauacagaccaagucguucucaugaaaacucggugucuaaauugaaauguguaaaauaugcaguggcuuuugaagacccaguaugaaaaagaagaaugucaacaauuuuaagaguuuuaaaaauauuaauuauauauugaaaugauauuuuggaucuauuggguuaaauaaaauauauuauuguaaucaauuuuacuuauuucuuuuaaauuaaaaaaguggcuauuagaaaauuuaaaaugauaucuguggcuagcauggaugagcugaccaggaaguaagggagguuagaggcugaaaacucagugaaaguggaaccccagagguaauaggggcccugaagguauuugaugagugagaugaacuugagcuuugguuucaccaggaauagaugauuaugugucaaagcccaggccugccccaggaagucucauagcagagacuuacacaaagcugggacccucaaagggcucugcuuucauugugagggccaaugaaaaaucuccuacucccugagaagauuguaaagaaaacugcauuacugcuaagagaaggagaacaaguucuguccuggaaagucauguucacaaguuaguccaugcucagcuuggaggcuugaauucauacuaccuaaguggccuagaaaacuuugagccuagaauuaaaaguccaggcuggcaguacacccacauauguggcaauggaagggguaaacaugauuccucccugaggaccccaacuucacaccagacuucaaaaauucccacagauaaauuuuaagauauauaaguuuacaaugaaaaaaaaaaaaaaaacagaaacgaaaugaaacaccaugaaugagagucagcagaagaaaaaaucaaacagggaggugaacucagaaauacuuuagauacuggaauuaagagaagcucaauauagaauagccauauuuaauacacuucaagaaaauuuuaaaguuugaacaggcaaguaaagaggaagauacgauuaaaaugacuuaucagauaugaauaagaacccaacagaacuuuuauaaauaaaauaauaauaauugaaguuuaaaauucacugaacaguuuuaacagcagauuaaacacagucaaagaaacaacuagugaacuggaagauggauuccagaauacaguacagagagacaaagugauuuaaaaaaaaaaaagguuaagagauaugaaggggagugagguggucuacuacuggccaauaaaaauuucagaaggagauaaugagacugaagugaaaucuuacgaaguauuaacugagaauaaucuagaacugaugaaagacaccaaaccacugaguaagguagcucaggcagaaaaaaagaaaccuauuaacauauccuagugaaaaugcagacuagagucaaaggaaagaucuuaaaggcagccagagaaaaaagacagauugucuuccaaggagcaacaauucaucaucuucauucucaacgguaacaguggaagccaaaggauaguucaauaacauuuuuaaugugcuaagaaaaaagaauuuugauaaccuaaggccuauaauuuuauaauugguggaaauauuuuuuaacaugacaguaaaauggucauuugcggacaaaaucugagaguuuuucacugaagaaaauuuaaaugaaucccucagucacauaaaaagguaaucccagauguaagaucugagauaaaaaagaaauaacaaaugacaaagaggcaaaugggugaguaaauuuaaacaaauauugauuguauaaaacacuaccaauuagugaguuaaaaauuaaacacaguucaacuaaaauauacaacagcaaaguacuaagucagggggagaauaauugaaguuaaaguguucuaggaucccuauuuuauuacagauauggguagauauagcaauuacuucugauauauauucauuuaaaauguucuagguuaaccuuuccaaggaugguaguagaauacauaacuucaaaaccaguagagagaaaaguagaaugagaaguaauaaucuaaugagaggcaagaaagaggagaaaaauaaauauuacagauuuaguacaaguggaaagcacaaaauacacugcuagaauucaauccaaaucuauuagaaauuauauuaaauauaaauguauuaaauauaaauguauuaaaugauuuuuuaaaaacucaguaauacaguguuuacaaaagacaaaccugaaauccuacgguuguaggauuaaaaagaaaaggauuuaaaaaucugacaucaaagucagaaaagaaaaccacaccaguauccuuuaugaauauaaaguacauucuuuuuuuuuucuuucaaucagcuuuccuagguugaagacacaaacauucuuaacaaaauauuagcaaaccaaauccagcaucauauaaaaaggauuauauaucaugcccagguaggauauauuccagaaaugugagauugguuuaacaccugaaaauuaauguauuauaccaaaucaguagaauaaggaauaaaaaccacaggaccaucucacuagacacagaaagagcauuugacaaaauccaauauccauucauaaugagagcucucaacacacuaaaaauagaaggaaauauucucaacaugauaaaaggcaucuauggaaaacucagagcuaauggaaauugauugaaugauuuuccccagaagaucugcucuagcacuucuagucaauauuuuuuuugaaguucaagccagugcaauuaggcaaaacaaagaaauuaaaggcaucugacuggaaagaaguaaaaauugucuuuauugccacaagacaugauccuauauguagaaaaucuuaagaaaucaauagcaacaacaaaaauggcuaaagccaagaauagaaaagucaguuuacaagauugauauaaaaauuuaauguuacuucuauauacuaguaaugaacaauuaauucaaaaugaaauuaagaaaacaauuccauuaacacuagcaugacaaauaaaauauuuaggaguaaauguaacaaaagaaguaccaaauuuauaugccccaaacugcaaaauaucacugaaagaaauuaaaguagaucaaauaaauggagggauauaccauguucauugauuacaauacucaauuuuguuaaguugucaauuuuccccaaauggaucuauagauucaacacaaugccuaucaaaaucccagcaggcccuucuuuuuuaauugacagguugaaccuaaaauuuauauggaaauucauaggacuuagaauagacagaaacaauuuguaaaaagaugaacaaaauuagaaaacuuacauaauuuaauuuuaaaacuuacuguaaaccuacaauaaucaagacaguauaguauggguuuacagaaaggcauauagacuuacagaaaggcauauagaccaacauaauagaauugaaaauccagaaauaaaccuauaaauuuauggucaauugauuuuugaccaagaagccaugauaauucaaaggaggaaaugggguauuuucaacaaauguucuggggcaauuggauauccauaaguaagaauaaaacaaaacaaaucuagacuuuacuucauaucauaccccaaaauuaccucaaaguaaauauagaccgaaauguaagagcuaauucuauacaacuucuagaaggaaaaaaacccaaaacaaaacaggagaaaauguuuauggcuuuggauuaggcagaguucuuagauaaaacaucaaaagccugagccauauaagaaaagacaaauuggacuucauuaaaauuaaaaacuuuugugauuuaaaagaugugauuaaggaaaugaaaagacagccacagaaugggagaaaauauuugcaagucauagaucugauaaaggacuuguauccagaacauauaaaaaacccuugcaacucaauaauagaacagacuacuuaauuagaaaaugggcaagagaguugaauaaacauuucaccaaagaagacuaugaauggcuaauaagcacaugaaaaguggcucaacaucauuagucauuagggaaaugcaaaucaaaaccacaaugagauaccauuacauacucacuaaaagggcuaaaauagaaaagaccauguauuugcaaggcuguggagaaaguggaaccuuuauacuuuacuggugagaaagcaaaaugguauaaauccuuuggaaacaguuuagaaguuucuuagaaaguuaaacagaaauuugcccuaugccuucucaguaauaauagaucaagcagauaaaaacauuccaaugagaauauagaagauuugaacagaccaacuaacaagcuuguuccaguggauaugaacauaacacugcacccaacaaugucagaauauaccuuguuuucaaguacagaaggcacauuuacaaaaauugaccacauuuuugccguaaaucauauuucaaaacauucuaaaggauuaauaucauauggauugcuuucucugacaagagggcaacauuaugagaaagcugugcuacaauuauaacaaugacaaaaaccacauugcuacagaacuccuaggauaaacaagagaucauaauggagauuagaaaaauacuaaagugaaugaagauuaaaauuaaaugccauauaucaaaaugugggagauguaguuuggaugauauuuaaaggaaaaauuuauaaccuuaaaugcauaccuuaaaaauuuagaaagccaugagauugacagugguuagaaaaauuaaaacgaaaaggaaauuuaggaagccugaaaauuaagaauuauccucuucuuaauuuagagagguuagagaaagaacaguauauuaaggccaaguaaauagaaggaauaaaauaaacagaagugaaugaaacaaaacaaaaucacaauagagaggaucagcaaagccagaaguccacgaaacauuuaauaagacaggggaauagugucaaguuugaccacuaagggggaaaacagugaaggcacaaauaaauaauauugagaauaaaaaaugggacuaaaugcuaauggacggacauuaaaauuauaauaaaugccaaugaacauggaaacuaaaaugaaauguauaaauuccuagaauauauaacuuaucaaaacugauacaagaagaaauagaaaaccugaacaguccauaauuauuagagcgauugaaucaggaaugaugaaucuucccacaaagaaaacaccaggccuagaugucuuuaccuuuaaauuccaccaaacauuugaggaaaauaaaauucuaaucuuauacaaaauaucccaauauaggaaaagagggaacacuucuuaaguuagucugugaggcucacauacauuugacaccaaagccugaugaagaccauacaagacaggaaaauuaugucauguauguaucucacacauaaauacuggcacaaaaauucugauauauuaaauauuaguaagugagauuucagcaguguuuaagaaauaauauacaaugugaaggauuggugggugugaggagaggccggagaccgcauauauggcuggaaaaauaauccaaguaagagaugauaaaggccugaacucagcagggguugggcuaaagggagaggaugaacagcagcacggcggcucugggggugcagcucggggaacugcccaagacaaaaaagccuugggguccagcuuguggccugguugauggaggagucacacuggaaugagggaaaggguagcagugucugggggcaaacacccaauucugggaggcugggccugccugcauccuggagguuggggucaugcacgaagcuugguaaaggcaugggcagggugugguuuugggaguccuggguuggggggcauucucauccuggaggccuggauucugcgaccggaggcagugaaaggagugucagguggugggggccccuucccgcccaacgcuuucugaacugcggcauggaaacccaggacuccccuguguccggcucucagccaugaacauuuccggcaaaaacagagaagaaagaaacucucccagcccacugugcuccucauaucagcaaaagcaguaugagcuuagcuugcaaaauaaacagggcccaacguaaacaguguggcagguccuggagaccaagcuaagaauacuugcugggggaggagggcuggagcggccucugccaucgauuccucagaaugucugggguaugcagcccccacacagacugccagcccugugugggacuucaggaagcccaguggggccagagggggagugggcagggccagcucucuccggaccucucccgaccgccugcauuggucccuggcccacacugaaggcccugggcccugcugcuggugcccccagccugccccuggccucaacccuccucagccucuccauacggacuuugggugauaugaaaccccuccuugcucucucuaccucaucucccaccccugucuguguccuccuugggaccagcucuucaccuaacuagcugugugaccucaggcgaccacucagccucucugagccucgguuuccccaucuguaaaagaggauuuaugugggcauuugagcaaauaagaguccucuccaggauaaagaagacaauaaucuaagaugaaaacagaaagggcaugaggcagcuuuugugacuuuugacccuaaggacacaagcaggagucaaacccucucauuugacaggggagggaggcccgcaggaaguagacucgcugugaggaggccccuggaucugcggguguggguggguuucugcucuccacacccuggagugaggcagaaccuaagccaccaggacaggcacagggguggaagggaucccuggaauggggacguccugcaagguaguugggaggucuguguuggagcagacacugcacugucaagcaagaguuuugacgagcccgcaggacugugacgagaagggagacccccagaccccucucuccaaugugggucccuggccaggacaccaaggaagaagagggcucccugccagggaaacugaggcagcccugaacaagcucagcuggccugcacuggugaacucccugcagggggacacucuaggccucccuggaggggugccagccagcugugcaucccggagaccucucauccuauggcuaggcaagcuggccuggggugggacucacugcacagcccagcugaggggcugagcugagcugagaaaacaguuggaggcuggggccuugacucccuuccggcaggcagccagaccagcgggaugaggugggggagggugcugguagggaaggccaggggcucuggcugggguuggcagggccggcgggcauuggcaccgcugcacgccugcugggccuccgagggccgggcggcugcuggauuuccugccccuacuucccgaagucagcaggauugcgcuugggguauuuacggucccgauggcugcacugauaacggagaaaacucgagccaggcugugccaccaagcccuccaggcccagccaggcccuuuccuagggucugucccugaggggugcaccagucaguggcagggcaaggaccggguaggcuaccaccuacccaccuaggucagcacagcucugucaacuccuugaugggcagccagguuccagguagaccccucagcggggcugagauuuagugucgacugugggugccacucaccaccucagagaccccaggcagaggacucgaauguaauggcagggagccagggcccaccagggcugugcaugcagaaucuaccagaauccucguggccccggcucagagccugacagggcaccaggauguggccccagccuuguucuuaaaccuugcccuagggaucagggacuccggaaaaugcuucccuuuguugcucagaugugaagaaauugggugcauaauuuugugccuucaaggccagcgcuggccccucugcaggcccccacaccgaccuuggcugacugaggacuguguccuuguucccaggccccagcaggcugcuggacggcugcugugcacgucaggaaggggccauugcacuucaggaggcccugucugccacccaccaucacccccgcaggaugccagacuccaggucugggcuuagaggguggccugucccauggagcaggggcagagccguaagaaaggucugggacaguaguguaggcaauggaaccagagcuuggcagggaguggcggggaaaggcgggggcuguccccagccugugcuguccagaaagggccaccgacacuccugcacgucagggauguucacgccccgccugccuggcugcagccgagauggaagcaggaguggaggcuggggaacugggugccacucccugucucuaccacggcuuuccuugaugucuagaaacuccuggccaugccaacaacacaggguacccggcccugcuguacugggugugccagccaggagucacccagcccuugcgcaaagagaaagccagggaaacaccguguuccccgggcagcagagaggccaaggcuucugggccucugagcuugccaauccugugagcugaccucucccgggucuugcuuccuguccugccagaugggcgcuaucucccacugggccaucugccuggcaaaggucugcaccagcccugcucaggucugugcugacagaggguggccaggcccaugggacucaggguacuguggucacacagccccauggggccaggcaccugaacaccagccuucgcucuuucugcaugacccaauuugcuggucucagggccccacggccgccccaggccaugggcagauggugccagguggggagagggugacgcugcagguccugggggccaggacggguggggcaggagcaggagccugggccgggcugugccugccccgccugcccggcugcagccgagauggaagcaggccagagccaggcguugccagggaaaccgggcggcagacgcacucccugcccaacugaaacuccucuauuuuuagccucucagcuacuuucagauaaaguccauguagacggacuugcuguucggcaagauaacagcccgcuucaaaccacagagacuucaaagggcaguggugggcucagccaugggcccgagaaaggcccucccaccgcccagaucccccggcagcucccagggugccugggggagaggcuccggccugagggaccgagugaugggcacagagccugguggggagugggggccugguggguucggggugaacagaagaugccucucuucccaugaacccaucccagcugggcccugcaccucccugagcccucggccggccccaaguggaggccccagacagcugggcccaggagaaggcugggaugugaggccagcuucugccacccuccacucaggacacagccaggaggcucgcagagcacaaagcagacuacgagaggcagcgggaaagagcuggggggagggggcacuuggugccaccugccaguaaagacgccacuugucagaggaugagaaaccagccuggccuggcuccuuccaugggggaccaaugccccgccaggugggcagugggccugggccccucuugggaguugcugggcaggcugcaguaggcacuggcgggaagguggggaggccugcaggagcuucacguucacacgcagaccacagggaggugccugcuggccccaggacgcuaaccagaaccaccgcaggccggcgcgugagccuaccuugucuucuacucgguucaggcgggcgccgaucguguugcugccgcgauccuugcucuuuucuaugggggauaaaacacccaaaucagggccaagugcuggggugggccggggaccccagcugggcuugggaaguggggugguagggcugggggagguagcugagagucaaaaugccuaaaccuacuaggacauuuuuaaaaagcaugcuaugacaaaaauaccaggggugguacgguggccgggcauggcugcagcuggggaccugggcuccauccugcuccacgcucuccaccucugaccucugagagcccuagggggcugccuaagcuggccacacugccagcugugcaagcccaugccauuccacucccagggcgacacaggccugacuccaggcugggggcacagccauuccgcugcuccguuacaccagcccacacuaugagccguggcugcuguuugcaucugggcuagggaaaccccagggaaugugccuuuucccugucauuccccggaaugacucacagccccguguccaggggacccaaggaauuuggucaaggagccagaaaaccagcccccaggcugcagccaggugcuucugucccucucaacuugagcccugcaaggcccccacccauagucucuugaauucugggcuggcagcucaccccacccaaaccccaccccaggaucacccccuucugcaaaguugcccuggguucauguuuccacaccuagagccuaaccucaacgcccuggaauuuaaagggacccagguagguucuuaugaaaccugaauauuccuuuguaaaauguacuuuggagccacuuugcuaaggguggggucuaccuccccuuacucccuggcuuucauuucaugucaugcacuuuggaggugcaauggcccauucugacaucauggggagagccaggagggcagaggugcgggagaguccauugcaggcugcugggcccagaguaacugacacagaaacccaccugagacggagaugaacagugagggcuucccaauggacugguccagccuggagagaaggacacagacaccaguucacaccuggcccuggcacugcgcagaugcacugucgucugugggacagacagcuugacgugcccggcaagacaguggacuguccacccacucuggggacacccccgacccuaaggccugccaggucacucccaaccccccagagggccaugcucccgagggggcugagcagggaucucggaaagggggagucggugggcugccucucagacuuccucccuggggguaggagugggaggcaguggaucagccaugggcaaggcagccugaccccucgccuguggccaggauggacacgggcucccagccaugcccuguaacacacggagcuaguucccaggcgagcccaucucggaggcacagcugcucugagucugugcaggcccgggaggauggugcuagcuccaugggaacacauuagcuccccacagucagggucuccagcuccaggccagucugggggagacccgugcgguggggccuggcaccaggcagugucuucccagggcugggccuggccccuugcucagaggugacagggaaggcgggugggcuggcugccgaguguccugaaguuguggggagugugaagcugguguugcuaccugagcagggacggaggcggguguuugccuccccuacgcgccuccccuaccccaauucccccaucaucucagauccgggcggggaacaagguagagcugccuggugggcuggcugugaaccguggccguggccagcugcccucccucugcagggcuggggguggugaggagaagggggugguugagaggcaagaacucagggucucagccccucccuccuccggcaccgcugaucaugcagcuggggccgggcugggcaggaccugggcacccuccccgcugccguuuggccgugcccaccuccucugcagcuccuugaugcgcaccaugagguugagguggcccugcgaguacugcucaaugacgucccgcacaucguaaggcuuccgcgcuugcugcgggacaaaaagacacgcaucacuucuccucccugugccccagccauguggcucaaagugcaggcagugacagugucugcccucgggaggcuugugaagaccugggagcucgccuauguggugauggcauaagccugguuccaagcgugcacaguagcgaagcuuguccccaucagcuuggccaugggucucuggguaguccugggccaucagcucggccucucugggucccagcuuccugucuacucaccggcaggggccugcugucuccucccuuccaccccccaccaccccaggcuaccaguucugguucucaauggcuucaggaagagcuggcccccccaaggggucaaggagcagcacagugccaggcacugaccaggaggcacagcucugcaugcccacuaccuaccugggccccagacugacccuugacaugcucacuggcugcagccgccacuguccucaggguagggagcgggucuccucugcaucguuccuggcaguuugugccaggcagcagggguggccccagaugacggccuuagccugcagcacuugcugugggugacgagcaucugcuugggcucccacaguggggcuggggccaugugaggcagggcaggggaccccagggcucccaggcuuguugccagcucuaagccuauaagugggacucaggugacaucuugaaaccacaacagagaaaacaaagcaucucaugauaucaggaaaccccaagccacauuuguggccuugcucccaagggccucacucagguggagcagccaggcugagcagggguuugauggccuaggaaggccuuggcccugcaggcaagccagcacauaggacaacagacugccucuaucccgagaggccacugggugaccgggugaggcccaggguagucaucauuagugcucaaauagccaccuuagcacugagcuaguggcuuuccugccuuuugcuggggaauuugcaaggcccaagagacgagccaagcggcuugguggggagggguggggcagggccagcccaagucagagggaggcaauugaggcccaggaugagaaaggaggaagcucagguaccguugagggcccgggcugggucugggaacaugcccucccugcccaccugcuaccucucuuugggguccuacuccugagaccagggugaccuuaaucugaggaugcagccacuucuacccugggaagcagcaaguucccagauggggagacccugaggucaggucuccauguacccacuuucagcucuagacacacuucugacaugcccagggguucugccaccaaugccggaggcuugguggaguucuuacagcccgcccaacauuguuuuggaccccaggaaucccaagacagggcagagaccuccucccuaccaaaggcugggccucagaaguucaggggguuccucuuccaccugacacaagcagguagggcccucacuggcaacacuagccacucucugggcccugaacgggagauccugagaucaggagggcugggauggggcccguguccucacaacacagcugugccccauggaaggaagggccugcugcuccuggggccacacugggcaccaggaucgccggcauugcccagaaaugacacaccaagaacugugauagaggcaggcaugggguuggacucuaggcagacccucuggcccguaaaaaccguacuuauguacaggcuaguaauaacauccucaggucucaguuucuccuguaauaugggaaugcuaaguccuucuucucucuucuguaagauaaaaugcugagcccugucucucucuuccguaaaaggggaugcugagcccuguuucuccuuccuauaagauggagauacugaguucucuucuaugaaaugggauguugagucuuaauucucuuuucuguaagaugggaugcugaacccugucucugucuucuauaagaugggaugcugagccuugauucccccuucuguaauaugggaugcugaacccugucucucucuucuuuaagaugggaugcugagccucaauccuccccuucuguaagguggguugcugagcccuguuagcaucugguagcaucucuuguaccugguagcaucuccuguaagauggagaugcuaagcucccuucuguaagauggaaugcugagccuugauucuccuuucuguaagaugggauauugagcccugauccucccuuuuggaagaugggacacugagcccuguuucucccuccuguaagauggagauacugagcuccuuucuguaagauggaauacugagccuugaucuuccuuucuguaagaugggaugcugagcccugauccccccuuuuggaagaugggauguuucuccuuccuauaggaugaaaaugcugagcucccuucuguaagaugggaugcugagcccugauccuccuuucuguaagaugggaugcugagcccugauccuccuuucuguaagaugggaugcugagcccuguugguaucuucuauaagaugggaugccgagccuugauccuccuuucuguaagauuggacgcugagcccugucucucucuucuauaagaugggaugcuaagccuugauccuccuuucuguaagaugaguugcugagcucuguuucuccuuucuguauaauggagauucuaagcuccuuucugcaagaugggaugcugagcccugccucucucuucuauaagaugggauacugagccuugaucuuccuuucuguaggacggguuguugaacucuguuucucccuuccguaugucccuucuguaugauggagauucuacgcucucuucucuaagaugggaugcugagcacugccuugcucugccuuaagggagggagugaggaugacauaggaugggaguugagaaaggucagggaauccuaagccagcaccaugccagagccagagucacagccagcuguggccgaagccucucuucagaacacauugaacauggcaugagucaugguggugagccuccugcagaccacagagcucugugaagcugaagcauggggcaccuccagccaucugggugcggugugggcaggugaagggaggcagggcaggggaaaaccaagcccuaggagucucugggccacugugaccagguggguguagguguguguguuagcagccucugcagaugcgagugcuuccaaacaggccuguugugggcaaggaaguauuauguaccugagugugugcacgucugcaggagcagggcugggugggccuaucagcagagagcucccugcaccuucagccacagccuuaccugguguagggcauagcccaagaaggcucagcaaugcccgcagaccaugaggacccacggcccgguggcaucccagcccacagagacuuauccuggagccacugagaugccugcuaggauacgguuagggcucacgggggccuuuguccagugguccucugggguugggcuggaaagaucauccugacuucaggagccugagaugagccgagauaaugcaggccuguccagacugacugaugguggacagggaguucaaggcacacuugaaggguggagaggcuccggcuccuugggccagacacaggggugguuggccaaggacuuaucagccagcaagguaggcagaggggucaccugccaugucagcagccccugaggccagcgggggugggguggggugcaagcaagcagacaggcaggcgucgaggaagggaagcauccugagaggugggcuaggggagccccuggagccacacacagcuccucacugccacgggcuacugcuccccucacccuggccccaccccuccaugcugcucccagcaauaagagccagcuggugaggucggagggagccccagcggcuuugugcaggagccucugugcccugcgaggauccugcuguugccagguuucugcaaggcucccagggccagggagcaguggagaagcagacagugggguggggguuucccagucugcuucaggaagccuccugggccauucucagggucccggccuguguccuaagacaggaaaggggacccacucccuccugucuggaagggagugcagggcucacuguguuccuccccagggaccagcuuuuucaccuguggcucagcgacagggccugcuggggcuggcgcagaugaucucucucucucucucugucccucucccucucucucuuuuuguauuuguuaauugcuuauuuaccaagagaaaccauuucuuggcccauauauucauguuucacaguucaggaacacaggucacugacaagcuucuagguaauucaacccaaagaaauucuuuauauuccaaaaucacuuugcacucugaaagaugccagccuuccucaucaccucaaaaucuuugacggcaucauaauaucuguagaaaucgugugcuuuuuuucuugguucagccacaucaaacuuacagagagcugcaacucccagguauucaacgaaugcuccaacaacaugaaauugcagacgcuuggccaggaggcuacgcaucugagguuucaccacaagacuggaagccaugguaguuauuaucacgaugggauauccuugauaucaaccucaaugccaguguccuuccuggcugauggagaaagggauggcuggaugaucucuugaccugagcuggaagcugcccacaccaccccuggagcuaggccugcccaggagccaucagggucugcaugcucugcuggguucccccagaccuuggaagcagcccccaggaugcccaaguggcgcaguucugcaagccuuggugggcucuggcucugcccugcugggaccugcucugcacccucaggccagacaccagccccacccugggaggcucccugugucccucugcucuacugcuggggugacgucagcugcuucggcugucacgaccaugcuguucuccagcgaacugacacacccuggcccuucccauggucuccucugcccucgggggacugcccugcccagaucugagucccaaagggguucacgcagccccuucccugucugggagagcacuggugcugccaggaggcuggccucucucuuccauugcccccgagugagcucccugcuccagcaaggcccuccaugccagcaccagagagaggagacggucccagaauggagacacccugguccacaggggcugucagaucuccccuagaacaugccaggcagaucuccgggcacuggccagcaguggcauuugccauggcuuuuauuuugacugcaagaggucccaggcacugcugggagcuuugacacaacuugguucaguugagucaugaaccacccccuucccuggggggaugcaggugggagggccagcugagaaacaccacugugggagggcugugcaugcgaaaccccccuggagaugguggcccgguggccagaacgagggcccgcauacugcucuuggcaagggccuggccgagggcugcucuuggggcucagagugacgacgagccuagcgggugcuggccugggguugcugggggcaaggcccgggugaggcacgugcauaugaucuuaugccaaacccuuaggcucucauuccccucacagcuggggaagaacuugcccagggcugccugugccagggucugcacccagaccgcccugugaagucuggaggcugagguggcuccagggcccagaugggugggggcuccaccaaggagacugugggcgggccugugucaauccuggggccuggaguggaagguguggccuggugugaaagacauggcugcagggggaccagacuugaaugccacugucaguccgucuggaugggcugugcauuaucuuggcucaucucaggcuccugaagucaagaugaucuucccagcccgacccaacgaccucuugacaaaggcccccauaagcccugaccagacccuagcagggagcucaguggcuccaggauaagucuuggugggcugggaugccaccgacuguggguccugguggucggcggacauugcugagccuuccugggcugugccuuaugacuggugaggcuguggcugaggugccaggggcccccagcucagaagccccacccugcccugcuccugcagacacgcacucacucaagcacgucacacgccccccgcuccaagggacucaggcaagucaccccccagccuucccugcuuugugauuuuugccuucuggaucacccaccacagaggauacgggguucccacaccuacacauguauuuccaagccaggacucaguaccccccaccaccgccuucauccgaggaauguccccaaggcaggaggggagacaugccugccaucaauggcauucucugcggggcauggacucugggggcucuaaggggcuucuguaggggggacaugccccuggagaaguuagggcagcuuauggaagcccuggagcuccagccucaccuggccaaggggaccccaccucuuacagagcagggcccagccucccuccauccucccaacucacagaggguggaggagcagggaaugagagcacugagccaguggaggacagggcuggggggucugggggaccugccuucccagcuuggugacucagggcaggcuccgcaccaucucugagucauucugaugucacccucacaucucucacuaaugcugccuugcacgacccaccccacgggaggacugagugagcuacacggcugcugccuucuacuuggugaagaagacacugcaugugucccugguuccaggccgggccuccaaggauagguccucugaggggccugcugucugggguucggugggguaggcacugucaggucucagauaggccugccuguguggcuugggggcggaggccuugacacccuccacuaugggcaggagagaacccaggagaggugugggcagcugcaucaggcugcgaggggcaggcugagggcaggaaggcucagcacagggcuuaccuggaauuucuucuuggccacaaaguacugcaugcgucgaaugaccuuaaugguggcccgaugguguucccgcagccugcaguggagagaggagaggagauugugaguggccacccugugcuggucauccccucacugccccugcacugccugaggagcacgcagacuggauccuuccagaaacaaggagaguguucaacuccaugggauggagauacuuaggccaugucccagugugggcucgaggggaggcugggggcaagaggcuuuucaaggugaaauguuucaccucaucugugagugggaaggggacccuuaccuugagugucauucagaagggggucagguaggagucagggcccugaguuggccauggcuaugcugcugacacauggcagccauagcaacuucuuucuaugcuugggccuucaggauccuugucagcaaaugggauaagaggguacaugcuggcgaugcccacagccccuuucagcugcuguguccuguagccccacaaacagcaagcgcuugggaaaguaggggcuacaggacaaauuaacaagggaaaguugccaccagagccacucuguuaagggggcugcgcuguuuuugccuccuaaaguuucuucuagaaauaaagauccuuuuagaaacagcaucacaaaaggaaacaaaggggaugaugugucugugcauagaaaaaagacuggaagaaaacacagcgccauggaggccacaggagauucccuccuggcagugaagcuaacgccugccugacuuuccugauggaaacaccagggacugcgagacuaagugaugccaacagcaaggaacagcugugugaggcuuuggagaccaagaaagacauagaaggugaggaucccacauagaaaggaaaugaacugagcugcgccugcauccgagcguuuccuccucagggcacuugucaguuuggggagcacugacacccaacagggugggggcccagugggcuagugauaaaaauguggaguccagggccacaggacagccaggacacgagggaaaaagauucugguccucuagccaccuuucacacaacuuccucuggaaacacuugugaauuccuaagccacacgggugggugagaaucacagaaacugagcaaaaagcaguugcugaagggguaaaagcuaagcagaguacucaguagacgcauggcacuguggagagaagcuuugggguuuagaagcuaucuagaaggcagccccagaaacuaagcaaugccaacuuuccaucacauuaaccccaccucucucaauccccuacuggaguaaggugcuuugcgcguggcagaagaaaauaaaauuaucuguagggagauaauacccucgagcaucuacaauuuuauacacgaaagacuaaaaggcaagggaaaagagagaucauacagaucuaaaggugugguacuuccaacagccuuaaauacuugcagcuccuuccauuaagagauggagucuguuuuccuauuacuugaauuuggggucaccuugugacuucacugaugaaagaguacuggggaauguacacgguauauaauucauguccuuuuggaauguggcccugcaaacaagcuugcugauuagagaggccacauggagaagagagaggccucagcuaacagccagcaccaacagaacaaccuccuagcugaaccaaguccaaccuccuagcuaagcaaagaaaaaaaaaaauacacacacacacacacauauagauggagucucgcucuauugccaggcuggagugcaguggcacaaccucggcucacugcagccuccgccucccggguucaagugauuuuucugccucagccuccugaguagcaggugcacaccaccaugcccagcuaauuuuuguauuuuuaguagagacaggguuugaucauguuggcuaggaugguguugaucucuugaccucaugaucuguccgccuuggccuccaaaagugcugggauuacaggcaugagccaccaugcccggcccaaagaaaauauuugaagccacuaaauuuaggucuaguuugcuacgcaacaauagguaacugauacagaaauaaggacuaagaaauagguaaugucauaucaauauccuaaaacuuacagcauuaauuuugggacaaggaauuggacagaggcuggaaggggcagaucacaagaugucggacuuugagcaugaugccacauguaauugggugagaauuuuagguaucgucgggaggggggugagugaauuuugcauaggggagaaugcgaaaaguuauggccagagggcagacugugauuaauuaaagaugggcacaauccauugugguuccucccauugcaggcuagagucuaucuccaccaugguggaaaugaucaugucuucugaagcucagccucaaggaccuuguggcaucuacucuuacccucuuagaauucuguuggcucauggacaagucugagcuagccugcuggaacagccgcgugaaggagagcugagagacccuggcugacaacccaguggcuccagacacgugaggacaacagagaccacucagccaccaccacaucaccaugcaaguacugccaugucaucgaauccaagugagaccacccaacugggcagcccagauugcugacccauagauuugugagcuaacagaugauugugcuuugcuucagaauauuuagaugaagacuucaaaauaaccaugauaaauagguucaagaaaauagaugaaaagauagacaauuuuaccagagaaauaaaauuuauagauacauaaaaaggaaguuccagaaaaguaaggaccauaauggaaaugaagaaugcaauaggugaguuggauagcagggacgacagaguagaaaagaauagcugugaacccaaagaaaauagccagcuuggagcaugaaaagaaaauagacuuaaaggaagagaugaaacaaaugaaaaagaagcauaagaugguagauugcauacauuauaaguggauuaauagucuaauuaaaagaucaagauugucaugauuaaaaacaacuauauaaauccacuuuaaaauauaacgauacaaaaacauguugggaaaggauagaaaaagauaggucaugguguagccaaaugaaaacuaguaaaggaaaaccaauagcagacuuuaaguauuacuaaagaagaauauguccuauuuauaaaagugucaauucagcaggacgagaucaauucuaaauuuguaugcaccuaaaaacauaaccuuaaaauacauaaagcaaacuggcagaacuaaaagcuaaaagagaaaauggugggagauuugaacacaccucgucaguaacugauagaaaagcagucaaagcuuugucaagucagagacaaauuugaacagccugauuagcaacuugacauauacagaacacugcucccuacaacuggagacuacauaagcuucccuagugcacacagaacauguaccaaaagagaccauaugcaagacuucagaagcaaguuccaacaaauuucaaagcaggcaaaucauauuuauuaugcucucugacuacaguacaauuaaauuagaaauccauaaaaagagauaacuagggaaucuccauguauuuuggauauuaaacaaucuaaauaacccaggggucaaagaaaaauauauaaugagaaucaaacaacaguuuaaauuaaauaguaauaaaaauguaagguauuaaaauucauagccaaauagguacugaaaguacagugaaauaagcacagacagugaaccucguggcuuuaaaugcauaucucagagcagaggaaaggcugaaauccaucucaagcgguuaaaaaaauggcaaauuaccauuugccuccuaccaaagauaguaggagggaagagauaaaguuaagagcacagucuaugagauaaaaaaugaacauuauuuaaggaaaaucaacaaagccaaaauuugguucucagaagagacuaauaaaacagacacacuuuugggaagacugaucagaugggggaggggacacaaaugaccgccaucaggaguuaaagauggaaugucacuauagaccuagaggugcagaaacauuuauucagaggacauuacaaacaaaaauacuuuugaugauuuagauaaaauauacaaauuauuuaaaaacacaguauguaaaaguagacacaaaaacaaaaauaauccaaauugcccaauauuaauuaaauaaguuaaauuuggaauuuuaaugaucuucuggcaaagaaaacucuguaucuagacgacaucaccaguaaauucuuccaaauguuuaaggaaaaaauaaugucaauuuuauacaaguauuuucauaaggcagcauaaccuugauaucaaaaucugacaaggauauuucaagaaagaaaaaaaaaaucacagguuaaucucucucgugaacauacgugcaaauauccuaaccaccaccagcaagcugcauguagcacugugcccaaacacaugcucgaaugugguuuaauccacuugugcaugcugaguuuacccucuaaggaccaagcagcgucacucuucacaucaacagaauaagucagaaaaaauacaaucaacacaacagauuguaagaaagcauuugauaaagcgagaccuguucauaauuaaaaacacaacucucagcaaacuaggaauagaaacuccauuaccuaaaaaaaaaaaagacaaaaacuaaaacaaaaaaacccaaacccuaagcagacaucauacuuaauagugaaaugugauacgcuuuccuccugagacaggaagcaaggcaaggauguuaucguuucuauuucacauuguccagaaacucccagcugguauguuaaaaagguaggaaaagggagauaaaagguacaaggauuggacaggaaaaaauaaaacauuuguuauuugcaaaugacauaaccauacauguaaaaaaaaucccuaagaauccucagauaaacuguuggaauacaugaauuuaacaagaacgccgguuuuaaggaugauauauaauaauuauauuucuaggccugacagaguggcucacaucugcaaucccaguguuuugggaggguggggugggaggaucacuugagcccaggaguuugagaucagccugggcaacauagugagaccccaucuguagaaaaaauaaauuuaaaaaauagccaggcuuggugguguguaccugugcuucuugcuacucaggaggcugagaugggcggacugcuugagcccaggagcucaaggcugcuguaagcucugagccuggaaugcagagacccugccuuuaaaauauguauauguauauuucuauaugcuaguaacaauuagaaaauaaaacauaucaauuacaauagcaucaauaaccauaaacuugaccagaaacuuaagaauaaaucuuucaaaaaaguuuuuuguuucuucuuuacugucuugcuuucacaaucuuucuuucuuucuuucuuucuuauuuuuuuuuuuuucuucuaagauggggucuuguuauuuugcccaggcugguuucaaacuccugggcucaagugauccucucacuucagccucccaaguaguugguauuacaggugugagccaucguacccagcucuaaaauaaaucuguuuaaagauguguaagacugcuacacagaaaagcacugagcauuggagagacagauaaagaagcccuaacuugacuuggggauauaguauguucauguauaagaagacucaauauuuauaagauguuaauuuucugcaaauugagguguggauuaaauaugauuccaaucaauaucacagugcuuuuuguuuguuuguuuauuuauuggaaaccgacaaggugauucuaaaauauuccuaacaacgugaagggccaagaauagccaagacgaucuugaagaacaacaaagucagaggucugacacuccuaggguuucaugaggccacagggcuugauuaagagcgugugggcagacagaugaacagugggggucugacggaauagggcagugguuccccaaccuuuuuggcaccagggaccaguuucguggaagacacuuuuuccguggacggggugggguggggggagaugguuucaggaugaaacuguuccaguucagaccagcaggcauuagauucucauaaggaguacacagccuagaccccucacaugugcauucacaacaggguucgcgcuccugcgagaaucuaaugccaccacugaucugacaggaggcggagcucaggugaucacguucacuugccaaccgcucaccuccugcugcacgguccuguuccuaacagucuauggauggguaccggucuguggccuggggacccguggaauaggacauuagacacacaaacccuccuguggccacugguucauagaaaagacgccuuugccgucgagcuggcggaaggauacgcuuuucaauaaagggugcuggaacaauguggaugcaccugugaaaguaugucaaccaugauccuuaccacacaccggucacaaaguuaacccagggagagucacaggccuaacuaugaggcaaucgggccugucgaagaaaguuggauaauauuuucacgaccugggaugggcaaagacgucuuuaaaggaacgcaaacaguaugaacuguaacagaaaacuauuugacaaauuggaggccccaagaucuccgugauggucucaugaaggccccccucccaggccugacacacgagaggaacuauuacccuggccucacguccuggccucuuuccaucaccccaaacagccugggagcaggcagggaacggggagucauaggugccugaccgugaagggucuaccacuggcugucacuuagggccuugggagccuguggccaugaccgccaaggucuggaugcggccccacauccagugagaacacucggggcuccucagauccuguucugcacagagggccaugccccguggcugcuucacaggccgcuagaagcugcugcgggccuccccuccugccaacucccuagaacacagccggagccuucacaggcaaacagccggccgggacugcaagcagccagggcugagggugccagcccaggcccccagcucuguccaggccaugcugugggucagccacugcucuggugacagcgcuggcuaccuggcuuuucugcugaacacaguccacccuguggucucagagagaagggcccggcuugcuccuuugcaggggguggugucucucucucugucuugggcgaggccugggauggggccaaguggccuuuccugguagugauacggaagaggggcagggaagugcugggaggagaagggcgggucccuggcuaggguuccacccuacggccuaugugcacggacccaggugaggacagacauuucgguguuucugcccaaauguugcauuucccgagaacacccuggccugccaugcucccaucccgugccuauaaagaucucgagaccuuagugggcagacacacaagcggcuggacaucaagaggaacacaucggcagaagaagacacaagcggcuggacguugaggguaggucgagaggaacacaccagcguaggagcacaccgacaggcaccaacaggcaccgacaggccggcagaccauugaccggaggaacgaugaaggguuuggcugggguggacgcaggagagcccaggcugcugagccgccugaugccaggggaaaaccacccucccacuccaucucccuucuugcucccccaucugcugagagcuaccuccacucaauaaaaccuugcacucauucuccaagcccacgugugaucugauucuuccaguacgccaaggcaagaaccucgggauacagaaagaccucugcccuugccguaaggcagggggucuaacugagcugacuaacgcaagcugucuauggacggcuaaacuaaagagcacccuguaacacacacccauggggcuucagcuguaaacauucaccccuagacgcugcuguggggucggagccccacaaccuguccgacuguaugcuccccuagaacuuugaguaguggggcacugaagaagcgagccacaccccugucacauguccugcaagggggacaaggaaaccuuucccauuucaguagcacugaugcaggagcgagcugguaagagacagggggcaggacggaggccuugggcucacugggccgugaaggaagugaccccuggacccugguugcaggaaggcacugagggcccggggcuggugcccuccugccugggcugggccacccuccaggcccguggcuuccucaccuacugaagggcggauggacccucucccugcccgcaccacccagcuugggagaggaggaagggacgugcugcccagcgggggcuuggccgugggucagcugcugagaaaagacccgcuucauucaucuccucacucauucaugcacccacugaccuguaucucaccuguucauucauuaaugaacaaguuauuguuaauaauuuguagaugaaugagaugagcuccccacccccauccgcugguucauuuguuaaugugcugccuaacuuacccauuagcuccuccacgcccgccugcccgccugccccguccacguacaugaagugccgcugggcacacagcccaggcugaguggucucaggggcugagcccacugaaggagccguuguuucuggauaggucaaauucaaagccaggagcccccagugcugcccaggcugggcuggcuggggugggggcugcugggcugcccaaggggccagcgccacauucaacacacgucacugggggccaucgaaggacacugugggaaagcagaggcaggaaguuucccggacugggcugcccauggcgggccgaccuucccaccuguggaacagauucccagcagcucagcggccuggccuccauccaggcagauccugaggcccaggguaggggcuggcaugugggagggcuggaggugacuccaggggguccuggggcuuggguccaguacagcucaggguggggcugggccuggagaugcccaggguggaggaggggcuggccucaccugugucccugagccuucagccccucccaggaccucuguccccucucccccagccagacaauuaagucagaugcaagccccuuguauccacccugccuggacaagcucucggccccuucuggaggauccucuaacucuggaauaaggaagaauuuaucagcuuugccugggaguggagauggaaagaaaauaaggaaauaagagcucgcucccuuccuucccacaugcuggggugucgcucuuugcaacucccucccgcgcagugaggucccacaccugugcguccuaggagacacagagcugucuucaaaggcccgagcuugggggacccucuaaguggccacagcgccuuggggaaggaacauccccuggggaccccugcccucugcacacaugcaggcuugugagaugaagagaggcagaugggugggggucuuggcagaggaaacccagagugcuggaggacccaggagacaugaagagggaaacugaagucacucuacgucacaucccccuagcagccaccucguaggcaugagggccuugcaggccuuccagacucuuccuugagcacuuaugucagcagacacaagcacaucacgugugugguuuccugcaccucccaguguguuguuuugcuucuuuuuauuuugaaacaauuauagacuccuaggaaguugggaaaaaaaaaaaaaguaccaagagguccuguaugcccucuacgugaguucgcgacggucacaccuugcauggguggaguaacagaucaacgccaggagauugacauugguacagugugcguggcucugccuuguguucacacgugcagauucacacagcaacgaggaauggaaguccuccccaccagaaagacccccucugcgucuccugugcaagucacucccacccucaccauucccaaccccaggaaccaccaucugaucuccaucccuacagccuggacuuugagaauguuaucuauacggaaucacacagcaugcgaccuuucgggggaggcuuuuucuccucagcacaauucccguaagauccgcuuagguuguaccgauaguggguuccuuucuacugcuggguaguguuucaggguagggaugcaccacuguuugccuguuccccuguugaaugauacauagauuguucucagcuuucagcuaguuaggaauaaagcuucuauaaauuuucauuuaguuuuguguaugaauaugagucuucguuucuuugggauaaaugcccaggaggaguucaguugccgggaugugugguagucgcaugcugacuuuuauaagaaacgaccacauuauuuuccccgagugcugcaucaguuuacauucccagcagcaacagaugggcaaucccguuucuccacauccucgccaacauuuggugucaucauuacuuuucauuuuagccauucugauaggugcguagugaccgcucacugugguuuuaaucugcauuuccaucuuugcuaacgaaguugaucaucuuuugguguacuucuucccuauuuauuuucuuuggugaaaugucucuucgugucuuuugcccaucuucuaguuggacaggcuguuuuuuacuguugaguuuugagaguacuucauguucuagaugccaggugucaaauauguggcuugcacauauuuucuccaagucuauaguuugcauuuuuauccccuucacuggggcuuucacaaaacaaguguuuuaaguuuuaaugggguccauuucaucaauuuuccuuaaacagaucaugcuuuuagcauccaaugugagaacuguuugcccuuccuaaauccuaaauacuaucuccucuauguuuuuucuaaagguuucagaguuguacacuucauauuuaaguccaagguggcucuugaguuaauuuuuauauaaagugugagacuuaggucaggguuuuaauuuauuuauuuggccuaugaaugaccaacugcuccuguaccguguguugaaagaggagucuuccuccgcugaauuuugcaucuuugucuuaaaauuagucaggcauguuugcgugugucuauuucuggauuccucguucuguucuguugagcuacaugcuuauuccuccaauaucaaaucauauugauuccuuacuguauaguaggccuuaaaauugguagagugauuucucccacugaauucuuuuucaaaauuguuuuaaucuacagcaugugccuuuccauauagauuuuagaacaaguuuguccauguccauaagaaaucuugcuaggauucuuguuaggaauuaugcuauauuuauagguaauucuaaggagaacugaaauguuuacuauuuugaguuuuccaguucaugaacauggaauaucucuccauugauuuaggucuugauuucuuucauuggcauauuguaguuuuuaguauauacaucuuuacauguuuuguuaaauuuauaccuaaguauuuuaauuucuuuagcgcaauuguaaaugguauuguuucuaauuuugguuuucacagguucauuguuaguguauagaaaugcaagugauuuuugugugcugaacuccuaaguuccagauauuuuuauuguagauuccuugggauuuucuauauagacaauucuaucuuugcaaauagaaacaguuuuagauccuccuuucuaaucuacaugucccauuucuuugucuugucuuauugcaguggcuggaacuuccaguacuauauugaauagaaguggugagaacagauacccuugccuucuuuuuuauuuuagggggaaaguauucuguucuucacuauuaagugugaugugauguuagcuguggguuuuuuuuuuuuuuuuuuuuuuuuuuuuuuaagaugcucuugaucaaguugggaaaguuccauaauagaucacauuaauuaaguuuugaauguuaacuagccuugcauuaccuagaauaaaucucucccgguugugcuaauauaauuuucuuauaaaaugucauauaauuaguuuuuaaaaacaauguagaaagcucccaaggacucguuauucaaaauaaacgcuagacggccaggugugguggcucacaccuguaauuccagcacuuugggaggccaaggugggcggauugcuuugagcucaggaguucaagaccagccugggcaacacggccaaaccacaucucuacaaaaacaaacaaacaaaacacaaaauaaaugcuggacccugacagcuccaccccaacuguauccuugucuccccuauccuggguaaccaucaaccugaauccuguguuccucucucccuugcuuucuuuuuuaauauaauauuauugaaacuauaugugucccaaaagucauguuuuuuuuuuuuuuuuuaauuuuaguaauuuaaacuugauaagaaugcagugggcuuuuccuugguauuauauugccaagccuucccacaugguugucugucacucuggcuuguuugcuuuaauuaguuuaaaauucucuuuuguaugggcauuccauguuuacucacucucccuccugcugggaggcaaguggcugguugcacguggagcuugugaacagcguugcaacacacacuccuguucauucucacucguccacacaccagaguucccuuuugguguaugcccagauaugggacugcugggucaacagguaugugaauucaccaccuuggaggugaugccacccuuuuaaagugguagucccacuguacacucccaucagcaauguaggagagacccugggcccuacaucccugccaccgcucccaauggucagacugugguuuaugccaauggagugguguaaaugguuucuguaaauggugccuucacguacucacuggccacauguguuccucgaccaugaagggcagaacaagucuuugucuuuggccauuuuucugucugauaauuuguauauuuauugauucguuauuuuaguuucuauuagugauuuuauugguuauacacacacauauauaaauacauuauacauguuauguauuaguuauacauacaccaauucuuuaucaauucauuguauugugaauauccauuucuuugguaggcagaauaagggcucccccaaagauguccuagaaccuaugaauauguuacguuauauggaaaagggacuuuguaucuguaauuaaggucaugaacacugagauggggaaaucauauugaauuguccaggugggcccaauuaaccacaagucuuuaaaagugaaggcccuggccaggcacaguggcucaugccuauaaucccagugcuuuggaaggccaagggugaggugggaggcucacuuaaggccaggaguucaagaccaguuuaggcaacauagagagacuccaccucuacacaaaauuaaacaaaauuagccaggcgcgguggcacgugcguguagucccagcuacucaggaaguugagguggaagaaucguuugagccagggaguucaagguuacaguaaacuaugauugcgccagugcacuccaacccgggucacagagcaaaaccauacaacaacaacaacaacaacaaaaacaacaacaacaaacaguggaggcucuuuccuggcuguggucagagagagcugugauuacgaaaaaaaaugucagagaggaggaacaugauggcucugaagauagaggaaggggcuaaaggccaaggaaugcagacaaccccuagaagcugaaaaaggcaaggacacagauccuccccuaggaccucuagcccuaaugacgcccuccagccccaucagaccugggguuggaccucugaccgacagaagugaaagagaguaaacgucuguuauucugauguguguugggggucaccuguuaaaccagugccagaaaacuagugcaaucgccagucugcaacuugucacguucuuuaagguaucuuuggaugaugagggauucuuauuuuguaaaaucgaauugaccaauguuuuucuuucacagucaaugcuuuugugucuuguaaaauaaauauuucccuaugccgaguuauaaaagauacuaauaaacguauauuauccaguaagaguuuuaagguuugcuuuuaacauuuaauuccuagauccaccuggagucaguuuuuauagauugcaugaggugggggcccaacucuagcuuuuuccuucuggaggaugauugauuccagcaaccugcaacaccuccuuggucacaugccaaugucccacauuuguauggaucucuucagggcucucugucuuguccacugggauaaugggcuaauugucuacccuugugccuacacugcaacaucuuaguuaguauagccucuuccacauccugauaucuggaaggcagggcccuuccuugaucuucuugguuauuuuuauucaguucuuuauucagccauagaaauuuuagacucaucauguuaaguucccugaaaaacccacuggaggaugccugggcugcaggugagaggcugggguggugagaaagcccagcagaggcucuuucuggcaccacugccugugcccacugcaugggaacacacagacaugcaaugggcacaccccuccagggcccuccuccagauacauggcauggcuagccucgcucuggcaguccacauccuugccaacacuuguuauugucuuuuuuguuuuagucauccuacuggguguaaaccucacugugguuuugaucugcaucucuuuaaugacugcugaggcugagcguguguucaugugcauguguuccugugaucauuugccauuuguaucugcucuuuggagaaaugucugcucaaguccuuugcccauuuuuuaauugggucaaugcauuauugaguuguaagaccucuuuguauauucuggauacacaucccuuaucagauauacaauuuggaaaaacaacaacaacaaaaaaaaccagccacagaugucucaguuccuuguguuguaauggagugagccucagauagagggaagcugggaaguuucucaaauguguguguccccggccaaaggaauacaccaguggaugaaagaagaacuagaguaagguccaggggcaggaugugcagcagucacaagccauccccauggggccugguauggcuuuguaccugggaugcaagggacauuuugagggugaugaaaaugcucuaaaguuagagagucgugaaguugcaugacucugaauauaccaaaagccacugagguguauacuucaaaaggugcaucugacugucccagaucacucccagguggcagguacuuugcucgggagagaggcaggcuccagagggaggggacacagagcagguagggaggcuuugagacauccccagcuuuccuggcucugcccagggcacaugccuuuucugggagggagcccuuucucagggggaucagggacccaggcaggaacccucaggacagcagcugaagcuggccucccuccuucccugggcagacacggaggccucugaacucccuauuugggcuccagccucaccccuuccaacccaucccccugaguggcggcaggaggggcuuuccgagggacagacugaagaucucgugacucccccgccucagauacuguauggcuuccuacugcucauguaaugacauccacacuggccggguggccugccaggcuccucgcaaccuggcccaaaugcaacagaaacagagcuuguggcugagagaguucugcgugaaugcacguucucuccucccccuggguugaugcaucacacaugacacuaagcaugugugguucuuacgucuuugugagauuguuuucauaucagcgacccacagaggagaacgaucccgugcugguccucaagcccagaccagccagggcagaccuuccuggcuggcagugaaauugugcgaggauccucgggagagguggcugaaacagauucagcaaagggaacucauuuugacauaacccagaaccgaaagaaaggaaccaguuuccucuguuuccccaggagcaaggugcuguagucugaaugugugugucuucccaaagucccuaugucgaaagcuaacccgcagcccugaugguguuaggagauggcgcauuugagaggugauucggccgugagggcagagccuucaggaagaggaugcgugcccuuggaaaggaggccugagggagcuuguuugcaccuuauuuuugccucuucugccacgugaggacacagcccgcugacuuccaugaaucagacagaccccuuaccagacaccagaucugcuggcgcccugacccugugcuucccagucuccagaacaaugaauuccuaaguaugaaucaccaggucuaagguauuugguuauagcagacugaacagauuaagacacuagguaucccaucggaccccccgagagaccaccuggcacacaccagcuaaacaagcugcucaaugaaacucaguuuagcuuaguccggaucagcuucauggaagccacucaacuggguucagaucagcuccauggaagccacucagcuggguucagaucagcuccauggaagccacucagcuggguucagaucaccugugaagcuaaaaucaacccagucaccucaacucaguaacacucagcacaguucagcucaagucaacacaacacgaugcaacucaagucaacacuacacaacacaacucccaagcucggcuacaaacagucuugugguggaaacagggaugaccagggugagugcugccuaggacggccccucagggcguggggaggacagggcaguacaagguaccccagagaggugccaagguggcagcggcaaccgagaaagugcagcuuugcagaagagcaucuuugaggaaacgucuugccgugugugggcauccacgaggggcucagaggaaggucagccaugcuauggggggaauagggcaaagcuggccgggccucauguucugcaagugccauuuugcccucacccugagccagugggagaggcacucuguguaggggacagggcggcugaacaccuuggcuauggggaccagucccuggggucccgaucugccugcccuugcagggacacagcgcaucugcagaugcuuuaauuuaaaaaccaugguaacgcuacgcucaccgagggcuucccugggacagccaccgcucucagaacagccgccugucagacgagggucgccgccccguuugaaagagggagaacacacuaguggccuguuggccgggauggugcccaccagcagugaacucagaugcucauuucggagcugcacugucccuccacugcccucugcacugagacgcaaguccccgcgucaggagagaggguuuccuggggguggaacgugggacagaugcucacuuugggcagcugcucagccuugccuccccuuucccauagagcccccuuccgggagcccacccgcuccuaaacgcuggcguccguuucugcugagagcguggggcuuucucugcaaguggggggugggagaugaggguuuggaugagggugugggaggacccuaaacugauucccaugcuaguuggagaaagaaagguguggaugaggauaaaguuuucauggugaccagggugacccuccgcucagagggacgagcggagcccggcaaaaccagucacugccuuguaguuccaagcuuuggggaugaucagcucccaagaaauugcuguggggugcgggggcugugggugacccaaauugggcagagggccuacaggucugaggcugccugcacagagccaccaggaaggagcuagcgaagaaauacaucuuuguccuggcuuuuucccaggaggggcugggugggugcacagacagagguaaagagccucgagguugggguguaggcaggcagcuggggaggaccccguuuaaauccuggggagauuaugaggacguuugucgcaggcugucagcccucauuaaguuaauggaacuggcgaguuggccggcuuccagcaugccggagaaagaaaacaagaaaaguguuuucagugaaagagccaggggaucccauuucgcccagcagcccaggagauuaugagccauugguaauggccugacugaaaugacuuauugggaacugguugauuaaaacaagggagagaaaaccccuaaugucucagaagaaugacaugggcuucuuacuggucuucgucuagaaaagugauuugugagcacugccuuccaaagccuugugaauugcaaagcaacugguccagccagggccucugcagagaggguuaccaggcaggagaggaaaagacguggggugaaaccgguggauuccacacagacccugggagccagagaacuuggagcuugggccagcaggagccuggacauucugcugggaaggcuccccagggccccuaaggaaggcccagcaguucacagagcagggcuaaagccucccauggauucccccaacugguuaggccaggccagccacaagcccaacagcuauacccccgucucccauguccuccgcccugggcugagggcucugucguccuguuucagccuccggcccaauucuucccuggaauacaugucauuccucaacuuccccagagauccagccccugcugccccuggcgcugaccuggacucugggcccacagugccucacucaggugggguugcgcaggucucuccccagcuucaccagcaagaugccccugcacccaggcuccgcuuccuggccucuuggcuguucccacucccucccucucaccccauuuucacucauuuacacacaauucucagggcgccguguagagccccuguacuuuuuauuuuuuuuuuuuuggagacagagucucacucuguugcccaggcuggagugcaguggcaugaucucaacucacggguucaaguguuuccccgccucagccuccugaguagcugggauuacaggcguccaccaccacauccagcuaauauauauauauuuuuugagauggagucucgcucuguugcccaggcuggagugcaguggcgcaaucuuggcucacugcaagcucugccuccuggguucacgccauucuccugccucagccuccugaguagcugggaccacaggcgcccgccaccgcgcccggacaauuuuuuuuuuuuuuuuuuuuuuguauuuuuaguagagacaggguuucgccguggucucgaucuccugaccucgugauccgcccgccucggccucccaaagugcugagauuacaggcgugaggcagcacgcccggccaagccucggugcuuuuaaacacauguuaacuccucgaucauucccguuguacgaauaagggaacuggggcccagagaggcucagcagcgugcccagggucacacaguuggcaccaggcagagcccuggccuugggaucccccauucccagugcagacugagugacacugagcugcuuccauccucaucugugcuugccccccagccgaggcccccgacaccccucgauuucuaggucucccaaucucaaccccaaaccccucccugcagagcccuggcagacagguucugacaccacccuggaaaucauggcauccucucauccucccuacuggggugcuggcggaacagccccccauuugguaaaggagacagaccugaggucucugauguuuggccuggccugagccuccuuccuccugcggccccaugugugucaacuguagggccaccagguuucagaguuacuuuuuaugcuaucaguggcaacagggacuugcuggacacagccaccacucucuuuccuugcuccagaggccucgccccucccgccauuuugaauagcucacgucaaaggcagcacagccccaguuagacucaaggacagggugacaaccgcaaagaggggaagagggcacucuggaggucuggggcugccccugcacacccagcugccagaccagagguggggaucuuggcccccaggggcaccauucaccuggccagaacacagucucuguagcucacagugaguucaagaaaggccuagccugccccugucacgugacagauggucuugaggcccagagggaggggcagcagcagcuggcuggacccgaagcucugugauccagccgggccuggcguggggagucccugcugugggcucuggguggccucugagcccccacauuccaggcuggcuggggcuccugcaccugcaguuucaugcuggguccugguugccaggcuugucccacccgggccccacaccuccacguggacgcccagcugggcccucgggcucaccuggaggaagaguggagccugguuuggcaucaggugcugagggcccugccuggggagguacccaggggcaucugauagggacccuccccaccagcacaccucaccacaucuacccaacacacacaaccacccuuacugggacagguggggcaggcacaccucugggauucacucugggagcaggcccugcguggacccagggugagcuagggggugggggcaugccagcuucaccagcauuccugaggggaacuugcuucucccucgcccgaggucuggggacacaaggagacagggcugacugcagagcugggggucuguguaggggucuuuccuggccaguucugggugucccaggccacugaggauagugcugcacuggccacaagcccagcccugggaaccugcccuuuccuaggguagagugugggugagccaugguuuucugaaaaucagauauugcuugcagagcccuaggcccgaguggucuucuugaaguauucugcuggugguggaagcagccgguucuggucuguuuucaagacggcuugcuucacgccagagggauuguuuugaaacacagcccuuaucgcuccccaucugguaaagcccggggaagcugguuccuggcuccugaggcugggcugccucaccugccuccagccagccucacccugcgugccucuucccaccaccuccuucugaucucuggaaccugcccccaugacccccacucccugugggcaaccaguccucccuuucccggcauucucuugccuucccaccauccuagccuguggccuuucugcaagaagccugcccagacguguccacccccaaagccaucuuccuuuccucugggcaccugugacaacagugaacuuauggccuucagggaacagguuguuucuugaggguccugucuuucucauggccguauuccagugacuggcacacgguggaugccuagugaacaagaauagaucagugggcacuggggcagccccagcccaggccagcagggaccaagcaccggcugccccagggugcaaggcugcaccgcugggcagaggagcagaaggcuggacgagccccucccggggccacccccaggccccagucuuucccucccucccucccuaaagggaaggagagguuaauaaaccaauuacuuugggcaacgaagcaaaauaagucccauuaaaguaauuaauguccuuugcacaguccccauuggagaagacuaauaaauuggggcuuugucaccauccgguaauuucuuucuaaggcguuucuucauccccguccaacagcacaguuuaaggcucuguuaauacuuuuaagacgggcucaaugccagacuaauuagauuugcauuuccaccaugggccaggcugggcucggaugugcccaaugagagaggcuccaggaccccgccagagccccagggacagcacccgucuuugagaagggccauguguggauucccacgccugccuggggcgguggcccauuacccaggcugccugcacagcuucccuauccccggggaaugggggccauggcuuugauccaggcagaggccagaccucauucccaggaggucccuuccuggaucuguccccaguggggcucacaggggucaccagugugauccacaucccagggucucucuagggccccagagccaaaugcuggcggguccaaggacagucugcaaagggggaaaagaacaaaucacaguugaagagauugacagccacggccucagagccaggagacagagacagcaucgcccaugacgagccacaccgacaggaugggcccucggaacagggcgaugagaagggcauuucccucugugcucucccuccucacacccacagcccagucgaaucgugaggacagcagcagacggauccuaguaagggacacccuacaaacaccugaccuguccuccucugaaccguccaggucaccaccaacaaggagagccugggaaacagucaccgcccagaggagcccagggagacggaugaggaaugucacaugggacccuggguggggcccggggagagaaaaaagacaguagggaaacugaggaaaucugcaucaagcauggacucaguuaacagucauguagcacuguuguuuccuugugacaaaugcauacuaaugugagaugcugauaauagggcugcugggggaagggcaccuggggacucuuggugccaccuguguaagaauuuuguaauuccaaaacuauucuaaaaucaaaguuuauuuaaaauaaaaaaaaugacggcaagaggcugggcauggugccucaugccuauaaucccagcacuuugggaggccgaggcggauggaucacuugaggccaggaguucgagaucagccuggccagcauggugaaaccccaccucuaccaaaaauacaaaaauuagcuaggugugguggcgcacaccuguagucccagcuacucaggaggcugaggugagacaaucgcuugaacccgggagguggaguuugcagugagccgagaucgcaccacugcacuccagccugggugacagaaugagacuccaucucaaaaaacaaaacaaaacaaaacaaaaaccaaauaguagugagggagaagaggcagccgaggaugagcugccuugcugcugccgccugcuccugguccuggccccgggcucaggccugaaggcggcccucgcugagcggccuucuccaaggcacgcuuagugagcagacaaggaaccgucagcaaaucccuguaucgugucagaggaagccccugccuccgccgggugcugaggcccagcagaaggaugacaagugucagguaaccccagccucugccagccccgcaccugaagacaugaggcaagaacauuaggggcuggggaaugggggccuguggucacgcugacuccuccugauaggaccgauccacuuagacaaucagcaggaucaaaagaucaaucaauagagcugauagaaaguaugacaugguugucaggugugagaucaacccccccaaaucaauggcauuucuuuauaccagcaauaaacuccugggagaaaaaauuccaaaauagcaggggaaagaaggucucauccaggaauaauggaagcaagaccccaccagcccuuucaggaaaagauggcaacagagguccaagagggccugacucaaugcagagagacuccuuguucuuggaggagaaaacgcaacaugagagagacuccaguuuuucccaaauuuaaccugcaaauucgaggcaaucccaagcaaacuuccaguugaaauuuuuaagaaaugcaauaaacuuaacuuuaaaguuggcauggaggaauaaaggucccaaacagauaagucaaacuuaaaaagagauuauuauaaauagggguuuaggagcucuucugggcauuagaacccguuucuaaaccagagcaucaggucuuggggugccgccauuguccuuccgaccagcagacuaucagugcaaagagggagccccgaucacacacccuuguauacucgggaacacacuagaccacaaagaugacaccaucgaccaccauagacaggauggaauggcugcagggcagguggggaaggggagucacuccacggaggaaaaggaaucuggauucuuccgaaugcaaaggugcaccuggacacgacgacaggccugaaugacaaaggcugaauuauaaauuucacagaagaaaauguaggaaaauacugcccaacagcacaugugacgaggccaaggguggaugcauucgguacaccguaauuuagaaauuuccauuuaaagaaggacgcaguucacauccuaagcucuaggaugaaggucucaucucuuuuguccucuuuuuuauccccagggccuaguaagguaccuggcauggcauggggcccaggaaacacuggcgaauaaaugaaugaaugagagagugagggaacgccaccucaugugccggcucugcgucaggagcaaccgcaaacaagucuuggcuaugccugcucucaggcaccucuugcaccccugcagguaucacaugcucugcaguacuggagcaagaaacacauucuucccucccagaaggcucugcaggagcucagcugcuacacaagcuggugcagccagugagcccaucaggggccagcuggcuaagagccuucucugagugccgcauugguguucccgaugccacaucgucuccuguuugagcagagacacuagaguggacacacgguggccuuuuauccuaaacaggcagggugcaagccugaguccccagcucccuguaauaaucucuuuuuaaguuugacuuuuuaaguucaaggagggacuaaacauugauuuucagaaugcggccaagaggguggugaagguaccauggguaccggcaaugggcugaugaugucccaagcuacgugggugagggcaggcaccuggggcugagagcccacgagagaccugcagucaagaggccccggaucaggccagaacgggcaggagcaggucugcaggccagcacccucaaggcccaccaggggaggccccagucugccguucugugacaacaccuguuuaccucccgcugaaauaucccacccuaccagaagaacccgcugccugugagauuccuuucugaggcaguccgcugacuaaacaggcauccgaugucauugcugggggcaacuccuuuuaggcucaaaggccugucacgaagcacaguugggccuuagauggcggcuaaucaagaaggcugguuaaagcugggaggucgugaaucugacccuauguagcugugcagacuccaggaaucaguaagagagggcugcgcagggcugcucuccuccggggagacgcaaguccccauagggccaugcagggacuggcguagggauucgagccccuucccuucccugcucaaguucucccucugggagcugcaugccggggagcugggagggaggccacagucagagcaacagccggcaggcaaacugacaucuugggcccugagcucuggguaaaagcugggauaauuucuaccccuaagugaaccagugaguuggguggugggccugcucugaggccugugccagggccugaagggguggggucuuaccucaugaaugcuucugaagaggugaagagagacacccagcagcaccucagaccccaccuucuggaggagcacagggccuugaagacccucggagucaaugaggggccccgcaugguacgggagucuaggugggcggugggcucacaccagucaucccugugauuucugggaaugccccuucccucucaaacaugacaacugggucuccaggcccagaucugcccaauuguggccaccugcucuaauguucaucaaagccugcucaggccggcuguccucacaaggagcucuccaaaaauaugaaaaauucacgaguggguucaggcaaaaaagcugcucuccuggaucugaggcaagaacaaaccaccugcacucccugugcccaccuggcaaggguggcugcccacguggccucucgguccagucuugcuggguggcugccacaccacaggugugggggcucggagcacuggauuuccugugggucugccugcuuacucgggggucccuaagccgcuggccuacuuuguuugaccugcauucccucagcagccgugcagaggaggccacagcgggcccccgcgcauggcugucaggaccgccccgaauucagcacauggggaggggaaggccuccuucucuccgaggcucuuguuugcaaagcuuuagaggagccagcaggacagagccuggacaaacaccgagcauccucagccccagaaaaccaaaucgguaaacauuccccugccaggcauuucugccccugauugauucagcugcaaaguguaaacugccccgagaaagggccggggggagcccagggcccccaggaccagcauugggaugaauccaccacaugagugggcacagcugggcaggcagacaccccacaggcaugaaggccccacugcuguaucagggugcaguggccagguggccgugaguaugagacagacugcaaaugggcacauggggaccggcuugagggccugaggccgccugaugccucucauuguagcugauguaucugaucuuggggcacagggcuuccccugcccuggacugcccugcccaucucauagaggcugauucuggccagcaccacccagggucucaaaucauggugguaccccccaagccacccgcugcagggauggucguucugugcaaaaccucuguucaccucaaggucagggcagaggcagggcaagucuguuucuuucagaacuuauuuuucuuccuucuaccuucuaauguggagaaaaccuaaccaugucgcagcacccagcagagugucuugcaacagguuaaacagucaacgcugacucauauacaugagagccaagaguucuggggguuacaaggcggcagcccgcccuggggcagggggauaggaggggcgcugcugggggccccugagggcuucugcagauggugacccacccuggcccugccugggguggcagagaguggggccuuggccaggagaaggaacuggacccuccuaagaaggucaaggaggaaaaccacaggcggaggaucccuggaagaggcucccagccccagcugucugcgcgcccgcagcugccccugcaaggaggccggcugugcuccggcccgagcacagcuuccucagccugcccccacucacagcgauggggugauaauugcaggccaguggugguggaaugcucuggaauguucuaucaguaagagaggaggcuaaagggcaggaggauagagacccgaacagagcucaggccuggguuggaagagggugagcugggagggcugggccuggguaggggauaggcuguagguagaagggauaaacaggggcacaggggacaggcaccagguguggacaggggucacacugggcaugcguuugugcguacacgugugcagccccgagggggcacacagggccuugcaagucuggauaauaaaacaaaaagaaagagcaaauaucuccagggccccaaugccugcugcacacagccaccccggcaagcgccagucagaccucucuggggugacugccugggccacacagucacucagcggcagaguaaaagucaaaccugcccucucacaggaggcccuguccucacacucccuccagcucauaggggccuccccugucucugaggccacccugagacacucugaggccugucugagacucaccagagacucuugacuucccccggaggcagcacugccugagcuggucauguguccaagcaggggcugcagggagacacaggaacaccccccaccccagggcgcccccaaaggagucuaugcccuaauccuuggaacucacgcaugcgucacucaauuccccuuugccacuugauuuccuuugaaggggaaucaaggcugcauggaauucaggcagccaagcagcugaucgugcaauggggagaaaauccuggguucucuggguggcccaaugugaugacaaggguccugauacgggaaagaggcaggggaucagagucagaggaggagacguggccgcaggggacgcacagagucugugaugugaggaugccaugagccgcagccgccuuugagggugaaggaggggccaugauccaagggaugugggcgccccuaggagcaggaaacugcaggacagggacucucccuagagccuccagaagggaccagcccugaggacaccuugauuuuaggccaccaaaauuuuggcgacuuguuccagcagccacaggaaacuaacccaggccccuccagagacccuggcuccagcugagcugaggcccccaggaggccuggguccacccgcucacauucggggccugccaggaaggacuucaaagcccgcgugcgcuguccucuggguggggcugcaucggggucccucgccccaucugucacucauuccauaucuuugaacaccuguacuauuguuugcuuaacauuguuccuuaaauagacucuguuuccuuaucuaaguauauuuggagagccagaaaaaagugacuuuaagugaaggcaguugucgaacauacacaauaaaaagaagaauuugcugaauuuguuaguugcccagcagcgucgaugggcagcagcacccacuccccaucccccacccucccuccugccauuccuggaggcuccucagaggccaggcccagcccaucucacagagggguaaagaaguucuaacguuucucaugguuugagagcaaccagagucacuggcacccugggcgccaugcagggcuugccucugucuguucagggccuaggcagcagcacgcucagggugaagccacggggaccaggccggccagcuccgcacagcuccacaaggagccugcucuaguccccaggggcuacugccgcauggcucaccaccccaccugcacacccaggccucagccccagugacuggaucccacuggugaggccucugucccgacccauaggggcuggccucccuuaggacacugcuccaagcuacaucugcagaaaggcuuccaacaaccugccccuccccucucucuguccccuggacacggucaacuuggccaauaccagcugggcaaggacaccauacugacagggccggcaguccucggagcagccgaccugccuuaagacggagcaugucagcuccuggagcucugcgggcccagugccguggauaggagccauggcugggcugacaaacgcuggggcagagugagaacaaguucuuguuaaaaaaccaggacaccaccagccccuggucugagauggaguccucagccuuucuagaaugaaauggugguauuucauuagaguaauguuguucuacgaaauguccuuuuuugcguaauaaaaauguugcccaccuauguccauccaccuuugggggugggggaauauguagcggaccuuugauggggcugugacauccaaauggcugggaaccacagauagggcagaaacaacugccgggugcacauguguuaccaugugaccucaggcaaucucgggccugccaccugucaucuguggcuuugguugguccaucugugugaugggcucucaguaccucacacaggggcuggguuggugucaccuguggccaguggccaaguaugagccagccaggaugggugggggcccugcugcgacccuggcccucccagacaugcugggcacacaugugggguaccugccugugccagacgcacugcacacacucaaggccaccccaggacaggggaugucagucccacuucacagggaggcggaggcagcagagaagucaguccuuuuucaaagcagcauggugguagcagggcucgagccauccucugcagaccccuggacuccaccuguaccaggguccccccaagccccaacccugcuggugagugacagccugcaccucgcucacccaccuggccgcaggcaccucacugcacccgcaacaacagggcaggccuggggccagcgucugaugauagcccacucuuuggccugcugagugucugcggaaggccagugugccaaugcccagguggcagaaggacaauccccccagggucugucuguguggccagugcugcagcccacguucugcugggaggacagccuggcccagcuguggggcccccaggaaaagcagacauccaccccaccccugaacacccaggaaccgcacaggccccucuccaggcuaagcccugcaucuccuggugacucgggggcccaggagggaugggacaggcugacuuggccuccuccagccuccaagggcacucugcucuaggccuggcugggaguggggggagguuggccauggcucuggccagggucucugcccccagcagaggugagcagaagccugagauucccuugucacacacgcuagugccaguggccccgaccugcugcauucucacauggcgcuuagccuggaagaaggaucuucugccucuuuccuugcuugguacaaaugucaccucccucagagagccuuccuugaucucccggcuucaugauaacacgucugcccacccccauggccaaggaacccgcugugcccccacacuccagacccugccucccccugggcucaguaaggaacccgcugugcccccacacuccacagcccacccccaccgagccaggggcucacuucugcccucgucucuccucccuccccaccauuuggagcaguuucuccuuuccucguucaucuucuccauuuccugcccugaccacaggcccaggcuccuggggccagcaguccaggccaggcucggccccucccagcaguggaggagggugugguucucccuugaaucccugcagcccaggcccagggcccugccuggagcaggaaauggaugaagcugagaggacccagugucauucugugcccccaggugugccuccccugggcagggggcaccaaccccuuucccugccuccagcccacuccuguauuaugaccgccucacauccucauguccaugaucacaacagcaggcauccaucacagaguuagggcugugacggucgcacccugcugcagccccacucucccuggcagcgagguggacauggcauuaauagggacuuugcugugaccccauaucccugccgggcucggacccaccagccguguuuuauggucugcgagggccgagucagcacgaaggcuucccggcauuuuacacaaagcuucuucgccgugaacggagucaaauucacucacguugggaucauaaauauaauuaggagacuuuuauuuucaaguagcacuucugaaaucuauaaaauuaagcuaauauacugauuuuuaaaacacaagaauuuuauugcucugugagucagaguuugccagcccacaaggccaggaauuaacuccuugcagcucgcgggcauccagcaggccuccaggggcccccgugggucugggccugcugcacccacuugaggugcacaugccccaggagagcagcuuccugggacagagagguggcugggcaguggccggacauccacccacacggcagcagcugcccggggcucucccucuccaccggcaccccuucacuucugugcugggugcccugggaacaaguccagaugcucucgggauccagccucugcuuacccuguggaauacacuccccccagaauuucccugccugccuccuccucuccugggggaguccucccuaauccgcugcccuacccugaaggcugccccuucccgcugggaucucuucuggacccacuaauggaaagugguaccccuggcuccuccuccuggaauaaugggauccccgagcagggagugcuggcgaggggcacucaggaugucuugggaaggcaggcggugggggucgggacugggcuuccucagccacccucggcuggcacuucaggguagcccgaggcaggcccaggcucugcgccacuccccaccugugacuguggggucccugagccgugggcaucuuaucuugaccgaguuuucacccuuaggccccaccaggcccagcagaggcgcagggcgcaugccagccagccaggaacccaccagggcagccgcauaccagcugcagaugcgcaggugaaaugggaagccgcccuuugcucugggccacaccuaugucaguggcggaagaucacaagggacaccuggaaggggcuagguugggguuugcaggcuguguaacuggggggugggagggacggcccuaagcaagccgcuauggcgaugagcuggcauugacucccucaaggguccagcuccaaagcccccuccuagggccauuggcaccuagcgccucccauccccaaagugcaccuucucuccaggcacgggggccaccgucuaaccccagaggccccucaggcucucccaagcccacuggucacaagucucaggaagacuccaaaaaauccagacuccccagaggccugggaccugggcccucggcacuccagggcuccaacuauucacagcccccggugggccccagaucccagauacggcccaagcucggucgccuuuaaucccauuagguccccaagacuuagaauggaguuucaacuggucccaguccucuaauccccuggacugcugguuaggaaaggcuuccuucagauuugggagcacaggguaaacugaagggcaggcaggaagccugggccccuucccagguagguucugcccaaugagcccccucuggcaucuaaaguauguauaaggaccaccccccaaccccaggcagcucaugggccuucugcacacacauacuggagggccaaggagcccccucgcuucucugucccuuuguacacagggaaggggcuccagacacacuggaggaagggcgugggguccucucacccaccuccuccugccucugacugugacugugugucuggagauggggucuuauaagaaguaauuaaagcagaauggggguauaagggugagcccuaaucccaccugacugggguccuuaugagaggagaaggugacucgggcacacacagagggauggccccaugagaacaccggggaaggugaugucuacaagccacggagagaggcugcaggaggacccagcccugcagcaccuugaccuuggacuccagccuccagggcugugaggggaugaaugccugcuguuuaaacugccccacuguggucuugguggugacagcggaguggacucaugucaucccccagcuccuccaagugcuccucaagugugcucaacagaaaauggugaggagggagaggguggugggccaggcccuaggaugccugcgggguguggaugggugggugaggggcacuucaggacgguggcugaaugcaguggaguguggcuucaggcaucccuggccuaggaggggugggaaggagcaagcagugguugggcucugaaggaaggggagaagcuugcgggaggggaggugggggcggccauggcccacccuccaccgggcagggccucaauugccauuagccuguccccaccucccaccccagggccccaggcaucucuggccauccaggggccaggcugucccccagggccucagggcaaguggcgucucauagggggucaccaucaaggagagcccccugagcagcccuucccuggcucucacacacagucccucccuguccugcugcggcgcugcugucagguuucacacguuuuaugggggaguucaauguaagccagaugcgcgcugacagccacggcacaggugaugacaaggcagggcuucccuggcacaugugccucuuguuagugugcccuccgaggcgcuuaccccaccagccuggggcagcgugcacagccggcugggcacgcggccacuccggggcacaugugucgcacuggaacaugcugcuggcccagaagccuccuggagacaucaccucugcgguggucccagccggggccugggaagccacagccaggccccagcacaggaggucaucccuauuucacagugggggaaacugaggcuggaggaggcaggaggcccauccaacacgguuuauggcggaggagcgguggucuugcccucgcuucugucuacauagcagcuuccaggauuaccucucaccucccuggcuggcacugaaugugccugggaccugacucaucucuucaggaagcuacccccgagaccugcuccuacucuccaguccuucagggccucggaaaaccccuguuaucccccacccagcagccgcagcaagcauccugagaucagccucgacagccccgcuccccacaucuggcucucagccaaggggcccguccuacccugcuccccacauucugcccaucaccaaggaucccguccugccuugcccagcacagcuggcugcggggccccggggacagugcucccccgaccugcgguggccggggggcugugaagcuuccucauucaacccauccauugcuccccugccucuacccuuggugcuccccgccaccucacggaaaguccagccuucuaggcgccuuuuggccaccccugcccugcucugcagcugggcuccggccugaggccucuuaggaccugacccucccaaucugccucuggccugugcuuuggaugguucauucguuuauucuuuggacguccaccaugcaccucucacacacaccugcgggcccuggggccggagcaggaccaccccugccagugcuagacaagcuugaaacugugccugugaucagaggccagaaccacuagaaaggcaaggcuggggcugggagaaccgcaaggugguccugauuuagagcgcgcaacugcucugaggaggauguucaggggaagcguggguugaggccugaagacucaagaggauuaagcagggaagaggagagcgugugcauguuucggggguggugcgccuggcagggcaggggaacagcgggcgcgaaggcccugaaguggggggggagagagagagagagagagagagagagagagagagugagagaguguguguguguguguguguguguguguguguguguguguggaaggccugaagucccccuccugcccgcuagaccccucuccacugccucugcccuccaggaggcucuauagcuucagaucugaggccaagagggcagcacacuuggccuggcuccucccccagggcugcccaggccuggcuguucuuccucucaaggugcccaccgugcccgacugucucccuaggagcugccagcagcaaccucggggguccccugcuacucuuuggggucccuaugcucuaccuguaucuuugcaacuagaaugagucccccucacuagggguaccaccuauggcugcugucccugccugacaccgcccagggaagccaagccguggggagggccugggccagccugucuggaaggaagcugagcaaaggagacugaggguuugugggaaagugagggucggggucgcagugaaggagggcgaguguggggagccccuguguugagugcagcugagaggccugaguggggucagugcugauggaggaugccccuucccucuggacacacaaaggagcacuagggaaggcagagagaggccugggggugggggugggggugggaguggaucucagagcucagggcucugcucuucagaccccagcugcggggccagagccguucugagggacacuggagacgugcaaggcugggugaugccuccuauuuuacagagggggaaacugaggcuccagaagguaaggggcuggcuccagguggaggaugggcucagguguggcugugucccagacccccucuucccaggacccuggcuggcuugcugccuguggguggucaccagcccccagcaggagccucgaguuucugggccuccagagggugggugggaccagagccaccccugccucaggcaagauggggcuggggcccauggggcaggggagaccgccagggcagggguccccucccugggccccagugggugggacagaggcccccaggcuccggcugcaaggcgaggccucgguggcggccacaauaaauauguuuguucaagggaagccaggcugggagcugugugcgccggcccggugaggaagaaaaggccgcuugugccuugcacacuggggcgauuguuccugcucacgcaacugcugccccguggccggaaaggucagacggcccucgggccccgucggaagcaccggugccucgggccccuucgcucgcgccugcuguaacauucgccugcgcuccucacugcccggcugcauccacaucaccuccaggccuuggcacggggagagaagguaccaggcaaggucugaaagauggcccagcaaaggcgagggaagaaacgaagccaggaguccccugcccagcccaggcgucaggaauaguguggaaagaggaggccccagcugguggccucagcacccugagggaguggcucuggccccgagggucuucgcagugcccacggggcagcuuguuuuguggacuauuguuuggauauugggggaugccaaggugaggguuggggagaggcccaggagcacaugagaggugccagcaaugcuccugaggcaagaccaagcaucguccucacccaccaaacagaaggcugagaggcacugccuggccgcagccccgcuucagagcaaauggagucgacagaggccaccacgcaggcacuccuggcucucccacaauuuaaaaacccuaaagggcaaaaaucaggaacucaagccugguuuccucccauuccucugaagggggaggaaggaacacaggagcccacggcuugcaggccacaccucgcugguccccugcuggcaaggcggccucccucuccucuccucucugcaggagacagcucugugagauggcuucauccaaagggcccucagaauugugguccugauggugaaggcugugagcagccgcugcaguggugugaucagacgcucuagcugagugaguuacccaccacugucuuccacccggaagagcugggagauggggccauaggagccuccuggguggcuggcagaggggacagggacucuggaccagcccuccccucccuugcuucaggcgccuuucucugggccucaggcccuccugugugcgcugcugggggugauucuaggaaccugaucuccaugaccacagggucccccaaaagaugggucuguuccggagggcuugccucaagcagcgaaggggacucugacaugggaggaaagcccucuccugggugagaaccuggagccgcaccuccugucccgagagauggccgcccuggguguccgccuucccuguguccggugcccgagugggcguguggugggcggccugcagugcuggcucccuuucccaggccucucccgcugacacacagccggaaugugccagacucaccaaggccugaauucccgaggggucuggcaugccgacugugggacgagggcauuugggcauuguucucuccaugcaacaguggggugcaugggcggugaggccccuuggauuccgccugccacccuuggcuuuaugaagcugcaccaggucugacucaggccuugaggaauucagcacccccucgagugggcacaggggacuguaccuaggggcugccucccucugccaggcugggcaacgcagccccugccgugaacagaggugccuggcugcccucucuuucccccaggucccugaggaccuuuggguccaagguugagcugugaggccaaaggaaguguuugcucccaaugcagggcaacaagggccuuccuuuucuaugagcaaagcugggcucccagagagcggcggcugggaggaggcugggccggggcucucauuucuguaguugguucagcugggggcagccucugguccaucuggccuggugcccagcccugcuucuggccacagccacagaggccugccaccaaaacggcuccagcgucugucccccaucccuccauucuucccuccucugcccuucgaaaccaccauuacugaagaacccugcgucucccaggggcagccccucuuggaccaccugcagcaguucauaccauaauccgccucccccaggguaauggggccuggauagggagacucuguggccauacaggucucaccucugcacuggaugccuagggacaaaguccaccugccuccuggggccucccaggcccccugcagucugucucugccagaccccaccacgcugcuauugaccggcuccuccagaucaccccugcacuccccauaagagaaagagggaggaagggagguugugaagagcgcaggacagaagcagagacaagggggccguggggaaaggccacaagccaagggagguggggccucccuuugagcuuccagugggaaccagcucugcuggcuccuugaauguagcccaugucggacaucugaccuccagagcuguuagauaauaaacgugucacuuaaagccacuaaguuugugggaauucauuacagcagccguaagaagcuaaaauggucccucucaaaacaguccugaaucuacuacuuccuccucgcccuccugguccagcugccauccuccgccuggacuagugcaguggccucccuccuggucugccaggucugucccagccccucagugguccauucuuggcucugcagccagagugacccuguugccaucugcgccaaccacaccgcacucggggccagccagggcuucacguguccuagcucucggggucccagcacaugggucuccuugcuguccugccagccugugggcccauccccacuucagggccuuugcuguggcuguacccucucuccacaaugcucuuagcccugacaccaugagauucaccucgcuuuggggacacuguaagguccuccacgaccccauccacaacaggccccuuccccaaaccagcccugccugucuuuguuuucccuuccaagcacucuguagauaaauacuaaagugcagcugucccucagcacccauggggaccucccgcagguacccaaauccacagguacucaagcccccgauacgaaauggugugauacugacauggaggccacauacauccucccaucuccagaccacuuacgauaccuaacaacacaaaugcugcgugacccacucuauuguuuagggaauaacgacaagacaaaaagccuguacaaguucagauguucagcacagaugcaacuuucuuuccaaacauuuuccauccacaguugguugaauccauggaugcagagcccuuauacgucucccauugguggacaucccuuuggaauuucguaucaguuuuguauugucacugcugucccuggcaccuggagcaggcauucaguauuuguggaguaaaugccaacacaucucacuuuaaggacuucacuaucuucuuucauuuaauccaccuggcagugcuacaauguggggacuuuauuacccccauuguauaggugugggcaccgaggcacagagauuugucacguccagggcagucacucgagcccgcagcauggccuuagcccuguggcagggggcucaagggagaaagagcuaggccagaccagcccuugccccuaggccuugcuaagcagcuucucggcaacaggucuggacccucggccccgggagagcccagcucauggguuccuggcccgagcgcccuuugugcccgccuggggcaggcggggggugggagugugcuacauaaacgggcuauuguucugugacuacaguugccagcccugcaugcacaacagccccugugucugcaguggcucccagaaccaaucaacaccuuaucacgagcauuaaucaccccgcuaucugccccaaaucaggcaaacacuucuggggacuucaaaccccugacugcacagaaguuucuguguaauaauagauuaaguuucuggugguucagcagcauccacugcggccggcccucuggggugcugaggggccaagggcugccaggaccaggaggacgcucugcuccggccucagcuccuccugagaugcuccuccugcagcuggagcccucagggacuuccugucccccuggcacucugggccagcagaaccccaugcccaacuggccacccugagccuccguccuguaggccagcuucugggaggaugcaguaggcucaggccccgugcccucacgcucccaaggcccggcucugcuggugggcugugccagaguguuuuagaaucuccuagaggaagugaccuggacccuagugggcgggaggcuagcaagccagaggcugcagaauuaguaggaagccagccuagcucuugucaccaagcaccaacccccgguucuagagucaaacgcucgguagguccuauagaaaaagcagcuaaccaguuggcguucagccggcugugguccccugagggcuggcgccgggucaggcauagcacugugaacaagaguccuggcccuggccucagagcacagccaccuggggucggacuuacccuacgaggugccaggaagagccuugggaagccacagagaagucagggcagaagggugggcgaguggccgcuccagagguggagggggcaaaagaggugaggccugugugaggggaggacagaaccaucggaaguccuggaagggauuugugcaaaggcccugggcaagaacacucuggaaggagcugaaggacgaggagaaggccagaguggcuggggagggaggaggggaacagggaggcaaugaggcugggaggugagcgggagcggucacaugaaccucacgcaggguaagaggguuagauuuugcaccacauaugauggaaaugaagcgcuuugacuagcgcggccccgggggccaucagaugcucccucugccuccacagcaaagccccacagugcccacagaggaacgaaugccuggccacgucccugccccuucauagugcaagacgagcccacaccaggccaggugcuugguguuguacaucgacaccguuguggaauccugggcucugucugcucgcccuucugcauacagcccuucuccauucagcucacucugcccuaggaggcugaucucugcagguuauguccacaagcuccuggcccagggcuucagauugggucuagccaacuggaccccuggcaggaggcaaggagggaggagagcggauccggggugucugcuccugcucccugccguggagcugcuggggccaguugugagccucaugucagacagccaucauucuguuaagcucaggcaaccuccuccuccucuuuauuccucgagucugggguaggauuucccccagggacacuaccccauguuccugcacaaggccugguggucccugacaccugacucacacaggaaugauccuugggugccguccugcgccccacacguagcuaccgugauugucccuguuuuacagaugaagaaacagaaccucagagagggcuugagcugcccugggccccugagcugggauucagacccugaugugucugccuccagggccugagcacaucccccaagcugccuccuugucccuaacaucuguagacgcugagcuuuugaggccucuguugcuccagagccccacugccccauggcugcuccuuccugaaaucuggcuuaugucugucucgcuccuacaggggcagauauaucacaggaccuaagagguagaagcaaaccuaacagggcagaggaaagggcauagcacaaacccccaaccaaguggcuuaaguguccccucccugcugccgaccuccaugcccagggccaacccuucaccugggggcagggacagggcuuggagagucaggauuggaggcaaauguguucccuuucucacugcuuuugggcuucaaguguucugcugggagcuacuugggaggggccucuggaagggcagaccuggcgcccaugccaguggggcacgggggauaccucucugccaagcagugaggagaugggcacagucacaggagaagcacauuccaugggaaagccggcuuuaaaaucacuauuucccccguauuaaagucagcuccuauucaggccaaugcagaaaaauaaaauuuugggggaaaauauaaacuacuauuccucccugcuaggaaugggucauccccuuuuucucuggccucaguccaccagaucuucaccggggucccacccagugucccucuggacuucuggccaccucccucacaucagccaugguggggcagggguggggugggggacggcuggaaccugcaguggguggugucuccgccuggggccucaguuuccccacucugacagggcagcauccaucuccugagcugugucugugcccuuuuggaaaccuacugcuggcccaggaagagcaccacccucacucgacacaccgucugugaucugaggaugcugcaguucccccaaacccauccaggggcccuaggauccucaggucagggggccaggcagccacuccuucaugaagacucccgcccaucuugccacgucagcacacaucucgugagcgagcucagcuucucugggccacugcccgggacccacccuuggccugcuccucugcccuggccagcuggaagcaaucugccuggagcaggcaggugguccuccuuagugggcucccaagaggccguccccagcccuucacccacgcagagguggcucuguaugcauggcugccuggggccccuucucugccggagugaaccaagugcucuggaauucaugaagaaaucaggggucuuuagccugcuguuuuucuuggcgaggccuuaucacaaauuaguggggaagcccgaagguuaggguuucaguuaguucagcagaaucugaggagcggggaguuggccuccugccucuccaagucagaaaacgcuuggccuguggggccccagggagcucucagagcccaggaugauuaaccaggcaggugaccugugcuuugggugggggcggggguggggccugggggagauagcuuucacacaagcugacagguuucacaaagcccagugaucucucguaccuuccccaggcugcccucggcuggagugcacagccugugggccuggggcuuuggcacugaaggcagggcagggcgcccagccucauggaaaggguacguucgggaagggggcgagggcaagucugacuuggguuccaggggcagcccuuugaacuuggcgacuucacgugaaugcacuuccuaaaccacagcuaaacgcagagguucuauaucaguagcucgaagacgauuggggacccccaaccggacaaauggcaggucaccuccacgcaaaaagugggcucuucugaggaaaaagcaggccaaguugccucuccuguuuuggaaggcaggaacccgaaagccaaaccacuaaguauccaccagccacucacgaacucaaaaaagcugggaacauuucuggcaagcgcuggucccguggcugagcccccgacccuggaguguuucacaaguccagccgucugucccggauggauucugggaacuugucuuaggcucaccacugggucugagcacagauggccgucggcuuccuccugucuccacgucaggaauccgugccugccccacccugcccuggcucuccccuggagcugaaacggguccagcacugcuucaagacgugagcuuguuuaggagucauugucugaugcuucucagacccugugcuucucuauugggcccacaggcuuuucuuaaacggacagggacccugguggcacaccaaguuccaauccaguggcuccugauagccacaccagacccugcccucggcacccuguccagguuacuggaucagucaucucuacccugugacagagaccaccguguucccauuucacaguugagaacgcugaggccugguaccuuccagugccuuguuccagcuccauacgauggccagaagcuucagcccagugacuccacccucugugggugaacuggccccuucccccaacucugagcccugguucuguugccugugucuccuugggcagguccccacguccuccucugugagcccaggacaaucacagugucgccuccuggggagcgaagugagagggaagggcaaggcuugggugcagcugcaauggcacccaaggggagaagcuguguuuccgcgggaagggguuccuagugggguccuuccuaggugacaaggccccuucugcccucagugcagccacggccuugcaggacagccugcucgcugccacccaccacuucucucucuuugcccucccacccuccuuccuccaagggcaguguuagcuugccagggaggguucgaggccuagggcuggcgggacagggacccuggcugccagcuccauuccacugugcagaaacccaauccgggcgggaggacgcugucacuccugaggauuuagggccgucaccugguggagcgggagggcucuccucccugacagaauaagugguuacaugccgaaaggugacaccgcaaagggguccugagccgggaggaggacuguauaucaucugagccuggaucugugcguguuuuucuuucugucuuuccuuccuggucuccuugucgcggcccccuggcgaucuuaccagaacguccugguccagaugugauucucuaucaaaagccugggcccccaggcaccaccggaggggcugugugcagagguggugggggcugcauagauggaguacagggcucugugucagacacagagagccauguucugauuucugcucccccggugaaaagaguaaaugccuccacgcccacggcagauacaaaggcugagaugccccaucccugcggcacaucccccaacgugugacuuccucgucccgaggucccccuggaauccgugacuugcuuugaccaccaugucaugagcaaaugggacacagagaggcuggaguacaugugcaccgaguggcugggaacccugcggccaccagcgguuagugaggccccacuagcuaguagaggagaggcugucugccaagggucuucuccgggagcaaggccauccuagaccacucagcucggaccaguccaccugcccagccaaccgcuaggugugagggauucgaggcuguugcuacuucgagcugcugaguuugaggcuggcauccccucuuuggacuucaggguccucucuaaaugccacugccuccaggcccacugcuacaguaaggacagaacagcggaccagguguggggcugccuguguagggcuuccacgugccacagcugccaaguaccaccuggucucaccuaacagcuccucucucccugcccauucagcaagaaggguauugucacaucccacuuuacagauggggacaccaaggcucugagacggaggggcuugcuaggagucuugaggguugcagugucccgggggaggcugcggagccuccucgucccucacuugccccaacgguaaaugggacagggccgugggcaccuuguccagggcggcagggagugggguaagcagcuguggcagguguguggagcaccacggacaagcagcaccacaccccucucaggccaccacggaggaaggcggagccaagaggaaggcagagccacagaggaaggcggagccuguuuucaggauccgucugggauccccccuguccucuccgcucagaccacccuggcacgggaauggaggccaggaggcuuuugggccgcagcuggcccacaagggugugaggugagccugccccgaggcaccccagguggcagcugcagugcccaaagaccuucaucugccaguugguccugggagugacacaugcccccacccccacuccgcuaaggcagcacuugccauagcucccacucagaaggguggcucagauacugccucacagggcccuggugucaguuggcugagccuggugggguagagggaaggagggaggaagggucuuggucacagggcacagcuaucuaggggcagcuuagccaccucacuaaguuccaagaggcugccauagccuauuuacuaaacaggucaugacucccaaccacgugagaagggaagcacucucgguccgccacugccgacccuggcuacggcaucgcucucaucagcuccccuaggaccuccauguggccaaaccccacugccaguucuauucucagcuucagugggacccaccagccguggcugacaugcuggccucuccuuccuuagaaaaagcuccuccugggggugaccaagccuccaccuucccgaucuccuuugugagguccuccuugaucccugaccucugaaugcugcagucucugggcucaguuccaggcugcagcccccaugguccagcacucagcucccaggaugggcuggccuugccucguucuguacaaaugucacugccacagagaggcaugcacccgaggcccgcccuggccucccauaguccuuuccuaucuucacccagccuaccucucuccaccugucaacaccugguaagaugacacaucaccugggacccccaaaaggcaggagcaugcuggcuuuguggcuccccagcccugacucaccaagcucaggaccucaggauccaagcuugaucccaggggcacagggcuucccauacccugugccugccaggaccauaguaggcugucugugugggcccugcgaccccauggaggugaggcggccaccaaauggaggacaggaaagcucggcaugugccucccaggggcagggggugugcguagggacaggcuccuugggcuuggggugaggguauccccaggcaguggaguugggucucacuggaagucccaaugagaaguccacgguggggucucccugcacuggcaaaggggacaaggccucuuaaaggggccaagggacagauggauggauggacagacagcuccaggugaaccuccucggaggcucggucagccuccagccagggcugcugcaggccaggcaggccgaggggaccaucaccaccgcugcugucggaagagacaaacggccggaggccugccuggcgugaucugcagcaucagaaguggcccagagugaguggguccuccugaaacacccaggcucugcugcccccaccaacucuacgcgaggccucccaccccugcaggcggaguaaagccucccaaaggcugcugaccgccggaauguaaaucccuagaaauauuucuugauacaauuugcugauuccacucacaccuugggggugaaacacaucccuggaccugccccucuugcgagcuggagacagcaauuugcugaucugccagcccucugaggcagggaggcugagcuaggacugggaacagcggccucgcuacaaagcgcccagcgggagucggcuuauuagcugccucugaacaaaggcugcagaggcccgggggucccucacgagcagaccccugcggguagcuuuucaacccccgaagugcugccuuuuaacucgaccuccacgguaggacaaacagggggaagaaauuagucguggaugcugcuggauguuucguaacuugucgaguugucucccuggaguuggucuggccccagcaacauguccccccggcguccagaauggaaaacaugagacaggcccccaccaauccccuccccaccuuuuagaaacucuuuacaagcuuuaagaaacaaauacccuuucuugcaucuggggccuggcugcugcagguguccagggaccguccauggcucuggccuggaaagcugugccugcccgagucccuggaaaucugagagccccugggaugaggaaacccugggaacaaccucaucucccucagguagccaaguccccaguggccucgagguccaggccaggccccaacucccagcaaggccguuccccaacucaacaccauauaaugaagaaaacgaggaccauuugccccaaaugauccaagggcacgacuucccauuggcugagagggacacacuaugaaccccacagguagcauggacuccuagguucugggagccgcccugcaaaagggggaaggggcuggugguggcuaaugcuguuuccguuucaguggccaaggaggcuccccucuucagccuugacacccaggcugacacccccaacauaggacacucagagaaggacccacaggagcucagaguucuggacagguagggguuaauggcacacugcuugcucuggucagcccugggucccucuccccuuacagagagaggccaggugagcuucgagggggcugccucugcuucgagaggccuucuugaggccagcagcuuccuccuggccuucagcuguccccaggcagggccagcacaugcucagcacgaaggaggccugacuguagccgggccccggaaggcggcugagccagggaguacgugccugaguguacacauaggauggaugaggagagcugccaggacacucaagcccccaugagcccaccgauacuuuuuaaagauaacaaauggcaagggcacuuggcuucucgauucuuuacacauccaucaugcccacaguccauuuggaagacugugcugucuaacauacuagaagcgucuccuugcaacccuccaguggguuugggaacugaaccccaccucuuucagcaggagccccuccagugagcuggcauggagggacacggacaguaagggacuuguuuugggacauuuugcaguuugcuacauuugcauguauggugaagcggcuccaccuccgcccaggcgugcaaggggucagacccuggggucuuuugagugguucgcugaccuagcuauacaucugugaugcagguuugaucuguguccauuuccgucuuucugucacugaaaaugauggacuauucggacaccuccaagggccacagcuacaucagggcuguuuguuucucugaaaccagcacgguguuuggcuccgaagcucugcacccaggcccauucuccaacccaacacuguguggugagaaacacaggugccaauuuccccaaaugauccgagggcaggacuuccuacacuguccugcccugguuuccuuugcuacugcugggccuuccaccaccagcaaggcucgccagccagcaggcagcauuugggugauaacaaaugaggguuuucagcuggagaggauucucugacuucuuauuuugaucuguguucucugaacucugggauuugugugcagggggugauaaugguuuuuuuuuuuguuuguuuguuuguuuguuuuugagugccuggucaacacgucaaucacagucaucauggcucacugcacucuugaccucccaggcucaggcgauccucccaucucagcccccaaacagcugggaccacaggcacgcaccaccuuguauggcucuuuuuuuuuuuuuuuugguagagacagagucucguuauacugcccaggcuggucucuaacgccuggccucccaaagugcugggacuauaggcaccagccugugauaauggcuuuagccagcaccaccuucuguguguucuccuaaucuuauguacauagccauuguuacccccaaugagagacaagaagccugagacuugggaggucagcucugcacccgagagcacacggcuggagauggugcucugcgguuggggcuccacuugccacagggccuccugccccagcacacacucaggggcgggaggggggucacaagcguagaugaguaucuguggucuauggucccuggcagacgccaagccuucaccccaggguggggauucaguaacucuuggaauagcccaggaaucugcauuugaauggacuuccugaccuuaaggugcauggcagggagggugcagacaugaaggcccuuacaggcccaguaaugacccgggaugccugccuagccagcucucagaucccuguaguaaaaugggcaccuggaugcugaugggagugccuggcacagcaggguccagggcuuggucaacaccagcguggacauuaaccuuuuagugugguccuaacugcaacugcccuuccccugacagauauaaguggcccuagcccaggucaucuaguacggagccagcuggggagucaugcgucuacacaaagcacguagacgacuucuggacaguccaggccaugcaugugcuccaaggagccucagcuagcucagaugcccgaacuauccuccaugacauguacgagucagccuugcauccacuggaagccaauuccugggguucaucaucccuguccuccccucugcucauccacauccucagagcugugccccaugaggcuacggggaggggcuggugcugcggggaucaaguuccggcuucaggaggggcccugagguggaaacaggcaggugaggagggggucagccagaugcagggaagccagucuggggcuagggauggaguguggugaggcacccuaagugugggggucuaccuggggcucaggccccugaagcccagagcaagcacaaggugugugagggggauguggggaaggacggagcagaggaaggcagcugucaggggagggccucugggcugcaguggggcucucagcucccccgagggcagggagggccucaaaguguuuaagccaggacggggcacgcgggugucaacccggcucuuccagaagaggcagcuccacagacauugaacaugcccugagacuacacccaucaacaaaacaaaacaagguucacuucugcgacagacgcagcuuucgcagccuucagaaaccaaggaagccaugccagguguggucuuuacuccaugaccacggcagccccuaaaaugcugggcuaauaccccggggggcucaaaccuggaggcccuggggcgagugggccaucgggggagaggggguuccucuggcccaaggucuuggacaggcgugugcucccugcucuccagccgcugugagcugcuuuccugucuacccgcucucuaucucaggcuccccagugcugcccugcggcaccuccugccaucugucuuuccguuucugcucuucugaaagcuuguguuuaaaacaaaauuaagaagccaguucauacgggccuggggaacuuuccugaauauggggaugggaggauugggacaggaacguuccuggguggggccgugaccucccggagcuccucucccucacccauccuaagccaggcccugguggggcagaggcacuuucauuaaaagguucuggaagaaagccagggaaaaggguggaaaacugggaaacaggaagggaagaauuccaccugggcuacccagaagucucccuguggcuuugcugucuaccuucucaguauguagauuuuggggaacauuggcauacugugcgcagaggugugggcugcgaucacagaagccugggagggccuggcugucgaggcucucacucugggguaacccucaagcugacauccagcuugugauuccugcuccccaacagccuuugaaauggcccaggugacccgaccaagccguggggucugagggacaccaugccaggcccagucugugucgcacugcagccaucaguggaauugccugcccugccaggaguaggaaggaagacuuggguugucugcaagagcaccugggucccugagcagagccccggccacuucaugguggacaagcagcaccagagggcaggacaucuggggggcuguuugucacucagcaggaccauggcugugcuggcgaauacagggcccacugaacagcuccacaggcaccacugagguuccuguacucacauaggggauaugcacagagcuccuacugcaggccuggccuugggccagagugaugucugccagucacccaguauucaggaugcacuggguccuggcuccugccugcccucggcucccuccaaaugugggaagagaugguugcuuuggauccagaacaccagugcuccuggccuguucaaugcgggccacccaguuccaccuccugaaggagaagcaccgcgcugcccgugccuuucacggcugccuuccguaguggggaaucuggagucucuggggcuuggggccuacuguagcugagcggcccucaagauaagauuucugggaggcagggaauggaauuccaccaggcccugcagaacugaagcugcguguccuaacaccgcuuggcaagccaacccacaagagccugggugggaagcacacgccugggaagcuggagccuggcccuggaggcuggggacaaggcuuuucugcugagaaaggacacccagccauuccucgagagccuagcugaggaggcuuggggacuguguucuggccaaugggccaccuuuucccacuguggcuuggccagcugaccacgcagcuccacuccccaaagcugugcccuagaggguuccuugagagccgcagcacaucugaugcagaggguaggugugggcgcuucagcuuggagcuuuuuucugacuucuuucccuagugagaggaccgcuugagccuggcccggagaggguacauguugcuuugggguuauucacgaccccuccaaaagugaaaaauuguuaagugauacaaacagccauuaaugaggauccggcaaccaaaacgcucaagggaggcuaggaauaggggcuccgaccccggcgguggggucagugcucugcagacagcgcuugcccauuacucucagugcaugagaggucaaaggcagggcagccucucccagggccauuccucaccaagaggccagcccaaaggguuuggaggugacgugggggacagguuuaugguuugcaucaccaugguucccacucuggccacccccucuacccacucaaucacccaagcucuggcugguguggccacccucaaccucaggaggcugggaggcauuuagaccagcgcaaggcugcggggaugugggaugcggggcugcuccagcuggucaacccucacaggcagggccagcuggaauguggccagagggacagggugugauaugagggugccccagagggcuccccauacccccuuugcugguuccccuucccccaagagguccuucuguguuugaccaccuggggagucacagguuccaaggcuggcaggggcuuggaaggaugggucccaggggaccccagcaggggugguggaagaggaaggcuugggcacaggcauccccagguacacuccggcuggaaacgaagucuaccuggcugcucucuucccccugggccuucacacaugccccugccugagccaggcugcaggggguccucccuggccuccccccauucccacacuggccaacaaagggucuggguaaucugcaaagcccccuccugccccacuccugccugcucuguccaccuuccuggcuccuccgggguaagggcccuccaugacacagcccgcaggucuuuacagguucccuugagcucuccagagagcagagagucagacagaggcucagcaccaaaccccagcuggccacuuucuagcugugucucuacugaggcuccuuggcuguaaauggagcggguggcauggggugcccaugcugagguucaugggaggaugggugaggggcaucucauguuugggucaagacacuugcggucauccucgccaaguaucaucaguggcauuaccgccggaccccacccugcuacuccucaccagcaccaaccaccggcaaucugcccagcugcacccuggagcucugcuugugugacaccuggcccuggcuaggccccuccugcaggcuccccccuggcuuugugcccccauuagaguauccagguaacacugacgagcuggagagcauguguccugagggacccagaagucagguccccaggaccuccauucuuucugaaaggcaccucugucugcaucauucccuugcuuggggaagggaugccaccauuggaaagaugacgacgaugcugcagccacccucaagaugcucuccuaccccuaccaccccggccccaagggcuucgugucccuuucugggaugcuggcuacagcuggugccuucaccucccaggcguuugcaggugcuauguccgccaccuggcaugccgcuuccuccuuugagauuccaccucugugaagccuggccucgccccccacaccccauauguccacccaacacucccugcagcugugagcuccuccaucuaucuagagcaccuauggcgucacagcccugugcccagcccuggggauucagaagugcacaggggaagcagagagaagacaguucucacugauggcagaggggcuguccagcugcccugacuccacugccaccacacuuagcccuaccccgggagccccaacccaggagaguaccagagccuguggcccagcaggcagcucgcccauagugccugcugccucucacgggccugggagggggcugaccuugcggcucaggccaugugaggugagugggcugccagggaggugaggcccaacccccccaugagaugcggaaugcuggaaugcucccauuugacuuauccuguggaugagauggagacgcaggaccucuccagccugggcacugcgccugcccaggacugugcccuucagggagcaggccccagcaacaggagaggcucggaaagaguccuggcccgcauccuuggcgcucuaucucuguggagacugccugugugggggagggcugcaggccugggugccccaaggcgccccccacacaccccugaguggcagccaccuggagcucccugaguuagcaggaaccgagcaggaagcagagaacaaaggcgcggcagugagcggcgugcugggccaucgugucugcagggccaggcuccgagcgcgcguuugcccaucuggaagcaauauugcaguaauguaagacggccagaauacgguauauccucugaauccaugaacucuacagugaggaauauggauuuaauggauaaucuuaccagcagccaagagaacccagauuccuccccaggccuucacccggcacuuggcuucuccugcaacccagcucggccagaggcccgcagagccuguggcuguggccuccagaacaggggccgacccauaaugucagcucacuuuuuucucuugcugggugggucgagggagaacagaaaccuauccacggccaacaagggugccuguccuccagacccccuucccacagugggaaaaauucagcuggagaaagugaagaaauaauggggauggcgauuaaucaaaaucuacaauggcugugacuuguucuggaaucugggggagaagaaaccauuucuguagcucuucccaacguaauauagcuggaauaauaaaauaaaacaauaaaaaccacagcggaaaagaugacuggagaguuuuuauggcgagcagcagaggaagagcccagaaggccugagaagcgcagugaacaaugugauucagggaacguuuccagggagcggaggaggagcgggaugcagguccggcuggcucgggacaccaagcaaguaggggcuccaggcugcucaguccacggaagccacaucccaggcaugguccuggccccucuccgggaucucauuucagaggcucauuaacccuaauguaaaaucccccaaauaccaaaugcuucacaaaguuguuaauuucauggggagucguuagccugcugccuucugggugccccaugccaaggggugguuccucauacuuaccaggucucugguuccucauacuuaccaggaccccugccccacccuguuuacaacccgggugucuuccagggagcugaucuugcucugacaacugccuuggagggaggcgggggcugcaguccuuccauuucccaugcugccuccucccuguguccagcccccaaacucucuaggagaugccaugugugcucccaacccagaggcugugagggagucccgugcagaaaaagugcaggagccaggggacucuggcuuuccagccacuggugugguugcggauggcaaggaaggcugaggcuggaguguccacagggcucuccuguaggccugagcagggaugggggccuuagccagccccuucuucauguuccaaggggaauauggaagccccuaagucuccucaaaccaccuaagagagaagagugucuaacauuugggccgccagcaugcauucagcuggggcggugucuggccugguggcuucgggaauaugugggcgagaucuccacucuaucccuaaauaccucacuaugauuacugggggcucugcucugagucuccccacagcuuuccaggggauggcuggugagucuaacaucccccaggccggacuccuguuccugccccauuugcaccccagccccagcgaggguugugaugaucuccugaggccaggcugcccagcuagagucugcuucccccaggcaggggucaccagugucaguccaucccacacgguaacucccacaucuaguagagggccgggcacccagaaggcacucaauaaaugcaggggguguggaugaauagagagccggcaaguguucauggcuuaaaugagaugcaagcacaaaaccccacucagguuuccaaagggcuagaaagccguuaccuccuuggauccuggccucucccuggcucucugggaggcagggagcacagaaacgauuucuccuuuuuacagauggguagagauucagcaaggcugggcauaccauuuggcagugauccaauuugguccaaaaggacuuggcugugugcugcccaaggggauggacacaggugagcaggugagcagccccagccaccugccaccugccaugccucagggccagccuuucccgugagccaacucugccuccccucaaaggcacccuccucagaagcagugccaggacccucccuccuaagucugcugaguggauuugagacccucgaguugaaaggaaauuugaaaaauaaaacuccuuuguaagcugccaaaguucuauuucccuggugguaaagccuuaagauaccucacuuaguuuaagcacaguuuaccgauugugaggucugacugggaaauagcuccauuguacccacagacccucugugggacccugugccuugugcauggccgugggguacagagguuggugggauaguggagucacccuggccuccgagagccccguucugggcaggcgacacccaagguugagaagauuccacaagcugccacagagcacuuggauaagaugguggcucaguaagcccacaggagguguuucaugacggcucacagaaaagggaggagagagaacacuccaggcaggaugcaggaugugcaaagacuugggcaacaauuagugcgcaagacaggagaccacaaagaagcauuaccagaagccaagggccugaaaggggccaugagcccuggagucggggagagacuccaagggagaugggcuggaggaugggcagaacccaguacauggggaggaaguauggcugccagucacugucacacaaaacccuguaggauuuacaaaguagugcaaaaacuauacugaaaacuaugagauauucuugaaccaaauuuuuaaaaauccaaauacaaugaaauacaugcucuuggauuggaagacuuaacacauuguuaagauggcaauacuccccaaguugaccuacagauucaaugcaaucccuauugguaucccagaugguuucuuugcagaaauugacaagcugauuguaaaauucauauggaaauucaagggacccagaauagccaaaauaaucuugaaaaagaaaaacaaaguuggaaaacccacuuuccaauuuuaaaacucacuacaaagcuauaacaaucaagacgauauaguacuggcauaaggauagacaaacaaaucaauagaauaaaauugagaauccagaaauaaaccuucauauuuacugucaacugauuuuugacaaggguaucaacauccuucacugaggaaagaagagucuuuucaacaaaugguguugggauaacugucuauccacaugacaaagaauaaaguuagaccccuaccucacaccauauguuaaacuaacugaaagcggaugaaagaccuaaguguaagagccaaaacuauaaaauucuuggaagaaaauauagggguaaaucuuuuugaccucagauuacauguuguuauuuaguuaugacaccaaaaacauaagcauccaaagaaagaaacagauaaauugaacuucaucaaaauuaaaaaccuuugugagucaaaggacaugaucaagaaagugaaaagacaacccacaaaaaggaagaaaauauaucugauaaggaacuugaaucuagaauauaaaaaacuuauaucuagacuauaaagaacucuacuaaauaauaaaaacacaacccaauuaaaauuugggcaaagaauuugaauacauacuucuucaaagaagagauacaaauggcuaauaagaugcucaacaucauuagucaucggggaaaugcaaaucaaaaccacuaggagauaucacuucacacccacuaagauggcuaaaaugaaaacggcagacaguaacaaguguuggugagaauguggagagauaggaacucacauacacuacuggugggaaugcaaaauggugcugccacauuggaaaacagucuggcagauccucaaaagguuaaauauggagucaccauaugacccagcguuucuacuccucugugaauacucaagaaaaaugaaaaucuauguccacaauaaaaacucguacccaaauguuccuggcaguauuauucacuaauagcuaaaaaguaaaaauggcccaaguguucaaugaaugaauggauaaauaaaaugugauaauauccauaaaauggcauauuauuuggcccuaaaaaggaaugaaacacugauacaugcuacagcaugaaugaaccucgaaaaccuuaggcuaagugaaagaagucagccacaaaagucugcuuagugugugauuccagcuaugugaaauguucagaacaggcaaacccguggagauagaaagcagagccguggcugacuggggcuggggaaugagagaagggaaguggggagugacggcuaaagaaugcaggguugcuuuuaggggcacugaaaauguucuggaacuagauagugugaugguugcgcaacucugaacguacuaaaaaccguugaaucguacacuuuaaaugggugaauuguaugguaugugaauuuuaucuuaauaaagcuguuacaaaaacaaaaaugaacaccaaaaaauacaaaauaaaaaaaaaacagcccugcaggaccguagcaccagagcagacaccgagaguggcucccaauuccaggaagcccccgcagguccuggcgucugagccucugcccgcuucuugcugcacgguucccagguuugauauuucucaugcugaaagcccaggaacagggagccagaaguccucugcagcuggggcugggggguggggguggggggggccuggaagccgugcaggagagauggaggcucccacgcuccagggccaagcugacgugacuaaagcuaaacagaccccgugccacaacaggguuacagcgaauucugugcagcacacucagccgcucgccagugauggcagccucagggaggggcgguggagcaggcagccccaaagguaauuugcacacggaguuuauaaggccccucagcucuuuuaaacauaugcuucucugauuauaaacagcugauggcucacaagauucagauuuuccagcagggcuuccaaaaaaagauugcacuccaagcagagaaaggugaccgggugcuuugccgcagacguaaauccagccauguucucgcacagcuggagcugccccuguugccaggcuucgaacaugucacaucuuuaaaauguuugcugcuauugacaugucccaaggagggcuuuagcccuggccauuggccuggggagagaacagggagauggaaauggaccgccccccgcaacccgcguauaaacuguaucuucugccuccuaagagcugaggcugccugaaacccucaccucuugcucagaggugcuuagacccagaucaagggucaaaauuagaggcccuggggugagucuucuggucacugcccacccugugcaccccaggggucuccgcaccgacccucuugggguuggucccuuugcugccugccuggcccaccagggggauaagccugggcuccaccuccagccuccucagccccacccuccucgggggcugugggugcccugaagagaaguuacaaagaaaagaaaggagcagggagcaaaacagaaacgccagcaaggagccucaggaccacgugccuaagugagcucccaauucacugcuuugccaaguuccgcucagccaugccagcggcccgggccgcagacaccagugaggaaagggauccuguugagaagagugucaaagucaagucuccaaagcggcugcugaagaagugugcacgguggguucaggagcucucucccuacugaggaaagagucacagaggacuccccagcccaguuccauaaaaaacaauguuguguucaaguggaacaauucaugagcguggucuccugggugcccccgaucuuggccaucuguuugggaaaucuugggaaacaggggaacagcccugaggggccuggugcuuugggagguuggcugcccacaccaccuccucgaccugugcacauucacccggccacacacaggaacucugggggguggcacaugcagguucggcgcucaagaagccaaaugugggccaaggcacaccugcccugucccccaugcuccaugaaaggagcugccucugcaaacaggggcugugucccucacaccaaggccguguggcagagggggagggauagacccuggcuccaggauacccaggugcagcccagcucuaguagcuucuacauccuaaggccugcccaaucccuugaccuugcuaugccucaguuuucccaucucuacagugggugguaguguggaugaagcccucagaaccaugccugacauacuaagugcuacaggacuaauugggagauaaacaaagccucccugcuuggagugugccagugcacauccauuuaucgcucuccuggguccaggcugcucugagagccuggcaggucucagagcuggaccuaugaacugacggcccagaacaccagcuaggaguaagguuggaggcaggggcugccuggggguggggugggggcacaguccccaaaagggagggcucuuggaagagugguggcagcucugugcccaggcagggccugacuagggcaguucuguccuguucuguaacuugccuccugagggcuaaaggaauuucucaacacugcaaugucugcuuuuuauuccaguggacguuacagcagaagcaaucccugcuucuggcacaggccuguccccaagacccagggauaagagaaaaacaguagugagcuuuggugcuacuucucauccaccuacagcaucccaucaccaccccaucacaccugcucccccuucucuguggcugaccccaagagggcccuuugacauuccugggcauagaaaacaaauuugggacagaaguggcuguugagaaccccgcuccugguccuugugggugcugcccuuagccuuauccaugucccaaggaaauggauuugguguucucuuggggagaaaaggucacccguuacauuuccuaaaucacauuccaacugucaguuucucccacccaucacgcacccucuccacccacuccacccaaaaugccacagcucucugcugccuuagagacugcaggagucaaaaccgcucuccuuucugggagugggaccugcaccggggagugguucucacgaggagccuagguuaagagccacuggucuggugggcagaguucaaacucugcaagagcaaagacaugcuauguaugccuggggugggcaugcuaccugggcacaguacucuuucuccugggagccaccaaccaucaguaaaagccaacagguaggcugagcccacuuugcugccccugacaagggucagacuaagccuggugagaguggguggcucugucagcuggccuuugcugugugacaagucacccuacagcuucauuccuaaagcagcccacauuuaucaucccacaugguuucugugggcgagggaucuggggguggcuuggcugggugguucugaucuccugugaggcugcagucaagguguagaccagggcugcugucucaucagagguuugacuggggcuggaggauccacucccaagcucauacaggaggccauuuauaggaggccucaguuccucaccacaggaccucuccagagggcugcuaguguccucacaccaugguggcuggcuucccccaaaaucagugaucccagugagagggcagggaggcugcaaggccuagucuuggaagucaugcucugucacuucuuccauauuuuauuugaaagaagcaaaucacaguccagccaaaacuuaauuagaggggaauuaagugccacuuccggaagaacggauugucaaaggccuuguagacacauacuaaaaccaccacagccacacgguaccccagguagguuucccuuucuuucccauucuugucuuuuuccuccaaauuacauccaucuucugagccugccuagcuugauuagaauauucucuucagguucucuaaggaccuuuacugccaaugacucugcacccacugcucaccagaggccugguggguuucauuucagcagccucacccucuacaaguacagagcugggaauggaguaggcucucugcaaauaucuguucucacuacaaauaccgauccagggccuuuuaaugcguaaaacaaacuauaaccaccagagcgacagggauggggcuuuuuguuaacaccucucccaggacucaagagauaaucagaaacaacuucccagguuggcccuggcuguggcaauguccucaaaggccugggcccacuuuucccuggcaggcugaggggauuguucuuggcuggggggcagcuguggaaguggcaggccugcacaggaaggggggcacacaccccgagcuugggaugcuuugugggaggaagcugccucuggaagguggugguagaaaaggcccugcaggcaaugggucuggcaggcccaguucacuucauuuucccacccccccgugccuggcacccaaccaggccccaagcaggugcucaggagacagcugcugaguuaacccgcgucgaagugggggcucugggagaguuggguucggcuaaucaaggcuuggcugagcaaugcccaaacauauacacacacagcacagcugcccucccaaugggaacuggcccacaccccgugcugccacucauggagaccgccugaacuccagaccccccacccgucuggccucacguuaucacugaccccaaaugcaggaacgcaaaucugccugugaggacaggcugggagugacccuaacacagcacuguugucugagggcauuccccgagcagcccaugcugaggcugcucuugcaugggggcugagacuguccuggaaugggggauucccugagggagcaggaccugcaucugucacacucugucagccugagccgugugccucucccugggccuuggguagcuaagacggcaauggacaccacaaacaggccaugccacagggugacagugccccagagccacagaguugucacugcagcuggguggagggauagggucugaccccacuauauccaagccagaucuucagaaacccuccaaacccguccuucccuugggcucgcucguggucauacaugcacuaggcugcuaccccuguuggaugcugagggcuaccuuaagcuccucccuguccucagccagaagucuagacaaaguugccgccugagggagcccagccuggcacuucucacaccuccacagaugcucgcuuucuccaacccucccaucucucucacugggugacggcaagucccccguagucuucccccucacccugcugccucucuucaguucucucucuguucagcagccagagugaccuuucuagaagggagaucugauccuuggcacugccuugcccaaaaccuccuagagacuccccacugugccuccccucugacgacagccuacaaggcccaaaaggacccagagccugcccauccugguggggaugugauuuggguggggacaugaguccaugccaccuguggguacagcagagaccuggggcaggaagucaaguaaacaugucucaaaggaauagccgucucaugggcucagugggaacagaguugacaacaggcccauguaccugaaaccaucaaguuggaagggaagccccaguggaaugcaggugcaggcgacacacaggccacaggaggcggaagauucuggaacaaggacaugggcugcagggucagcagaaaccuaugaccagugaaggaagaaggugggcguugcaggaucacagagcccuuacccaggacagcugcagugguggguguguggaccaaugcaugcaaaaagccucacugaaggggaccgaggaggggccacagacugccaacugcaagggcugaccuuaagagcaggcuuccuggcaaugcaucagccacucagggauaacccugagguccuaaccacccccacucccccacguuccuguccacuccugagagcagcgugggguggggccuuucuucagauggacugcggaggcugccacguggcccugggccucucagcuuccgagggaagcagcaacuugggaaccuggcugggucugaagaugguuccacccuuagacuccgagggugggggcaggguagggagagaauugaggcccacagaacuccuuggccagggccugccacacauccugcugcuugggugaggggcucccacagcaguucuuucuccugccuugcacugcagaagaggacugguguuuccccugggacaccgccggggcucugggccccaucugcacuucugugcuggcaaaugcaaaagaauuagcucagcaacuuccuccccuaaucccccacccccacucuaaauaccuuggaaucaagagaaaagccgaguggacguuuugagccuaauucucuucagcugugagugcgugugugcgugcgugcucucgggugcacaggcuugcaagggaaccuuuugaaccccaaagaguaaagcuggagggagugcaaggaacgcuagcucagccccuaccauguacagaugaggcaaaccagacacaaaaggagaaugggaccugcccucugucacguggggagcucagggaguggccaccaggugcccaggcucucugucucacacccaccccugcagccuugagucccaagaaggugacaaggugcaggcgccaaauuucaaagccuuccacaacccacagaacaauucagaaagggagcuggccgugacugcagcccccucccagaauucugccauggugcccaaggccagcccugggcucaccucccagccugccuggcagcccccaucugccucuggggcuggccuggaguccgcccagccucacaugcuucucuagccaauucccacgugucucuugucgcccgacgagacaacaaaccccucucagucucggccuguuuuccucuccacucuucccccaaaggacuagaggaggcgggagugggggcacacaacaggugcgcugggcuggcaggcggcgcuggcugauugacggcaccccguguguggcgagggggugaggagcagaggacauaggacacagaacuguccuuccugaccacgucuggugagcuggucacaaacaauagugacaggcuccuuggccuggcaaccccacugcuaagaguacucaaggagaccucacacaagcacacaaggugaggugcccauggaauaucacaggcggggaauuugucagggaaaaauccaagugcccaggagcuuggggucugagguuccaggguuagguagaggguggaggcaagcccagaacaugaaaaucuauauaaaugaaucaacuacuuguaagauauguccccauccaggcccacaauuagaacccacaguuuuguuaaguguaagaccaaauaagcucaauuuucaugacuuuacaaaucaguuuucaagauaaaaauccuaaccaacacccuuugucacucuuuaguaggaggguggacaccauuuuaagugaaauugauuuagggagcuuuucagccuguguucgacauccuuggagaacacaacaacaaaggcugggagacagcucuguguccaagagcgaggacugaaggaguccaccaggcuaccuccuccaucugaugcagcuaacaaaggcccaaagaaaaauggccacguuucgaaaaucugucuuucccaccagaauguaaaccccacaugagugggacuuuuauucuggugaaaucugugaaaugacucugaagaccugggauccugcuccccugaccuccuggggagguagaaauggacaugcagggagggugaucaggggaggauucuggccuccugaggaaggcugaggaaggccagaggaggccugggggccacagugaggcuggaauugagcugcaccccaagcagcaaaaaggagcaggacaggggccugaggccacccucaacucaacauuccugacccugucuucucacauaaucucucucguuuccuaucucaauggcuccaagaggcugucagcaucaccuccauccuacaggcggggaaaugagacuugcagguaucucugcauugcagaguccaggccagggucaggacuccagcccugcccugcucuuuuuggucaggggcagagaauaauaguggucacugagugggaguugugauccuuuggaugucaagagagaggcugggcacagaggaagcaggcagacaggcagcugauaaucuguccugaggaggcaggaaggugggaaagccacuugggagcugaaguuccaagcuccauuuuccccucagacuucacuucuaaaacacaaguucaaagauaguaacuaucaagaauuucaagacagugacauuauagcgugaaacccugagucuggggugcaccugagcacuggcucugagugauggcacugguugcacagcugccucucggacaggcagaugacaaaaacuucccagcuagauagugaggguggacugcgcccucugaucagacacaugaacucccugggccagugcgaagggacaggcgcccaggggaugugucacuugugcccagauugccugugggcugagcaggaggcagggaguggacucaucugggcgucguugcugaaggccugaaaggaaucacuugcugccugaaaaaaugacaccauuuucucuuucucuucugggcugaagaacaacaaaacccccaacccggucacccuuggagagagauuccuggcucucccguagacguauauuuucggcagaggcagugaagaugaauggccuccuugcgugccuugguggggggacggcuggcucgcuuggcuggcuccagccucccccuuccuccuguguuugaggucaacccuggguugggguuguaacaacuuucgagaacauacccagaguccugcauuccaacacuguuuuugcaguccacauggaagggccaaacggcccccagccuugccagggaagccucagggugugaacuucuagagggggcuuuugugacccaggcuuuuguccccggaguuuauggcaaugcuuggcauucagaaggcgcgcgccagcggcgcggaggggacggacaaggggaggggccggcagacgcggucaagugucacgcccggaugggggaugggaggugggcagggcgggcccggccgggcgcuggcaggcgcggggcgcccucggcgcugcccuuugccagguggguggccuggcaugucccggccaccccugccacucacccccugaggucccaaguccucaggggugagcggcagacacggguguuccaggcacagcagugggggcuucagaacaucccgauccccugcauggacccgcugggaggggggaaaacgccucccgcacccggugccacggcgguggagaccuugcccggguucgagggucgcugcagcggcgccggcggaggggcuggucucgggcguggccuggacgcccacaggccuccacaccgagggcccacagcagugucggggugcggccgcuguccucacgcggucaccccgggguggugaacacaucacgcagagaacuggcccgugucuccagcucaccccggcgaugccaacgcugaggcuggcgcuggccccggcccccgguggugcucagggacgacgggugggggcagggagggcggcggcucgcgccaccucacacccagccagugccucaugcggcgcuggacccgcugggccaaucugagcccggguggcaucaaaacgagacucuuucggccaaugacaggacacggcacaucacuuuccgcacccagccaauccgugcagcagcccgccgcaagccuuccccugcugccgcccaaucagcagguggggggcggucgccacgucggcagcggcgggggcagucggagcgcugccgcagucuccaggcagaacggucgccgcgucgccucagcacggaccuccagggagcuccucagcaagauccugccagggcgccccucagcgcgauucugccggggugccucucagcgugguccuccccggggcuccucagcacgauucucccggugcgccccucagcgcgguccuccucggugcgucagucaucgugguucuccccggcgcgccccucggcgcgguucuccucggggcuccucagcgcggcgcucuucugggggcuccucggcgcaguucuccccggggacuccucggcgccguucuccucggggcacccggggcuuuucggcgcgguucuccccggggguucuucggcgcgguuguccccggggguucuucggcgcgguucucuccgggggccucucgccgcgguucuguucuccccgggggcuccucagcaugguucuccuccgcgcgguccucccugggccuccucagcgcggcacucuccugggggcuccucagcgcggcacucuccccgggggcuccucagcgcggcacucucccggcggcuccucagugcgguucucccagacucuccucagcgcggcccuccccaucucucugggaggguuugaacacggucagcacggaccugggcggacggcgcgggacgggugaucacuggcguugcugaggugagcugugugccccgcggccgucccagaucacaggcgucagcagugcagccuggccugggcagugcgcucccaucugcaccuuauggacagcguggccagggucgagguccgaguuccuggccgcgucccaaggaucggauuccgggucuauaguucucauggugguucagagugggcugaauugggauuggagucuggaauccgcaucgugguucugaguccgcgcuauugggauggaaguugggaauccauguugugguuuugagucaaagcccgaauugggaccggagucggaaauccacuuagugguucugagucagggcccgaauuaggaucggaggugggaauccccguugugguucugaguuagguauccuaguugggaucagaauucgggucuaggguccacauccuggcugggaguuugccugaguugggaucugaguaguuggggucccagucaguccgggucuggaguccgcauggugguuuuagguagggccucauuagggacagaggaucgggagucugaguuggggaccugaaucccggucuggagucugcaucauggcucugaguugagauccaagggagguccgaguuggcgacuggagucagggucuggagucugucuuuggguagagguucugaauggggggcucugaguuaagagauugggauugggguuagaggucucagugggguaugggagucaggaauugaagucgaaguucugccucuagguggggauucugagucaggaauuagggggcgaaguaaagguugcagucugaguuggggguggugaucaccugccaggugagagguagugguagaagucucuuggucauauuggagaugagaguugaucagaugcaggucucagucuggguaguaggcuugaagggccaccacuauguucagaucccaguaccccacuguggucccugagcaggucaaauagccuuuuauauaaaauugagaguaagagugccuucccacagcacuguucugguuaugaaagagaauaauucauccagguagaauaguucugucuuagauuaucacaaaguauaaaaacuuuccugauaauauccacauuugaugugcauuuaccaguucuuucuuuacuguggugccccuuuugcuagaccaaaagcucccaacgaggaacucuguuuuguuuucugcugccugcucuguacccagccaagagccugauacacagccuuacucagucaguacuugaaggaaagcaggcaggcaggauuaaccagauuucuauggugucucaaaugauccauuucugcaccuguuuuccagauacucaguaggagaaaaauuuaaggauugaguugcuugauuauggguguauuuuaauguguuuccuaacaugcugaggagaaaagugggucuguuucaggauuuaugcuccagcuagagggauuuuuuaaaauugcgaaucagagcauguccaaauucagauagaaagcacaagaaaacuauaaagaauuucccuuaugaauguagaugcagaaguuccuuguacaaugcuagcuaacugaauccaauaauauguauuaaacaacaauucuuaaacaagugggauugcucuuaggaaugcaaagaugauccaauaucagaaacuuuauccauguaauucacauuaagaggcuacaggagaaaaaccauaugguucccucaauagaggcagaaaaaaaugaugugauaaaguuuaacgccuaugugugauuuugggguaguggaguacaccacuuagcaagccaggacuagagaggaacuucuucaacuugauacaaguuauaaaccaaaacuuaacuuuucaguaaacuugauagagaaauuaaaaguguaucauucucuuuaagauaaggaguaggccaaggaugucauccuggccauacccuaauacaagaaaaagaaauggggaugugaggaucagguaggaagugauaaaacuuaguguagcucauaggguugauggucuccauaaagauucucaaacauuuugguguuacgacuuguuguauucuuaaaaguuauugaaacccccaaagggcuuuucuugauagagauucuaucuguugauaguuaccaucuuagaaguuaaaacuaagaaauguuuaaagcagaacuauacaagcacauauuccacuggggucauggugugcugccucuggaaaacucuuuaucuuugugagaaugaaagaaaaggcaaauaaugucgaguauuauuaugaaaauguuuuugaccuuuccugaaagggucuggggggcucucuggaauccccagacuacacuuugaaaauuacugggcuacauggaaaaaaaaaauuaaggaacuuaacaacuaaagagagauuucagauuucagagagguuuuggauauaagaucaguguacucaaaacaaaaaacaaaaacaaaccacauuucuuuaugccaauagcaacugacuaaaaaaaagcauaauagagauuaggacagcaaucagaauagcagcaaaauuuauaccagucuaggaauuaacaaagacgacgacuuuuauggaaaaaauuuuaaaacucuauuggaggauauagagggagaucuuuccauaugcagagacauuuuauuuucuugaacagggcaacuuggcauuagaaugacgucaggauuuuccaaaucuguuaaguucaacaggacuccacucaaacuuccaguuggagggcuugaguaauuuaacaaacauauucuaaaauguauguggaagaaaaauauuuguaaaugccaacugaacuuuugaaaaggagagcagaggacuucugcuggcagauaccagggcacacgccaacuucagcaaucagagcgguguggugacagaggcccagaagagagcucagagguaacuccaagucuagaggaaggggacaugugauaaagguggcaccacauaucaguggggacuguucagaagaugauguuggaaagccagcccuaaaauggaggaauaggaauauggauuccuaacugagccccuaggaaaaguagacuccaaauggacuaaauauuugaaagcaaaagguaguugccauuuguuuaauaggagaaaaaaugaauaaucuccagggccaggguggccgugggguucuuaaacaggauccagaaagcacaaaccucaagacuaaaauguaugaacuugaaugcauuaaugauuauggauuaaggauuucuguuaaauaaauccaucauggcaagggucaagacuguuuucauaauaauacuaaggaaacaauuugcguuuuucacuuuuacacucaugaauguaacuuugccaugacucauuacaagauauuugaaacaauuaaagcugaggagggaacaacagcuaaaauauaccagaaagcaccacaaaucauuaagaaaaagguaggaagauugccaguuugcaggaggguuaacaaacagaugaaaauuugcccaagcuaaucaguuaucagagaaauguaaaugaaagcaacagcuauucuucauaggagaagcauuagaaaguaggauaaggccaaguguuggcagaaggcaaggaacaagccucccugugugcugcagguggggacggagacaggcacagacguucugaagagcuggccaacacuucuuccucaaauaaaauauuuuauaccuguggcccagcaguuucccuccuaaguaaacaugcuggagcaguucucacccagaacaacgagaggcugugugugugcaugcucagggcagcauggcccauaggggugggcaguuggagcuggucacugugguuaggagcaggggacuagauguacacuucacaagauagagacgcguggaaacacagugcugagugacacaaaugccaaacagaaagagggccucaguacaugacuguguauuuaaauuaaaauuacacaccacccagacacgcaguacuagggagugcucgugagugcacacacacacacacaaugauauaaauaaauuacccuggagaagcuguuuguguagggaggagagcaaggauagaggcuagagaugaaguggaaaagcauggagaggaagagagcggugacuuuaugcagacccuuacagggugacaguguuucauaggcugagggcugugaucaacucugugcagagucccaaaagccaagaaccaacgaaugaaugugccuccaugacucuccugccagauacccucuaguggcuucuauuucuaggaaauaaaauucaaauuccaucagguuuuuacaagaucugcccugcuuaccucucugaccacuguccucccucacugagcuuuggcucugccagccuucuucuucuuuguuaaaucugccaaguaucccuccugccccaaggccuucaccaccucugccuggcuugucuuuucuggugaucuucccuugacaauuccuucuucuuauuuaaaucucacaggaaauuuugcucugaccugccauaucugucauccccuucagucacucacuagcugacgacuaccuuucgagucucugcaaagcacaggcuacgcuuuucuaguuccuuagacaucuacuuauuuguuggcugccuaucucuuccaccggaagagaggccccaagagagcauaucugucuuccguauaggguccgcacauggugggugugucacagauuucuguugaaugguuucauucauuuauugaacgaaggaagaggccaggccaggaaagugugccuccauuuucacaacucagugagaaagcaaauagcaugucaaaaucugaccccuugcaaccaggguuucuuagccagccacacugguaaugcuugggacaggauguaucuuuguugugaggggcugucauuuauauuguaagauguuuagcacccugccuggucucuaccuaguugauauuaguaauucucccauagucaugauagccaaaaauaucuccagacauugccauauguccccuggggggcaccgcagaugacaaccacuuccuuagaacagcucuugggacugggauggugucucugcuguggcucuuuaaaggcagcaggcccuggcuugcauccugccacaucuaacaccuauagccucaccaccucggugagaaagacccuggcccaggccuggccaaucagaguacccucuucccuggucagcaguauaauuuguuuggcaagcacuuccagucccacaaccuaugggcugccacccagagguuuaguuggaacuacgugucagcugccgucccucagccaucuauggcaugggcaccuguggcuugaccaaguuggagguggccuagagaggccgggcugggccugcucaccuucuccaguuagugcagacugaugaaugagugguucucagcggauaccggauccagguuugcaguacacuccaggaggaggacgaguaggguuucccucagagcaggccuggaugggagggcaagggguggccucuaauacugccuuuccuuccggugccuuuaucagccugugccaugcuccucugaacuggccggccccagcauguccagguuacuggcaggagccuguauaacccaggguuccagucacaccagccaggaaggcccaugaggcuggagcgcacccagucucuggcugcucugucugcggaacuaaaagccuuucucccagagccuuuccuacggcugggcgaagcucuuguuugcaauuuaaauguggccucauuuauggaagaaucccugcuccuccgaaaagccuugggcucaaccucccuagcagcccgggccucagccaggagaagaaauggaucuaaaaggccuuucuccugcuaauuguagcaauuagcauuagagaauggggacucgauggggggccagcgccuggcaaaacaagcuuauucccagcuuaggcccaggcccagcuccacacacugcugcuuggccagacucggcccccacccagggucugguuggcuucagggcagggagagagggcccaggccugugggugcuaagagcaguuguggagggugugcaucugaguuguuaagccugguagcuguacagguagcccugggcuaugacuugugguccucucagaaaagggucugacuggaacgcagagccagaccagauauucaugaguggaucacagaguguagacugagggcuaucuggugauugacagaaaguagucuuggggcaaaugacucuuaaagaguaaggagccauuccccucuauggcuaacuggaugccuuucucucccccugcuccagaaaggacuuccuguuccuucacugagcgugcuugcuuaugaggcuucuggaaaccaggagaguucagugggccucauuauugagcguaugggcaggacaaccugcuugggacauaggccaugcuacaguugauuuuagccagcuugcugcaucuacacagcacagugccuucccaggcagugaauuaugucuaacaggcaggggaaugaucauugccucauguuagggaugcagucauucaagaaauauuugucaaacacucagcagguacuagacccuggcccagagggagggauuugauaggagcagggaccugccuacccucccaggguuaguggacaaaggggagaaagacuaacuaauguugaaggaccguuugcacccugaggggagugcugaggccugggagcacagcagguguauagcaggaacccacuggaacuagccuggggucugaaaaacucccuuggggaaaguggcaggggcaggccaagggcccucuggugguagggagccugugagcaccugggauggaaagaagccaagcaucugaacuaccagaaaggcagcugcaggauuaagcaagacccacaggucucuaaacuuugaaaggaugucuguccacugaguagauaauugauuggaauggggcaggggaugugagaaugccaguuaggagaugccugcaguacagagaaaugguggccuaucaggacaguggcaauagggauggagggaagcagggaaccucuagaacuauggaugggugaaguaagccuggcuuggugaugggcuugaggugaugggcagguggugaggaagcggguguaucggaaaugaccccagaacuucugacuugugccacugaaaggaugggugacacugaaaggacaggggccuucaguagagugggcuauaaaaugauggaggcuguggagaggaggugggggcaggugacuggaaugugggucuggcuggguuggagagacauuuggggggucagggccucacagguggucuggaagcccuuggugcugagggaacagcuuagggaaaugguuugcauagagaaaggcacuggcauuuaguggccaugccagaagggaaaaccugccaaggagacugaggauagagccagaaagauggcaagaaagccaggagaacuggagggauggaaaagaggaccuaggggucaugguccuggcagaggucacauuggauccagugcuugugauucucugauugcuggcaguggauggccacuggccugcaaauggcccuaguggaauguccccugccuguguggcucccugugggcugccucuccccuggacagauggggagagaccccuuccccaccugguucucuguuucacccuuggaacuguggcgguaaagaggaccuccccacaguacgugcagggaacaagcuagguugacucccucagggaggccucguccuugcugagguauuucauaaccucaggauagagaaauccccccaacuuuaaugcaaagccaagcaagcugaaaaauggccuugaauaggcugagaugaaaaaacaaagaggcugucaacaucagagacucagugggggcagggagcuucaguggacuccccacagacagcaguuccugggcuucuaugcccagacccagaggccugagcccaagaugucaggauggguggucacuguaagugcaguggauuguagcucaggggugagacaucgccuuuuucuugucagcucuccuuccugauuaguggcucaaacagccuuccgagacucaagggguuaacugcagauccucuaacuccuccacuugcuaauuuuuaaacacagcugagcucugagcaccccucccaaggcugugagaggccagaggccagcacagacucugcaccaggucugcacagccuccaccccuacuguugucaggaaucugcaggcaucuagaacaaaggugccuccauuauuucccucacccagcauauccugauaccugagccaagaguucacccagagcuuuugcccacuucauugauggucuggugggcuuuuguugacacauacccgugacucccaaaugaaccuuucagguuggcuuaaagccgcugggaccuacacaugacaaaacccagacggaaacaguggcuuacacuccugugucccuaaagguaccuguuccuaacagugggagugccagagccuggaagcuggaagccaaggagacagggaccucccuccugcugacccccugccaggccacauccaccuaagggauuugggaucauacuccaucuucaaccacugggaucaaauggaaagcccucaggaauucugagagacagccccuauaccuaugugcacugacacacauacacugacaaauacgcauucugacacauauaugaacaugcacauaugugugccccacucccugccaggagguggguucugucccaucuuugacauguuacuucuuguccuucccuaggcccaguggcacuuucuuugugauaggugcugagacccccccgacugggcccaguggcuguucccaggacccagucucugcucuuaucuuaacccagcucuagcucccaggaccccagccuuucgcagggagagagauagcucuuuuggucuggcacauguuccaugccaaguaguggaaacagcagcugcagggcagccucagacuugacaucauuuaauccuugugacaauccuacagggaggaagacacuacacauaugugcagaugcagcaaggagcagcucagccacauggaaugacuugcuugaggucaccaggcacuugacacagcagaguuuagcccagucucuggagagaccagccuuccacauccugucaugcuggggagggcugcccgcuuuuugucccugcucccccaguucuaaccccggaagagcgauugucccugcugugccuucagcccagacagaagcaggcuaggagaggggaggagaggcagggcuggcccucggaaggcucaccuuccucaacaguucucugcuugggcaaaggucuuccaagcagccaggcucugaggcuagucacugucaucguugggugaggcagccugggaguaccagaaguuggagcaggugggaaccuuccccagggauggggcuggauaggcaggggugggugcuaaguggcaggccacaaccaggcaccugggagggccaagcaccacacugagaacgcagugcuuccccuccccuccuaggcugcucaggaacccaucagucuccuguaaacaaaugagacuaagucucuggcacucuaggcccaggugcaaaggacagcugccccugcagcuacucacucugcccuggcccucucaggaggcuugugaccucugcaccugcuggcuuguuuuguuccuaaaauacccggauccuugagaaucuagaagacaccacugcuaacagauuuccacaucauucauucuguucuuccugugcaagcuucaugcugggacagggaccauaaaacaaggugacccaaaaccuucagcagaaugcagguaggcagagcagaggucucugggagugucauuccaaggcagugucuuccuccuccccuaugcuccccauuucccaagagugggcuucuuccaccccacucaagcaccucuucccaaggcugaccuaaaggccucaagcucugcggauaggggcaguccugagguggcauugagucuuaggguuggagugggagauaucugugcaaaggcugauaggaacguccuccaagggcugacuucaaagcuuggccuaaaccacugcaucaaagucagcaagcugagcuguuugcacagaaaaggaggaggagcaggcccuugagccaccuguagcucuccuuagggucucaggcuuucacaccagggcaggccuugggccagacuacccaacuuccaggccggaugugccaccggggaggaggagguaacugccccucaaaacccugcagcccagggcuccaggauuccaacccagggaccugcaggcuccccugcucuccagaucagaccccuacucucagagcccuaggcccagugggugacagccugugagacaggccugugugggguggcccuagccccaccucagcuuccaaccugaccuugcugcaugaccucuggcccagcccucuccaccuggagugccaucucucuuugugggaugggccaggugggcugugugugggggagggcaaguauauaggugugguauagguggaaacugccacaguaaccagcagcagcucagagccgggccacccaauuuguaugccagccccagcugggccuaggcacgugguguguggaaaugaacgaagcaggcagcccuauguuuaggaggcagguccagagcucacccaggcacagcacaagaugagugccuggccucagugagcgagcacuggcugcuaugaggcugugguguggaaccuugacacuagggccacuggccuggcugugugaccucuaccucaucacccagagcagggcaaccagaggcagagccucagugugguguucuccugugaaauagugauggcacaggcaggggcuggggcccagugccuacacagaggaucagcaaaggauggcaguuauugaaaccucuacggggaaguuccccagacacgagaggaagacccccauggaagcugugugugugacgugcuuagauuuuccagagucuucauuuuccuugucuaaacagaggucauggcgccucccucucagaucaaacagcccuguaugaguggcuacaaccuuuggugggcucagugcagccccuccugcccccuugcuugggagcugucugcagaggccuagggagcugcguggggucucuccaccucagccuguauccccacccccaccagguccccugccugacuccagcauacccaggcccuagaagcaccaacuccauggcugcagcugaguggagugugugccugcccaagccuagaggggugcugaccccucccucgcacgaggagacaucaaagggaagcaggaagcagcggccuggcugacccacagcgggugggagaagugcagccucacaacugcuggggauuuuccaucccaccaggauuuccgcgggacaccccaaguccagccuuugaggcuccucaggaaccagaguuuggccuggagccaguuggggcagaggaggggggccaggcuggguggcuuaggggugugguuaggccugcuaaggggcuccucuucucagucuccccaugauuugcugguuacuggcuugaaaucugggcccagacccauuccaacacugaacccugagcucccugagaccuggcuggcaaggacaggucccaauuuuuacaggggccugagaggaauggagaagggaucucugccccuuccuuucucagucacaccuccuugacagggggucaucagagugggcugugguaggugcaccagggaagggaccauacagaggaggcuggucucaaguccuagggugccugggauggcccuauugaaaugcugcagcagcucuugugcaggcagggaucuguauggacagcuggguggacacaggugccuacugaccucccagauccuucagcagagcucagcccugagugacagcccaaggcagaccuggcuaccucagccucuggcucacagcccucagccagagcccugagaggccugggaucucaaagcugcaaggugggaggccagaggagagaagcccggagcugguagugaugcuggcugagugaaaauugcacauuucccaacagugugaugcucccuauccagccugggcuuuuggcagacuucugugcuuuguggaggaagcuggcucagauuccuccccucccugugcaguuugugugucaagguguacuugucacacccaacucaggauaucuugcaucacuuuguggguccuugucccccagagcugggacugcugaguuuuagcccuaagcucuugcucccaucuuagcaagucagggcccaguguuguccuugccucugcaucaggaugguaagcugggcaugcuccgcaucacggagaccugcauggaccuggauuggguugccucuaucuucaggcuggucacugggcagacacaaaccagggccucuggccagaggggacaguggcucugaguuacuugugcugcucuuuaggggugagcaggggcugcuugugcaucauaguguaucacaggggaugcacauuuacaauugaaagcuacugguccuggguagaaguggggccgaguaggacuucccagccuugaacauggguuugucauccaacugggacccacacuugauccagcggccaugcucugugcagccugggccugagggcagccacgcucaugugaaaagugcuaguagccaagcugccauucuagucaccacagcuguccuugcaggagcacauugcccagggcugggagcugucauuuccgugacgggagugagacucaacacugggugaggguggggguaucuguugggaauuauuucaaaacaauuguggaaacuuggcaguggaggggcucugggcauagguauccacaauauccuagucagggguugggguacccuggcucugcugauaagcccaagugagcauacuccucccccagcuuggaacaggugggacgggccaggugacacuaguguggucuguggucuggccucccaagccaguggcaguacugggguggcagacauuugcugugugcuaucccaaggccuaaaggucacacagcuagguuggagcaggguuuugggcaggaugaguaggcauugcugugcucucagaaaggcgaagcaaaccccagaagcaagggggcgagacagggcaaaggccuacacuuugccaucaacucaggccuacucaaugcuggcccuguccuuccccugccccugccccaucagauggugcgagcuggcggggcuuagagugagccccccugacucuucuugguguggagucugaggcccagaguguacaggccucauccgugugacccagcaggaggaugggagagugggcccagaacuuggucaggcucauccguggagaacaaguucuucccuagucuaguuguggucugaguccugggugaagcaggaggcagccugggaaacagccucguucuaguaggaaucgcauucucaggaacgcugacugugcagggcccuuucucacugccaccugggaggaugccugccugcuggccauuucggcggacugucagagcacccucccuggggucccagaccgaaggccugaaguccacaugggaccccugaacuucugguaccugugugggcuuguccccucaacccugaguggaauggcaacagccagcugcaacccuccuagcuuccugucaugugcuguauggaagggccaagagcuguagucaucugcagauccucccacugcaccuguaggacuagcgucuccugucuggaugugagcaacuugcugguggccugugagaugggaguugcacugggcuucuggauaagggcuucucguucaggugacaauucuaugugaaggagacccauggaaacacaucuauccccugcccauguaccaggcagagaugguaccugcccauguacccuccaugacauggcugggucccugaaacaucagacagaucgauacucugugugcauguuugugggcaagacacaguggcacgugugcccuggaguuugguaaugggaggacugaaguagugccuccgugugugagcugugccagccauccccacgaagggggcauuccaugcagauggggauccucuccaggcagcuucuuccacaccugauuagcucugaccaucagaccccccgugccaaaagggccccuucccuggaaucuguaauucucacaggcugucccauacauuuuaaauccaggaaaugugcucacccaugagacagggauggcaagaagauaugaaugaaaagcaaccaguccguaaaauuggaagccauuucacuccuuaccagguacaaagauaacaugcugcauggaucagggacacaaacuuaccuaccuuaugauguagugaaagaaucuaaaacuuuugucucagcagacucccuggaggaagccaauaacaggaggccuugacuaggagaccucaagccuuggaaugugcccagaccaguggggagggaaggcugggaggcaguccucccuuaccccuuuucucccaggcagaccuacccuggguucucuccaggccccuccgccugagcaagugcucaguuggccacuagcucccugcacauccaacaagccuuucuuuccuguuccuucuucaaggaaggcuuagccucaaauccagggccacagacaaaggacagucacucuccucugccagaaagucauuuaugggacauggagaaagcaucaaauauauugcuuuuccaacaccuaacaguggaauaggaggaauagaaggagaacucagccagaaaguucuggagcauagucuuuuugccaaaagaacacguuuucaaaugaaagagguggugcuggggcacugaggaaucagggggauggaccccacuggagcuugucucaugcuggcagcaagucccaggccucaaacacauaccugggccaccucaggagagagacugcagggaagaaaugaguugcaaugcuccagccuaaccaacuccccuuuuguuaauccaaucccagaagguacuggguagggucaguuaacagacagcugccugucuccuggcagagucugaccaagccccagugggcgcuucucuuccuaaguccucugguguaccccauucuucaagggaaacgguccccuuaagaaucuaugugaaaggguucugaaauugcuguaccaguuaaugaauuauuuacucuaaacaaugucuugauaaagggggaggaugaaguuagcugauguugacuaaggagagacggaguugccaaggaaauucuucuaaaugaaaaaaaaaaaaaaguaaaagcagucagcugguuuugucugacuaugaaacgugucacagagcaugcaccuuuggccaucuuuugcauuuaugauuuggaagagagauguagcagugaguguggggccagggaggggaauccaacaaagccauucugcaagcuaguggcugggauuuugggguauagaguaagagcagccagccuuagaggcccaugucaucugggcugccucagagcuaaagcuagguaaccagagggaguaaggaaaggccugagucccaggcuaggcuuuucacaguuguauugagaugggaaaguaagggauguuccuugcagcagaugcagggcccaguugucuagagcaguauuugaaaugaguuggcauuucagggcaguguuugugaugccagucaguagguaggggcuucuaccucuuuuuuagaaauguuuacucugaacuaagcucuaugcuuuaacaaguuauguuuuaauaggaaaacugucauugauggaaucauauguaauuccuacauuuuuccaguuacccauuccuggggaaagcuuagccauuggacaaaccacccagagccccaggaaccugcauuugcagacagcaguggcaggcacaguggccuaguguugagcgggggaaaccuggccucuaugugucugguuuugcaaacuaaaacgccauugcccauacucaggcugacagguucuggaggugccauggacuccugcucuguaucucaccucuaguuccaucacaaugcaugagcugucagugggagccuuuuaaugcagaugcuaauacccauuccuaaugcuagcccauccccacacccuccugaguuggugcgauauauccugggaacaagaaaaucugaaggcuccugguccucaggcuagcaagagccuugccuguaagaagugggagaaggucaccucucucaggaggcagaacuaaggcugcacagcacaagggagaugucugaaugcacagucuggguggcagaaggacuccuguccuuucuuccacacagaccugagcaccucuccaggugccaccauuuucugucugggaacaucugcuauccccaagccucaguuuccuggucuacaaaacugagauggucucuucuauacaaggccccaggaggaucacugcaagucacugcauuucauggugcccagauuucccugcauuucuagaaugucaacagagaugagugggcucaaggggaagagauucuuuaugacuagagauauucuggucaacuuuggaccccagcuucuauggacaauagcauguggacaugagcccuggggaagcagggaugacugagccugaagaagagcucucaagccuuacacucuccagaccagccuuggguugccugaaccccagcauagccuuauggaaccccugccaggguccuagcaccugguuugaccugggcacaaguacucacucacucacucacucacucacucacucgucaaacauucacugaggguccgugacaggcuccauauggauuaagcacugaagauaaaacacugaauagaaacagccagccuauacccucaugcuccuugaaugugauagaaggagccagccaguaaacccuuuaccacaaauaaacacacaguuacacauuaagaaugggaggggagguaugugauuuuuuacagcccagucuuaagcuuuagaaauuggcuccucugaggaagggacauuucagcuaagaaccacaggauaagacaguccuggccuggggaaggggagagaaggucaggagagagcuugauauguuuaauacugaaagaauauuugaugagcugggacaucuccugcagauccacggcucccuagcuuugugacccugggcccuagacucaaucccucaacccuuaggagauuaucuauaaaacaggagugauaauauucuuguguuaaaagcugcugugaggauuagugaaaugaugucuauauuugccuggcaaacaggaaguguaaguaguaguaucauuugaagauuauucuucagccuaaacguguguucauuauggccgguguguuuucuccccaccuagaugguagugcugggccuccuuuggaguaccuugauguuuggggagcauggaugauaugaccauaaccugagaaggcagggacuguacccauucugguccucccaggucccagggcccccacagugcccuggugugugaucagugcccacaauacugaauagaggaacagacacaugggaagcaacggcagccuggucuuuaagggugagggagcaccuucuccugagagagggagagauagguugggggagguuggguggggguggggagagcgagugagcaagcaagcuagaaacuuccugaaaagggaaguuacucuagaaaaggguaaguuccuuccaggcaucaugggcuggcuuaaccuggaccaguuugacuuuacuaagucccauuucucaucuagggagccugaggccauuaagguuaucuggucccaaaauccccuagagcugucacagggauccccauucuuugccuuuagucaccccagccccaagagccauccuccacauggagugagcagggagcuacaaggaaaagacggucacaguuggagagagacagagaaccaggugggcugguaggacaggaagguauagggagaaagugaagcucucuccuggggaggcaggaauacucuccugcuuccuucuacccacucuucauagaacacaaacacugcaaaaaugacuuuuuccaaacccucuuagcauucagaaguagaauugcuauguaagaauuuuuucauaggugcuuuuuuggggggcaucuauuuaaaaaauaaccacaucauuagugaaaucuuccaaagucucuuuuuggagcccacauuucacuaauguccacaucugaggaggcuuucauaauaaaagaacacauaccuauuucaccuaugauggucagugcaaucuugaaaacacuaguaaauaguguccaucagcuuuaaaaauacaaacccaaauugggucauaccaaaaugcaaggauacacacaauaaccugggugaaucuucagggaauugugcugagugaaaagagccgaucccaaaaaggugauuugcuaugugguuccauuuauauaauuuucuuggaaugauaaagaaaugaagaauagguuaguaguugucaggggcuaaggacaggguagggugggagggaauuggggguagcuauaaaagggggacaugagggauucuugaagaguuagaaauguccuguagugagacuaucaaugcaauauccuggucagaauauuguacuacaguuuugcaagauguuacuaucgggggagacuagguaaaggaguauguaagauuucucuguguuguuucuuagaacugcaugagaaauguacaauuaucucaaaauaaaaauuuauuuuaaaaaaugcccaaauuaaaaaaaaaucaguaguccuccuaaaaauacccagaaaugaauuuuagaauguccaaaauccauacaaagaucuaaaaaaauauggaaggauguugcaauggauuugaacauguggguaaacugcuucuauuuguggcuggaaagacuuuuuuuuugagguggggaaggcaauucuucaucaguuaaucuaaauugaaugaaguuucaauaacaaaugccaaugggauaugaauauacacacagauagacaacuuuuuuuuuuuuuuuuuuuuuaauuaggcaagcugaggccaggugcauuggcucacgcccguaaucccagcacuuuaggaggcugaggcgggcagaucacuugaggucaggaguuugagaccagccuggccaacauggugaaacccugucucuaauaaaaaaaaaaauuagccagucaugguggcagaugucuguagucccagcuacuagggaggcuaaggcaggagaauugcuugaacccaggagguagagguugcaguaagccgagacugugccacugcauucccgccuaggugacaaagugagacucugccucaaaaaaaauaaaaauaaaaaaaaaauuaggcgugcuaguucuaaguuuauaugaaaaaaaugcauguccuauaaaauucagaaguagcagcagucuggccccuugugcuccucuagcccucaacuggccuaacaggcccuagugugcagcagggacuauuuucccaucaucacuguccacagcaucuggacaagaauacagagaacggcugauuuaaaaaaaaucuaaucugggauccuaugcauccuaaauaaucuuaugaggaugcacuuguauuuuuucugaugcugauacuauucauuccaacucgccuccccaucagcuuugucaggcacugugaauugcaugguacacaugauuacaauggauggaauggccaucaugagguauagcaauacauuuaaguaacacugugucacuacuauaggacaggcacuuuucugcauacuuuauauuauuaauuuguguaauccuccuaacaacccucugaggaagguacucuuaugauucccauuuuacaaauaaagaaacugagacuaagugacucacucaagguguagcagguagaaaguaguggaauuaggauaugaguucagacuccagacccuguuauuagccccugucuuuggcuauggauuaguaaaggagagcacagccaagggugggacaggcagcuguaguccucuggaccagcuucacauggauggggcugcauuguuacagguggccuaacucagacauggaaacugagucgcugcugcccaacucaugccaugaaaccauuuuggccugcacagcuuauaacagcacucuagcucuagcuaugacacuuuaugguguuaguggguuuuuuuggugguugguauggaggaggggcugggcuacaaguuuuagauuauguuucuuauugcggguuuuuaaaaauucuugaauuaggccuauuugcucuuuuguucucuauugaguuagcaaauucaguuuuuccaagaugcccugaaaguaugaucauacauguauacgaaaugguccuuggguccagcuggcaacuccugugcacccccgaccuggauucugccuuccuugaagugagccuuggaagaaacaagugcucaugcucccugacauuauuagcugccacgaugaagccucagucccaaacaccccagcuuccugucuaacucaagagcuaauccuguguuuaaaucuuaagaguguuuagaucuuaggccaugccaugaauuccccugguugacugcauuugugaaaaugagcuucccauuauuggcucuuaaguaauggagaugagggggaguccugcuacacagauaagugcaucauaaaguuacauaauuaaaauaacugagcucuggccuaucaacaggcccaucagcaguccagaauagagucuagaaauggacacaaauuaaaugagaguuugaaauaugauaaagguagcaguugaaauuaguagagagaugaugauguacucaaauaaauaguguuggacaacuggacaaauauaugggaaaccaaauuggauuuaauuacucugucaaaaucccgauaaagcaaggauuuaaauguaaaaaaugaaauaaaaaaugauagaagaaaacauggaagaauuuauuaaaacaauuucaggaugagagguuauuucagaauuuaagauaaggaccucaaaccauaaaagacugacacagcugacuaugugaaauuaaaaaaauucugccaccagaaaaauauuauagaaaaagccaaaacaccuaaggaaaaugaggauaaaauauuuucaaugaauaugacaaagcaaguuucuacaaaucaguaagacaagguauuuuacaaaguccaaaggguaugaagaaauaguucacaagaaagaaaaacaaaugauuuuaagcauuuggaaagauaaaaaccucauuuccaacaaaagaaauguaaauuaaagcuccaguguaccauuucucaucuaugaaaugaaugaagauaaaaaccugaguauacacuugguaagggugggggaagaaagugcauuugugcagucaaagugauguaaaugguacagcccuuauuuggcaguaucuaucacaacauaaaugaacauuuuaauccugcuggaaauggggggaaagggaggaucucuuaaaguaaauccacugaaaacggagaccaaaauuuuacaauagagauauuugauugggaaguuaauuugaaaaauaacaguaguuaaaauauuauuuuaucucauaugcaauaacaguuguuagaguuacaauuauguacacguuuuagaaaaaaacaaauccagaggggauuuugguuugucuuuuguaaagcauuauaugguaacaucugagggcaucuuuuauacuuggcagaggauguuggcagcacuuccacagagaggaucauuuuuuguagaaguauggcaugguuucacugcuugaccaagaggccaccugcaucaauuaucaucuccccugcuguccucugaaaugcuuaucuaggcaucgaucuugguuuccucuucaacugauuaacuaacuggucuacucugcccagucucuauuugagaaaucauuugacaucauuuucuuuaacuugaugaaaucuccuauuuugacaagauuuacaguuccucuuuauaaguuccucuuuacuuugugugugcuuuauauugucuuugguugacaagagacagccaaagaggucagucagcagagauacaaguagggauaagauggauagggagaaacaacaguguucaauagggagggauguuucagggaaacuaauuucauaaguggucauuucaguagugaauauauuugaaugguuaauggcugcuguuuuuuagcugcccuacauauccaucaacagaggaucuguuccauaaaucauggcacaaugaaacucugcagcuguuaaugaaaaggagauuugcuagaugucuuaauacagauccaucuccagaacauaccagugucuuccuuuuaaguggugcacacuggggcugaacacuuacuaagaaaugaaagggcuccccagucaaagcugacaggugucauuacaacaugaccccugugguagaucccagcacaauacacuggccaucacuccauucucuucaaauguccuaggguugcuucauacagcagaccaucguacccaaagccacuaugcauaugacuugguuaucuccugccaggcuguaguccaguuagugcucccuuggaaauacucaagaccuuaaugaacuaucuaucugugaaucugugaagcuacccauuucuuagaggccucuuuggagagcuggcuguugaauacccaguaugaugguccuuagccuucuuagaccuuuccuguaccacuaccucuaugccuuuugccaaguccaaguguucaccagaaauggaacugaugccagaaagacuacagcuaacaaucugagcagaacagugagcauguccuaucugggaaaagcccagcccauugggcuaaaucucuagcugaacacagagacuaugcuccuuccaauuauacuggaagcccaaccaugagaaaacagcacuucaacuacacuguucagagccaucaccuguucacacgugugucuguauacauguaaacacacauuuugcaauaaaaaugcuucucagauguacugcaccauaauaaaucagcauuguauguacagcucaaaaagaaguauggcauaccuauggaagaagucaaaggcaaaguguagaaaaauacauacaguaugcuaccauuuguauaaaaaggagccguaucuacuaaguacaugcacacacagacacacguauauuuguuuauauaaaauacgucuggaaagaugcaauaggaaaguguugagugguaaccuuuagggaaggaaacuugggaauuaggguuggguggggagaguguuauuuuucaccccuuuuguacucugaauugguuuuaccauguguguaaagacuguuguaugauuuuuguagcacaacccuugaauacauaaagcacgauuggcuccccagaaggcagguguuggccaggcaguggaugcacgguagggcagugugcagcccugcaugcacguggcugguaugcccugcgggcagcagcuccccgcacacagugcugugagucucugguucaugucacucuguggagcaggggcugcuccagcacaaagagguuuuugacagggaaaggcagagccagagucagggcaggcccugggcgggcuccuagagagcccaaccacccucuaauaaggggugcucuccacccuaucugaggagcaauugggaucuccuaggaagugaaacuguuacguaugucuuauuacagaauuuccaguggagugauucuggaagaaauguguauggcauguugugacugcuaugucucaugaaauauuuacguuuuuauguaacuuuuuuccauuuucagaucaucuuuuauuuuaacgcaaaaugacaauauauuuuucaauuaauuugcccaauaucuguguuuaaauguuuucuaaugcacacacguguuuuaaacucauuaaaaaaauaugacuuagaucccaucccacuuucauguuuuauauugccaaaacucugcuuuugggagaggugaguuaucuucacuucugaaacaguacugcuugggagcugguuuggcccuggcuauucuggggaaaugacacaauauugaccuagaggggcccuaaucuuuccccgcuagagcacuaccucuaauagggugaaggaugggagaaagaggcuagugaacccaccuucaggucuguccacucaggacaugcccacacuagccucuccaggggcucugcccuuggcauccccgucccccaccugggcucuggcagagaagucaggcgggaagaagccggcugagugcccgccacuguaagaggaaacgaagagaaacagcuccagucagccccagaagcgaggccuggaaaaacucugcagcuggagcuaacacaaaggacuuuucagacccugcagccaaggugcccagugagcuuuuuuuuuuuuuuuuuuuuuuuuuuuuaaaaaacagcuauuagggugacaagccuuuccaaaggccagcaguuggcgagaguuuccaggaagcuggucuggcacugggcugggauuggagcaacuuuaacgaguuaaguucagaaggaaggagucaucaggaaagguuuaagguucaacaaacuuuucaaauuauuuugcaaaaaguucuggcuuuccaauucaaaggcauguuucgcugugacuguuuuaagccagagccuauuuaaaaggcaacacaacuagcaugcuucagauucacucacucgagguauuugucuaaauccuccgaaugggcuuugcaagugccaucuagugccuaguaacacuggggccaucuuacacaucucgacaggcagcccuccuccccacgugccuccccccagccucuguggucgugugcgcgcgggcgcgcacacacacacgcacgcaugcaccuucccuaagcaggaagcugcucuuugccaagagcgaauggaauucagauuuccagaggguguccuuggccuccagcucuacggcugcaugaugaagaaagguccuagugugugugccgggggcugggagagaggggccuccagcucugcucacaucuaucugggccccaagaaaaacccacaacuggcugugcucuccccagccacacccagccuuggucacauuccuucccuuccugagcccacacuggguggccccggcaaaccagcuuccacaccucccuccccaccggcagggagaccuagcccaagcccccauggggcagccagcaaguacaaaugaggggcugcaccccaggcccaaagagccagaaagcacggagggcccuccccccaccccacccccaaugcugggcauccccuuguggcugcugucacucauggggaaagagacacacucccuugucuagcacccggugagcugagcucccaucccuuccugugccugcuuucaggaagucccucuucauauccaaccuugacucuccuggcuguggugcuugugggccugggauugaagggccaucacugcccuuugcaccagagcuucccaacauaccagcaagaagggacuguaccccuuccccuguccagucugggccuuccaagcccugagauucagcaaccucaggaauuaaacauuuauaggaaaacaccuaugcagacaagggacaugagucaggguggucaucagcaguagcaagguggguaggcuggucacguuuagcuucucuuuagcccaaguaauagggucuuccaccugcauggccagggaggggauaggcugagagcaaucuuucuacaggcugucagcaucaacaagugguugugaugagcaggagucuguauggcuuuucagguguuccggcucaaggaggcccaacaccaaguuggaaccuccaggccuggugccuaggcagaaggugggcuaaacaaaggccaaggggagcucugcucugucacuucccuuuguuugcuaaugagacuguuuccaaaagcuggccugguagccugugggauuguuucucucaagauuucuucuaggggagaagguggcugaggcuuugcagucugcaucacccaguccccagaaucuacaggggacucagcuugccuagucacaguucggcuuuuggccuuggcuccagggcccauucugauccucgugcuugggucagggauggucagcaccccugcccugaugcugccugcuggggucuccugcugaguaccgugaaggccuacuguggccugagaagccaacuucacugucccuuuuggccagcccuagacccuauauuuguucaaguaacacauugauucacuggcuucuccuuuaggcaaggccugcaggggacucagcugggguucaugauuccuugccaccuguggugggccugcauggccagcccaaggccucaagugccacauacugcuccccugacagucagguggcuaggguaugacacucaagaaaaugcccaggcagaacccagaguuggggucacuugguccagcccuucugaaggggacugguuggaucuguugcggggaggagacaggccaugcuggaccagcaaaaaagcauagaacuuggagucuggaaccugacaucuggccuuggcucugccaucagcuggcuguguccacugggcaagguccuaucauaucuggucucagugcuuccauuuacccagaguccuuccaucaccugacaccuacagggaugcuuucccaaucaaaauucaggccaugugguuugauaaggccaccuuccaauguggaagacaggcugguaauggagaggccugggagcacagagcuccuaggcacugccauggaauguggggaccuuagggaaggauaucucaauugaagcucuucagagccccugggguggacuguucuguacucucauccccuaacccauaccagccugagcucaaucauaucagccugugaaggcugccccaccacacugcuucugcacccaccacaccaggcccccuugagcucccaccuggagcccacacacccagcuggugggguucguggggcaguucaaaaagaaaagcagaaaaaagcauuugaguauuuuggacuggaaggaauucaauuuaacuuaacaaaucaggacaugaaccuaaagaaaacacugaaaaacaagcccaacuuugaaaggcccaaagagggaggauuaggugggagaagaaagguccccugugggcagaagacagcugcucaguccagaccagggaccaggggaggauacugggcuugagugcagaccgggccaggguagggagacaagcccaacauacacucgaggacuugaagucaggggugcuagcugacuuuuuagcccacucuuucuaccccagauacagagacuagcugccugaggaagcauagcggggcccacaggcuggcugccuggugcugcccaccuccucuccagggcuuggcucccuggggcagaaggcucagaccuauaaccacagugggguugcagggauuuauuugggggaagaacccugacugggucagaaugauuaugugcaugcauguauguguauguagcuccuuguucucugaaaagccuugccuaccacccuacuucccaaguacccucuauugccuugcaaagucaccccugcucucugccucaguuuccccagcagggcaccacaggacacugcuguggcaagguuuauacuuagggugcagugcagucugaucuuguauaaaugcucagugccaaagacuuaggagauaagucaggcagagucaaaauuaaccuuugaaaaaucccuugaauuggcccuaaaaauaaucccuuucucagaucuuuguguauauccccugcuggguugcucuucugccugcuaaagugggagaaucucugggugcacauccagaguacccugggagaggcaugccagguguuccuguaccuuuuucaggauauucccagugucaucuucagagggagccucugaggcugcagccacacaugggaaaagauuacuuauggagaagaucagaggcuaaggggcuggggaugguggggacaucggauuuugaggucagaccuggacuccugucuaccucugucucucuaccuuuuauuuuucuuuccuuuucuccuaacaaggcccuauuucuaagauggcaccucaggccucccaugggaccaaccaggccugacagacuaacugcucagacuaacugccagacuuccuccugcuagccagucacuaccaaggaugugugccucagauacagccccugcccaggacaccuacguugucccuaacagggcccacauaucuaaagcaugaaugccuagccaggggcucuggggcaccauaagaaggcaugaagcugggccugccaauuugcauccugggagggcaggucagccuuguccaggcaauccaggaggcuucccaguggcccacuggccagugaggaccuuugaccuccuuggcugguggcaccagguuuaugaugcacauagaggcugaacuugaagaauucuuauugcagagggcagccacaagagccacuggccagugcccagauaauaucugcagacuguucccuccugcuccaugggccacagaaucccuuugucuuguuacugcuacacugccuuccuaccaaucuucaggguucauccuggccucugccaugcauauccaggcucccccagagauugugugucugggaaugagcccuggcuucugcuccuaucucccagugauacuggcaagucccuauccuucuugaggcuucaauuuccccuucugugagcugggaggacaggcccacuagaugcucucugagggaccuaccaaggaugugggcugugugucucagccaacagcaguaucuccuaaccccaacacaagaaauacacauaguaggugucugguuaaugcucuuggaauuucagccuauacuaaccaucugaaagccacugagucugaacucugcuaccauauuugagauuaucucuccauugggcaccuauggguugccuagagacaagcuaccaugguccucuucccucgcccgucaugugcagggucaaaggcaggugagcuacacagcucgcccugcucuucacucugcuuuaaugugggugcuugccuuggcagaugggcccgacagugauaagaacaaaugacagaugcauacuggggcaccugugacugccaugagacacaguccacugauucugccuccaacccccuccccagagcagaauagugagugcuagguuuccgccuguaccuccacgggaccccaacagcuccugaaccccauuccgagauuugagguugugacuuggggaccucuagacuucccuucccuccaccugacuccagacuguccuggagcuugggacucucaggccucuaggcacaucuuauuaaggacagcagcugacagccauauguugugaccccauuuguaucccaugguaacucaugaccuggcagucucaaaagcucucaggccaaauaaggaauguccccacaggaucucccaucacaaagagacauucuaugcuggcuaauauuuucaggcauuuccccgagucagguauguggcuggaugccuaacaccaucuccucaaggccuuacacuaauacugugagauauacucccaauguauacaagaggaaacugaggcugauagagauuaggugacugccccaguguccugugggcaggaugaaaugacccaagcuggccagggcucccugacagaccuugucccuggauucagcgaacauacaucaaaccauuagcugacaaggaaugaaucugacaagcuguucaugaccaccacacugaaaacuacagggcaagguaaaagauaugaaagucaaccuaaauaaacaagggacacaugaugccauguuucaggagccccaaaacuauaaggauacccauucucccaugcccaucuagaggcugcugcgccuagaggaggcuuuccauggcaacuggcauauguauggugaggagaaacccugcaaagacagcaaagccagugauggggaaggagaagcagccagagccagcaggaccagcugucaaaaccuguuagcaaacuacagugagaaggaagcaagguccuggccacaaagaacaacuugaaucugaccaguggcacccaauaggguccagaaacagagccacacguagccagugagcugauuguaaagacacugauacggcaggguaguugggagaggacgggccuucccaugccgggugcugagcuagacuggauauccaaguaggggaagaguggaccuugaccucggccucacauuggacacaaaaaucaaucccagauggagugcagaucuacaugggaaaggugagcuaauaaagcuuuagaauaaaccagaauaucuuuaugaccuuggaguagucaaaguuucuuaaauaggacacaaacagcccuauccagagaggaaauguuugauuaacuggaccacaugaaaauuaagaccuucuguucaucaaaagacaccaucaagagaggaagaaggcagccugcagagggggaggcgauauuugcaaugugugugucugugagagagugugaguguguguaucucucucucugacaaaugacuccagaauaucuaaagauauauaggaccauaaauaaacauaaaacaggcagaagauguaggcaauuuauacagaaugauguaucugacuaaaugauaacauggaaagggacucaacuucauuagucaacagguuacugcaaauuaaaaucaccauuugaugcugcuagacauucaccaucauggcugaaaaggaaacgacggaaaaugccaaguguuaggauguggagcagccagaaugcugccugugggaaugaaaauuggaaugacuccuuugguagacugcuggguaguauucacuaagaguaaacauaugcccacccaggacccugcagcuccacacauaggcauauauuccccagaaacgcaaccugaugcucaccaaaagcauguacagaauauucuuaaacagcaaccuacaccagaaacugccugcuggccacaggugguagaauggaugaaugauguaggccaugcacacaauggagcaccagucagcaaggagcaugagggagcacucucccuucagccccauagagaggcugccagacaucaaauugagugagggacauuggacacaaagguguaugaguugcaucauucccaccgcauaaaguucaaaugugggcaaagcugguccuugcugcuagcaguuaggccugugguuaaucucaaggucagugacaggaaaugggagccugagaggcuuucuggggguucuguugcuuccuccgggugcugcacacaugggucccagggacugaagaugccucaagcugcgcacuugagaccuguguacuaaucugugugcaugcacauuacccuuuaacuaaaaguuuaacaccaccacccuauaccaggguagcccaggugagccuaauuagguggauagcccuggccuucagggccgcuaggcccagccccaucccacucccucacuuaaggggacacggcuuccagacuuccugacuaggucaccuccgugcuucagccuccagaggcucugcaguucaaucuccccuuucagguaucagcagagcacacaagagaucuauaugggaugugccccccgcccaaccccgccccgacccccugccccaacugccagaagugucuccaugacaauaucagugcaguugugaaguccuuugcccuccagccaccucuguggcgugaauguucucucugucacauccuccaacaccaucugcuuggcugaggaccugagcagcaucauggcugggaguucacaaguggagagggcugagccuggccagagugcacuggggcagggugauuuggauggccuuucccuugcagaggaaaugagaagccucacugcuuucuucugggccauccaccuagacagugcggcccucuccccauagcagcagcccuaggccagccgcuucuuccucacgugcucagacggaggaagugaaguuuggaaagguuagggggccacggggggccgccacagcugggcugauggcaggcuggaagccagauugagggcaucugauucccaaucccaucucuuucccacugagccauuacgccucgguuuuaauuuaauuagaagaacauuuaauccccccgugcauuucagagacggguuugagccuggcuggggcuauguggggcucugacggggauccuaugacucaugcagcccuguacagcccucccgggcgggcccccagagggcuuccuuggcaucucgugcagacagagguggucuggagcuuugcagaagacaggacacuggucuagaaagacaaaauggucucaucuguucuugacaagccccucacucauccuucuggacacugguucccagaauguccuuucuguccuuucccaccaaaguuuacagggagagaaauauggugaggagcuuagacacucacagagcugcagugccugguacccuggggucugugggaguaggucacaguggaccuggaugucuccaaaaugucccaggccaagcuggucccaucaaaagagcuagccccuugguccaugaagccaaauuuggggccacccuugugacguuugcccuuauuuccagacagcacagacuggcccuguccuugcugacaaaugcagaauucaggagacauuaguagugauguggaugaaagccaggccacagcggccuugcuggaaaagagcaacucgaaugucuuggcgugagauucugcaggguccaggagaaaguugaagacauggaaauucuaauuaacgcacacggggcuguuuuugcucaaggauuugcgaagcugucaugucacaagaggccaggcaagcacaugcuugccagggaggugcucacagucaccuggugggggucucugcagcuuucccucugccuucuuuccacccccucugcccagccucggggguccugguccucccccaugcccaucucaaugggccgggugcucccugagugucccucuggagagugggacugagggcgguaucuguuaaccucgagcuggggcuugcccaucuaagaugccaaaacagaagagacaggggcccuucagagaaaccacaugacugggcugggcagagccauaggcugcagggcuuaugggccuguccucuugggccgucuaucucagguauccaugugcaaccaauggggcagacgugugaauuccaggccaguccuggcuggcuuggcaguuggggaugcagugugagggaggauuucacaaaaaugauuucagccucccaggguugcuuggagaagcucacccaggccacaccugcacacagcccccaaguucagagccgcagauccucaggccccuagcccugugccucagcacuggcacaaugugucugcaguccuugcuucaucuuaggcaggguugagugagcagcaauccuagggcuucuccaugccuggggcuuuggggguucuggggaggaagagaccaagagggcuauacaugcccuucucccuccuggcaccauucgaaaggcuuagggaacugguacugagggcuuugagagccaaaggaggacacagccguacagccuaaguguguccugggggguuuacugagcagacguuggaaagaugaauggaaaucugguggcugcagaugggugacaagggcauucuagauggcagguuaccacacgcaaggcacagggaugcacacaggcauggcaccguccccacccacugucgugccagugacccuuggugagcagaggauagugagugggucagaaucccaggaacucauccuggcucuugggguacagggcuccucuugucaugggggugcuccccaacugcccaugcaggccuacagucucuacuucccaccuuucucucagaagcccugucauaugguucugggugggagacacaggcucagggaguuugaggcuggcagggacucucuugugccccauucaaccuaggaagacagcuucugccugaaagguguguucgaggcugaguccuggccgcccagagcugguugaggguccugaggcugagcaguagggcccaccuauaggcuggggugcagcgacgccacucuuuaucuccuggguaccccgugccucagcuugucaugacucccuagcuugcaucaggccugcucaccccccaccccaccucuggcuaacaggccccggaaagaggagcuucgcccagccccagggaccuucccguaaucaaggcuauagugaccucaccucucuggggcccugcgggcggggagagcucgagauggaaacaaaaugugucuuuauuuauguuuuuaauuugaauucuggaacuggcccagcaugguaauacauuuaacaucaguagaaugcugaagaaaaauggaaauguuuuuugguaacugccucccacccacucugcccccugugagaccccagcacacaucccugucccucacacacaccagggcgugugccucucuucccaguucaggguccauggggccaggcugcccacaggagcuucgcugcaucccugagcagcuggagccgaauuuaauuaugggcaucacugggcgggcugugcaggagguggaggaaugcagccccaaugcgggcagaagaccugcacggcccccacaccccugccgccaggcgguuugggcccugaggaaacagggugcccacugcugccagccuucucccccagauggaguggggccucuacccagccuguaucccagaggagccuggguuccuaggcccugacacuguacgugcccacucuccccuucaggccucucuggagggaccguacccugacuucugaggaugcaggaacccagcuccccugaagccucagcccugagucuucccugaccagaacacaaugccucaagguggccccuuugcagcaaccuccuuguuuuucccucucccaguccccucuucagaucccucaccccaagccccaugccugggcuccuuccugccuucccaggcuggcucauaucuagcagccacuuuuggaacagccugcucugagagaggccuugguaaguuacagggcagggaccugguuggguaaugacuggagucucugaccugccugggcccacuuaucacuggaggccaugggagugccaaccugaaaaggcugcaggaucuugcagaaugguaaugugccagacccaaagugggcagagagcuuggggauggauguucaggucucucaggcccugucauccuggaguggaacaagaaacagcccaguguccuagaugacacagccacacuggcuuggggucacccuugggcagguggguaaccucuggcuccagggagcuuggcaugugcugauaccagcacuggcagcccucacccccauaguggugauuuacugggcagcugcaaguuuggcugugauccacauaagugccuggucucucaccaccuucaccugcaggggccuugcaagacccaagaguugguaaggccuggcugcccagcuagauggacugugggugauggcccucuccucccaguaggacuuuuugcaugucuggaugcugguccgugaccaagagaaccaaggugagcgagagcuccaacaggagaagcaagcagccagaaggaugagaagggacaguccccucucugaggggacagccaagaggcaauacaggcacugccaccuguauugcacacaacaugagccacuaaacuaacacugaucacuuuggagguccaucauauccaggacuugguacaggccuuggccacaguguaagccaucauucugccuucuggugcugaccuguaccugggcagcccaucuggcuaccagccugcucacaccucugcuccugccuuuuuacccagccaggaggggcccagaagcucagagcccuauucucaggguguccaugacuagucaccccugcuuuccagugaucugcuggcucccuuggagccucuucacacccuacccaccaugagguacugccaaccucucugugaacugggggggccuggaaagacagugggcagguccugucugaucauaauuaccccuuaagauagccacuccuucccuggagguggccucauucuggcuacccaacccugccaguucucugguuacaccugcagcccccagcaccaugggucccgauuuccucagugauuugcaaggccaggccuugcaccuggcuggcugcaaaggcaggaggcccagggccucacuacgacaaagacacacauggcucaggacaaccuccugacccccagagaguccaaagaacaaaacacccuuuagaaaaauguugguagagagaaggagaguuuccacaagugacccucagaagggccgcgagugucacucacagaucuugacacaaagacauuuaucaaggggaauccccaacggguuagcagccagaaugggacuguggccagaauggacuugggugccccacugaccccgcugcacggcugucaccgcugggcaccccagcggggagucacaugucgcaggggaaucacaccguggccgggcaccggggauuggccuggccaugccgugacggcgggggaggacgggcaugcaucccaggccagcugugccucaggggaaggccaacuggaaggcguggaaaaucagccauuuccuccaccugaaggagccccugaggacagcagcagcaacuggcagacugcacccggcaucugccccauggcuuuggccaggguuccauggggaaaugcuaaaaaacaaagucgucucuuuuuuggggggcaggggagggggcugggggagagaaaaacaaucucagacucucaaagcaugaaaacaaguggaaaaugaucagucugguuuuccauaagucaaaacaagaggaucauguucccaggcucagugggaagugcccuugcucuccucucuugccuggugccuccguguuggggccaggcagacggcaaguggugggcacuaggcgaguagauagcacucuggccagagagcaaggcuuccccagcaccaagucugacuccuugagcuccaguccccuccagcccagcccuucacgcacauguaggcacucacugugagaugugggugaugggugucagcagagucuccccuuccagguccagguccucggcgaagcuguugguucucaugaaauggggcaugcucacuuccagcaguguugggcucuuccuuacugaggagaaaguguggggacagcacguuaggccucccacccaaccugccagugcuguggagccaggccugugagcucccagggccaggugaggaguggagcuugugccuggaagcuccagcccugacaaucaguuuuauaguuggguguugggguggguggguguuuaagauggccccaaagugccugacaccucagugucugaggagaauaaaggccagugaaucaucuucggagugguaacugugccuggggcugugcucagguguccaagacucuccccaccucagguucugggccucuucccauguucacaacugacacuugggucaagaauaaaacagaggugacaggcacaggccugguaagggacaacagcucccaccaccauacauugucacacucauacauugacagaguagugggucaggaaagauggggugauaggaccucugacccaugaggaauggcaagccugggaggugggggcagccacagaacuccuuccucaaaacacgaugcuacaucaaccaguuguacccccaaugaggcacaggagucccuccaacagcuggcuucacauuaugauuccugggcccaccucugcaacuuugacacaggagcucaggauacugauccuuaucacuccccacucucuguugacacuaucaguauuugcucuuggcuuauauuugucuucauuuaaauauuuuauugcaaaaggauuaaguacucaucugugagaaguggaauaauucaaagauucacaauggcuuuccucccccaaggucaucaguguuaacugccaacuagaucccuagcccacccucucugcucauccgagcagcagaugccaggugggaguugcuuuuaugcacaugggaugucacugugacucuguuccugucacucuguaacauaagcucauuucauuuuucucuagguauauaggcauggauuuaauuauuuuagucauuacauaauaguccacaguuuagauuggccacagcuaaccauucuguauaucauggacauucaggcucuuauaguuuuaagcugcuuaauuauucagacuaugaugccauauucaucuuuauucuuaaaagcugacauacuggagcagggugagaggguguguccuuaguaauuuuaauaaauguugcuagauugcuuucccaagaaguuguagcaauucaggcucccccagcuuucccacauccaugccugaaugaaguguugaaugaagcccgaaugaagguugucagcaccuuuugcagggacuaucaagcauggaugaaaacugaggcauugcuguuauuuccaucuguguugaauaccuuuuaugggcuuggcaucuguuuggguuuccucuugcagaauugccuguucauguccuuugcucacuuuugcuuaucacuuuguaggaauuuucuauacauuacagacauuaacuccuuguuauaugaggcauagauagcuuccccagucuguuuuuucaccugaauuauguugcuuuuauccuagaaaauguuuuauguuuuuaaagugauacaucuuuugcuuuauaaaaaaggaagguuuucccacaucagcguaauacaauucucucuuaaauuuauuccuaauuucacuauuugaauguguuguauguauacauauguauguguguaaaaguuuuaaugcauuuaguaucuaugccugauaggacagaugaucaacaauuagaaaaugaaaauuuaaaggguacuacauacaaacuuacugaaaaaaaaucuaaaauaaaacauaaaaccauaaaauaucuugaagaaaacauaagagaaaaucuccaggaccuuggauuuggcagugaauucugaaauacgaaaccaaaaguuuaacucguaagagaaaaagaaucaacaaauuggacuuuaucaaaauuaaaagcuuuugcugugcaacagacacugcuaauggaaugaaaagacaaagcacagacuuggaaagaauauuugcauaucaccuaucaggucaaggacuugcacucagaauauauaaagaaugcuuacaacuugacaauaaagugaacaauccaauuuuaaaaauggauuauaaauaagcacaugaaaagauacauaauuaacauaaauauggaaaugcaaauuagaaucacaaugaaauuccauaaauuaaaaaaaaaauucaaaaccugacaauaccaaccacucuugaggauguggaacauguagaacucucauauguuacuggugggaaugcaaaauggcacagugacuuuaggaaauaguuuagcaauuucuuauuaaguuaaacauacacauaccacaugaccuaucgguuccuuucccacccaagugaauugaauuuuuauguucgcaaaaaccuguacauaaauguguauaguaacucugcucauaauuaccaaauacuggaaacaaugaagauguccuucaacaggugaaugcauaaacaaaauguauauauucaugcaauggaauaccacccagcaauaaaaagaaauuaacuaaugauuuaugcaacaacauggaugaaucucaaaugcauuuugcuaagcagugaaagaagccagaugcaaaagaauacauauuauaggaucccauuuauaggacauucuagaaaaacaaaacuacagggacauaaaacagaucaauagcugccagugguuaggggagaaguacuugacuucaaaagacucaccccaggguauuuuuagggguauggaacuucugugaaugauacuggauuguggacacaugacuccagacaucugucaaaacccacagaacugaaucucaaagaguggauuuuacuguaugcaaauuuaaaaaauuaacccggauguuggaggacccuacgaugaaaagcagacuaugaugagcguguuacaaacaaaugacauagcagugaaaggaaaggaggaggaggagcuggcauauguugcuuucaaaaacacuguuuugacuggacacucuaugguuaaagcaaaagucuguccuaaacacucuaaucuaguagguaaauuugcuucacauaggguacuacguguacaauaggguuacacaaauaaguaaaugaacuguagguaaugggagccagguuucuagcugucagagaaaaagcuauaaauaaguugugggggagggggcaaggaugaacucuggucagaaaugucaguaugaacucaugguuagcuuuauauagauacagauauguaaagauguauguguacucagguuacauacauacauauauuuccuagcucuguccacugagaggagacugaagcaaugauacccuaguagccacgagcauaccccgugccuagauccagguuuucuauucauucuccagggagccagggcucucuggaugaauggaugauucuagggcuaggguagggaaaauaaaagaugagccugaaguauugucaagugcuagaaaagaaaugcuuaaaaauaaaugaaaaggauggcggggggcacaucaaaaggacacaugaacccaccaguggccacagcuugaacaauuugagcaacaaaauaaauaauauuggacuauaacucaaaaaauaaauacucccaaauccacacugauaaaauuaaauaaacaauuggaggagagggacaaaucuuccuuauaaaggaauuccaaauaaaaaauguagaaggaaugaggaaaauagaaguacaucacgguaauauuugcugcaggaaaacgauccaugaaugaaugcugaaauuaguuagugaaacucagaaacuucacaguuucuuccuugaaauguauuuuaauugcugugguaguuuuaacauauuugcagauuuuuuuugauacucuccugcaggagguagaguugaaccccucccuuccccaccuugagugugggcuauacuuagugacucgcuucuaaagacuaagcuauggaaagggaaaaacagcuauucacuuacaguggaggagccuggccgacaccacuuuaaacgaguggcucaagguuaauauuaccagugauaaaccauguugaugucauguuccacaaugaggaaagcaucucaccucacuggccuccuuccccuaaaccuauaacccuggucuaguccugagaaaacaccagacaaauccaaacugagggacaaugacaccugacugguauucuucaaaagugucaaguuaaugaagaacaagacugagaagcccgucaccgaucagagaugacaauaaauguaaugaucgauccuagaugggaucuuggaacagaaaaaggacauuaguaguuaaacuggggaaauccaaauaaauuuauaacucuagcuuaauaguguaccaauguuaauuuuuuaguuuuggucaauguaccaugguuauauaagaugcuaacauuaggggaagcuggugaaagggauguggguacucgguacuauuuuuguuucucuucuguaaauaaaaaaugugagguaacaagagaaaacagaaccuguauacaauagcacaaaagaauauuaauuaucuaacuaaguauaugcaagaacucuggagaaaauuguaaaacuuuaguaagagacaaugaagaagauauaaauggagaaauaugccuucauuccaaugacuagaagacucaauacugaaaagauuaucucaaaaucugaauaaaucucuccaaaucuuaauaaaaaucucaaggcuucugugugagaacuuuggcaagcugauucuaacugcgacuuggaagugcaaaaagccaagaauuggcaauauucuugaagaagaacaaggugggagaacuugcuguaccaaacaucaguacuucuuccaaggcaguggucauuagggcaaugugguauugacacagggagagacaaauaggccaaugggacaggauugagcauugggaaacagcccacacaaauauggaagcuugcuguguaucagagguggccugcacauccugggaagagcauggacuuuucaaucaaauguucaggagcaguuggauacccacacuggaaaaacauuaaguuggacccuuaauuaccucacaucauauaccaaaaauucauucuugucauucuaggggauugaagaccuaacuaugaaaagcauaacuauaaaggucacaugacugaauauagaagaauaucuuaaugacaucagcauuaggaugguuuuuuuuaaaagaagcaauaaccaugagagagaagacugaguaauuugacauuagaguuaagacccaaucaucaaaauacaccuuaaagagugaaaagacagugcccacaaaaugcaaaggacuccuacaaaucaauaggaaaaauauaaaugacuuaauagaaaaugggcaauagacaaaguagcacaucacaaaagaggaauccaaaaggcugaugagcauguggaaagguguugcgccugacuagcaaucagggaaauguaaauaaacucaggagcucauggcccgugggggcgaguggcagacuuccagcaggaaaccacacagacauuacuuagucacagccaggagaagggcucagagugaaagggcucugugcccaugacauccuuagagagaccagggaaggaccuguaaggcuugaagaaugugcagauuuggagacccacaggucugggaccuggcagaagcauguuacugcccccauuuuagagauuuggggcugagauucaaguacccuagguuauauaaugcaguugucaagugacagagcuaaaacuucauccaggauucaauuuuuuuuaaaggaaggaagaaagaaaaaacauauuuugauguuugcaucacuuguauguagaaggaacgauggagcacaggcuagaacguagaguugcuuuccaaacacccaugaugacaagugcccaucuccaaagccugagggccaagggugagccaccugaccccugaggaagguucuguccugguguuuuaggaaauuaaaaugugcacaucaguuggcugcccagagugggugggaccugcaccugccagagaggaaugugugcuuuuugguuuaauccugggaacggcauauggggccccuauaacaaggggcagagaaggccuccacagauuuguuuuuccaauucaagaggagagguuauugucugcuggcuuguguguuggagacuguggggcgugcuuucuccaccacagggaggcagugaccagagcugccaccucuucccuguuuucaccuguggucguagccaggucaggcaucuaggagagcauggaggggagcuggggguggguggguggggauucagcucuuuccagacacacuggugcugccucuuucaggccagggcuugagggcaagugcugugcccuaacaggucuugcuugucacccccaccucugaaguggguauuucacagccugaacucacagcugcagagaagguugagcccaugguguacuugaaagggcaguucaucuggauauccaggcucugcaggagguaccggagcaaugccaggugcccuuugcugaacugccuagaguggcuggcccuggggacaaagagcacagcauccuggugacaaugaagucacacuuuccuaagacaguccugguuuuugaugcuuuaauucuuuggcugccuuugcuuugucaaggccaggaucugggccuaaauuuucagggcagaacaaaacaauuuuguuuucuaggaaagugggaggucugggauggcaaaggcagccucgggcguggcgacuaccccagcuggggacgcuggcugccaagucucacccucucaagagaacaggaaucaaacucagcacagcauccuccuuucuagucagugguccugcucgauagggggauuugaauuuuauuuuuuuaaaaauacaggcacagaaaaaagacuagaaggaaacagauccaaauguuaacuuugucuuugggugauuuucauuuccuuccuuauugugucuguguuuucuauuuugcaugauacuuuuccaagucaagaaacaauaauuuguggaagucuccuguaucugugccuugcucucuggcccacgaccuugcacaucuuauccuagaguugccagaauaugucccuccaccuggccuggagcugcccaugaggcuacauagagcucuccuaucaugaaagucuuugaggcuuucuguucccaagaaauucuggucucacuuccucugccuucucaucgagccccagaccccucccugcccagauuaggucagcauucaagccccaaguccagccuaugacaaagcucaaagcuccagcccaucucugcugcccucugcccucaagagacucucgccagugucugggcccuuccuaguaacuucacccaaccacucacccccugcccuuccccuccugauugauuaaaauccggccuaaucucccagguguaacccaagcccucuuccacaagcuuuccagggcuccggagauugcccccuccccuguacggcugcagggcuuaugugugccuggcgcucagcacgggaaccuugccuucugccucacccaugucuccccaggguuuggcacaggcgaguucccugagccagccuacuucacaaggaugaacagaagcucucccuauccuuugcaaguagaagcccccucccuggcccccucaagaaaucucccccucucaguggauucaccaaagcccugcggauccugcacugugaaggagaagcccuccccaggggcauccggacagcugcagccaggcccugcgugacauugcugagccgcagccccacagccugugccagcugcccaugcccggcucauagacccugagccagaguggccccgccaccaccugugucuccacucagaggcgagaaguaagggacauggauggaaaguguaaaagccauucccacaacagcugccaggaacaaggcgaggaauggagugaaaauguauauucacagcuggcacccaguuccgcuuaggaaaauaccuugcuugaguggacaccuguuguuuuugccugccagcagccaggccuggcuucugggaacagcuucucaaaucuuccuuagggggcucuuccuuucccacuccuagugugcaguguuuagguacccucuggccauccccaaaggggucccuguggaccuugccucagccaucggagguacagcugcagguccaaggauggcuuguaccccagcugaggccaauaagaaccuggccuuagauucuggcaggaauccuggaagagaugaccucguucugcugggcuuccugagcuguugaaugcaagcugguggccauuuugccccuuuuagaaaguagcugccuaaggauacagccaucccauggggccaauggauagagagcaagggaaagggagaacaaaagagggaacgggaagggagaaggggagugcaagaggggagagugagagcaagugagcaagaucaucucagcucugggguccagcugugucugaaacagcuggguccagcugugugagccaaaaaaugucccuuuugugcuuaagcuuguuugaguugggguuccaucauuuguuaccaagagagucuucaggaaugugcaugacaaaguugggggugaggugugagccuacggacaugggccugggggcagucaagguuacaaaauagcuaaacuggucugcacugcccccacuaguuuucagggcagagggcagggagaaggcuugugggaaagaagcuggccugaggccaaggcccuggcccuagcccugcaacagcacagggaacucuuggaaagggauuuccuaaggugggacauuggcuuucuacugcugugaugcaaguccucaucuccccaaaccuucagugagccucucuccacacccugcuguaugaggauguuugaugcaaauuauggaacauguuggaucucacauuggaucaaaggugugcagaauagauuugccucaagcaugacagugaugugacacagucaaagaugacuuccggaauccugagaagucccagggaggaugcugggcuuuccaaaaccuaaguuuaggauacugaggaccacaccccacaccccaaacacuucuccuuagaauaaguauagcaagccucagcauacacaaaucucagagugaacggaaaugucucugcaggcccaaggguggggucugaguagcgggggcgcugaggaagacaggcagugacagagccaggacagggucaacccugagcgugagugagcccaggaaacggaaagagagcaacacagccacccacacaacuaaaaucgacccacccgggucuccaugcugcaggaagucacugucuaggucucccaagacacauuuucaggggaagguuccaggcagcaagagcagcccuaggaaacuuuaauauacaauggaaucuggguuaagcacuaucuucuccaagaguugagcucacaggacauuccccagaaaccucuggagagguggggaggaaaguuucuggaggucuuuggauggagaaaacaaaaaaguggccuugauuuucaagacaaaauuacacaggaagaaaaaaauguuuuuaaucuaauuaagagcgaucuuuucaccuucaucacaacaucgcggaaaugugccaguucuuaacuucacacaauaaucaaagcaauuagugagggagaagccuuggaaaccggugcagauguucucagaauguuuaauggggaaaugaguugcaggccucauucucagcauccggcuccaggcccuggcuaccaaauccagacaucugcuggggccccacccccaggccccgagggcgcgggcuugagaaacacaggucccuucccaggccaccucccagccaggccagaacuggggccgagaggcuccccauagcuucucaaauuggagccuggacacagucagagccaccccagaacuggggggaggcucaacaucaaaauuauguuaacaacugaugucaaaaguaaucaacucagcuuggcucccccacugcugcuggcugcaggagggcugugaguaggaggagagcaagcggccccagagggacccucggcuaugacccccucagccugaacacuacuucaagaaaagaugugguggcaucugucugguaugguccugugggcuccauuccaaugcuaauggacucuuaaggggcccaggaaucaaaauggucaacacuugaggaauuuccaguaaucagagaaaacguauagaaaugaggaugaugcuuacuuaggaaauggccuauuacaggaaacagagggccacguggcuaaugucagugagcugugggagagacagagaccccagguggggcaggcagaucagcaaaucuuggaggaccugcuauguggcaggcacuggagacauggagguaaagaacacaauauccauguucucagggacacacucauaugcccuuagcauucacguucuucacacugacagcuucuuaaugcaagcccaccagauacuuucauaagcacuaccucugacuucaggcacuugcugagcugcacacagggcaggccaaaaggaauggaaagugagccaccaccggggcagcacucacuagugaaagauaaauaccccagcucucucagccgcuuguagaacucugaggaguguucugugcagcuucccagcugcccaccaugaagcucuuucucaauaagugaccagcacagcuuaauuccugaauuaagcugugugugcugugagacugacacaagacagggugacaggaagcugucggaacauuugaguagggaagcagcaagauccacuguacauuuaaagaacucccuugagcuguuaugugaagaauggaguacaggaagcaagaguggaaaucaagagaccaguaaugagguauggacaacaauguaggcagagaaaugguggugguuuuaaccagggagauagcuggagagacuaggugugggcaaauccagagaguugauaagacauacugauagauuagaaagggguacuaagaaaaaaggauaauuuaaaaaagacuuucagccaggcuuggagaaaaauagcaugcugcuccucauccccucugacuauaaaucaucucacucauccuccccuaaaagcauaaaaucaguaagugcaaauaaaaccacaugacccaugcuguuagcaguauuaggagaaagaauaccuucaaauugccuguggguagcaaagugagccaaauuccaauagcauucuaguccccugcccagcacugcaaaacugcauacagaaucagagaagaggcuuaaaaugcuuugucaaaaaguuugaagguaguuagcaacaucagcaaaaauagaggaguaaguaccucuaaggagccuucuugccuucacagacauccuaagcaccaagcagccuaagccacugaugaacuugcagauaccacugauguggauuauagucuaauuaauuguagagacaccacacuucugcacugaaccagaaccaaagccaaagcacccuacccaaaugauacuacagacgcguguacaggaaaaguccuuacuaaggcuacuccauaaaauuggaagucucuguuauuccagauaugcagauaucaacuuggggacacaaaaaacuuggggggaaaaaaacaagaaaacaugacuugccaaaagaacacaauaauucuccaauaauagacuccaaaguaaaggaaaucuuaaggaaacccaaugagauacaagagaacacaaauagacaauacaaacauaucaggaaaacaauucauuaucuaaaugggaaauccagcagaguuagauaugaaaaagaaccaaacaaaaauccuggaggugauaaauuaaaugaaugaaauaaaaaauacaauugaaagcuucaaaagccggcuaagucaagcagaagaaauaauuucuaaauuugaagacagguguuuugcaauaaaccagacagauuuaaaaaauaacaauaaaaaagaaugaagaaugccugcgugacauaugagacacuauuaagcuaacaauauuucacauuuugggaguuccagaagaaguguugggauaaggaccagaaaaucuauuuaagaagauaauaccugaaaacugccaaaguuugggagagaaagagacuaacagauaaaggaagcucacaaaucccuaaauagauucaacccuaaaagggccucucugaggcacauuuucaucaaacugucaaaaaucaaagagagaauuuaaaaaacaagagagaagcaugaagucacauauaagggaaucaacagcagauuaacagauuuuucagcagaaaccuucuaggccaggaaagaauugaaugccauauuaaaagugcugcaagguggggaaaagcucacaaaauugcuagccacaaauacuauacccagcaaagcuauccuucagaaaugaagcagaaugagggaagaaauuuugccucccucagacaagcaaaaacugagggaauucauuacuacuaaaucagccccacaagaaaugcuuaagggaguacuacaucuggaaguaggaggaugauaucuaccaucaugaaacuacaaaagcauaaaacacuaguagagcagauacacaaaugagaaaggaaaaggaauaaaagauuaucacuacagaaaaccaaaaaauugcaaagaaaaacaaugagaggaaacaaaaguauacaaaucagucagaaaacaauaaaaugacaggaguaaguccucaccuauugauaacaaucuugaauguagguaauuuaaauuucccaaaugaaagauagauacuggcuaaaugaauuaaaaaaauaaaacccaauuacaugcugccuauaagaaacugacuucaccuguaaagacacccauagacuguaagggaauggauagaaaaagauauuccacacaaacagacaccaaaagcaugcaggaguagacagacaaaaaauacugagucaaaaaaaaaaaaaaaaaaaaaaagaaaaagaaaaaagagacaaaggaggucauuauauaauuauaaauggaucaauucagcaagaagauauaacaauuauauaugcaaccaacaacacuggaguacccagguauauuaaacaaauauuauuagugcuaaagagauagaccccaauacaauaauaguuagggauggcaacauuucauacucagcauuggacaauucauuuggauggaaaaauaucaacaaggaaauauuagauuugaacugcugcuucguuagcacacagcacauucuccaggauauaccauauguuaggacacaaaacgggucucaauaaauuuuuaaaagucaaaaucuuaucaaguaucuucucagaccacaauggaauaaaacuggaaaucaauaacaagaggaacuucugaaauugaacagauacacggaaaucaaacuacauguuccugaaugaccacugugucuaugaagaaauugauuuuaaaaauuuaaaaauucuuugaaacaaaugaaaauagaaacacagcauacaaaaauguauaggguacaacaaaagaagugcuaugagggacauuuauuucaauaaacacccacaucaauaagguagaaaguuuuuaaacaaauaaccuaauaaacgcaucucaaggaacuagaaaagcaagaacaaaucaaaccuaaaauuagaaggaaauaaauaguaaagaucagagcagaucuaaaugaaauagagauaaaagguaaaaaagacaaaagaucaaugaaaugaggccucccccccaccccccgagacacggucucacucugucacccaggcuagagcgcaguggugugaucuuggcucacuguaaccucugcuuccugggcucaagcaauccuccugccucagcuucugaguagaugugcagcaccacaccucgcuaauuuuuuuuuuuuuuuuugguagagauggggguuugccauguugcucaggcuggucucaaacuccuggacucaagcgaucggccugccuuggccuuccaaaguacuggguuuacaggugugagccaacaaacccagccaaaaaacugauuuuuugaaaagagaaaaucaauaaaccauuagcuagacuaaccaagaagacccaauaaauaaaaucagaaaugaaaaaggagacuuacaauggacaccacagaaauacaaaagauuauuagagaccauuaugaacaacuauaugucaacaauuagaaaaccuagaggaaagagauaaauuccuggacauauauaaccucccaagauugaaccaggaagaaaaaaaaucugaacagagcaauaacaaggaaugagauuguaucaguaauaaagucucccaguaaagaaaaccucaggauugcacggguuuucuacugaauucuaccaaaccuuuaaagaacuaacaugaauucuucucagacaauuccaaaagacugaagagaaaggaauucucccuaacucauucugugaggcaagcaguaucuugauaccaaaaccagauaaggacacaauaacagcaaaaaagaaaacuacaggccaaucucccugaugaacauagaugcagaauccucagaaacaaaacacacacacagacacacaaacuagcaaucugaauccaaucgcacaucaaaaagauaauacaccauaaucaagugggauuuaucccagggauucaaggaugguucaacauauacaaaucaauaaaugugauacaucacauuaacagaaggaaggacaaaaaaauacaugaucaucucaauagaugcagaaaaagcaucugauaaaauucaaaaucucuucaugauaaaaaaaaaagcucaucacauaaugucuagaaggaacauaacucaaugaaggucauauaugacaaacccacagccaccuggggaaaagcuaaacaccuucucucuuagaacuagaacaagacaaggaugcccacuuucacuauucuuauucagcagaguaagaaaaguccucaccagaacaauuaggcaaguaaaagaaaaaggguauccaaauuggaaaagagaaugucauauuguccuuugcagauggcauaaucuuauacauagaaaaaccuaaagauuccaccaaaaucuuuuagaacugguaaaggaauucaauaaaguugcaggauaaaaaaaucaacaaacaaaaauuaguagguguggacaugauggcucaugcuuguaauuucagcacuuugaaaggaugaggcggguggauugcuugagcccaggaguuugagacuguccugggcaacauggcaaaaccucaucaguacaaaaaugagcugggcgugguggccugcaccugaaguucagcuacucaggaggcugagaugggaggaucacuugaaccucggaggugaagguugcagugagcagaaauugcaccauugcaccccagccugggcaacagagugagacccugucugcacuccccugccucccccaaaaaaucaguagcauuucugugaaacagcaaauuagccaaaagagaaaugaagaaagcaaucccauuugcaauagcuacaaaaaaaagcaaagcuuaaccaaggaggugaaagauuuccacaaugaaaacuauaaaauacugauaacaguaauugaagaggcuacaaaauuuuuugagacaucccaugcucauggauugaaagaaaaauguuaaaaugaucauauuuaccuauagcaauauacagaugcuaugaaaucccuauccagauaucagcaggggcuucaagauggcugacuagaggcaucuggcacucaccuccuccacaaaauauagcaaguagguaaccacaguuuauauagaucgccucugagagaaugcuggaauucaacugagaaguaauaagaaaaacccaaugcaagggauaagaggggagucaggcagucugcuucuaugggacuggcugggaucaugaagagacuccucgaugugcagaaagguaaguaagugagccccuagugguccacauucccacagcagacuccugaaauccuagucagagaacccccugacccauagaugccuugagacuaacaagaggcuaccuacagacugugaaauggcaaugaacagcucccagagagggagaucacccugaauccucaggcaauucacacauccccugaauccucaggcaacuucaggaaagucccauuuugauagcccaacccccaccagacugcaucugcugugggccccacaucccucuaucucaucccuggagccccauggacaucccuuacacaaagcugguugccacuccugacugcucccuccaggccaaagcaugagccauuggcaauacucugcuaccuccgaagcaaggcugccaugaggaaaggugacccugcccauagucaccaccuggggccgaagcaugcauugcccaacugccuguuuauagcugcugccacugaaagcaaucccacucaacuuccccaggaguagggcugcaauagaguugcugcugccccaacaugagcauucagcaggguauacagggaucuuccugugccugccuaccacagucaguacauucuugcauuacuggagggccucaggacaggcccaccuggccuggucccacccucuuuucucccagugccagcgcauaccaucucugggccuagggaucacccugcccuauccaguauuguuggcaccugagcacuccugggggcuugaggacugcccuacccaacugaccauuaccaccacaacuggcauucacuugaauuugccaccugugggccuugggacaagcucauccagcuuaucccagccaucccaauaccagcauggacaccuugggaggcagaagauuguucugccacugcuacugccauugcccaagccauaucugcugcucagagcucaaggaccuacccacccuguggcccagcucugucaucauuggcaccugagcaaguugccuggaggcccaaaauugguuucccuggacuugcuaacacugguaccagcauacacuaccauugggcccaaggauaagcauucggggccagccacugcugccacuggggccugaggacuggcccagcuggugucccuauccccagccagacuuuaccacagccuccaccaacaacugcauccuaaacuacagaggaacucccagacacuacuggugcuguuuacagcugaaaaaaauuccauggagaucacacuacugcaggcacccagaaucaaaaccaaagugcccugcccaaagaacaccauagauauaucuucaggaacaagacucucuuaggaaagacagaucaaaaaauuggaagaaacuacuguuacaccagaugugcagauaccaguguaagcacacaagaaacaugaaaaggcaaaacaugacaacuccuaaggaaugcaauaauucuccaacagauuccagugaaaaagaaauugaugaaaccuugaaaaauucaauauaauauuaaagaagaucugauagacuauacaaagaaaucagaaaaaacaauucgggguaugaaugagaaauuugcccaagagauagauauaaaaagaaccaaacagauauucuggaauugaauaauagauugaaugaaauaaaaaacauauuugaaagcuucaauaacagaccacaacaagcagaagaaagaauuucacaccuugaagauaagucuuuugaaaugacucagacaaaaauauagaaaaaauagaaaagaaugaacaaaggcuaugugacuauaggaugccauaaggugacaccuucagugucccagaaggugaagagcaaaccaaaagauuauaaaaccuauuuaaugaaauaauaccugaacacuucccaaucucccaagagauuuagauccaaauauaggaaucucagaacccuaaauagauacaauucagaaaggucuuuuccacagcacauuauagcaaauugcccaucccaagacaaagagagaaucauaaaaccagcgauaaaagagguuguagacacuuacaagggaacaaccugcagacuaacagauuuuucagcagaaacuuuacaggccaggaggaugggauuauauacgcagagugcugaaagaaaaaacaaaaccaaaaaccugccagccaggaauacuguacuuagcaaaguuauauucgucagaaaugaaggagaaauaaaguauuucccuuaaaaguaaaagcucagggaauuaauugccacuacacuggcacuacaaaaaaugcuuaagggagucuuacaggaagaagugaaaggacaacuucaugaaagcacacaaaauaaucagaaaucaauuaaugacaggaauaagcccucacauaucaacaauaaccuugcauauaaauagauuaaacuuucuacuuaaaagacagacuggcugaauggacuuaaaaacaugacccaucuaaaugcuaucuacaagaaacgcaucucaccuguaaagacacauaguugaaagaaaggaaugggaaaagauauuacaugcaaaaggaaacaaaaaccaaacaggaguagcuauacuuucaucagauaaaacaaagguuaagcuaaaaacacuaaaaagagacgaagucauuauauagugacagagggaucaauugaccaagaggauauaacaauucuaaacauauaugcacccaacaccaaagcacccagauauauaaggcaaacaucaaaucugaagggaaagguagacuucaacacaauaaucuugggaacuucaauucuccauuuccaguauuagacagaucaucuagacaaaaaauuaacaaagaaacauuggauuuaaacugcacuuuauaccaaauggaccuaacagacauuuacagaccaguucauaaaacagcugcagaauauacacucuucucaucaguacauggaacacucuccaggauacauuauauguuaggacacuaaguaugauuuuaaauauauauauauuuuaaauuggauucauaucacauaucuucucagaccacaauagcauaaaacuauaaauaaauaagaggagcauucaaaacuguauaaauaaauggaaauuaacauguuccugaaugaccaaugggucaaagaagaaauuaaggcagaaauaaaaaauuuacugaaacaagugaaaauagaagcacaacauucugaaacuuaagggauacugcaaaagcaaugcuaagaggaaaguuuauuguaauaaaugccuccauuaaaaaagguagaaaagaucuuaaauaaucuaaugauacaccugaaggaaccagaaaagcaagaacaaaccauacuaaacauaaaauuaguagaaggaaagaaauaacgaagaucagagcagaacuaaacaagaaacuaaauaaauauaaaggaucaaugaaaugcaaaaucgguuuuugaaaagaaacaaaauaaccaguggcuaaacuauccaagaagaaaagagagaagaccuacaugaauaaaaucaaaaaugaaaaaggggauauuacaacucauaccaugaaauacaaaaaucaaaacucuucagucugaucaauaaauugauuacaguuacaggauuuaaaaaucaggcuuauuucuauauaccaauaaagaaccagcugagaaagaaaucaagaaggcauuaucuuuuacaaccacuacaaaaaaucuaggaaugaguuuaaccaaagaggugagaaaccucuaacaaggaaaacuacaaaagucugaugaaagaaauugaaaagaacacacaaaaaacaucccauucucauggauugggagaauuaacaaaauuaaaaugaccauacuacccaaagcaaucuacagauucaaugcagucucucucaaaauaccaaugccauuuuucauggaaauagaaaaaauccuaaaauucagauggaaccaaaaaagagcuggaauagccacagcaauucugagcaaaaauaacaaaguuggaugcaucacacugccugauuuaaaaauauaaggcuauagcauuaaaagcagcaugguauuggaauaaaaacugauagaccaauggaacagaguagaaccuggaaguaaauccauguauuuacagccaacugauuuuugacaaagaugccaagaacauacacugggaaaagagcacccucuucacuuaauggagcugggaaaauaagauauccaugugaaaaaugaaaccguuucuaucucuugcuauacuaaaaucaacucaagauggguuaaagacuuaaacaugaggcaugaaacuauaacaucacuauuaaugaaggagacauuggggaaacacuuuaggacauuggucuagggaaagauuuuauggauaagaccucaaaaacacagacaaaaacaaaaauagacaaaugggacuauauuaaaugauaaagcuuguacacaacaagggaaacaaucaccagagugaagagacagccuguugaaugggagaaaauauuugcaaacuacucaucugacaagguacuaauaccagaauauacuaggaacuccaauaacucaauaguaaacaacaaauuaauuccaauaaaaagugagcaaaagacauggauagauauuucucaaaagaaaacauacaaguagccaacagguauauuuaaaaaaaaaagcccaacaucaguaauuauaagggaaaugcaagccaaaaccauagugagaauggcuauuuuaaaaagacaaaaauuaaccaaugcuggagaggauguggagggaacucuuauacacuguuggugggaauguaaauuaauacuauagaaaacaguuugauuucugaaaaaccuaaaaagagaaauaugacauaauccagcaaucucacuacuggauauuuaucuaaaggaaaagauaucaguauacuaaaaauguaccugcauccccguguuuauugcagcacuauucacaacagcaaagauauggacucaggaaccuaaguguacaucaguggauaaauggaaaaagaaaaugagguaaauauauacaauggaauacuaauugaccaaagaagaaugaaaucauguccuuugcagcaacaugaauggagcuggaggucauuauuuuaagccaggcacagaaagauaauuaucuuauguuauuaucauaugugggagcuauaaaaguugaucucauggagguagagaguagaaggauagauaccaaaggcugugaaagguaugucuggagggugaagagagguugguuaguggguaaaaauacacagcuaguuagaauaaauaauuuauaauguuugauaagaguugguugacuauauuuaacaauauaauguauauuucaaaauaaaaaagaggacuugaaauguuccuaacuauagagaugauaaauugagggugauggauacccugacuugaucauuacacauucgaugcauguaacaauagcacauguaccccauaaguauuauguaucggucaaaaaaaaaaaaaaaaggaaaucccagugcuuuggggggccaaggcagaaggaucgcuugagcccaggaauucaagaccagccugggcaacaaugcacgacccugucucuacaaaaaauuaagaaguuauccaggcaugguggugcaugccuguagucccagcuacuugaggggucaaggauggagaaugacuugagccugggaguuaaagauugcaguaaguggggugguuccaagauggccgaauaggaggagcuccagucuauagcucccagcgugagugacgcagaagaugggugauuucugcauuuccaacugagguaguggguucaucucacuggggcucgucaagacaguggguacaggacagugggugcagcccacugagugugagacgaaguagggcgaggcaucgccucaccugggaagcacaaggggucagggaauucccuuuccuagccaacggaaggggugacagacggcaccuggaaaacuggaucacucccacccuaauacugugcuuuuccaauggucuuagcaaacggcacaccaggagauuauaucccgcgccuggcucggagggucccacgcccauggagccucgcucauugcuagcacagcagucugagaucgaacugcaaggcggcagcgaggcugggggagccugccauugcugaggcuugaguagguaaacaaaguggccaggaagcucgaacuggguggaguccaccacagcucaaggaggccugccugccucuguagacuccaccucuggggacagagcauagccgaacaaaaggcagcagaaaccucugcagacuuaaaugucccugucucacagcuuugaaaagaguagugguucucccagcacggaguuugagaucuaagaauggauagacugccuccucaagugggucccugacccccgaguagccuaacugggaggcacuccccaguaggggcagacugacaccucacacggcuggguacuccucugagacgaagcuuccagaggaacaaucaggcagcaacauuugguguucagcaguauucgcuguucugcagccucugcugcugauacccaggcaaacagggucuggaguggaccuccagcaaacuccaacagaccugcagcugaggguccugacuguuagaaggaaaacuaacaaacagaaaggacauccacaccaaaacuccaucuauacgucaccaucaucaaagaccaaagguagauaaaaccacaaagauggggaaaaaacagcagaaaagcagaaaauucuaaaacucagagcaccucuccccauccaaaggaacgcagccacucgccagcaauggaacaaagcuggacggagaaugacuuugacaaguugagagaggaaggcuucagacaaucaaacuucuccgagcuaaaggaggaaguucgaacccaaagcaaagaagcuaaaaaccuugaaaaaagauuagacgaauggcuaacuagaauaaccaguguagagaaguccuuaaaugacaugauggagcagaaaaccauggcacaagaacuacgugacaaaugcacaagcuucaguagccgauuugaucaacuggaagaaaggauaucggugauugaagaucaaaugaaugaaaugaagugagaagagaaguucagagaaaaaagaguaaaaacaaacgaacaaagccuccaagaaauaugggacuaugugaaaagaccaaaucuacaucugacugguguacaugaaaaugacagggagaauggaaccaaguuggaaaacacucuucaggauauuauccaggagaacuuccccaaccuagcaaggcaggauauuauccaggagaacuuccccaaccuagcaaggcaggccaacauucaaauucaggaaauacagagaaugccacaaagauacuccucaagaagagcaacuccaagacacauaauugucagauucaccaaaguugaaaugaaggaaaaaauguuaagggcagccagagagaaagguuggguuacccacaaagggaaacccaucagacuaacggcggaucucucagcagaaacucuacaagccagaagagagugggggccaauauucaacauucuuaaagaaaagaauuuucaacccagaauuucauauccagccaaacuaagcuucauaagugaaggagaaauaaaauccuuuauagacaagcaaaugcugagagauguuauaaccaccaggccugcccuacaagagcuccugaaggaagcacuaaacauggaaaggaacaauugguaccagccacugcaaaaacaugacaaauuguaaagaccauagaugcuaggaagaaacugcaucaacuaacgagcaaaauaaccagcuaacaucauaauggaucaaauucacacauaacaauauuaaccuuaaauguaaauaggcuaaaggcuccaauuaaaagacacagacuggcaaauuggauaaagagucaagacccaucagugugcuguauucaggagacccaucucacgugcagagacacacauaggcucaaaauaaagggauggaggaagaucuaccaagcaaauggaaaauaaaaaaaggcagggguugcaauccuagucucugauaaaacagacuuuaaaccaauaaagaucaaaagagacaaggucauuacauaaugguaaagggaucaauucaacaagaagagcuaacuaucuuaaauauauaugcacccaauacaggagcacccagauucauaaagcaaguccuuagagaucuacaaagagacagacucccacacaauaauaaugggagacuuuaacaccccacuguuaacauuagacaaaucaacaagaccggaaguuaacaaggauauccaggaauugaacucagcucugcaccaaguggaccuaauagacaucuacagaacauuccaacccaaaucaacagaauauacauucuucucagcaucacaucgcacuuauuccaaaauugaccacauaauuggaaguaaagcacuccucagcaaauguaaaagaacagaaacuauaacaaacugucucucagaccacagugcaaucaaacuagaacucaggauuaagaaacucacucaaaaccgcucaacgacauggaaacugaaccaccugcuccugaaugacuacuggguacauaacgaaaugaaggcagagaaauaaagauguucuuugaaaccaaugagaacaaagacacaacauaccagaaucucugggacacauuuaaagcaguguguagagggaaauuuauagcacuaaaugcccacaagagaaagcaggaaaaaucuaaaauugaugcccuaacaucacaauuaaaagaacuagagaagcaagagcaaacacauucaaaagcuagcagaaggcaagaaauaacuaagaucagagaagaauugaaggagauagagacacaaaaaacccuucaaaaaaucaaugaauccaggaggugguuuuuuugaaaagaucaacaaaauugauaggccucuagcaagacuaauaaagaagagagaagaaucaaauagaugcaauaaaaaaugauaaaggggauaucaccaccgaucccacagaaauacaaacuaccaucagagaauacuauaaacaccucuaugcaaauaaacuagaaaaucuagaagaaauggauaaauuccuggagacauacacccuuccaagacuaaaccaggaagaaguugaaucccugaaaagaccaauaacaggcucugaaauuuaggcaauaauuaauagucuaccaaccaaaaaaaguccaggaccagacggauucacagccgaauucuaccagagguacaaggaggagcugguacuaugccuucugaaacuauuccaaacaauagaaaaagagggaauccucccuaacucauuuuaugaggccagcaucauccugauaccaaagccuggcagagacacaacaaaaaaagagaauuuuagaccaauaucccugaugaacauugaugcaaaaauccucaauaaaauacuggcaaaccgaauccagcagcacaucaaaaagcuuauccaccaugaucaagugggcuucaucccugggaugcaaggcugguucaacauaugcaaaucaauaaacauuauccagcauauaaacagaaccaaagacaaaaaccacaugauuaucucaauagaugcagaaaaggccuuugacaaaauucaacagcccuucaugcuaaaaacucucaauaaauuagguauugaugggauguaucucaaaauaauaagagcuauuuaugacaaacccacagccaauaucauacugaaugagcaaaaacuggaagcauucccuuugaaaacuggcacaagacagggaugcccucucucaccacuccuauucaacauaguguuggaaguucuggccaaggcaaucaggcgggagaaagaaagaaaggauauucaauuaggaaaagaggaagucaaauugucccuguuugcagaugacaugauuguauauuuagaaaaccccaucaucucagcccaaaaucuccuuaagcugauaagcaacuucaacaaagucucaggauacaaaaucaaugugcaaaacaucacaagcauucuuauacaccaauaacagacaaacagagagccaaaucaugagugaacucccauucacaauugcuucaaagagaauaaaauaccuaggaauccaacuuacaagggaugugaaggaccucuucaaggagaaguacaaaccacugcugaacaaaauaaaagaggauacaaacaaauggaagaacauuccaugcucauggauagggagaaucaguaucaugaaaauggccauacugcccaagguaauuuauaaauucaaugccauccccaucaagcuaccaaugacuuucuucacagaauuggaaaaaaacuacuuuaaaguucauauggaaccaaaaaagagcccgcauugccaagacaauccuaagccaaaagaacaaagcuggaggcaucacgcuaccugacuucaaacuauacuacaaggcuacagucaccaaaacagcaugguacugguaccaaaacagagauauagaccaauggaacagaacagagcccucagaaauaauaccacacaucuacaaucaucugaucuuugacaaagcugacagaaacaagaaauggggaaaggauucccuauuuaauaaauggugcugggaaaacuggcuagccauauguagaaagcugaaacuggaucccuuccuuacaccuuauacaaaaauuaauucaagauggauuaaagacuuacauguuagaccuaaaaccguaaaaacccuagaagaaaaccuaggcaauaccauucaggacauaggcaugggcaaggacuucaugucuaaaacaccaaaagcaauggcaacaaaagccaaaauugacaaaugggaucuaauuaaacuaaagagcuucugcacagcaaaagaaacuaccgucagagugaauaggcaaccuacagaaugggagaaauuuuuugcaaucuacucaucugauaaaaggcuaauauccagaaucuacaaagaacucaaacaaauuuacaagaaaaaacaaacaacccuaucaaaaagugggcaaagguuaugaacagacacuucucaaaagaagacauuuaugcagccaaaagacacaugaaaaaaugcucaucaucacuggccaucagagaaaggcaaaucaaaaaaccacaaugagauaccaucucacaccaguuagaauggcaaucauuaaaaauucaggaaacaacaggugcuggagaagauguggagaaauaggaacgcuuuuacacuguuggugggacuguaaacuaguucaaccauuguagaagacaguguggugauuccucaaggaucuagaacuagaaauaccauuugauccagccauccccuuacuggguauauacccaaaggacuauaagucaugcugcuauaaagacacaugcacacguauguuuauugcagcacuauucacgauagcaaagacuuggaaccaacccaaauguccaucaaugauagacuggauuaagaaaauguggcacauacacaccauggaauacuaugcagccauaaaaaaaggaugaguucacguccuuuguagggacauggaugaagcuggaaaccaucauucucagcaaacuauagcaagaaugaaaaaccaaacaccgcauguucucacucguaggugggaacugaacaaugagaacacuuggacguaggaaggggaacaucacccaccagggccuguugugggguggggggggaggggggaggggggagggaaagcauuaggagauauaccuaagguaaaugacaagguaaucagugcagcacaccaacauggcacauguauacauauguaacaaaccugcacguugugcacauguacccuagaacuuaaaguauaauaaaaaaaagggagagagagagaaaagagaaaucuaaaaaaaaaaaaauaccaaagacaaucuucaccgaaauagcaaaaacacaauccuuaaacuugcauggaaccacaaaagaccacaaauaggacaaacaauacugagcaggcagaaugaagcuggaggcacuacacugccugacaucaaaauacagucgacucuucaacaacauagauuugaacuguauagguucauuuauacguggauuuuccccauaaucuaacaaggauagaaugcaauauucacaaaagugaaaacuauguauacagaugacugacauuuuguauaugcgcauuacacagggcugacucugggacuugaauauacauggcuuuugguauauacagggggucucggaagcaaucccccuuguauacaaaacaaugguaaccaaauuagcaugcaaugggcauaaaacagacauauagaccaauggaacagaauagagaacccagaaguaaauaaauuuauuuacagacaacugguuuuugacaaaggugccaagaacacacucuggggaaaggacaccauguugaacacaucauguugggaaaacaggauaucauaugcagaagaaugaaacuauacuaucucucagcauauaaaaaaaucaacucaaaauugauuagagacuuaaacaugagaccugaagcaaacaguacuagaagaaaacagaagggaaacccuucaggauaugggucuagcgaagauuuuauggguaagacuuuauaagcacaggcaacaaaaacaaaaauagacaaaugggacuguaucaaacuaaaaaccuacacauaaaaggaaauaauaaacuauuaagagauauccuguagaaugggagaaaauauucaucugacaagggauuaauauccggaauauacaaggaauucaaacaauucaacagcaaaaaacaccagauuaucugauuuagaaaugugcaaaauagaacaacuggccaacagguaugugaaaaaaugcucaacaucucucaucacagaaaugcaagucaaagccacagugagacauuauuucaccucaguuagaauggcuguuuucaaaaagacaaaacauaacaaaugcuggcaaggaugcagagaaaagggaaauaauacacuauuugugggacuauaaauuagugagucauuauggaaaauacugugguguuuugucaaaaaaacuaaaaguagacuaucauacaguuugacaauccacuaccggguauugacucaaaggaaaggaaaucaguauauaaaaaagauauuugcauucucauguuuauugcaguacuguucacaacaguuaagauauggaaucaacuuaaaucuccaucagcagaugcagagaaagaaugugguauguauacacaauggaauauuauucagucauaauaaagcauuaaguccugucauucacagcaacauggaugaacuuggauaauauguuaaaugaaauuaggcacagaaagauggaggauuuugacugcucacaaaacagagaaaugauauuugaguugaugaauaugcuaauuacccugauuugauuaugacacauuauauacauguaucacaauaucacuguguauaucccauaaauaucuacaauuauuacauguugacuaaaaauaaaaggacaaagaaaaagacuccuagaagaaaaacccacaaggagcaucauaauggugaaaagacuaagagcuuuuccucuaagaucaggaauaaagcaagaugcgcauuuuagccauuauauuaaacauaguaguggcuuucuagccaaagaauauggaaaagaaauaaaggcaucauuuagaaaggaagaauuaaaauuauguuuguucauagauaugaucauauuuguagaaaucccugaaaacucaccacaaaaacugaauaaauuaauucagcaaaguagcaggauaguaagucaguacacaaaauucaguugcauuucuuuuuuuuuuuuuuuuuuuuugaggcagagucuuggucugucgcccaggcuagaguguaguggcgcgaucucggcucacugcaagcucugccucccgaguucacgccauucuccugcuucagccucccaaguagcugggacuacaggcacacgcugcuaugccuggcuaauguuuuuguauuuuuaguagagaugggguuucaccauguuagccaggauggucucgaucuccugaccuugugaucugcccuccucagccucccaaagugcugggauuacaggcgugagccacugcgcccagcuuucaguugcauuucuauacauuaaucacaaacaaucugaaagggauauuauuaacacaacucuauuuacacgacagcaucaggacacucagccuuggccaccaaggaccuuuguaauguuugccacugcugaccucagcugauggagcugcaagaagaguauuccauuauauccucaucugggcuacagcugcugcacccuaccuacuuaacacuccaucaagugagcagauuucaauucauuguaacaagaaacagaaaaaccaaggaaacauagcacccaccugagaaauacaauaauuuucagggacugacucccaagaaauugggauacauuaauugccuuacagaaaauuaaaaacgacugauuuaaggaaguucagugugcuaccagagaacagagagacaaccuaaugaaaucauuaauacacaaaaggagacauucaauaaagaaauagaaauccuaaaaaaaaaacaaacauuuuggaggugaagaauauagugcaugaaaugaaaagugaaauagaaagcaucagcagcagacuugaucaaauagaaggaggaauucaucaacuggaggauaaauuauuugaaaauaaccaguagaggagaaaaauaaagaaugaaaagguaacaagggaaguuuacaggauuuaugggacaccaucaggagaguuaauguucacacaggauuuauagaaggaaaguagagagguaaaggguagaaaguuaauucagagaaauaauggcugaaaacuucccauaucuggggcucuucccagauugauggacaucuagguacaugaagcucaaagaauuacaauuaguuuccaucuaaaagagguuucaccuagauauauugccaucaaaauguaaaaaauggaagacaagauaauuuugaaagcggcaagauaaauaaaguucuuacaucugcaggaaccuccauaaggcuaucaguggauuucugagcaaaaacuuuccaggccaggaaacaauaggauuauauauucaaaguucugaaagauaaaaaacugccaucuaagaauacuuuacacagcaaagcuguccuucagauaugaaacagauacaagacuuccucagguaaacaaaaguugaaggaguuuaucagcaacuacucuugccuuacaagauaugccagagggaguuauucaggcuuaaauggaaggaugauaauuaguaacaugaaaacauaugaaaguacaaaauucacugauaaauaaauauacgggcaacuuaagaauacucuaauaguguaaugguaguauauaaaucacauaacucuaguauaaagguuaaaagaaaaauaauuaaaaauuacuauuguuuucauaauuucucaauggauaugcaauauuaaaagguguaccuuggggcaucaaaaauaaaauguagcgggggaaguauaagaucaaaauauuccccccaaacaaagagggaacaaucccaacuuauuuuacaaggcuagcauugcccucauacuaaggccagacaaggacaauauaagaaaagaaaauaacuggcugauauuuuuuuaugacuauacauuuaaaaauuuucaacaaaauaugaucaaacugaauuuaacagcacauuaaaaaaaucauauaucacaaacaugggauuuauccuuaguacauaaggacaguuaaguguacauauacaagaaaugggauacuuuaauaaaaucaaagauaaaaaucauacaaucauuuugauaagugcaaauaaugcaguucacauaauucaacauccuuccaugauaaaaacuaugaacaaauuagguauagaaggaauguacugcaacacaauaaaggccauauaugaauagcccacagcuaacaucauacucaaugcugaaaagcugaaugccucuccucuaagaugaggaacaagaaaaagauauucucaccacuucuauucaacacaguacuggaaguccuagccagaggaauugggcaagaaaaauaaauaaauacacucaaaucagaaagaaggaaguaaaauugucucuguuugcagaugacaucauauauguagaaaaugcuacagacuccacaaaaaaaaccuguuagaaguaauaaucuaacucaguaaaguggcaggauacaaaaucagcauucagaagucauuugcguaucuauacacuaauaauaaacaaccugaaaaacaaauuaagaaaacaauuucauuuaaaauagcaucaaaaagaauagagagcucccaaauaaauccuuucauauaugaacgcaugauuucugacaagcaugccauguccauucaauggcaaauggauucucuuuucaacaaauggugccaggaaaacuggauauccucacgugagagaaugaagucgagaccuuuaccuaacuccauauacaaaaauuaacucaaaguggaccacagaccuaaauguaagaccuaaaacuauaaaacucuuagaagaaaacauggggcaaaaacugcaugacauuggauuugguauugacuucauuuggauauaauaugaaaggcacagauaaaauaaaaaauagagaaauuggacugcauaacauuuaggcauacauuuaaccaaggagauaaaagaccuagacacugaaaacuaugaaacauugaacaaauucuaagaugauacaaauaaauggaaagauaucugguguucauagaucaauagaauaaauauugccgaaauagcuauacuacucaaagugaucuacagauucaaggcaaugccuaucaaauuuccagugacuuuuuuucacagauauagacaaaaaaaauccuaaaauuugaaagaaacuacaaaagaccuuaaagaucuaaagcauacuugagcaauaagaacaaagugaaagauauuacacaugcuuauuuugaauuauauuucaaaguuaugguacugguauagaaauaaaccaauggaacagaauagaaagcauagaaauaaacccacacauuuauggucaacuaaucuuugacaaagacaccaagaguacacaauggggaaaggguacucucuugaauaaauggcacugugaaaccaggauauccacaugcaaaaaaauuaaauuggaaccuuacccuacacuguagagaaaagugaauaagauuuaaacauaugaccugaaaccauaaaaccuauaaaacagggaaaagcuccuugccauugguuuuugugacaauuuuuuagaugugacaucaaaagcacaaggaauaaaacgcaaaaauaaauuagaacuacaucaaacaaaaaagugucugcacaacaaaggaaacaacaaaaugaaaaggcagcacauguagcgggagaaaauauuuccaaccauauaucugauaagcuauuaauauccaauauauauaaggaacucauauaacuagcaaaaaaacuuaauaacccaauuaauaaccuguuaagauggacaagggacugaauagacauuuauucaaagaagacauacagauggucaacagguauauaaaaaggugcuuaacaucacuuaucaucagggaaaugcaaaugaaaaccacacugagauaucaccucauaacuguuagaaucgcuauuaucaaaaagucaaaagauagcaaguguuggugaggauguggagaaaaggugucccuuauacauuuuuguuaggaauguaaauugauacagucauuauggaaaacacgauagauuuucuuuaaaaaauuaaaauuggaacugcuauaugauccagcagucucaguuccggguauaucuaaggaaaacaaagucaguaucuugaagagguaucugcacucccauguucauuguaguguuacaguagucaagaaaugagcaacauaguauucauaggcaugguggcuuguaccuguaaucccaguacuuggggguggccaaggugaaggauagcuugaacacaggaguuugagaccagccuaggaaacauagugauacccuaucucuacauaaaauuuuaaaaauuagcugggcaugggggugcaugacuguggucccagcuacucaggaggcugaggcaggaggaucacuugagcccaugagguugaggcuacagugaacugugauugugccacuguacuccugccuggaugacagauggagacccugucucaaaaagaaaggaagaaaauaguguguguguguguaucaccaaauucccaaauaaacacaucacauacauauacauacagacacacacacacacauauauacacacacacaaugaaauauucauccuuuaaaaagcaggaaaucaugcaauuuaugacaacauagaugaaccuggaggauauuaugcuaagugaaauagccagacacagaaagacaaauacugcacuaucccaguuacauauggaauucuaaaaagcuugaacucagagaaacggagaguagaagggugguuacuaggggucagggaguaggggaaauaggaaauguugaaggguacaaacauagaguuaucagaugaauaaguucuugacauaacguccagauuggugacuauaguuaauauauucuauacuuggaauuugcuaagagaguauagcuuagguauucugaccacacacacgcacacacauggcaacuauguaagguauauguuaauuggcuugauuguaguaaucauuucacaguaggucaaauauguucuuaaauauaugcacuuuuaauuugucaauuauaccucaauaaaagcugaaaaaagcaucaagaauaacaaacuuaggaaccaacuuuaccaaggaggugaaagucuuguacaaugaaaauuacaaaacaaugcugaaagaaauuaaaguagacauaaagggaaaacaccuccuauguucauggauuggaaggccaauauuguuaaggugucaguaccacacaaaacaaucuacaaauccaagguaaucccaauaaaaauccuaaugauguuauuugcagaaagaagaaaccccauccuaaaauucacauggaaucucaagggaccuugaauagcuaaaacauucuugaaaaugaugaacaacauuggaggacucacacuuucugauuugaaaacuuacuacaggccagguacaauggccuacaccuguaaucucagcacuuuugaaggcugaggugggaggacuucugaguccaggaguuugagaccagccuggggaacacagggagaccucaucucuacaaaaaauaaaauaauuggccagguguaaugguacacacuucuauucccagcuacucaagaagccgaggugggaggauugcuugagccugggagauugagguggcaguaagcagugauaaugccacuguacuccagcgugggcaacagaguaagaaugucugaaaaacaaacaaaaaccccaacuuauuacgaagcuacaguaaucaaaacuaugugguauugacauaaagauguagagaccaauggaauugaauagagagcccaaaaauaaacccuuguauacaugaucaaaugauuccugagaagagugccaagaccauucaauagggaaagugcuguauuuucaacaaauggugccaggauaacugaaguugagacccuuaccuaauaccauacacaaaaauuaacucaagagaaugaaguugagauccuuaccuaaccauguauaaaagagaaugaaguugagacccuuaccuaacacuguguacaaaaacuuacucaaaaugggucaaaguccuaaaacuaugaagucuuauaaggaaacauaggggaaaaacuuuacaucauuggcagugcuucuuguaugcgacaccaaaggcacaggcaauaaaaguaaaaauagauaaauuguacuugcacaggcaauaaaaguaaaacuagauaaauuuuaaaaauuuacauugugugcauuaaaauaauaucaacuaagcaauaagacaaccuacagaaugggagaaaaauuugcaaaucacauaccugauaagggauuaauguccagauuauacagagaacuucuaaaagucaucaccaaaaaacaaugcaccugaaaaaugggcaaaagggccaggcacgguggcucacgccuguaaucccaguacuuugggaggcugaggcgggaggaucaugaagucaggagauugagaccauccuggcuaacagggugaaaccccgucucuacuaaaaauacaaaaaauuagccaggcgugguggugggcgccuguagucccagcuacucgggaggcaggagaaugaugugaacccaggaggcagagguugcaguaagccgagauggcaccacugcacucagcuugggcaacagagugagacuccaucucaaaaaaaaaaaaaaaagggcaaaggacuuggacagacguaucuccaaagaagauauacaaauggauaauaguacgugaaaaguuguuuaacaucucuagucauuaggaaauacaagucaaaaccacaaccuuacauacacucagaugacuacuauuaaaaaaauaaacacagccuaggcaacauagugagacccaucucuaguaucagcuacgugggagguuaaggugggaggauagccuaagcccagaggucuagguugaggcugcagugugccaugaucaugccacugcauuccagccuaagugacagagccagaucuugucucaaaaaaaucccacauaaacagaaaauaaccacugcuggaagggacauggagaaauuggaauccuugugcacuguuagugggaaugcaaaaugguacagccucuguguuaaacaguuugguguuccuucaaaaauuaaaaacagaauuaucugauccaucaacuccaccucuguguauacacccagaaggauuaaaagcagucucaaagauauauuuguauacccacgauuguaguggcauuauuuacaacaguuaaaacaucaaugcaacccaaauguccauggaagaauggauaagcaaaaugugguauauacauacaauguaauauuauucagcuuuaaaaaaaauagaaauuuugacacaugccacaacauggaugaaccucgaggccauuauguuaaaugaaauacagcagucacaagaagagaaguacuguauguuuccacuuauaugagguauguagaauagucaaaucagagacauagaaaguacaaggugguuuccaagagauggcggugguggggggguuggggaauuauuguuuaauggauauagaguuucauaauuacaaaugacaaguguuauggagauggaugauagugaugauugcacagcauugugaacguaucuaauacauucacugaauuguacacuaaaauugguuaggaugguaauuuuuauguuaaguguauuuugccacaauaaaagauuuggaaaucaacaacaaauagaaaucccagaagauaacauaggaagaaaucuagaugaucuuuaguuuggugauggcuuuuuagauaugacaccaaaggcaugauucaugaaagaaauaauugauaagcuagacuuuguuaaaaauaaaaguuucugcucuguaaaacauacugucaagaggaugaaaggacaggccacagaagggagacaauacuuguaaaagauauaccugauaaaggacucauccaaaauauauaaagaaccuuaaaaacauaacaauuagaaaacaaacaaucugauuacaaaauggacugaagaccuuaacagacaucucaccaaugaagauauacagauggcaacuaaguauaugaaaagaugccccacaucuuacgucauuagggaaauggaaauuaaaacaagaaaugugauauaucuacacgcuuauuagaauggccaaaauucaaaacacugacaauaccaaauacuugccaauauguggggcaacaggaacacucauccauugcuggugggaaugcaaaaugguacagccacuuugacauauaccauuaaugggaauguaaaguggugcagcccugguggagaagaguuuggugguucuucaaagaauuaaaaauggaauuaucauaggauccaucaauuccacuucugaauguguauacauaucccccgaagaauccagaguauaucgaaaucagugguuucuuauaaaauuaaacauauucuuaccaugcaguucagcaaucacauccuugguauuuacucaaaggaggugaagacuuauauucacauaaaaaucugcacagagauguuuacagaagcuuuauuugugauuguugaaauuggaagcaaccgagauguccuuccauaggugaguagacagauaaacuguaguacauccaggcaaugaaauauuauucaucacuaaauagaaaugagcuaucaagccaugaaaagauauggagguaauuaaaaaacauauuacuaugugaaauaaggcaaucugaagaaacuacauacuguaugauuccaaucauauugcauuuuagaaaaggcaaugcuauggaggcaguaaaaaguucagugguugccaaggguuguuggggaagaaggguugaauaggcagugcacagaguacuuuuagggcagugaaaauguacaaauauauguaaauauacguaucuguaugauacuauaaugguagauacaugcauauuaguccguucucacagugcuauaaagaacuaccugagacuggguaauuugugagaaaagagguuuaauugacucacaguuuuguaggcuguacaguaagcauggcuggcaggccucagaaacuuaaaaucauggcggaaggcaaaggagaagcaggcacaucuuuaccauggcagaacaggagagggaaagaaagugagaugggaagugccacacacguuuaaacaaccagaucucaugagaacucacuaucaugagaacagcaagggggaaguuugccccccaccaggccccuccccugacacauggggauuacaguucaagaugagauuugggugggaacacagagccaaaccauaucaacauguuacacauuuguagaaacccacagaauguacaccccaacagugagcccuaauguuaacuagggacuuugauaauaauguguaaaugcagauucauaaguuguaacaaacgugccacucuggugggagaguugguaaugggaaaagcucuguauguaugggugcaguggguauacgggaaaucucuguacuuaccucucaauuuugcuggaacccuaaaacugcucuaaaaauauaaagucuuuaaaauacacauacacacauacagacaaucgaauagagaaucauaaugguacacuaucagaaaaucaucaaacacaaaaaaaggcaguaagggaggaaauguuguauuuaaaaaauguaaggcaaaagaaaaggcacaaaaugucagaacuucuuuuuuauaaguaaguacuuuaaauguaagucgauuaaauucuccaaaaagcagagguuggcagaauggauuuaaaagaaaaccaucaaccuaugcuguauauaacaaacucacuuuuggucuaaagacacaaguagauugaaagugaaagaaugaaaaaugauauuucauacaaauaguaaccuaaagaaagcuggagguaauuauacuaauaaaagaaauaaacuugaauuuaaaaauuguuauaggagacaaaggaggacauuacauacugagaaaauggaaaauuacucaagacuucgcaauuggaaacguauacacaccaaaauauagagccccagaauauaagaaaauauacugacagaauuggagugagaaagacaguucuacaauaauacuuagggacuucaauaacguacuuucaguaauggguagagucaaagaagaaaugaaaacagaaacuuaaaaauaucuucagacaaaugacagugggaacacaacauaccaaaagcaaaacaugcagcaaaagcaguucuaagagggaaguuuacagcaauaaaugccuugccuacauuaaaaaagaagagauauuucaaauagcccaaaauuguaccucaaggaauuagaaaaagaagaacaaacuaaagccaaaguuaacagaaggaaauaauaaagaucagaacagagacaaguuagaaagaaaaaccauaggggaaaaaagucaguaaaacuaagacuucaauuuuugaaacaaagaauugauuuuugaaaaauaaaaucaacaaacucuuggacuaagaaagaggacaaaaucagaaaugaaaauggagaauauauuacaacagguacuucagaaauaaaaaggaucauaagggacuuuuaugaacaauuauaucccaacaaauuggauaaccuagaggaaauggacaaauuccuagaaaaaaaccaaccugcuaagauuaaaucaggaauagaaagccugaacagaccaauagcaaagagaucacagugguaaacuaaagagcuucugcauagcaaaagaaauuaucaacagaguaaacagacaacauauagaaugggagaaaaaauauuugcaaacuauucaucuggcaaagguccuauguccagaauccauaaggaacuuaaaccaaucaacaagcaaaaaacgaauaauccaauugaauuggcaaaggacaggaacauacauuucuuaaaagaaaauacagaaguagccaaacaaaaaaacauucucaugaucacuaauaaucagaaaugcaaauaaugaggccaggcacgguggcucaugccuguaguccuagcacuuugggaggcugaggugcguggaucaucuggggucagguauucgagaccauccuggccaacauggugaaaccccgucucuacuaaaaacacaaaaauuagccagguaugguggcggucaccuguaaucccagcuacucaggagucugagacaggagaauugcuugaacccaggagguggagguugcagugagccgagauugcgccacugcacuccagccugggagacagagcaagacucuuucucaaaaaacaaacaaacaaacaaaaaagcaaaaaacagacaaaaaaaaacaaaacaaaacaacaacaacaaaaaaacaccaaaccauaaugggaugccaucucacaccagucagaauggcaauuauuaaaaagucaaaaaaauaaaaguugcugggaaggcugcagagaaaagggaacgcuuauacacuguuggcaggaauacaaauuaguucagccacugugcuaagcaguuuggaguuuucucaaauaacugaaaacagaacuaccaucugacccagcaaucccauuacuggauauauauucaaaggaaaauaaauuguucuaucaaaaagacacaugcauuuguauguucaucacagcacuauucacaacagcaaagacauggaauccacuuagaugcccaucagugguggauuggauaaagaaaaugugguacauguacaccauggaauacuaugcagccauaaaaaugaaugaauucggccaggugcgguagcucucaccuguaaucccagcacuuugggaggccaaggcggguggaucaccugaggucaggaguucgagaccagccugaccaacauggaaaaacccugucucuacuaaaacuacaaaauuagcuggacgugguggcgcaugccucuaaucccagcuacucaggaggcugaggcaggagaaucacuugaacccgguaggcggaggcugcagugagccgagaucaugccauugcccuccagccugggcaacaagagcgaaacuccgucuaaaaaaaaaauaaaaaaaaaaaauauauauauauacaugaaugaacuuacguccuuugcagcaacauggaugcagcuagaggccacuaucuuaagcaaauuaaugcaggaacagaaaaccaaauacugcauguuaccacuugcaagugggaccuaaacacugaguaaacauggacauaaagaugaucaguagacacuggggacuacuugggggaggaauggagaggugggcugaaaaccuaccuauuggguacuaugcucacuaccugggugauaggcuuauccacacuccaaaccucaucaucaugcaguauacuccauauaccaugcaacauauagaccuguacauauacccucuaaaucaaaaauaaaaguuaaaaaaaccccaaaaccucaaacaaagaaaagcccaggaccagauagcuucaugacugaauacuacccaauauucaaagaauaccaauacuucuuaaacucuuccaaaaaaaugcagcuauagggaauacuuccaaaaaaaaaaaaaugcagcuaaagggaauacuuccuaacacauuuuaugaggccagcaucaccuugauacccaggugagccaaaggcaucacaagaaaaggaaacuacaggccaacauaacccaagaauaccgaugcaaaaauccuuaauaaaauauuggcagacuaaauuuaacaauacaucaaaaagauuauauaucaugucuauguggaauuaauuucuggcaugcaaaucuuauuuaauauacauguagcaaucaaugugauacuaacagacugaaagaugaaaaccacaugaucaucucaauugacacacaaaaaguauuugaugaaguugaacauccuuuguugauaaauucuaacaguucagguauagaaggaacacuccucaauauaacgaaugccauuuaugaaaagcccacagcuaacguuauaaucaaugagggaaaacagaagcccuucuacuaugaaccaguacaaggcaaggaugcccacucuagcuacuacuacucaacauaguacuggaaguacuaguacaaccaaacagacaagaaaaagaaaugaaagacauucaaaucaggaaguaagaaguaauauuaucuuuauaugaagaugacaugauccuacauauagaaaaccccgaagacucugacaaagcaaccuguuagaacuaauaaaugaguucaguaaaguuguaggauauaaaaucaauauaaaacaguaguugcauuucuauacacaaauaaugaccuggccaaaaaagaaaucaagaaaacaaucccauuuaugauagcaucaaaaaaauugcuuaggaauaaauuuagccaaaaagaugaaagaccuguacacugaaaacuaugaaucauugaugaaagaaauuaaacaagauacaaauaaauggaaagauaucccaugcucaugaaucugaauaauauuguuaaaaugucaauaauauccaaaucaauauacagauugaauaaaaucccuaucaaaaucccauggaaaauuuuuuuaaauucuaaaguucauuuggaauagcaagaaccuuaaguagccaacgaaauucugaaaauucuguucugaaaaacaaagggagacuucauacuuucugguuuauuuuacaaaacuauugaucaaacaguaugguccuggcauaaaaaacaaacauguagaccaguggaacagaauagagagcccagaaagaaauucaaagauauaugaucaaccaauuuuccacaagaacacgaagaaaacaaugcagaaagauagucucucucauaaaugacguuaggaaacccaguucuguggcuuguccaacccauggcccacagaccacauguaagcccaggauggcuuuaaugaggcccaacacaaauuuguaaacuuuguuaaaacauugaauuuuuuugcauuuuuuuagcccaucagcuguuguuauuguuaguguauuuuauguguggccuaagacaauuguucuuacaguguggccccgggaagccaaaagauuugauaucgcugccuuacaccauacauagaaauaaacucaaaauggauaaaagaccuaaacauaagaccaaaacccacaaccagaagaaaacauaggggaaaagcucgacauggcucuggcagugauuuuuuggagaucacaccaaaagcucaggcuacaaaaacaaauaauugguauaccaucaaacuaaaaaacuucugcacaggaacggaaacagucaacaaaaggaaaaggcaaccuauggacuagaagaaaauauuugccaaccauauaucuuauaagaggauaauauccaaaauuuauaaggaaugcauacaacucaauaacaagaaaauagauaacccaauuaaaaaaugggcaguggaacugaguagacauuuuugcaaagaaguuauaaaaauggcaaacacauauaugaaaagacauuuaacaucacuaaucgucagggaaaugcaaaucaaaauuacuaugcgauaucaccucacacucaugagaauagcuauuaaguguuggcuaggguuagggaacucuuguacaguguuggugggacuguagauuggugcagucauaaugaaaaacagaaugguggcuccuaaagaaauugaaaauauacuaucaucugacccacuaaucccucuucuagguauauucccaaagaaaaugaaaucuccaccucauaaagauaucugcgcuccuauauucauuguggcauuauaugcaugagucacgauaugaaaacuuacguguccauugauggaugacuaaacugugguguguaugucuacaauggaauauuauuccgcauuaaaaaaggagauccugccacuugccacauggaugaaacuggaagacauugugcuaaguuaaauaagccauauacaaaugaaaaguuuuaaauaaucucaccuauauguagaaucuuaaaaagaaaaaagucaaauauacagagauagaauaaacuagugguuaccaugggcaaggugugggggaagaaaauggaaagauguaggucaaaggauaccaaguagcagauauauaggaugaacaagucuagagaucucauguagaacaugagaauaguuaguauauugcauuuggaauuuuugccaauugaguagaucauagcuuuucucacucauacacacaaaagaauaacugugagaugauggacauauuaauuugcaucacuauguuaacgauuuaacuguauguuuuauacacuaaauaugcauauuuuuaaaauuaaaaaaaaaaaacacaacaagauaauguacagccagacagaagcccaauaagaaaagagaggacuugaacaauaccauaaaccaacuagaccuacaaacauauauggacacuccacccaacuacacauucuucucaagugcacauggaacauucccuaggagggaugauauguuaggccacaaaagagucucaauaaauuuuaaaauauagaaaucauacaaaauaucuucucuaacuacaauauagugaggccagaaaucuguaacagaagaaaaaccuaaaaauuaacaaauucagggaaauaaaacuacacacucuuuaaaaauuauugugucaaagaagacaucagaagggaaauuauaaaauacuuucaaaaagugaaaaugacgacacaacauacucagacuuaugggauguagugaaagaagugcucagaggaaaaauuauagcugugaaugcccacacugaaaaagaagaaggauccauaaccuaauauuauaccuuacguaaccagagaaagaagaacgaaguaaaccuaaaguuaaaagagagaaugaaauaauauguaugaguggagauaaaacugaauucgagcuuaaauaaacaacagagauaauuuaacaaaaccaaaaguugcuuguuuuugaaaagaucaaaguugaaaaccuuuaacuagaaugacuaauaaaaaauuagagaaguugcacauaucuaaaaucauaaacaaaaguaggaacacaacaaaaaaaaacaaaaauaagaaaaaaaaacaaaagugggaacgauauaacugaucuuacagaaauaaaaagugugauaaaagaauacuaugaauaacuguauaccaacaaauuauauaaccuagauaagauggacgaauucacaaaauacuaauacagaccaaaacagaaauugaaauuaugagcagacccauaacaaguagaaaguuugaaucaguaaccaaaaaccuuccaaugaagaaaaugcuacacagauggcgucacuguugaauuauaccaaacacuugaagaauucacaccaaucccucucaaacucuuccaaaaaacagaggagaaaaaacuuugcaauacauucuaugaggccaguauuacauggauuccaaagccagacaaauauaccacaagaaaagacaaacuagauacuaaaaucuuuuauuuaacaaaguacuaguaagccaaauucagcagcauauuaaaaaggauuauauaucaugaccacauggaauuuaucucaagaauacaagggugguucaguacaagaguaucaaucaauguaauacaccacauuaauacaaugaaggauaaaaaauccaugcaaucauuucaauucacucagaacaagcauuugacaaaauucuacaaccuuucaggauaaaaacauggaacuuucaaaauguguuaaagaggauuugugaaaaauccacaacuaauauacuuaaugagaaaaaaaacugaaaaauuucucccauaacaaagaguaagauauggcuguaugcuuuacccagugcuauugaacaauguacugaaaguuuuaaccaugacaauuaggcagauaaauaaacaaacagguaaaugaauagcauccaaauuggaaaggaagcaguaaaacucuuuauucaauaaugacaucuucuaucuagaaaaucaaagaauccacaaacuaguagagcuaauaaacaaguccagcaaaauugcaggguacauguucaacauuuauuuuaagaaaaucauuugugccucuauauaccaggaaugaacagcccaagaaggaagucaauuuuuaaaauuccacuuacaauagcaucaaaaagaguaaaauagcuaggaauaaauuaaaacaagaaggugaaagacuucugcacuaaagacuacaaaacacuguugacaaaaauuaaagaagacuuaaauaaauagaacuauacauccuguguucacagauuggaagauuaaauauuguuaaguuggcgauauuacccagugaucuacagauucaaugcaacccuuaucaaaaucccaagggccuuuuuauuugcagaaauguaaaaacugauuuuaaaauguaaauggaauuuucccagggccccaaacaaucuaaaaucauauugaaaaagaacaaaguuggaagacucaggccugccauuuucaaaacuuuuacaaagcugcaguaaucaaaacaaugugguacugacacaauguggucucuaggacacaaggauggacauauagaccaauggaauauaauagagaauguagaaauaaacacucacauauaugaucaauucauuuucaacaaauguaucaagaauucagugggaagaguagucuuuuaacaaauggugcuggggcaacuggauccucauauaucaaagaaugaaguuggacccauaacucauagcauauaaaaauuaucucaaaauguaucagagaccaaaaaauaagaguuaaaggcauaaauuucuuaguagaaaacaggaguaaaucuuuaugacuugagauuggaaauaaauucuuagaaaagacacaaaaaacacaauauuguaaauguacuaagugacacugaauuguacauuuugaaaugguuucuguuacuuaaaaaauuuaaagggugcacagaagacuaaaaagcagcacagacagaauuaucaccagaaaaagaagacucuauauuaaaugucaacauggagaacacaugucagaaauagguaguccagagcagcagcuauaguggaggcucuugcaaaugacuaagauuugagguggcacccucagagaaucaccucuuggggguagauucgauuuauggaguagauguaucucagagacaugguaggaaagccaaagaauggugagcauagcugccaucuagaaaccaccuacacaugcaagcauaagagauugguugaaagguuauagcacagucacacuaaggaauacuaugcaacuuuagcaaugcaaugagaaagaucucugugaauggauguugagugauuucuaggagauguuguuaggugagaaaagcaaaguucaaaagggcauauacagaauaguacuuuuuugggaaaugagaaaauaaucaugucuuauaaagagcaaacacacacaaacuauaaacuagaaaacacugaaacugguuaccuauaauggguagggggaauuaggauggaagagauaugggugagaggaagauuucucucaguagcuccuuuuguuuaguauugacuuuuggaaguauguuaauguuauauguauucaaaaaauaaaauuaacaagauagggaccacuucugaggugguggaaugagcaccuugauauaaccacucccugaaaagcaaugauaaaacuggacaaagaaauauaaaauugaaaagugcuaauuaaagaaaaaauauuaagccuuccuaagaauagcaggguuaugauuuaacguggggcugccaucuccccacccaagcucaggggcacgguaggcuugaggaccagcaacaaagaaggcucaucugauuuugaauuccauagaaaacccuaugcacuauguuaagcaacaaggauuucaguggcaaauaauuggaggcaacccacaucacagcaaccuaauguuucaauacugguugggcaagcgacagauuaagaaaaauuuuaaaaggaauucuggagauauggaaguuguacaugcuugcaggagagaucagagagguuuccugcuaucuacuuauccuuggcugacugugagaccuuuugcaagcagacaguaaaauacaggacagaguuauaaagugccugaacuuugaaugucccaacccacacauagauccccucagcagaggguggaagauucacuggcucaagauguuuaaacaaaugucugacuaaucauggcuugaccacuagguuaugcugauccaggggugacaccaaugaagccaggcuuacaaaacaaacauaagaauuaaaacaaacaaaacugagcaaagacaccaguggcugcacacugcaggagaacacagacucugcagaauccaugcagagaaggcauacacaagcgagcaaacaaauaaaugaguaacagaaaucaucccugguuagggagaagaacuagaauccagaguuucuacgauauauuaucuaaaguaaguuuuuaacaaaaaaaaugagauaugcaaagaaacagaaaauugugacccuugaacaagaauaaugagcaauaaauaggaauuaucucugaagggccccaaauguuagggcgcgauuucaaaguaaguauuauaacuauguucaaagaaccaaaagaaaccacauuaaagaaugcaagugugaugacaaagacucaucaaauagauaauaucaauauagagauagaaauuagaaaccaaauagaaauucuguaguugugaaauauaauaacuuaggugaaaaacucacuagugcggcuaagcaaauuugaccuggcagaagaaagaaucaaugaacuucaacgcagauccauaaagaugauucagacugaagaauagaaagaaaaauaaugaagaaaaaugaagagauacccauuggauaccauaauauagugguccccaaccuuuuuggcaugagggaccaguuuuguggaagacaauuuuuccacagccaguugggggaggcuuuaguuagauucucauacggagugcacaaccuagaucccucacaugcucaguucacaauaggauuugcucucugugagaaucuaaugccaucacugaucagacaggaggcagagcucaggcaguaaugcuugcuugccugcugcucaccuccugcuguguagcccaguuucuaauaggccacagacugguaccaguccauggcccugggguugggaaccccuguccuaacaggauguguaacaauguauguguaauuaaguuguaacauauauguaauuaagaguagaaaacauauguggaauuaaggaguaacaacauauguguuaauaagaguacugagaaggagagaauagggcagacaaaaauauuugaguagauuauuaaccugaagcagauuguuuuugcuuaagcugcuuauuguaaccuccagauuacacuuuaaaaaugggggaaauaaacuaacaaaggaauuagaaugguacucuagaacauaucuauucaaccugcagaaggcaguaaaggaggaagagaggaacaaaagugauaugagacauauagaaaauaaauaacaacaugguagauauaaauccuuccauaucaauaauuauauuacauauaagugaauuaaaaacucaauaaagagcagagauugccagacugccuuaaaagcaggauccaaauauauauggucuauaagagucacauucuagauucaaagacauaguugaaaguaaaaugauggaaaaagaugacaugcaaacaguaauaagaaagcuagagugacuguacuaaaaucagacaaaauuggcugggugcaguggcucacaccuguaaucccagcauuuugggaggcugaggcagacagaucacucgaggucaggaguucaagaccagccuggucaacauggugaaacucugucucuacuaaaaauuagcuggguaugguggcaaaugccuguagucccagcuacuugggaugcugaggcaagagaacggcuugaauccgggaggcagagguugcagugagccaaggucacgccacugcacuccagccugggcaacagagugagacuccaucccaaaaauaaaauaaaaauaaauaaaaucagacaaaauagacuuuaaaaacaaaccauguuauuagagauacugagaagcauuuuacaaugacaaaagggaaaauuuaacaggaagaaauagaaaucauaaacagaagucauaaagaaauaaaaauuuauaacagcuaaaaacacagcccugaaguauaugaaauaaaacugucagaaaugaagagagaaacagacaacugaacaauaauagacaacucaacaauaauaguacuaacucuuguugauuuucugucuuguuguucuaucaauuauucagagugaguuauugaacuauuacccaacuacuauucuuggaugaaauggugggaggugaggcuauguggcacucugcuuaauacccuccccuguucuggugucagggagacaaauguggagcugacuuuucgucagaaacagugguacccagaaaguagugggguaacagaucccaagugcucaaaguaaaaaaaaaaaaaaaaaaaaaaaaaaaaagccaaccaagaauacuguguccagaaaaguuucuuucaaaaagaaggcaaaauaaaagcauucccagauaaacaaaaacagaauuccuuguuagcagaccaguuuuguaagaacuacuagaggaaguucuucaggcaaaaaggaagugcucccaggaaguucacauauauccaaaagcaaagagcaaggagguaaauaggagcaaagcuguucuagaguaaggaaauaccaccaguugguaacucaaauccauaaaaaccaaaaaaguggaucaaauauaugauauaaggagguuaauaaaacagaaacuagaaauauauacuugcucuccuuucagcuucuuuaaagauauaucauuauauaguaugaucauuauaauagcgcauaauaaagauguaauauauguaacaauaccacaaaaagugguaaaacugaauaaacucauacaggaauaacuucuguaucucaccaggauuaauauaaauaugaaguaaauuuugagacgauacauaagguaagcccuagagcaaacacuaauaacaaauagaauauugaagaaucauaaaagaaaugaaaauuuauauuagaaaguagucacuagauggaaaagaaagcagcaaaggagaaauagaggaacaagaaauaguacauagaaaagaccaaaaguaaaacuguggauauaaaucuaauuauaucaauaauaauauuaaaugugaauggauuaaacaaucuaaucaaaggcaggaauuaucagaccagauuugaaaaacaggauccaucuguauuccaucuauaugaggcacacuuuagaugauaaaugccaacugaaaguaaaaggauggaaaaagauauaucauguaagcagcaaccauaaguaaccugaagugcuauaauaaagucaaaggagauuuuaaauuaagaauguuacugaaguuaaauaugaauaucucauaaugauaaaaugucaauucaugagaagauacaaugauuauaaacauauauucaccuaacaauagagaacuaaaacauaagaagcaaaaacugacagaacugaacagagaaauagccaauucaacaauaguaguuggagacuucaacacuccacuuucaauaauguguaguacaagaaagaagaucaauaaggaaacagaagauaugagcaacaccauaaaccaacuagacucaaaagguaauuauagagcacuucgcccaacaaccaacauugaauauacaguauuuucaagugcacaugagacauucuccaagaaggaccauaugcuaagucacgaaacaaaccugcauaaauuuaaaaggauugaaauaauacaagguaucuuuuucugaauauaaugaaauaaaaguagaacucaguagcaaagaaauuagggaaacauacacauguggaaauuaaacaacacuacauucuuaaauaaucaaugggugaaagaauucacaagggaaauggaacguacuuugagauuaaugaaaaugaagauacaacauaacagaacuuaugggauacauuuaaagcaguguaaagauggaauuuuauagcuaugaaugccuauaucaaaaaauaaggcuucaaaucaguaagccaacucuccaccucaagaaacuagaaaaagaagagcaaacuaaaccuaaagcaaguagaaaaaacaaaauaauaaauauuagaguagaaauaaaauauagaauauaaaaauaauaaagucaacaaauccaaaauuugguucuuugaaauuaacaaaccuuugauagauugguaagagagagggagagggagaagaaaagaaggggaggaagaaagagggggaggaggaaagacagagagggaagugcaugaggcaaagggggagagagaaaacucaaauuacuaaaaucagaaaugaaugacaguuuuacaaauuaaagcaaaaaaacgaggcuagcugcaguggcucacaccuguaaucccagcacuuugggaggccaaggcaggagaauugcuuguggccaggaguucgagaauugcuuguggccaggaguucaagaauagcaugcacaacaaagcaagacccuaucucuacaaaauauuuuuugaauaacagcugguguuguggugcacaccugucauaggcuaaggggcaaggaucacuugagacuaggagaucgagguuacagugagcuaugauuacaccacucuauuccagccugggcaacagagagagacucuguuucucaaaaagaaaaggaaaaaggaaugaaugagggaaguauacuaccaaccugacagaaauaaaaaggauuaugaaggaacacuaugaacaauuuugugccaauaaauuauaaaacuuagaugaaauugacaaauuccuagaaagaugaaaacuaugaaaacugacuaagaaauaaguagaaaaugugaauggaucuguaauaaguuaaagagauugaauuaguuaugagaacacuaguugaaaagaaaagcccaagagggccagaugagugaaucuaacaaauaucuaaagaauaucaauucuuuaugaccucuuccaacaacaaaaaaauagaagagaaggaaaauuuuuccaauacauucuuucaguccaguaucacccugacaccaaaaccagacaaaaacaugaaaagagaacuuauaaaauuuauuuuacccauuuuagguauauaguucuguggcauuagguaaauccacgcuauugugcuuuaugcuuucuugauguuguaaauagaauuguuuucuuauuuucagauuguuuuugacaguguauaggaauacuauugauuuuuguauuucauuacaauaacugugaugaaaaugauguaaaacccucaaaacccucaacaaaauacuagcaaguaaaaucaagcaauguuuaaaaaggauuauacauuauaaccaaaugggacuuauuucaggaaugcaagguugaauuaacaucugaaaaucaauuaauguaauacaccauuaucaacagaauaaaagacaaaacaccacgauuucugucagucuguucagacuguuauaacaaaguaucacgaacugguggcuuauaaacacagaaauuuauuuuuugcaauuuuacaggcuuggaaguccaaggucaaggcacuggcagauucagcaucuggagaggacucgcuuucugguucaugaacaguugucuucuuguguccucauaugacggaagaaaaaaaggagcucacugaggucucuuuuacaagggcacuaauccauuccaugaggucuccacccucaugaccuaaccacuucccaaaggccucaccuccuaauaccaacauuggggguuaggauuucaacauauacauuuugaggaaacacacacauucagucuauagcaauuaaugauagaauaaaagacacagaaaagcauuugggugauaaaauucaacacccuuccaugaugggagaaaaagcccuacucaauauacuaggaauagaaaggaacauccucaaccugauaaagggcaucuauuaaaaaucacaguuggccgggugcagugguucacaccuguaaucccagcacuuugggaggccgaggcggguggaucacgaggucaggagaucgagaccauacuggcuaauauggugaaaccccgucuuuacuaaaaauacaaaaaaauuagccaggcauggcagcaugcgccuguagucccagcuacucgggaggcugaggcagaagaauggcgugaaccugggagguggagcuugcagugagccgugaucacaccacugcauuccagccugggugacagagcgagacucugucucaaaaaaaaaaaaaaaaaaaaaaaaaaaaucacagauaauaucauacuuaacagugaaugacugaauguuuccccguuaagaucaggaaugagacaaagagaucugcucuuuccacuucuauucaacauuuauugaguguuccauccaggauaauuugggaagaaaaagaauccagacugaaagaaagaaguagaacuauuuggagaugacauaaauuugugcugguccaguuuuguguuacuauaaaggaacacccgaggcuggguaauuuauaaagaagauuuuaauuggcucacaguucuucaggcuauacaggaaauauggcaccagcaccugcuccuggugagggccucaagaagcuuacaaucauggcgaaaggcagaggggcaggcauaucacauggcaagagcaggagcaagguggagggagguagcagauucuuuaaacaaccagcucuuagcauaaacuaccagaguaagaauucgcucauuaccacggggaugguaccaagccauucacgagggcuccguccaugauccagacaccccccaccagaccccaccuccaacauugggaaucauuuuaaugagauuuggagggaccaaacauccaaaccguaucaauguuguauacagaaaaccccaaggaauccauugugaaacaauuacaacgaaugaguucaguaaggcugcaggagacaaaaucaguauauaaaaaucaauuguauuucuacacacugucaaaaaacaaucugaaaauauaauuaagaaaacaauuccauguauaacaucaaaaaagaauaaagcacaacagugcgaauuuaccuaaugccacauaacuauauacuuaaaaugaguaaaauaguagauuuuauguauauuuuuaccauaauaaagaaaaaauaaaauaccuugggaauaaguuuaacaaguacaaaacuuauccucugaaaauuacaaaacauuguugaaagaaaagaagauacaaauaaauggacagacauuacaugcucauagacuggaagacuuaauauuguuaagauggcaacacucccggaaucgugcugaucuacaaacucaacacaauccuuaccagaaucucagcugguuucuuuguagaauaauaagcugauguucaacuucauaugaaaaugcaaaggacccagaauagcaacaauuuugaaaaagaaaaguuggaggcuucauacuuccugaucuccaaauugacuacaaaguaacaguauucgagaaaaugugauacuggcaugagauagauauguagaucaagggaauagaaucagaguguaaaaacggagccauauaucuauggucaauugauuuuugacaaggaugccaagaauguucaaugcggaaagaauagucuuuugaacaaauaguguugaaacaacugauauccacaugagaaaaaucaauugguccacuccacaucauauauaaaaauuaacucaaaguggaucaaagacauaaauacguaacagauaaagcuauaaaauucuuaggguaaacauaaggguaaaucuuuaugaccuuggauuuggcagagguuucuuagauauaacaccaaagaacaaggaacaaaagaaaaaaaguagauauauuggacuucauaaaaauuaaaagcuuuugugcuucaaaagacaccuuaaagaaagugaaaagacaaccuacagaugggagaaaauauuugcaaauaaucuaucugauaggggacuuguuacuggauauauaaauaacuccuucaacucaaaaacaaaaagacaaauaucccaacuuaaagaauggaugaaaaaucggaauagaaauuucuucaggguugacauauaguuaauaaacacaugaaaagaugcucaacgugaguagucacagggaaaugcaaaucacacccaaaaggagauacugcuuaacaaccacuaagauggcuauaauugaaaaaagauaauagcaaguguuggugaggauauggagaacuugcgcagugcucauaugcugguggugagaauguaaaaugaggcacccacuuuggaaauaauuggucaguucuucaaaaagauaguuaucggccaggugcuguggcucacaccuguaaucccagcacuuugggaggccaaggcggguggaucacgaggucaggagaucgagaccaucucggccaacaugguaaaacccugucucuacuaaaauacaaaaaauuagcugggcaugguggcaugugccuguaaucccagcuacuugggaggcugaggcagaggaaucgcuugaaccugggagguagagguugcagugagcucagaucgcgccacugcacuccagccuggcgacagagcaagacuucaucucaaaaaaaagauagugaucauuugacucagcuuuccacucccauguguuuucauaucucuuucuuuucuuccuuucuuuuuguuuuuuugaaacagucuugcucuguugccuaagcuggagugcaguggcacagucucggcucacugcaaccucuuccucccggguucaagcaauucucuugccucagccucccgaguagcuggaauuacaggcaccugccaccaugcccagcuaauuuuuguauuuuuaguagagaugggguuucaccauguuggccaggcuggucucgaacuccugaccucaggugauccaccugccuuggccucccaaacuguugggauuacaggugugagccaccaacacacccagccuuucauaucucuuucaugcccaggagauaugaaaacacauguccacacaaaaacccacauguucuagaagcauuauucauaguagucaaaauguggaaacaaucuaaaaugcuuaucaacaaauaaauggauaaacaaaauguuuauucauuguauaucauacgauggaagauuauucauucauaaaagaaugaagcacaagggccgggugcaguggcucacgccuguggucccagcagguuaggaggccgaggugggcggaucaccugaggucaggaguucgagaccagccuggcuaacauggcgaaaccccgucacuacuaaaaauacaaaaauuagccgggcuugguggugcgugcccguaaucccaccuacuugggaggcugaggcgggugaauugcuugaacccgggaggcggagguugcagugagccgacaucgcgccacugcacuccagccugggcgacagagggagacucugucucggggaaaaaaaaagaagcacugaagcacaaaccuugaaaacaugaugcuaagugaaaguaaccagucacaaaggaccauacauuguaugauuccacuuauauaaaauguccagaauaggcaaacccauagagagaaagauuaguuauugccuagggcugagggggauggaauaguggguuugggggugauauuuaaaaggcacuggguuucuuuuuggaaugauaaaaauguucucaaacuggaguggcaguugcacagcucuggggauacacaggcacacuucacuuuuuugcacuuuguggauauuguguuuuuaaaaaauuaaaugugugugguaagccugcacugagcaagucuaucagugccauuuuuccaacaacaugugcucacuucauucugggucagcauuuuuuagcaauaaagugucuuucaauuaagguaggcacauuguuuucuuagacauggggcuauugcacacuuaauagacuacaauauaaacauaacuuuuauaugcaguggcaaaccaaaaaauuugugugacuugcuuuauugcaauauuugcuucauugcaguguacuggaaccgaaccacaauaucucugagguaugccuauacuaaaaaccauucaauuauauucuuuaaaugggugaauuguaugguauguaaacuauaucuccacaaggcuguuagaaaaaagcuauagcagaagauauuugggguccagggccaaagacuucuuagaccugacaucagaaguguaauccauaaaaaggaaacauugaaucucaucaaaauuuaaaauguuugcucuguaaaguacccuguugagaugaugacaaugaaagcuacaaugaauaaauauuugcacccuguuucugacuuaagauaaguaucuagaauauauaaacaucucccaaaacucgacaguuaacaaaaagucuaauugggaaauggaaaaaugauaucaacaagaauuucacugcauagaauacaaaaauggcaaacaggcacaugaaaagauguucaguaucauccuaaugaggaaauguaaauguaaaccacaaugagaucucacuacacaccuaucugaauggagaaaauuaaaaacagugugaacaucaaaugccagcaagaaugcagagaaacuagaucacuuagaccuugcuggcaggaauggggaaugugaaauggugcagucacucuggaaaaucaguuugguaguuucuuauaaaacuaaacaugcaacugccacacaacucagcaauuacaagcuugggcuuuuaucccaaagaaauaaaaacuuauguucacacaagaaccuuacaagaauauucaugucauccuuaucaauguauaagguucccauggcugcuguaauacauuuccacaaacuuaguggcuuaaaacaagacacgcuuuuuuuuuuuuucucacaguucuagaggccagaagucugaaaagagucuuaggggacgaaaaaucaaggugucagcagggcugguuccuucuggaggcuucaggggagcaucccuucccuuuccuugccuuuucuucuggaagcguucuuugguuugugaccccuuccucaaaucacauugccauuuccugccccugcuuccguggccacguaacccuuuuucucuucuguagucauucuucugccucccuguuauaaggacccuugugauuacaccgggcccauucagauaacccaggaugaucucuccaucucaagguccuuaauuugacacaucugcagagugcccuuugccauagaaggcgauagucacagguucuaggcguuaggaccuggcuacuuugggggccauuguucagccuacucugauuuguaauagcccaaacugggaaugacccacauguccuuggaugagggaaugguuaaauaaacugggguauauguccauaccgugaaacuccacucagcacuaugauuuaaugaacugucgcgauacaaaacaaccggaaugaauccagagaaugaugccgagccaaaagaccccguuucuaagauaucguguauugugugauuccauuuacguggcauuuuugaaaagacaaaacuagagaaucagagaacagaugaguggucaccagggauuggagggaugggaugggagaaaguccguguaaaaggacaaauaaugggaaccccguggcgacgggagcacucugcaucuggacucuugcuguugacauccugguuaucauauugugcuaugguuuuagaagaugcuaccacugacggaaacuaacuaaagggugcaugggaucccuauuauuucuuaccacugcauaugaaugucuaaaaauaaaaagcuugaaagucucauuuuuuuaaacgggcaaaagaucugaauaaauauuucacuaaagaagauacacaauugggcacuaggcacguggaaaaaugcucagcaucauuaggaaaaugcaaaucaaaaccacaaugagguaaccauuccaacuggacaguauuuuuuuuucuuucuguacuuucguggaaggggugcuagaguuggaaaaugaucauuuuugcaacuaccacaguaaagccugguuuccaaaagcauuuaaaucuggagagacuuuuuuuuuuuuuuuaacaaguagcaggguauaugcauggccuuaaagaaucucccccgauuguuuauugguugcaaggcaaaauauaguaacuguaagguagaaaaguggauaacggccucaauuuggugaucaaaauaacaucguuaauaaggggcagauacacugugugccucaggaugugauacacugagaaggacaucaggucacuuacagaguacacaacguggaucuaaccugaggaaacaucagacucccccaagaaguggcaggacuguaucuuuaaaaaauaucagugucauaacagagaaagagacuagaaauguuccagauuaaacaagacugaagagacacaucuaaaggcaguacugacccugaacuggaucuugcaguggaggaaaaaaugccacaaaggacauugucauggcaacugacaaaaugggaacauaggcauuaaauuagguccaaguauuauauugauguuuaauugcagaagucaauaacuguauuacugcuuucaaagauaauaucuuuauuuuucagaaauacacagcaaaauguuuaggggcaaagagcuguggaguaugcaacucacagauguuucagaaaaacauguuaugugaauauaauguagagaaagggguucaaaugauaaagcaaauguggcaaaauguaacaauuaguaaacugguaaaucuuagugaaggguauguagguguuuuuauaucucgugcuuguaauuuuucuguaguucaaaauuauggccaaauaaacaguuuguuuuguuuuaagaaacaauccugagggacugcuuuagcucagcaggucacaacugggggcaauuuugcccuccaggggacauguagcaacauguggagauguuuuugguggucauaacugaggccggagaugcugcuaaacauccugcaauagacaggacuuccucccucaacaaagaauuauccggcacuagauuucaauagagguacaguggagaaacucugccccacuuggcugacaauaagucacucugccaggacuggugggcaggaaugccggccgggaaagaggaacccugccuguggaauucaaggucagacaaaacgagaaaaacaaccuggcuacaucacugaaauuaacaagccuauuccugugucacgggcugaauugugucccacaagguuugcaguugaagcccuggucuuuaauaccucggcacgugacucagcauguuuggagacaggaccuuuaaagaggugaugaagcuacaaugaggcuguuagggugggcccuaauccagugugacuggugcccuuaaagaaaaggauauuuggacacacagagaaacaccagggugcaagugcccagagcaauggucaugugaugacacaggaagaaggcggccaucugcaaggcaaggaaagaggccucagggaaagcagccuugcugacaccuugaucucagacuucuauccuccagaauugugagaaauacaugucugcugucuaagccacccagccugugguauuuuguuauggcaguccuagcaaacuaauacauccuggaaaguuaacacauagaaauaaaaguucuguacauagaaacagguucaagaaccuauguucuugaacaaaaugaauuuuaagcgauagagaacaucacagaguauguacaccaaaggaaauuaagcagagauuauaaauuuuagaauagaauugaaauagaaauaaaauucaauuagagauagaauuaaaucaaaauaaaauuguuucagcagccuuagaggcauuuuuacuauuuuacugauugagaaaaacaagaugcagaaagcagguaugauaugaucccgugaguuuggaaaacaaugauaaugccuucauuaugucacauguauuuuauuucauugaauauuauaugaacaucaggaaaaauguaagacaacaaauccuagauuaucaacauagguaacagagaggaggggagcccaagcaaacauaagaaaaaaguucuguacugaaacacaucuauuccauucuacucaucuguaaaguuaaagugugaauauuggaaaguaauacaacauuaaggacacuaaaagaaagaauagccccuauucagaucugguauugauagagccugaggccaauuuggcagcagacagagacacaagacuguuugcugcauauggguccugggugagcacuuacauguucuaacucacucagucaacacaggaguccugggagcaggcaguuaggauccugauuucacagauguggaaacugaggcacagagaaugcaguagcuugcuuagggccacauaagaaaauggcagagcugggcuaugacccuaaagaagguuggccauauaggcugugcuccaaaccacuccaugaaaccugccacucaauuuuuagaaacauaauuguacaggaagauuuaauuuuccugucucagaauuuggcagauguauuaggguuuuuuuuuuuuaacuaagggcagagcagaccuaaaugaggcaaugaauaaguauguauacacaauccaucucaauguacauuuugucuguccauguauacaaauaaaacuuuguguuauacaaauacagaagauauuuucugaggucuguggagcauuuacaaaaauaaugauguuauuuucauacuuggagacaaagaaaaucuucauuuuaaaaaaaguggagacuucauaggcuacauccuuucacuguaagccuacuaaauuagaaauaaauaacagugauaaaaauuuacugcuuaaaaauuaagaagacauuaaaagaacucuaaagagaaaaaucaaaacacaaaauuaaaacuaucaagaaagcaaugaaaaggaacauauuucauaaucagaucuacgugucacagcuaaagcugcaaucagaggaaaauuuauagccuuuaaaaaugccuuuaguagaagaacuucaaauaaaugaacuaugacucuuaaguaaaagaaaacaaaaauagaguuagccaagaaaagggaauuaauagcuauaaaagcuuagauuaaugaaauagauaacaaagaguacaaagauaguuuucugauaauaaaauauaaauaaaacauaaauuucucaugugcuugauuaagaaaaaaggagaaaaaccacaaaaguucaggcauaaaggaaaagaaaaacgaagagaugauagagaagaccauaaaaucacuaaaggaaaaaaucaguugcuaccaaguggcaacacaauugaaaugcuugaggaaauuaaauagcaaugaauaaauuacuccaaaagaugcaauaaacuaauuuagaacaacauaucauaaaacagacuaaaaagaaauuacuaaagauauccuauaaaacauguaucaggcccagaugguuuuacaacucaauucuauuuaaccucuacagaaaagauaaucccaauguucuucaaacaguuccaagacacagaacaaggaagguagauaaaacuuuguuuuguaaaccauuguauuugcccccacaugauggcagauuucauacucuucugaaagauguacuguuauuucuaggaucagauaucagggauguccugcaucagugaugagagugaagcuucacaguuuugauggcuguuuaacggagauaugauacuugaagcagaccuccacugauggguaugucggugguuugcaauuuuuugcuauuuaacaauugcagaaaucaauauccugaugauggauuauuuugcaaauguguaagauauguguagaauaaauuucuagaaugauucaaaggcauaugcaucuuuaauuuugauugaaauugccuuauuuaucuccacagagguuuguaucaauuuauuuuucuaacaucaaugacugagacugagaguuuccauguacacauacccauagaguguuaucaaacucuuugauauuuaauaaucagauaaguuucaaaaaccccauugcuuuaguuugcauuucucuugucauaauugaagucauccagcauauuuucauucuuaagaauuauugguauuuccuuuucugugaacuguuuuaauauccuuuaacuucuaucuugauuuacaagagcguuuuuauauagcaauuaaauuagccccaugccuauaggugaguggcaacugguuucuuuagguuaucaauaaaaaauuauuuucaguauguuuuuuugcuaugcaaaauauauauuauauauuuacauuauauauuauaaacaguuuuauugagauauaauugacauaacuugcuuauguuuaaagugugcaauuugguaacuuuugacacaugaugaaaccaucgccaugauuaugauaaugaacauauccacugccccaaaaguuuuuuugugcccuuuuguccuuuucccuccuacuacuaccccugauccccagguaaccacugauaaccacugacuuguuugucacucuauauuaguggucauuuucuagauuuuuacauaaauaagauaccauguacucuuuuuuuuuuugucuggcuucuuucacucaccauaauuauguugcaauguauccauauuguaggcauaucagugguucauuccuuuguauuucuaaguaguauuccauuuuaggaauauacuacaacuuugaaaaaaaucuauucaaauguugauggguauuuggguugcuuccaguuugggguuuccaguuuuuauaaagcugcuaugaauauuccauguacaaaugguggcaugcauaugaucuuauuucuccuggauaaauaccuaggaauagaaucgcuguagaauaugguagguauguauuuaacacaucaagaaacugcugaacuguuucccaaaugguugcaucgcuuuggacuuugcauucucaccgggagcauaugagaguuccaccuccgacacaucuuuaccaacacuugguaucauccaucucccucauuuuauauaauauaauaauugggccgugguauuucauuguguuuuuuauuugcauuucucuaauaacuaaugauauuucagccacaucuucaggcuccacuucuaauucuaguucucuugcaguuuucacaacaucaguaguuacuuccuccacugaaaucuucaaccccucagucauccaugaggguuggaaucaacuuuuucccaauuccuguuaaugcugauauuuugacguucuuccaugaaucacuaauguucuuaauuucaucuagaauggugauuauuuucuaaaauguuuucaauuuacuuugcccagauucaucaaagcaaucgcuaucuauggccgcuauagccuuauaaaauguauuucuuaaauaauaagacuucaaaguuggcauuacuccuugauuaugggcugcagaauggauguuguguuagcagccauaagaacaacacuaaucuuguacaucuccaucagaggucuuggaugaccaggugcacugucaaugagcaguaacauuuugagagggaucuuuuugucugagcaauaggucucgaaaaugggcucaacauauucaguaaaccauguugucaacagauguacugucaucgggcuuuguugcuucauuauagagcauaagcagaguagauuuagcauaauucuuaagggcccuaggauuguugaaaugguacgugaguacuggcuucaacuugagcaagguugccacaaaccuucaauuuguaaaaaaugcauuaucagcaaagugcagucaauaagaaugagacacgccuguauuuuaaaaaucucaauuucugguuauuugcugcaagaauauaugaauggaauugauuuuugcauauuaaucuuguaucugccaccuuacuaaacucauauauuagucauaguggucaucuugcauguucaucagauuuucuacauagauaaccaugucuucugcaaauaaagacaguuuuauuuuauaaaauaaaacucucuucucaauauauguuacuuagacuugcucucacaggagauugggguuucuguuuacacugcauagguugucuagaagaucccauaucuaaaacauggaucaugaagguccuggauugguucacugggucacccuguacaagcaaaagugcagcuucuccagaggcauguaccuuauacaggauacauaggaaccccacaaacaaaaacauccaccacacaaacucaugaucuaaauugcaaacccacaaugaaaugagccaucaugagcaagagucagaaaaaacuacagugaacagaauuagacucuccaagaacugcagaugaugaaaugacaggauagaggguacaaaauaugcauguucaaaugaccuaaagauuaaaaguuguaguuuaaaauaugagaaagguacaagaugcuaaaaucaagcaaauuaaacccccauacaaggauuuauagggaaggaaaaaauauauaacugaaagucucaguggguagauaaagcaguggaacagaaacaucucaagaguuagaaacugcauagaaaauucugugaaugaagcagagggagacagagauagaaaaucuaugagacagcugaggaagacaaugagauggucaaauagaaguuucuggaaaagaucagaagcauuaggggaggcaauauucuacaacauaaugguacugacuuuccacgguugaugaaagacauaaacccucagauucaggaaucacaacaaaguguaggcaugauaaauaaaaauaaugcaccaccuugguacaguacauugaaaccucugaacacuaaagucaaaaggaagguuucugaagucacuagagguagggagggucacuuacaaaggaaaaucaauuagccugaugacccacagaagccaggagacugcaguguuacagcuccagagucuucagacaaaauguacauauuaaccuguuacuuucucccaacgaaaccaucauccaagaauaaaggcaaaguaaaaauauuucagacaaacugaaacugagaguuuaccuucacugaaagaaacacagacuucaggaaaaaggaaauuaaauccaaauggugagacagaaaacugcaagucugugaguaaauaucucaauguaugcagcaucaacaaaaagaggauuguuuaaaagacaaaaccaaaauacugggcaacaaaggcccaggaaacggcaggaggcaguaggaucuggagcaccuugaggucccagugagguuucagaggaguuggggugacuuuugaucucaacuggcaaagcauucaggauuuaauccuguggcagccaccaaaagugcacaaucagaacacacggcuuugaauggaggagugcaugaaaggccaggcuugguguguugggcugaggacgcggagccgggagcaggaggaggcuacagccugacccugugagaaccaggcucacaagugcagaagugagaggugaggcuguuccaugacgcaugccuccagaaagcacacacacgagugugaacgaugaguccccagaccacacuggggaccucuggguaugugaugcaugcuccuccagcacgcugccccacuucacaaacgggaaaccacacaauagucccaggucaccuggcaaacacguggugacacacacaggcacagcuuugaagacgccuccccagaagcccuucagaaucaccuccaggccagguggaaaggugcgugcugcccgauccuacgucacagaccacgaccuuacagcccaguguucucugagcagcaaaaggccucugagguggccuccccgauccuacgucacagaccacgaccuuccagcccaguguucucugagcagcaaaaggccucugaggcggccuccaggaccagugaauuuggggaagucuccucuggccuccuaggggcauucaggaggccaccuccggccagcccuacucugacaaccugccuccagucccuuugucaagacaaaacccugguggcacagcccugcauuuuuaucguguacccaccauggguuaggcaugguaccagcuugggaagggucaguggugaaagacaaagggccacuccccuaugaggaggggacuggacaaccuggucaauggugaccuggcuguggagacaacuggaguggaggaggggcaggguaggcagcucaggauggaggcggcuccuucaggacuccugggauccaggaaagacaguuccaggcagagugaauacaguggcucugaggcagggacagcgaggcagcauggccaguaugcggcuccagcccaggccucuucugaccugcagauguggauggccaugcccgcuuggacccucugggcaggaggcugccugugugucugcccccaccccacaagcauacagaggaucuucaggacgcccaaggcagcagcagccgggcugugagugucaggcuccccaggcugggcacagacaauggccaccgcauccucgcagguccccagucccuuugacacugccaagccaaguggcaugcgguuggguccccaugcauccuucaugaggagucugugacgcuucacugcaaagacucuagggcuaggcuggccagccccugcugugcucuggcucucgggcuggguggcugcugacauuccccucccuccccacccaggucagaagguugagggagcagcagcgggcccugcugcgugggaugagggcuggugccuccccucagugaggcugcucuacagggaccacacagcccauuuuugcugcagguuagucuguguucugaugcuaccaugggggaccuucuaccuucccagccucccuccccugaggucugccacugccauaccugccugugccucucgacaggcucagugaggugucaggacacacagguguccucaggaguuccccacauggcccuggccuuccguuucuccaucuauaaauggggccaacaccgcacagcaccagcuagagcacgagcugaaggggcuugugugcagguggauggcgcagacagguagcagcccugaggcagggucaaggggacuucugccuaaccugcagguucacacaacagaaagcacagccagacaaggucgaggccuggguuugacuuugcgggggacucaguguggcuguucguacccgccuugcgggaguggggcuguggggcuuccccaggaguggcaucugcccugggaucagcaucuccuucuccccaagccagggcucuccaagagccuccugggcaaaggggacuccggauuaucaggggucgcucugucccugggggccaggccaacagcucaggcuccagaaagcuggugguuccagccugggcugacuuaucaaguuaggaaagaacaaacuccagcaggaaagagaaaucuucuccguggaggagcauuccacaaaaggcgccugacuuucuccgcacuugccccucauuaacauuccgcagacagcacuaaugacuucauaacacuaaccaggcugaauggacggcaucgauucgggcugccccgcauucagcaagcagcaagcgaugcuucuccaggccgcacacaggcuggguccccagcccccggccacgcccaccugcccguuagcaugcgcagaaagcccccauuugcauggagacaauggucucagcccugaauccggagcugugggggcacugggcauugguuggcacaaucgcccuuugugccggcuccagcgggcaggcgggagcacgucccgggggcucacugagauguggucgggucccagcccaauccugauggcaucuaaguccuggggagccuggugcccaguggagcgggagccuggacuuggucuugccugcugacuuccacaugggaugcccaggaaagccccaaggggcagggaacaccacccagccuccugccaaggagguggggaugcaggugagccauccugaaugaacuggagcuuggcgggcugggcuggugccugcgagcacaaaggguugcgaacacuguggguuuguccccucucugccaugcauaagaugugacagcauccuuacaacugcugguaagcugagacauucggguuagucccaggcacugggaagagguccgagagggagagauggaugcagaaaugaccaaaggguaaagggacggcugcugagaagggaauggaucauauuacuuggauggcugagcacauacacagcaggugaccuguggugaugccagggcaucagcgcuuggccucccacaccuccucugccaggcauagaacccuggccacuuggcacaacugaggcagggccuggcuuccaacagcccagaguccggaacagugggguccagccuccaagggacugggccacauggagcccucccauggggcauggaaggcagagaguggggagcaggcccuccaggguggggucaagccuccuuagagggacaugccuuggaaucauggaagaagggggcugagacuucaaggagcagaaaccgggucagcagagacaaaguaagcaggaaccaaugcaaggcccacgugcgugaugucugucuggacaacagcaaguggucaaaggggagugggcuucaaaugcugugcuccccccaccaccuggaagaugagggcucucccaugcugggagggcaaggccacuguuucauguggggccuaaacuagugcuuucuggcaccaugauaaccaaguguuuucaaaacaggugcccuuuuccuccaagggggaccacgcccugggacgggggcuucugcgaacauuugccagggccucugcauuggugcugcagugcagcaucgggcaagugccaucuuuguaucagaacacagucacuacuaugucugccucagaggaagcagcgagcagggccacagauggcaccuuugcacgagguacuagggagcaaacaggcuuugcuguguuuucuccugggaagacaaggugcacgccccuguccugguggcagcacagcuaucucaaauaccccacgcugggcucagaggacagaaaaagccagaauccuucacauuugguuuuaagagagcugcuagagaauuuggcaguuugggaucacaguccccagaagugggcacugaagucacaugcaagagaaguuggagcucccagggagaaguggggucccuuccaccucuccuaacucucaagggcauccguggcauccguggccagugggcaggaggucuccagccccucacacucuguagagcuacccaguucacgguccugcccuauaggauguuugucucaaaacuggucccgagaugacggaugcaucacgugugccuccugaugcagccaggaggccaggucugcccuggagcaguguggggaggccaagcgcugaugcccuggcaucaccacaggucaccugcugugucugugcucagccagcugcacuucugggaacagcagaaguuggcgggaggcaugggggggccacaaccagacacugcuguguuccugccguguggcugaagcacaugggcccagccuccagggccucacucgugggagccacaaccgggcacugcuguauucccgccguguggcuggagcacacgagcccagccucuagggccucgcucuccacaucugucaaagagccacgcuuacgaguuagcguggguaaaaccccucaccagggauggaggacaucuaaacccuagacaggucugccauccaaucgucaggucccgcagaagguagcuucaucccagcccccgcugcaggggugagaggagggacgcagauccgagccacaccaucacgcacagacucggggccccugggcugcaugagaagggccugucccgucaggccccccacguuuuacccgggccuggugcugcuccuccagggccccauccccaaaccccuucccucuggcgucccugccaguaggcccagaggucacccuagccacuuuccaaccagagcccgugggcucggcugggaggaagccaggcagcuggaaucaggaacacacccuucccucaguacagccggauggagccgacccaccccaucaccugcccaggcuuccucucgcaacagaaggcguggccagcuccuccuugggaagacucugaggggaaggcaccuggaagguuuacagaaguuucuagaagcuccacccucugucuguucauaccucguugucagagaccacagcccaagggagaaacucacuggcuugcucgggcucccaaaaaaggcagugaccuucccggccccgcggcccccaacugccugagggguucucaccagaacugucauagccgucgacagagaagugguccagccgccgcucuucuggggggucgcacgugauaugggggacugugagcaucuucucuccaggagucaccccauugucuuuguccagcuugaacuuuuuuuucuuuaccuaaaaaaaacaagacaacagauuagcgguuccuggacaucgucugccaggcccuacgccggccccagagugccugugcagccgccccgagcccagcccccgccacauacacccggacagggaccugaggccuggggccagcuccagugucuucacacagagacagggcagggcugcugggggucacguggggggcuuggcccaggugcugcccugugagcucacggccucgcuaacaggacagcaggaagcagauaaacguacaagauggugccaguggaggugguaacaggggcugugaccaguaggggagaaugcauaucgggggaacaggcugggggccagcagggcaugaagagggcgccugaagugagggagcaggcuguguggaaaucugggggaacauuccagcacagggaacaguaggcacggaggcuccaccggcagcuggaaacugggaaggccaggucucuccacagggggugggcacgggccaggaaggggaaccaugccagcgucagccccaaccccuuaugaccccagccaugucacaagacuucugcccagcgccugccaaacuccacugcccugugaccuccagacccccuucgcugcaccccugccucaccucccuccccugcugcuccccucccaccacccacugcgcgcggcccccugcccacugcucaccacccacugcgcccgguguggaaagcccaacccugaggcccucugaagagccuucuuuccagcccguccugcucccagagcucuaucucuggagcucucaugcccuggcccuggaaugaccgguccuacauacccccaagucgggggacauugggauggcaggaaccuagcaucggguguauggcccagugucccgaacgaugcugacucccugacacaggcuguaccaagccaaaugcauggugagaucccagccucgugcugcggcccccacggccuccccaccugcuagcaagaaggcccugcccugguggcaggugggcuacucaccaccacagacuucuuggguuuggggcugggugacagcagaguguggcuccggggggccuuccggauguagaucuuccagguggaggagucgggguucucggcagcauagcaccuccaugcggucugaggucgggcagggggacaggcugucaccugcugagccacccggcgggggcccuuauggaagcuacagcucccccucccuguuccccaggccuggccccuccccucuggguggcagggucugggaccucagagucacaggcuugacauggucccagcucccagacccucugcccaggcagccuggcuuggucccuugcugcaccaggcagcucacugccucaugggcuaauuguuacccacagcugggacaccacagaggucuuuaccagcccugagccagccuugagccaaaggagagacuugcaaaggugggcaggucgcacaucauccccaggugccaggguacacagcgugcauaggagaccaaugcggaaaugggcaaccaguggccacacagugaggaagggcugagaaagaggggucgcccaggaccugcaggugcugagcagggggcagggagaggcaggaucccuagggcuggcaggaggugaggucucucccagaggccuauaccaccuugcaguugggggagccucugauggcacaugggugcagcucugaagccagcauuucagagagaccccauggcagcaccacaagggaagggugggaggaggggacacuaucggcaggggacccggcgggggagcaguugugcagcguccagaugggcaggaggggcucccagggccuuguaugaggacauguccugguggccuugucaucacuggccacaugagccugagagagggccgaguggagaauguucccccacacugaugggcuccugggugacagccccagguagacacagcagcuggcgaggggcaccugcagcccucacucccauccagcacccagggacaggcaggcgagggcacaagcccagccuuccaaggcccgaguguuacacacacaggcugagcacuccacguggucccccaacccuggcaaaccccaugaccccugcccugcuccugugcacaccugccaccuggggccccuacuccaguccucccacagugugugcagcuuccgagggaaccccuuucaaaggaccugugguucccagggagugggaccaggaauccaaugugguccccugccaggcgugggcggccagcaugcucaugcugggaccaaggcggguuuacgggccugauuuauggucucccaggaaggagaaacugugaagccauaaaaccaggcuaagggugggagcacacagcccccccgauggcugagccaggagugcaggaggacugcgacuggccccugacagccugggccuugccuggggcagcgagcucacgaggacugcaggggggacgccagccagcgggggcugcccagguccugggccuuccugggggacaucaggcccagugugcccagaggaacugacacugugcucccagccacugcacugggcggaggcccuauccccagugggcacuugucauucaacccggcaacgcccacccucugggcaccucagcggcuguuccucagggcagcccuggcccugcaguggccaacaagagagacccacagggacgcaauucucaagugacuccugugccaaguccuugcuuacguuaacagagcagucccauucucugguggguccuggagagccuggagugacagagccagagcccagcaucccagagcuugguacugccugccuccccaccugccuccagaaccuuccugccccuguugcuccagggcucugccuuucccagcccacuggccuugugagcccagagggaggcccaugccauccaucgccaguccucaccuccaggcaccagggccucccgagcccugagggaugccaggcccuccagaaggcaccaacugcacagcuggguccuaccucccuuggggacaaucaccuggccaccccacucccagacucagcccucagguuguugugcagugggagggagaaugggagcacaagggagccucagagccaaccacguccacuccuggcauggccacggccgugccuccucuccagcccacagggcauggcccuugaugggagcagcuuuggaggaagacaggcuccaaugccccgugcucaccccaucaccacagcagccaaggcuuccacaagcagaguaugccccacaggccagccaagcugaugcaggggccaaugaugguucugacagguggccgugagggcuggaugcaacaauaacagugaccaaaaugacagugaccagggccuugcaggcaccgcaccugaaugagugaggcugccgccgggaucugccgguugaagugcuucugccucugcuucugcugcaccuucagggcaaaccccgagccaagaauccccugggaaggaauggacaggaggcucccguccacacaggccacugccagcugggugcagccucaggacgugguuaccggucaccguugugggaaggccagguauggucagugcuggaagcccccccaagucccaccucgggcccagccugccuguccugggccagcauggggggcagaacuuauaccccaggucuuauccagcaaggggcccagucccauggggcagggcugcagccgcucuaacccauucccagggaccauucugggggccaggugggcugguccaucuguaugugcccaggaaggggucauacugggcacugggauuggggucgcaagugagaaggcaguccucagcugaggaggacccugcugcugccucgcccaaggacgguugaugggaugcaaaggacccacccugaagcuagggaacuccgugucuacagaggagaucacguggugcacgugcaugugugaugcacacacacacacaauagauaugcacacuaacacacacacacugacacacacacaaacacuaacccacacacuaacacacacaaaaacacacuaacacacaaacacuaacacacaguaacccacacuaacacacacuaacccacaaacacacacaaacacuaacacacacaaauacacacuaacacaaacacauacuaacacacacacuaacacacaaacacacacacuaacccacauacuaacacacacuaacacuaacauacacuaacauacacacacaaacacaaacuaacgcacacuaacacacacacuaacacagaaacacaaacacaaacccacacacuaacacacaaacacacuaacauacacuaaaacauacacuaacccacacuaacacacaaacacuaacacaagcacauacuaacacaugucuacaugucaugugcacacacauauacgcacauagauguauaggauacauaccugugacacagauacauaaauacacauaugcaaacauacugauauacauguauaaugcauacaugugcacacaacacagcacacauacuaaauacaacauaugcacauacaauauguauacacaguaugcacgcacacauacaguacauacacacccaugugauacauauacacauacccauaguauacagguaacauaaaauuauacacacacaacacaaacacauauuaugcacauacgcacauaacacacacacacacacccacauacaggcauugugaacuagacacaucaccuuacaaucugugguuucuggaaaggacauggaacaaaacccccccagccacagcguggaagugcccucuccaggcacaagauucugccuccauggggcgugguagcagcauugcccacccacccagggcugagugagcaggccugccccacacugcgcccaugcacagccacuccaggcugccucccacacugccugcaaggaccccaguggggacugcaaacgggaagucugcauccagggccccagggagggcagguggggcucuggaguauagcaccuucuagaagggaagcacccucuugguucugaacguaagugggucugcucacagggaggggcgugcagccaccccaggaccccagcuguccaaggagccagggaaaacgcacccacggggcaccuaccgcugggagcgcaaagaaggagauggcaaagacagagaagcaggaggcgauggucuucccgacccacgucuggggcaccuuguccccauagccgaugguggugacugugaccugcagggagagggacaguggucagccacggaugggacuggagccucgggagggccaacugccuaacccaaacccaccacucugaugagcggagaggccggcaagagacccugaccaccaggacgaccccgugugacucggcgaaagcaccaggaacagagccgcgggauggcacaugucucccaggcucucggcgucacacacaagguaugucccaccagcacauguaaggagcccagcacccacgaagggccaggccugcuggcugggaacgugggccugggagcucgccccacaccggcugccucaucugccugccuguccccaggaggcugggccccugggccaccgacguugcugugcgccggcccccaggagaccgggagcucccacugaggcuggucgucaacaaagagcaggggcugggaugacgcgcugcuuccugacgccacuccagggcaccagauguuuuauuuuccucuuuucugagaguacaagaugcagcucaagccuucuucuuggugggagagccauccguccaggacguguggugggacaauagaaggcuccccccacccuuucccccgcgcuggcaucugagguuugcuuccuggggauuccagucugagccuggaaaugucauucugcaggacguaggagccuacccuggcugggccugguccgugcaggcugccugcuggguucuucaggagcuggcgcugagcccaacaaggagacccagaguggcccucaggcacagcucacccuguggacacacaggcuccugccugggcucaucuggacagcaggcaugguggcccagaccauggcuguggcugcgggaggucuuugcagcccugcucugggcaccacacucaggacagcacagcauuuaccggcuuggggcuucuggucaaggucaagugacggccaccgcuugcaggcccaggaaugccccagcugggaaccacauggagacccccacuggauucccagcccuaugggcccagugcugauggcaggaaggccugaggccuguuuaacacacucugauggaaggcaagaacaaaccccggcccaccugagcccccacgagaccagggucccugggccacccugugguuuccaccagccacugaggaggagggaggguggggagaagccccauggccacccccgggcaggggugcacaggcgcacacgcggacagagaggcaggugcacacggcucacgcgacugcccagaacugccacagcaggaggcucggaggcucagguagcagaagcggccacauugcgggaaaccaggcuguaccgaugagcacguuaacgaacagugaugaacgccagccaccgccgccaggccacagggcgggacaggccucugcugagcccuggccgccacccaggccccugccccacuagugcccugaccgcacguucgcuuauggccaggaugcuucugcagaggcugcuugcaggcuaccucccacagcugcacacggagcucucccugcagcgccacuguccuuaagagacacacacaugcccccaugccccugccacacacacaaugugcacaggaagcuguuuacugccaggcccuuucaguggaccacccggcucuguguaugugggugcacacucacaagcgugccccaugcagagaugggaugcuccacacgugcacgugucugugcuugugcacacacacacggaaacacacgacccggcacacgcacgugcgucacacagaugacaaggucaugugaaaagggagcugguccccauguccgagccugacacucucagggcacauucaggugcagacaccuugaacgcacagcgcaggcacacggagcgcagccaggucccugcagggugaagccaggccaugggugaggcugacaguggcuggcagagaggggggcccugggggaaccggagccccucgucugcaggguguccuccccagagggccugcacccacaugcacaggcugggcugccgcuaccuuccccagagggcccaggugcacugggguggggaguugcagaggcagacacagggcugcaaagugggcggggcaucggagacccugugccaguccugcccuggggagugacuuccaccuggugagcucucagcccaaaggggcucagcccagggucccagcacauccacuguuuaccaagucuacagcaaguccaagaaagcacacacagguggcccagaaacgggccuagaagggccugggcagggcagggacccuggccuauccuggccuugagcucggagggccccugcaaccuggagcaagagggcuccagagucugucuaauccagauuuuuuggggggacacucaccccuucaguaugaacaugcugauuccuacuuguucauccagcaaccuccuauucaucccucagaccugugccugggcuggcgcagccccugccaaugcccugaggcagugcucaccccuccacuccgggcucugccuccgcucugcagaagggccccucucagcaccgucugccuggcuggcacgugcagcccgagacuugaggagcagcccagcgcaggcccaagucccaccccgccuggacauccuccuagcacuggguccgggaggacaaggucaggcugaagaaagcagggguggugggguguggcagaccagcgcccaaggugggggucagguaugagaagcaggguugaagggcugcguccaggacagggcugucuguguuccccaggcaaaugugugcugaugaucugcuggggcugggcucagggacggcagcacucucuguggcuggggggcacuaacaggcacuccugcucccacccaagcguaagcagugggacguugcucuucacagacaguuccgggacaggcguggggauccccguccucuggggagccaggcuuucuggagauuugcaaaaaugcauauuuuucuuucgauaauauuuguuuuggaaaauauagaaauuuuucaugacauuaugaaaauguaaugggucuauuauuuuaauaaauuaauauggaauuguuuuuacaugccuccacuguauuaaauagugauggcacaaugcccacgagccaggcuucuccgucaggggcaccaaggggcccugagaccaagaggccugggcacggcugccucccgaggcagccgaggacaaacccaagauaggcugagaggcaggaauuggccugaggggggcugggcggcaagcaguugggggaggccaguggggagcuccugccuugcgugccaagcguaaggggcgccagcaaacccaggcaucaagacaaauggcacgggcuggcauauuaaacauuguucuaauaacaacauuaaauuauuuuaauauauuuuaaaagcauuacuuuuuaaaugaaaauaccauauuuugauuauuuaaaaaucuaauacagaaacugcaugaugaagguggaauggaguggggcuggccuggaagucagaguggaguuggggucaggugagcaggugagguagccaccugcucgcguaaggacacccgagaccaccuuccaaaccugcccccaaacagacgagagcugcugagggugggggugucaccuccuggggcugagcugggugcacgugggcuccugcuggcuggcuggguggucaguagaaggcaggggugccccgagagggagagaaaggccagccccagaagugccccugggugucugcccaccguggagagcacacauacagcaggacgcagcuccaggaccccaccuucgccuggucugccugucugcccagacccggccccagacccucauccucaaguuaacaaggaaacggccccucccugcagaccuguuuguuuuuccugcauucagacacaggcagcucaggaaugggcuguuuuauggucaccaugcuggggauuagucccugauggcccaccaccuggaaugcagauccacaugucugucuccugggccguggcuccuugccagggcaccagccauaugaggcacacaaagucacgcccauggcaggaacugugggggcgagcggggaacgcacaccccacuggucaguguguuucccccgcccuccugcuggccugugccuucacucccaugugaaggggcgggaggcauggggagccuucuaguccccccauguuccucccugagaaacacugggauucuauucccuccuuucagaaguagccuccucaaggcuggccucgaggggaggacagaggccagcccagaaaccugagcuccagccgcaugccaagcccuggcucccagagcucacuggccccggcuggaaacgugguagucauuugcccagaaggaaggggugguccuggcuggagaugugguggucgucuguccagaggaagggguggucaagagcgggaggaggggguagcccagaggugucacaccccagcuggcacucucaggucaagaucaucuacgaaggaggaaacugaggcugggcagucacugugcugagggcuccccauuagaaaguggccaggcagacagcuggaccaaggccugcaggacccacguuccccgcuguggccaccccgaaggcagagaugggcuaagaggcugcuucagccauugcaggccccgaccuugcccagccucgagagcccagccugcccgugaggaggcaccuaaggauggagucaggagagcgcagcacccaagcucagccccacagcuccaaggagggcggcaggggcuccgggacaucccaugcggccacagccauucccaggucacugugcuggggccccagccaugaggaggccccuggcucuucauggaggcucugggccaagggcgcccucccaggccugcuccccucuccagggcuuggaaggaagcccaugcaggaucucgcagagcugggcccucggccucagugcccccaguaggcugagcacacagagguccaggcagguguccccucucguggcacgaugccugucucagugguuccaggggaugugggacaaugcccuaugagugagggccucgggccccaccuggcaccgucaccuugccuggaaguccuguggcugcccugcuggcaaggcugggcuggcaccguggcucugaguguggggggcaguucucacccuguccgucuggccucaggcaaagccccagcauguucuguaccucaguuucccccucucgggaaggugcaugaucacaacacacuucucacgggcugccugcugggugagggcuuggcacguggccagccugucacucacuccuggaauuuguaaagugcuuuggugccccuugcagacuuagagacccagucuagagccugucuagagccuucugggccucugcuagcuggugggcuccccccaugcagggcucagagacaugcacuccucaggacagggcaggacagggccccacugaccugggugacacuacagagggcagggccaaugaagguggaggaaaggggccuagggggguggccugggaaagggggagccguggacagagggaggccccuggguggggggcaggacugucucugggacagagaaggguggggccagcgguccuggggcucuaacaggccaggcacucacauuccaaggggacgcccagcccccguggggccgcccuggagacuccggccugucucucaggaacagccauaaaggggcugacgccaccaggugggggugggggaacaagccagcaggcuggcaaacucucaggguaaaagcaaaagcagacacacaccccaaaauaaaccugcuuccuuucagcaggagaaaguaaauaaacgaacaccaauucacgagggccaggccuccccgucacauggaguccucuccucacucacgaagcccggagccccacacacgggcugguggugaaaccgucaacacccccauggcacccaggccccaggccgcgucuuccccgagguacagccaggcucagcgcccugccggaagguggcccaggugacugugucuugaggucucagcucagcugucacuuccucaaggaggccucccugcuccugggccgaaacaguccugcagggacacuccggcggugcuucccauggccaccugcgaaccaccacaggccagccccagcucacaccaugcuucucgcuccugacugugacagagagagcaagacagggcugcccgaaccccugccggugccuggcacacagcaggaccgcaaaccacacgccucaacagugaguccacaaacggagacccagccucaccaggaggcccuuucgguccagggaaagucuccgcagcagagggaucgguugcagccucugggauuacaguccucagcagcccuugcagcgggcccugcauuggcccugggagacggacugcugucucccaugugcagauggagaaacugaggcacacagcaggugcguacucugccucuguccccaggcccacucaguagggcagcugaacucguuccccuuugcacggaacuccaggaggaggaagaacgcugacccaggggcucgguggguggccagguccugccgccccucggcccacggcgccuuggcuuccccagcucuuccugacaccaccccucccgcugggcagugccaacagggcuggccugugacugucugggaggcccugcccucacgcacaccccugcaccagcccccagccccuucuggccuugccccgccagggugcagcguugccagggaggcgggaauuucuggaggcuccaggugaggagagagugaacagcaggcagucagacucgacuucaaaaggcggcugaaauguaggaaugggguuccagcuucuuuacuuucaauucuaaauuuaggugcagaggggcaaacacagcccggcagccuccuguuuguagagacccccgggcgcugaacagagaagcccguguuugcaaaaacugcuucucccuccacucaaacuuuaacacaaacaaacgcauuuuguuccaagggcaaagaaaagucuuaaauucuccccaaacgccuuggcagccagggcaggcgccacacucaggggauucgagaguucucacauccaaguugcguauccccaccccggcgaaggggacaggaggggacacucaaccacugagccggcgccuucgcuggacagcuguggaaacugguggccggcaaggggagggaccuucccaggaaguccaccugggccacccacuguccuaggcuggacugcauccccccuaauucauauucaccuggacccacagaaugcgauauuuggaaauaggcucuuugaagauucaaucaagaugagcuccuccuggaucaccuggguggacccuaaagccaacagcaaguguccucaugagagacagggccugacacagaggaaagaggcggccgcacaccgggcacgccuggagucuccagccacggggagaggagaggaaauuucucccugagcuuucggaggggcaggcccugugcacaccucgcuucgggcucuggccucuagagcccaugaguuucuguugcucugggcccagcaguucgcggacuuuguuguggcagcuccagcacccucucagggugugucugaggggugaggaguccacagaguccaggcaaggucuggggcagaugcagcaugaugaucagaauggccuggccuccaggaagccaccucccacccaguaagggccuguggcagccccgacggacggacagacauggagcagcccuggcugccuggccggcgagggcguacuucacuccccgguggggugaaggaagcaggacaaaggagcugaaagaaaacaacugcucagggcgcaguugcaaauuggcaaaacuggcuuaaaagcccccaucugggcugcugccccuucuugcguuucucaaguucuguuuguccgagaaaugccaggaacacagcccauaacucaggccucaggggccgcuccccccagacagcugcagggcagcugaaugggagcuguuugccccacagcccugggcgguggggggcccagggcgaccaggggcgcggggccuggcgggaacaauggccaggccagggcgcgcgauggccgaggcucgggcugcagcugacggugugggccggggcacugaugccaagccgggcacaaaggggccguguucccggccagcgggcggauguuugcacaggugugggagugggagugccgcucugcugcgggcuggggggcuggggaguagcguccgcugcccacagcuccagugggcggcugggaaggcaggcagggcagcagcgaaggcugggcacugcuuaucagccgugccggggccaguacccacuggcuuuugcugcaccgccagcuccucacugcccaccuugccaccagccucccgggaacucuccuggcucugggccguccaucccccgagcacgcccuacccauccacacucacugcaggcaggcucccgcaggggggcugggcccugcugcccaaaccugcucaggccugccacacuggggccuucggggacacaggcccccaggaaggcgggaagaggccgaaaguggggccugccccaacccaggagcugugucagcaugccccugccaucccugagcauugcagcacuuuggaagcuuccagaaaaccugcugacuuggccuacgucaggagccacugcugagugucuggccucaugggggaagcggcgguugagggggagggaggaggcacagcaaucgcagggacacgugccugccuggggagccaccgggaggcuucucaccccacccagauaugcucugauggugguggggggucccgagagccagcaaguccgguccuuucuggaaggaggacucggggcagacggacuggguccuggcaccaccacguguuucccacggcugcccugcccgcccccaccuccagcccccgugcggcccccaggccuuggcucccacccugugugggcuucgacggccuccuccccagcccccagccccuguugcuaccacgauuccaucuaaccuguuaucggacugagugagcccggaggucgguagacaagggcagacgcgggggcaggcuuguggcggcagaguaggggucacccugucaccucggcacuugggcuucucgguccccacccagggccacuccccaaggugugauggugccacccugggccuuaguggccuguggacggcccaccuggcccugcagcuguggggggagaugggauggagucauucccucccugcacucuggccuccagccagcuacuccccucgggguacccacguguucccccuagaagcagcccuugagcuccaugcauauauaaacgccgacuuucacuggaggauuugaaggcagccaccagcucccagagggacacuggcaagcuaggccugcccccuaaaaaugccucagccagcguccucugagccaugagaaacugcugcugggcccacaggccagugacuugggacuuggggagccugcagcucggagggcgcacccugauuccugcagcugcauccucaucggaacaucucccucucccacgugcaagccugagucccucaaggaagcccccacagacacggcccaagacacccugccccaccccucccgcacagccucucugagcuuuggguggcucgguguuccagugcgggaucugccugcugcacaccggcuuccccaaggcucccgggcugcucuagguggccggaacccaccuucacagccaggggcagccucugggcccacaggccgggucccugcuucccuaggcccagcugcaccuaugucgccacugcccaggcccggcuccagaacuugcaggcccagcauccacuggaaacacgggggcucucugaucucugcuggggucucuugagccaucauggucuuuccuguuugcugucucaugucuggcuccuuggggacaggggcacuuacagggccuguguggacccucagagacacgcgagguaugcaucugacgccgcucuccuugggcccugccagggugagggccacgguggaggcagggaaugggcaaccuaggacgauggcgggaggcagagccaugggggagccgaaaccgcuaagcccccaacacacgcuccagugaccccuccgauuucccucucaaaucucaaguucaaggaugagaccauucagaacuucaagauggugaugccaaaggacucaacacugagcguggggaccugugccagcggcuccaagcacagguuuguggacagaggccugugagcgugcaggugagaagccccugccaaggcccgaagucucaagacaccagugcccagauguccugcccacuccucagccugagcugccccuguccccaugccuggaaguuuccgacuuaccaccccccaccacagcgcaucugcguagcugccgaacuccacgcggccugacucguucaccgcguccuucucagccagguacacaaaguacgaggagaagaugaggcccaggaagccgauguacagggugguuaucagcuccuaggccagaaaacacacagugucgggcuccaggaaccgcaggcugggagccuccugugcagacgccuaaggcagcgagucccagcgaucacugggcguccuacgccgcuccagcgcgguucacaugcacagggccggcuucaauauagcccacuccucacaacuccgguaaguggcggguggggguuacccccagaaugaggcucagcccuggggucgcccuaggcccacugucugggccggcgcgggcuccacugauugcccagcucucuuuccugccacgugacagaaccaagaauggaccaggacccaggagauccucagggagaggaaggguccccucaccccacagagccaggggccagugcagccugaacccaucugagugcagcccucgggagggagucugguggcccugccuugaccggguccuugauuugccuggguuuuucauuucugacuuucugucuucauuugcccccagcucagaggaaggugagcacaccaucagccuggcaggccagggucacuggcaccaggcugggguggagcauccaggcugggcucaagcuugggcuugcucugagauccugggccccguucagguaccccugcgcccaggcacccaccggcccccggggccucagcgcaucucaagcuguccuagugugggcugcucugcucccuccguccuguccccaaccugggccccgcaccccuaacccgggccacccaccuggcgguggaugaagaccacggagcccaggagccuccaggugccucccuggcggucgacguguagcauccucaggaucugcaggaagcggaugccccugcgaaggagaugguguggggcugagggagccaggcugggcucagcuguucacgccgggccuagggcuggccgauggcaugggugucccugccccugccccucccaggcguccacucuggguggggaggcuggguauauguccaucccgacaggggccugggaaucucccucucaggcgcagccccccagagccugcucugaaucugcccacacagggcugagcugggggucggccagguaccuccagauucccucaguccccagacugccuucuggggggcuccuugggucaccccaguuugcagaugggcaggcugugugcccagauggucagguuaccacccaaguccuggaaguucagaggcgcuagugcugggccagagccuagggcugccugaggcaucuuggguugagccgugcccuccacacuugccugcacccacccugcuccacccaucccagcacauggcucagugcccccgggggcagugggcaccaaggcaccuugcaucugagcaagguggauggggcgugagaccacccgcggcucaggaggggugcucgggguggggcggcauggcggggggagcuuguggcacagacgcaccugauggccgacguggcaaacaccugccccuuggagcccacgcagaggaccaccauggaggccacgaccacgaugaggucuguggagugcaggagagggggagcuuuucgugaucgccacagccagggccccagggaagagcauacacccugcucucgucuggggaaggggcuugcuggucagacgggucacgcccugaugaccggggacauggagacaccucggauagggaggcaggcagcaucuaaacggagagacccaaccucuguccuggccauguggagcccccggccuaggcugggcccugugcugagcccugcaaguggccagaaagggcagggccucaggccuggaccaugguucucaggcugccgagggugacuggcccaccaugaagcuaugcugggcugugaggcucaugggaaucugugagggaccaacccccuacccccaacaccaugaucagcgucugagugcagaggcugcugagggcugccaaugcuccugugcuggguccugggcagucacccccugcuggccuugggguuccccaguccuuaggggacuccaucugguaggggucaugagguggggguccuuccuggucuggaaaccugggcgugaccuccacagggcaggcaugacucaccgaugauggaaaugggcuuccgggcaaagcgcagccgcccccagaggcccacguacuugcugcggcagccggcggaccagaggcggaccacguacuccgucccgaagaacaccaccagcacgaucuccugcagggacagagugggacgcucacugcaggcaggcucggccuugaguggcuucagacccugcaaccuguuugaacccagccaugcuggagccuccgcugaaggacacccugagaacagcaggcccggguccuggccugcugcggauggugaugccugcgcacagaggcccuggaaggcugagcagcuucagcucauguccauaggcaguggagcccaggugaggcugcagcucucaggccaggcccacccaggccagaggaggccccacaccaggaaccccagccuuggccagagggggccccacaccaggaaccccagcuugggccagagggcguccgacgccaggaaccccagcuugggucagagggggccccacaccaggaacuccagcuugggccagagggcguccgacgccaggaaccccagcuugggucagagggggccccacaccaggaaccccagcuugggccagagggcgucccacgccaggaacccuagccugggucagagggggucccacgccaggaaccccgggugcccuccgugauaagcacuuucccaccagauccagccccggaaagccucacagcuggccuuugagccugguguaccugcgguaggggcagccucuggaucacuuugcccuuacagggagucaccuggccccuccacaccccaacaccuccucaacuccaccgacaccagagggcggagguuccuggaggagugggaagaagacccucggagcuggaucccacccccuaggcacagaaguggaaagcugggccucaguuuccucagcuguauaguguggaugcagcagggccaggcucagugggcuugguggggacuuauugccaaaaugcagcuuucaugugaagugcagcccauugugacacuuaaagugcagcggccaccugcaggcuggagcccagcgcccaggcagccgggguguacgggaggcccuuggggaagguguguggggcuggaagaugaaaccagcccccacgugugagaggcgcuagccacacaaagccacaaagccacaggcauacggcgucucaggcccacuuccggcggacuccugccuguccucccucagaagccgggcccuggaggggacuucugcucccacugggugacaguggcuggccuugcucccaugccacgcccccaccagggaguccacuaugagcagucagcuggacacugccaucgcuggcucccaaauguuauuaauuaggauggaaugauacuuacaccauccggcauguguuugggacaagcccaauggauaaggggagacacgcugggagcuuaguugcuuuccuuuugcaaaaauguuuuuggcucaugacgucaaauccuucaggggugugugggugugugcggacaggugcauacuggagauggcagggguguaagguaaagaaagggugugggccaggugcgggggcucacgccuguaaucccagcacucugggaggccgaggcaggcagaucacgaguucaggaguucaagaccagccugaucaacauggugaaacccugucuccacuaaaaauacaaaaauuagccuggcaugguggcgcacgcccuguaaucccagcuacucaggaggcugaggcaggagaaucgcuugaacucgagaggcagagcuugcagugagccgagaucacaccauuguacuccagccugggugacagagugagacuccaucucaaaaaacaaaaaacgaaaaacaaaaaucaaaaaacaaaaacaaaagguguggacaccugcaggcucuguggccucauggggggggugugggucccaccucuguccucagcuccuggggaccagggcucuaggcugagguccggcugagcuccuuagagaagaggcuaccuuggucuuauccacccccauuucccaggccccagaacaggaccugcuccagucagugcucaacauggacaugcugaaugaacgaaugaaggaacaaauaaaugacuauuccaaugagccggccuagggcucucugguagcaggagcucugucucgucggucuuugcuucugagaaacugcccguuagggagaccgggccuggacaccauaacacccgccuuuguuuggucaucgugaaaaaggccacggaaacacagagcuccaaguccccggagcugagacagggugcccaugacggcacagaggccggcucacccgacuauugguggccuugauggggaggcauagcggcucccagcccagcucugcugacccauccaccacccagcagacuggcccuuagcaggguuuuucuuguuuugaugcacuuuauuuauuuauuuauuuauuuauuuauuuaugagacagagucucgcucugucacccaggcuggagugcaguggcgugaucucggcucacugcaaccucugccucccagguucaagcaauucuccugccucagccuccugaguagcugggacuacaggcgcaugccaccacgccuggcuaauuuuuuuguauuuuuuuaguagagaugggguuuugccauguuggccaggcuggucuggaacuccugaccuuaggugaucugccugcuucggccucccaaagugcugggauuauaagcgugagccaccgcgccugaccuuguuuugaugcacuuuuaaaauuacuuaaauaccuucuccaggcauguccuaggcaggucugaaaugauaggugugucuuauguuauacccugaaauagauaaguaacuauuaaggauugcuguggauagcugcgugucuuuuuaaaguuauuuugaccuaacacucagggaaccuguuuaggggcuggccuucgaagauggcaggacuccugccugugggacaaggugguaggaaugauuaaaaacaacacugauccccaaauccagcuggaugugggaaggcagugcaaggcugcauggcuggggaggccccgcuugucagguuaauuaggcuggugcugcuagcaggccaggaaagagccaaggaaaaguccccucaccaucucuaggcuggaaacagcaagauggaauguuugcucagagauaaaacuaucuccaccaccaucagccucaaacgcucuccugggcugugugggacaacacccagggccaaggccacagcaagaccccagggagcucacacucagcuggggacagggaggagggcuggucccccacgccaugccauggcccaccccugauucacgggaccacauccccagucuaaagcaggcucacagaauggcaggccugccucccccugguuccagcaguccagaccccaggugggugaugccccagccacccuccuaacccuggguucaucuguauuugcagacuugguccuaaguuccaaaggugaacuaaaggggccucaagcuccuccccagaaccugcacacauuugguacuucucccuugcccaccuugcucaagcagcugccauagcuccugcuguccacacugagggugacagucuagggcugucccugaggccuccuucccaggggcucaccgcccagucucccccagagccucccgugggccccaggugccccccauucccuggggcaccccugccuccucaggacccugugucaggagugcucucucccucccccacuccacccccuagguuaccccacccuucucaggccagcucagcacccccaucacccccaaucccucugagagccccauccacuacagguacagaaccgggguacuuccugacucccccacugauaacaaggccagccccagggccuucucugaggggcacccaggaucauccagccccacaaagcgccucucacaagaucuauguggugccugcaagccccccggggucaaggaugcaauggcccgggaugcugauggagugcggcccugagcucugccccguagauacgagaagaagagccguccuuggucuccacugagaccacaaacagaccaaagggacaaggaggccccuccuacccuggucacucuccuucagacuaaagcaaggccgccuccuggcugcagauggcuucauggacaaaagggccucagaucugggcaccgagacgugcacagagcaaacacagacccacauaaugggggugguggccucuguucacauuuuacagaggaggaaagccaggcucaacuaggucaggucacccgcagcuuaggggagggaagacuggcguccauggcagagagagccccgccccgggacaagguacagguguccucgggugugggagaggacacuggcaggugaggccaggccugccauggagggcugaccacucucaugcacagacaugaccugggcaugguggugguucuggaaguggcccuguuacugccagaugagugggugcaggccaaaggcuggaggacccuuggcaaaggggacccagacaugagauaaggacaccaggcugcaaaaguggcccugggagagagaggguaaccaagagagacuccagagccuccagcccugccaggggacagggaggugucucagcccuguggggugagguggggaagacaggccugggccucacagagccgucagcaccaccagccgcccugccuugguggucaucuagugggcagccgggaagcuggagagcugggucuggccuggagggagggugugggugucagauggccccaaggcgggugcaggcacaagagccaccaggaccacagcacccuccuuccuccagacccagugaagggccugggacaaagacguucagggucaggaagccaaaccccauggguucugccccucccugagacaccuucgcagaaacaacagaaaagacaugugaagugggaagaaacgccucggagccuuggcugaugccacugcacuccacaucggacccacucguucgacuguaugcuuuucuagcaaggccugaaagcaaugaguuucugggucccugccccccaaaacaagauaggccacgggucuuuccccuggccacaagucagcccaucccacacugcacccucagcucuguucuaccaugagugugaauccauguccauccuggggcguguuauaaguuggcucucaggugucuuauuugugugcuuuaaaauuauuuaaaaaaccaaaguuccuaacaacucaauuuuuaaaaaauaggcaaagggcuuggacagucauuucugugaagaagauacacagauggccaagaggcacacggagaggugcccagugucacuaaucaucagggaaaugcaaaucaagaccacaacgagaugccaccucucauccauuaggguggcugccaccccaaacagagugacaagugcucccaaggauccggagaaguugggaccuugugugcugcugggggauguagaaugccacagcuccuuuaaagcgugaaaugaccagccgcucgauuuugcugugaaccuaaaacugcucuaacaaauagucuguuuaaauaacaugccagaaaaaaaacagaauuacuguaugacccagcaauuccacuuuggagucuguccccggucucuuuaaaggagauccauacacacccauguccacagcagcaacauucacaacagccaaaaaggggaaccagcccagugucccucagugcaccgacggagacggaagauguggucccucccuaccacggaauaggauuuggccuuaaaaaggaaggggauucucacacaggcugcaacauggaggaaccuugaagacauuacucucagugaaaugauccaguuacacaaggacaaauacuaucugcuuccacucacgugaggucgcuacagucaucagauucacagagguagaaaguagaugaugggcgccaggggcuggggaagggggaguagggagugaguguuuaauggggacagacuuucaucaguuuugcaagaugaaaaaagcucuggagcuggaugguggcgauggucgcaaggaacugugaucuuaaaaaggguuaagaugguaaaacauauuuccauuuuauuuuauuuugagauagagucuugcucuguugcccaggcaggagugcaguggcaccaucucagcucacugcaaccucugccucccagguucaagugauucuccugccucagcccccugaguagcuggauuagaggcacccaccaccacacccggcuaaucuuuuuguauuauuaguagagacaagguuucaccauguuggccaggcuggucucaaacuccugaccucaggugauccgcccgccucagccuuccaaagugcugggauugcaggcaugagucaccgcgccuggccuuauauuucaccauaauguuuaaaaagaacauguuugucaggaacuaggagaagggcaauggggaugguuuuccuuuugaggugaugaaaaagcucuggaaccggagacagguguuggcugaaccgccuugugaacauacuaaaugccaccaaauugcacgcugugaaauggcugaaauggcugaaauggcugaaauggugaauuuuacguuauguguguucucugauacugaaaugagugccucgaggggcccuggcccguggcgguugcucaccugggcucccgcgggucaggucuccaaaaggauucugugggccuucagggccacccagcggccccgaguaucugccgcacuccagcuguggucaucuguagcuguccuugagccuuuaguucuuaaucuucacugacuauuguuaguucagcauucaacgaaauagcuaagcacaagccauuugucaauugcaaaauggcaugcagaccuugagcccucucaggaugaagacagaaaacaaauagcaggcagugcaaagggcccuggguggaaaaacacaggcaagcuguaaaauuccccuaaucuuguuucaucggaacgcugacaagacuuauguugaauggugcucggugccauccuucacggggggcccuggaugccaacgggacacccuaaggcacagucacugccacugacggcuucgcuauugguacugaaaucuugucauuaggcagacagacccugggacccucaaccucaacccaggggaaaucagugcauggugcggaaggaaaauggaagcucaagguagcucaaggucacacaggaggagacacauggccccgcaggccgaccccaugcugguauccgguguugugggguuacaguggcauaaagaggagaccugcccgaagccggagggccagcaagggucuagcaaagcaggugcuuaucugggauuuuuagucuccgagugaacagagcggggaaaggucgcacuuuggcucaaacguguugcaaccggccguggaaccgguguucuccgagaaggcugaaggucgaccuggccaucuuaucuauuguuuugcuuuuaucagccggcgaaucuccaacauagcgaagauuuucugggguucaauguguuuugaaguuccaugcugcuggaaccacauaauuuaggacccuagagaaggucccugugucaaucaaucacgugggaaagaucacagggcagccugaaauaacugguucugaccagcugcgcucacauccugucucucuggaugaaauauauagauuuuuuugcaaaacauaaaggaagccucgcagacccuuaucgcgaggacuuuagugucucugauauuacucuucuauuaucucuuuugucuauuuuggugucucugauguuacugcucuacaguaucuuuaaaggaaaauuaauuuuaaagacggcggaagaugaagauuaaauacgaaggaucagagcugagcuuuguggaaggggccagggucaaggaugcagaaacacagccggccucccuggcgcccccauagacuuaggccuggggaccuuccacuggagccaggaauccacccacccuugaaaagccugagaucuguacccacacuuuuuaggagacaaugaggccucaucaggccaagauggggccuggagacucugaagagggguggacacagggguuaggcugagggugcuguggggacccgggauuagggucucacccccucccauagcgaggaagccagagggcugggccugugcugagccaggcgcuucccugugggggcagugguccccacagcauagagcccggcuggcgggcuuuggggccagcuguuccaacuccacaccggcccggcccugauaagccacagagagagccagccucggcuccggggagggucagcuggccggagggcaaugcaggcacucaggcagcucaaagcgcccuuugucccagggccugccuguggccagcugcucccagccgccagccugugcugagagcuugugggcccccagugacgugcugggcacagcuggggcccucauccacacucacccccgcccucacccccaccccccggggaguaccaguccccaccccgcccaagguagccuggccuggggcaggcgccacagugcagccggccaggcccaggugagaugcaccauccacugggcugaggguggcacagucgggguccggcugcccuguccuggccuuacugcuggggacaugacccugcccugccacagccccuccccugccaaguguccccuuagugugggcaccgcuggggugccacccugaggcagccuuagucgggcugcauccuucugcucggcugcuuccccaggccccauggaacgugcagcccgugaccuugaguggggcccucugugucccuccugaggcccuggccacccaaggcccugcccgcccaagguagccuggaacaggcccaccuccucggaggggagggcuucugggccccugcacagcuagcuccaggcagccagggguggcacugggaguaugguggggggacccgcuaccuuggccaggcccccugagagccccuugucccacacauuagcaagagaaaggaucgcuaagcaggaggaggaugggcacagggcaggagcaggcuggugugaggacacugguggcaucccaggcgggggacccagacgagcagcucagccucucugugcucagcauccacaccuguaaaauggggcaccagcagugcccaccuccuaggacuguggggagggcgaaaugacaacaguggccugggccuguggaaagggcaugggaauaguguagcaggaagguggugucccaugugcucaagagggaagcgaccuuguccucggggggcaggguccugaguacaggugggguacagacucucaugcugcacacagcacagaagagccccgcugaccugacgccccgucccgugcuggcccagcugccuggggcccuccacgucaccuggccuuccuggcuguggaaguuccuaucuguccacagcuccacccugggaguuccuuuuuuuucuuuuuuucuuuuuuuuuuuuuuugagacggagucucgcugucgcccaggcuggagugcaguggcgcaaucucggcucacugcaggcuccacccccugggguucacaccauucuacugccucagccucccgaguagcugggacuacaggcgcccgccaccucgcccggcuaauuuuuuguauuuuuaguagagacgggguuucaccguguuagccaggauggucucgaucuccugaccucgugauccgcccgccucggccucccaaagugcugggauuacaggccugggaguuccuaucuguccugcagggcaccgcgcagccucacucucccugcagugaagcccucccccauccacugcugccucugcugggaucccuccuuuccuccacgucuguccucaucccacccagagcgcccuaaagucaggggcccgccuucuccaccugcaagcucagugcugagaccagcucacuacccaccuugugcccaaaauccugcugagaaacuucaggcaggggacaggugugucucccucccaggcaccugccuugugggugcuguacuugggguguggaaggggaggcugaggggcccguaaagaccugaagacccccacucuggacaucaucccccauguuugggauguuacugucucccccaggauggacgucacccccccccgcccccccagaaggaacaucaccuucccccgucccccaaggaugaacaucacccgcccccaggauggacgucaccccccguccccccaggauggacaucccccaccguccccccaggauggacgucaccccccagucccaggauggacgccaccccccaguacccccaagauggaugucaccccccccauucccccaggauggacgucaccccccuguucccucaggauggacgucaccgcccccacucccccaggauggacgucaccgcccccacucccccaggauggacgucacccccccaucccccaaggauggacgucacgccuccguccccccaggauggaugucaccccuccccaggauggacaucaccccccucauuccccugggcuggacaucucccccccaugucugagaugcuaacccccuccugaccggaugucacggccccccauggcugagaugcugcuaucuguccccaggcuggcgguacccccucccccguguuugggacgcugccucuccccacagggcaccucuggagcuccuccuggucuggcugccccucucugaagucacuggaacacucuggggguccuggcccugcaggaagacacacccaggaaaccagcggaagccacacaccaggccccacccugacuucccaugggaccccagagacagagagggaggaaggagccccugcccaggaagcaggcagcagagcccuagccacaggccuucccacagcuggcggccaucucugaccuucagagcugcaaucggccagcugcucugugugcuugucuccccguuaaugauuucggggugacucugggaggcacgaggccgcuuucccuccagaacuagccccaccugccagcugcccggacgugucuucuuccuggugagcgagagaggcaagggacuugcugggucgucauggggauggccguucccauccaccgggcagccgggcccugcaagugggugacagcugucgucugguccccacaucccggacaccauccugacaggcggcaugaggcccaguguccccugugggcugucuggggagacucucaggaggcuaaaaccacaggggcuggcccucccccugccccgggcucuacgucuaaguagccacaagggcacaucccggggugucaacaagauccagggcuuuccugauccucccugugccugcgucuaccccuggccuaaggggagccauguucacacauuucucuacgacccuccaggccccaggacugauuccauaaggccuugggugucgaaugcauccucuccacgggcuucccgggaagcaccucugggaagacugccugguaggcuuucagagagcaacgaaagugcaauauuuugcucaagggacacuccuugagcaaaaccucccugcaggccaaggcucaagugaccccucuugcugagccggugccuccagccccaccuugccccuuguccguagcucugggaguaacugcaaacucuugacauuugucacucagguaccucaccugggucugagcaggaggugcucaaggcagcuggccccauguguggguguagugggggaggcuucucaggguggagggguuagcuaagaaaggaacuuggaccacacccugggccuagcacauucuugggcccauuaucauuggggccaaaucuuucccaggacugccggcuuccgggccuuggccuccccaugaaggcugcccacccauggaggggaggagaguggggccucucaguaauuuuaauuucacauguacugccggugccuuacgggggccgacuagaguuacacacguuucaggcgguuuaaugaggugccuccagcccugggacccagcucgcugcgcaagccggcgggguggggguucccgaagcgcggcccacuuccucccccaccuggguguucucaaggucaggaggcggacacagggcgcagcagccaccugacaccugccuggggugggagaggcagauggcgcuaggcagagugcccacaggcuggcccaucuagucucugcuccgaacugggcuuaucagcagauucugaugaagcaaaaacuauguggacccccccgccuggagacccccagcacacugaaucaacccaucaccuggcaaggggugagaacccaggacgcacugaauaaacacguaugcuuacacagugugcaaggcacauacuucauuacuuucaggcaauagaugaauuucaauccacgugggggacaacauuugcaaacacagugaagccaccagcaagcgaugugggcacuggcauggaauuuacaaaauaaaagcaucuacaguuggugcuggggggcagcuggagugauguaggggcuggggcaggcagcggggccuacgucucauaacgcccuacagggcccgcacuucccacaucaaucucuucuuucuggcuauuuaggagaguguuguuuaauucccaaauagguaagggauuuuucuuccccaaucuuuuaaucauuuauuucucaugauauuggguuuugaucagagaacauggccaguuaaaucucaauuuuuugagguagguuagauuuguuuguagccacaugaaugauugguuuuguaaguguuccgcagacauaagggaacaaaacaacuccauuacuaggguucgaagugauagugcugguuuuaaagcacaguccuaugaaguucuuugccaguccuccccaacugaaccugggcucugugacaccugcaucaggagaauacagccagguggcucucagucccuggcacugccugucuccuggacuguucauuucugagaugugaggaauccaugcagccuuggagaagcccucaugaacaggagccuuaccagccauguagaugcaaugcuguggaggcuccagccccagcugauacuaugcagaggggagaugagccgucccacugagcccugccagacuguaggcuagcgagcucaggcgugaugcguauuuugaaggugcuagauuuguggaugguuuguuacauggcuauagauaacaagaacaggaguuauuucaaauuacuguuagaaucugaaauugcucaugauuacaacauuuaccuguccauguccucacuuauuuugugcccacuagaacuguccuauuccaaaagagguacauuaaaaucuccucccguuaucauauuuaaccuuccuguccuugcagauuuucaauaguuuuugcuuuauguauuuuauguuguaugaugccuuaaagauuacagucaggucuucuaauagugccugaucucauucacacuugucuuguuugggcuucaguguugauauucauccugaucucccuguuuuuucucuccuuuucuucuuuuagcuugcaguuucuuggccucucuuuggccauuccuuuauuuuucaaccacccauuauugcuuugccuuacuuaaugcugcugagcaauguauuuguuaaaagauaaaagcccagagcuacggcacggccuucucugucuuucaaagaggaauucaggcgauuuacauuuggugugaaguuggaggcauuugauuugacucuuucuguccuuauauuugcuauuugacucuguugacuucucccuuuugcuuuugguuguuuaguugagccacauguuauccauguucugauccucaugaaguugaggaugucacugaacucucauuucacugguuccucaaacucacagccaggucugcuacucucuaaagacaguguccacuguagugggcucccuaaggcuuucuccucaggaagauaagaauuugcgugugacugcauuucaccccucucccuucaccccaucaacggcucuguggguauagaaagcaaccuccaacauugucuucauaguuuagaacagggcuugacaagcuuuuucucuaaagccagauaguaaauauuuuaggcuuugcaggccacgcgauuucuguugcaacaacuccagcagacaauuuugugcuguuauagcacaaaaacagccagagaugagauguucacaagcacacguggccgugugcuaaucaaaucuuauuuauacagaucagcagccagguuuguaggcuaugguuuacggacccuuggauuaaagaauccucugacagguagguauuccuaccggcuaaacugugucccccgccccgcaaauucauauguugagguccuagacccuccagcacaccucagagugugaccuuguuuggaaauaggguugcugcagaugcuauuagguaagaugaggugguuagggugggccccuauucccauacaacugguguucuuaucaaacgggaaaccuggacauggacuugccggccggggggcgcuguauggaggcggaggcagggucuggugcgaugcgucgaccgggaacccuuccacaguagcugggggaggccuggaacacucccucacagccucagaacgaacccaccucgcugauaccuggagcucagacuccuggacaggcagggggcugcagcuggcacccaggggcuccaggucaucagcaaggccaggccagaggucuguucuagggucucuagagagguccaggccauaggccucagggccugaagcuucucucuccccaggcggggucccugugggccuacaagaaagugggcccugucucuccaagaggucuaucagccuaccccugccccauuccaccagaaaacccaggcucugaaggcagaacucaaugugccaguggaggcacuccaggccgaugaccagaagaaaaggcccaggggcaggaaaaugugggcauaugggaggcacucagggcucugaacagucaaaaaggcagguggggcugcccgcaaaucaggcccugaauccucugcugagccccacaguuugggagcugccucccaggaaucauacccagggccccgcacacacaggaguggcccaagccggcugcccugcaauuuguggugggggagcccauggcccggagacgcccacgccuggcugcagacaccauuagccgccuggcaggcagcuuuacacguauuuaaagcaaaucccccaucuuccccaggcagggcuguuuccgucuccaggccaguuaaacgaggauuuaguuucagccugggaaccccacugcugauggcuguuaaccccaaagacggugcaccccucugaucacugucuuagcuagaacugggauagggggaaaaggggguggagcgggggacauuauuuuuaucugccaggagccgaagcuucuaaaaaugucauauuuaagaauuucaccagcacuagaaguuuggcaaaccaaagagaccaggggcugagcacccuucuuuugacuuggggagagugcugagaaggccgcaggguugaacccuguuuacuuuagcagagauugaggagcugcaacccacaccggcccuucaggggcccgcgcaguguugggacaggaaggccugcgguuauuaaaggcugcccuguggacgugugugugugcacgugugucagcgcgugugugcacacgggccugucuagucuguuuucugacugcugaguaccucacucugauucugcaaaucuagagauuuuaauaacaggcggugaauuuaaacaguuguuuucccccccuuucaggaauguuuuaagggauugagaggaaauugugcacggauuuugcuguuuuaagagcuaauaugugaacaacuucagaaggauguauguuguuuuagggcugaaguuuacacaguaaacgggagagucaaaagcagacuugucgugaaauuguagggccugucuucuuaaauuucauuccucugagaagggacugccucccuggggagcaaagcuggaaggaaacagagaaagucugaucuuugucccccgugccccuuacgguguccuguugcagaaucccuggggaggcagugcccagugggauggccagcagcagagaccacccagcccaggcccccucucagggcacugaggagggucccccugcagauggcugcauucagaggucugcaaaccccacagccccuaagcugcucaggaaugacaugucagcacaacauggucuuguuuccaaauuugggcuggggcuucugcuccuuggggacaaauacuuucaaagacaugaacaaucaaaaccucaucaagaagaaauagacaaccugcauagcccuguaucugcugacuuuccaauggcaaacuucuccacaaagaaaacuccaggcccagauaccuccacauguucuagcuaucaaauguuuaagggagaaauaauugcaauucuacacaaacucuuccuaaaaauugaagagcaggaaauauuucccaacucauucucugaugccagcggcaucugaugccaaaaccagacacaacagccaacacauggcaggugacgcccucgugagcgugggcguggaaguucuacacacaaccgaagucagucacauccaaaaagguguuuuaaaacgcaucaugacagcugggcaugguggcucacgcuuguaaucccagcacuuuggaaggucaaggcgggcagaucaccugaggucaggaguucaagaccacccuggccaacauggugaaacccuaucucuaccuaaaaauacaaaaauuagcugggugugguggcgggcgccuguaaucccagcuacucgggaggcugaggcaggagaaucacuugagccugggaggcagaggcugcagugagccgagaucacgccauugcgcuccagcuugggcaaaaagaccaagacuccaucucaaaaaaauaaaaaauuuaaaaaaguacaaauacauauaaaauaaauaaauaaauaaauaaaauaaaauaaaauaaaaauucaucaugaccaagugggcuuuguguaagggaagcaaguuugcuuugcuauuugaaagucaaucagugcgauuccccacacuagcaaauuaagaaagaauuugauugagauuguugcaaaugauaugauuaucucaauagaggcagaaggagcacuugucaaaaaauccaacagccauucuugacgcacucucuauucccagcaaaccaggaagaggaggaacuucuuggccugauaaguggcuucuacuaaaacccuacagcucccaccacaccuaauggugaaagauuaccucacuucaccuuaggaguaagauaaggauagcagcccucuccccacuggcagacacugucaggugcauucaaguaaaaacaagaaauaaauaguauauggacugaaaaggcaaaaauaagacugacuuaauuguggacaacacaaucaucuccauagaaaauccuaaagaaucuacaaaaaaacaaaaaaaaaaaaaacaaaaaaaaccccaaaaacagaugaacaagaaaccuucucaaacuaauaaguaacaugagcaaagucacaggacgcaagguuaauauacgaacaaaucaauuguauuucuauauccuagcaacaaauaauccaaaagugaaacugagaaaacaauaucauuucaguagcuucaaaaacauaaaauacuuaggaacaaaucuagcaaguuucacaccacuaaaaauuacacaauccugaugagugguguugaaaaauaucuaagacaccggggagcaagaccguguucguggaucagaaaacucgguauuacuaagacgugcaugaggcacuggggagcgagacaguguucguggaucggaaaacucgguauuacuaagacgugcaugaggcacuggggagcgagaccguguucguggaucggaaaacucgguauuacuaagacgugcaugaggcacuggggagagagaccguguucguggaucagaaaacucgguauuacuaagacguguaugagauccaaauuuaucuacauauccaaugcaaugccaaucaaaauucuagccaauuuuuuuuuugguagaauugacgagcugauucuaagauauucaugagaaugugaaggagcuggcagaacagcucacucuugaaaaugaacaaaauuggaggauuaacaggaccugauuucaaggcuuagcguaaaagucacaguaaucaagacagugcuuuccuggcagaacagaugacaaaguccagaaaucgaacccacacacacggccaacugauuuucaucaaaggugccaaaguaauucaaugggaaaaaagucucugggacaacuggauaaccacaugcagaaagauuuaaccuccauccauaccugucaccauauauaaaauuaaacucgaaaugaaucacagaucuaaacaagaaaugugaaacuauaaaauuucuacagaaaacaggagaaaaaacuuuguaaucuuggauuaggcgaauauuucuuagacagaacacaaagaacaugaacccuaaagaaaaaaaaaaagaagaacccugaugaauugaacuucaucaaaauuaaaaacugcugcucuuuugaaagauccuguuaagaaaaugcaaagacaaagccaugacugggagaaaauauuuguaaaacagaucuggugaaggacucauauccagaacauagacacaacucuuacaacucacaugauuauucuaagaagacaaccuaauuguuaaaaccagcaacaaacuggacagauccuccaucaaaggagauauaugaauggcaaauaugcccaacaccauucgucacuagggaaaugcaaaugaagaccaugacggaauauggcuccagccuuuaggaugggcaaagcuuaaaaagcagacaauacuaagugcuggugagaauccauaggagccagaaugcucguacauugaugguaagaguggaaaacgggccuaccauuuugcaaaaugcuuuggcaguuucuucgaaaggaaaauaugcaucuaacacaugaucccgcaaucccacucccagggauuuaccccagagaaaugaagacauaugauuacucaaaaaacugcacgcaauauucauggcagcuuuaaucauaacagcugaaaacuggagacagcucaaauguccaucagccugugaauggauaaacaaacugugguacauuuuauccuuuccaaauaaaaggagacaaacugcugaaugcagagaccaugacacggaugggccucaaaugaauuaugcuaagugacagaagccaggcgcagaggcuacacgccgcgagauuccauucacaugacguucuggaaaaggcaaaaccauggggacaggaaacacguccacgguucccaggugcggggaggggcuagccgccaguggguaccagggagcuuucgggugaugggaacaccuuggaucuugacuuugggggugguuacaggaccauaaauguuugccaggacucaucgaacuggacaucuacagagggggagaguuuuccuguauguaacuuaaaccucgacaaaccuaaauuuaaaagaagaaauuagaaaauaagaaaaccuaagaaaugcaugagucagucaacaauacuuuuuaguuaaucuauuuagagggagaggcagcuaugaccccaccaagcccacugagcucagcacagccuccccugccuccugcuaccaccagagucuggccugggagcagcuguaccccauggauggaacacggggacccugucucagucugugccccccccucacuuggcagccuccccaggcaccccucgccugccaucugggcccccggggagccaggugcuaggugaagccuggcuccuguccaugccuuguacucgggacuccagcccuauuugcgcucugguccugggcugagccuggugcugcccugcccuuccugugaggcuccuuccagaagccccugacccuacaucagccgggacaccaucucuguuggcccucaacucgccaccccagcacccuucauucaccugcucagggaggcgcccccucuuccggucacucagcucacguguuggcauuuguuccccuacccugccuggcacucuggccuaggcgaggaugcaugucaggcaucagcucccagggcgggcagugcccuuggcugcuuuccagcuccggggcccgcgcauggagcugccuagggaggaacaugggugucugggccacugcgacgcucccagaacgugggcuucucccaccuucuaccuaugccuuuucauucaacccccagagggacccuagcagggggugugaggggugacggcaaggaugcagaugcugcagugugucggaaauccaggcgccgcgccacggcucugcaacugcaaagacccucucaccccgugaucagaaaaguucaaacuccaggcacacggcccagucccggcaacggcaaagagaggcgggggagggacgugcacugccugcgggauguccauccaggccggggcucggcagcucugguucucuacagacaacucugagcaucucucaucugagcuccgcaaagacauacagauacauccacacccagaccugcacauugggguccaguucugggguccgucccucucgaggcccaaacaguccccugcacccuggccuccccgucucugggucuacuggagguggagcuggcucccuuccugcuccucuacgcggcucgcgcuggguggcgggggcggugggcaaggagccggaacccccagauugaguggugcagaaggaaaagccagggagggguguccugcccaggggucucuccgccacccagggccagucauggggaaggaggcgcauaggggccugggguacucaugacugggggccacgugcugcugcucacguccacugccccccaggcacccccacaccaggccuggggagcccagggccacccaugcagaacacaaaacgccucuuguucccaccccaggugcuugggaggaggaggcccccccacgccccuaccccgggccucgcagagcagucacuggaagugucccagcugugcuaugagcaggucacgaggcuccacaacaggaccugcccacgccgggacacccggugacacuccacucccucugcuuuugcagcccccgggggacccuccucgagggccccaugucuucuggguuccaucgcuuugagguagaaaaucugaggccucaaacugcccccaaagcaggcaaaggucagauguguggagagaggauggcgaggauggcaaggacggccaaggagggucgccccaggugccuggacccagguuugucccgcaccccgcacccuggcccacaugucuuccuuccccauagccccaccccagcauccuggcaccagugggcuccugguggcacuggcuggaugcuguagccugcugauggccacuagcacgugcuggggaccuaaagccacaugguugagacaucaucauuugcuccacaacccccuagccuggcuucucagaucucagccugcccccucuccacccagccacucucccuuggguggaagcuggauguacucuagaacccacccuggagacagccccugggaugaagaaaccaggucguguccgggccccagcaccugucaccaaacauccuccaaagugaggauuuuucagucacaggggcucaggagggcuggggcagugguagucgggggacaguagggccccuuuauucccgccagacagguccucacuuuaccccaaagucgacaauggcgaacuucuccucagacacccacccaccugggccaagucaggcugugugucuguguguguacgugcgugggcauuugugcacagccuaagcacccccaggccaccgccagagcccaacaccgugugugcacacgcauaaacacacaaaccuggugcuaucugagaugcaagaagaagaugucaccuugaagugggucacuguauccaacagccccacacgcaccuaugaaaccgccuuaagaaacuuuucacuaagggcuuggcgggcuccugagaugucuuagcagaauguagcgguuugcagacacguaaacguguccccccacccccagagcuuaggacacuccaccuacaccuacaaggcugagaaagggaauauaaacugcuauggaaaaauuauaguuauaccggaauuuuucuuuguucgcuaugaaaucuuucaaauaagucagaauacagcaacuaaccugaccgauuauacgcauggauauucccaucccauguucugcuguauuuucuucugccacgcuugauucagacuuugagaaacaaaauccaagggaagcagcaaaagacguucccagucuaccucccuggacgaagccaccaucuuuccaccuacguuucugugcucacacgacucgugcaaucaggacaaacacgcaugacccugggaccucgggucugagcugccacugcuuagagaccugccugccgccaccuuauccugggccuggccucuaccagucagaggggcggcguuaagucugagucacaccaugccaggccccaggcuccugucaugcagagcgaaacccuaacuccccagagucgccccaagcccucacacgccagguccugccaccucccugaccucaucccccaccgcucccugcuccccugucucugaaugcuacaggcuccucacagcucccuccacccgcgccaggcacacgccccauccgggucuuggcacgugccaugcucucugccaggaaugcuugacccugaaaccccaacaucuggaccuucaccuccauacagagacucgcagcccggccgcuccacugagaacugccgccccuccccuuccaugccacucaccauuucuuacccgcgaaguagucaguaguccacccaagguugugggggucugaacuuauaaaagauggaaauggagucagcuuauuguuugugguauaggcacuaaguagaaguuaaggcagauuaauaaaaacgguaagccagacaguaaaggguuaaaugagaaaccagggaccaaggaaacuuugaaaggcauauguauaaagguaacuauuaggacaaaaauacaggcugggcacgguggcucaugccugugaucccagcacuuugggaggcugaggcgggcagaugacuugaggucaggaguucaagaccagccuggccaaaauggugaaacgccgucucuacuaauaauacaaaaaaaauuagccaggugugguggcgcccaccuauaaucccagcuacuugggaggcugaggcacgaaaaucacuuaaacccugggagauggggguuucagugagcugagaucaugccacugcacucuagccugggcaacagagggaaacuguuucgcaaaaauaaauaaauaaauaauacaaccuccuaauuacccaaauguuuuuaaaagaaaauaauacacauauuguaaagaaaacuacaacagcaaccgugacaaaauacacguaauuauaaaagacaaugacagaguugagaccaagaaugucaguccuaugaauaaaugcaaauuagcuguacuuuucaggagaaaaauaguuugacucacaaaauaagacucaacuauaugcuucauaugaaaaacaaguuuugagucuaaagacacaaaugguuugaaaguaaaugaguaaaauauauaccaugcuaacaaugauaaaaagaaaaagccagaauagccauauuaaucucagacaaagcagauuucagagcaaagaaaguggccagggauaaagaggcaguuucauaaugacaaauguguugacuucucaagaggacauaacaauccuaaaugcuaaugcacccaagaacgaagcuucaaaacacauugaacacaugguauacuuguauugaaauaucauauguacuccauaaauauguacaacuauuguguauccacaaaaaugaaaaauaaagaauguaaauaauuuuuuaaaugacaaaagcaaaaaauaaaauacauuaaacaaaaaacuaauaaagaauaaagaacugaagaauaaagagagaaauccacaaauacaguuggagauucuaacauccuucucccaagaaugaauuaauagaacaaguagauacaaaaucaguaaggauguaucauuacugauguagacuuggacaaugccaucaucaaccacauuagucucauugacauuuauagaacaguccucccaacaacagcaguacacacucuuuccaagcacacaauggaguauuuaccaagauaaaucauauucugggcccuaaaucaagucuuaauauauuuuaagagaccaaauuauauuaaguguuucuauagccauaaauaaauuagacaucaguaacagaaagguaucuugaaaaucccuaaauguuuugaauacacuuuuaaauaaugcauacaccagagaagaaguuaaaaaggaaauuagaaaauauuuuaaaugggauaaaaaaacacaaaauuuguggauguuuauaccaccaagugccuguauuagaaaggaaaaaaaaauuucuauucaaugaccucagcuuccaccuuaagaaacgagaaaaaaaagaacaaauuaaaacuaaguaggcagaauaaaauaauuaaaauuaaucaaauaaccaaaaagaaaaaaaauaaugaaaccaaaagcugauucuuugagauccauaaauuugcuaaaacuuuagcugacugauuacacuaacaaagaaagaggcacaaauuacuaguaucaggaaugagagaagagacauugcuacaaauucuauagcuguuuaaaggauaguaacaggauauucugaaaaacuuuaugccaauacaauuaacacccagaugaaaugaacauauucuuucaaauacacaaaauaccaaagcccacucaagaagcaaucaccugaauaccacuauuaucaaucaccugaauagaauuaucaaucaccuaaauagaauuaucaaucaccugaauauaauuaccaaucaccugaauauaauuaucaccuaucaaucaccucaauguaauuaucaaucaccugacuauaacuauuaucaaucaccugaauauaauuaucaaucaccugaauauaacuauuaucaauuaccugaauauaauuauuaucaaucaacugaauauaacuauuaucaaucaccugaauaaaacuauuaagucaauuuaaaaucuaguuaacaaucuucucaucaagcaaaguccaggccuaccuaaacaacuuuccugauggaguccaccaaacacagagggaagaaauaagaccaauucuacacaaacuccaccucuaaaagggagagagaacacuucccaacucacuccucaugccagcauuacucuaauaccaaagccaaagacguuacaagaaaauauauagacaauaucccucaugaaccuagaugcaaagguuguuagcaaaauuuuaacaagucaaguccagugauauacaaaaagaauacuagagcaugaccaagugugguuuauccaggaauacagaaccugugaaaaugaaucaguguaauuaucauauuaagagacugaaguagagaaagcacaugaucauaucaaaagauguaucaaagagcauuugacaaaauuuaacacccauucauauuaaaagcucucagcuauaguauuagaggggacguuuccuuaaccugguaaagacaucuauggaaacccagagccaacaucacccuugacggugaacaaugaugugugucuucuaaggcuggggacacagcaguguucacuuguauuggacacugcaguggaugagccgcccagugcaaucaggccagaaaaagaaacaaauaggcguccacauuugaaaaaaagagguaaaacugucucuauguucagaaaacaucauucauauaaggaaaucaauggaauucauuuuuucaaaagccacuggaacaaaugaguuuagaaagguugcaagauucaagauaaauuugucaaaaugaauuucaguucuagauuagaagaaauaccauugaccauagcauaaaaaauaugaaacacuuagguaccucaaaagauguacaagaccuauacacuaaaaacuaugaaacaucucugacagaaguuaaaaaucuaaauaagugguauauaaccucauauguauaugagauauauaacccuuauaagagauauauaaccauauacauauuagguauguaaccauauauauauauacacacacauauauacacauauaugcacacauauauauacacauauauauacacauauauauacauauacauacacauauauauacauagauauauacauauauacacauauauacauauauauauacacauauauauacacacacacacauauauauauacacacacacacauauauauauaugagauagauaaucucauugaucagaggauucaauauugguuaagacaucaauucuccccauguugaucuuuagguugaaugcaaucccaaacaaaauucuaccaggcuuugcaaaaauugguaagcagcuuccaaaauuuauauguaaaugcaaaggaccccgaacaaccaacacaacuugaaauagcaaaacaaaguuggcuaaauuacccuaacuuauuuuaaccguauuauagggcuguaacaaucccagugugugacuggcaaaaggacagaucaacggaucacaguagaguguccagaaagagacaauuuuaugauaaacugaaccucuuaaaaggagucaagaugauucacuggguaaaggauacucuuuucaacaaaugacacuggaccagucagucauccauaagaaaaaacacaugaaucuccgccuaugucuuacaugauagagaaaaauuaacucaaaaugcauccuaggccuaaagguaagcacaaaaauuauaaaacuacuagcagaaaaucuuaguaagaguguguuugguaagcauuuccuaaauagaaugugaaaagcaugaaacauauuuaaaaggaaaaagcuauauuugacuucauaaaauugaaaauguuuggucuuuaaaagauacuauugggccuggagcaguggcucacaccuguaauuccagcgcuuugggaggccgaggcaaggggaucgcuugaggccaggaguuugacaccagccugggcaacaaagugagacccugucuguacaagaacuuuaaaaaguuagcaccugugguggcacaugccuauagucccagcuacuugggaggcugaggugggaggauccucggagcccaggaauucgagguugcagugagcuacguuuacgccacugcacuccagccugagcacagugcaugacccagucucaaacaaaaaaaaaagauacuacuaaauaaaugaaaaggaaagccaccgacuagagaauacauguguaaaacaaauaucuauguaaccagaauauacaaagaacuuuuacaacucagaugacaaacagcccaauuuuacaaugggugaaacauuuaaaaagauaugucaccaaagauguuuccuggaugccaaugaaacacgugaaaagauauucaacaucacugguccuuaggaaaugaaaguuaaaaccacagcaggaugccacgcacaccucuuagacuggcuaacaugaaaaugacggaccacgucaaggguugaugaguuagccaguuucuuaaauaguuaaaaauauacacucaccacauuauccagccauucuauaccuagguauuuacccaugcagaaaggaaauauaagucccuacaaacacuuuuauacagaguccgccagcacacaaguggauaaacagacugcaaugcguccguacaaugggauacggcucagcaaugaaaaaggaaugaauuauuacaugccacagccuggaugacucucaaauauggaaccagacaauaaaaaccacacacuguaugauugcacugacaacaagccccagaaaacgccaaccgucuacacugacaagacagaccagggguccccuccggagccaggagcagcggaggaggggccagcgacgggagcgagaagccuucugggggugacggaugugccugcugucucaauuguggugaugguccuguggcguacacccauguccagauuugucaaauccuacauuuuaaacaaggccuuccacucuaugccaauuauaccucaacaaagcugauuuuuuguuugagugagcagaauaaauaaaacugaggcuauggcgguuccuggcugaggccccuccuucgcaauuagcgcgccuuuggugggcacggggccccuuacaccggcuuccccuagcacuuccuuccccgcccccgccaggggaggaggcaucguccaccaacacccuuuugcccucuuggccauuggcucuggacugagaaccuucaugcccaauguccccacacccucggcacagccccaggaacugagguccugauaugaccugaauuucacacaugaggaagcugaggugcagagaggauuggugacguguguggacccacggggaagucucaggagucuggauacccccauauccuggaguuuccccagcaaggucugggagucuuucugcaaucccaggcuccagggccauggagagccacagcaggcacggcgacagccucugaggcccaccccaagccaggggaccccacggugcagcucugcgccggccuuucacaggaggggugcagaggccuccagaggcugccgacuggcccccaaacccccuuagcugaugucuaugcgaggaccagccacaggaccugggccucagcgccucugacaggggcuccaugaacucuggggagaaacuacaaauucuuacaaacucccgggaugagaggggguuuuccaaagguucuagaacuccuaaguggucuaacagauguccucauuuaaaaaaaaaaaaaaacucaaaacaccugagccugagaugaagcaagagaacuugagcagaagggggcuuucugggaacguucagaguauccuaacgguggggacaaagcccugcucacaagcaucccgaaaacggcguccccauggcuuuguccucaaucccaggcuuucauagccaccgccagguccagggaccuggcuggguaggccacacugagaacuaaccaacgaaaagggcccagcucagucccucccccgaggacagcagccaucccugacccuccccagccaguuucagaaaacggucagugagaagagacacaggccccgcuaaagaaagcuaaaaugaaauaaagacgcccgcccuucccccagguuccccaccaaaugcugcucugaaugcacgcaucauucucagcacauggugcucggaaacugaccagaucaucaccccgccaggaaaaggggcuggccugcgccucucggcacacacuugacauuuuguucucauccaggcuucccaugcugacaguuucuggauuaaaugugcaaauggaacgcggccccaagggggucucucucccugccugccugagguccagggcugggugugcacgugugcacgugugcaugcaggcacgugucugagccugaacgugcacacacacgugaguguguccacauggguaccuaugugugcauacguccacacgcccauccgugcacauaugucugugcgugugugccugugcauccucuucuccauaaggcaucugggcuggacacgaguguguuuuucaacccccgacuucaacuaccuugaccaugaccaagucuggaaaacucaccaccagcucacagccgcccaggacuuuucucagcccaacagggauuggcuucaccuaaaaaucuaaaugcaguccccucacagcaaguccccaggcugugcucucugccucccauugccacccuagagggcacaaagcugugaggcccagaggaccagaacgcaccuucccaaguggccaggagucaagacugcauauuuggggaggagacuauuguccccaguugccaggguccuaaagacaccugaagggaacauccacuccuccugaggccagcuggagcugaccuugggguugagagcaucucccacaagcuacugaggaggcugcuggccgccccuggccccagguaccccagucaucccaccaggcaucccguuggccaguuuuauacccgggagaaagaaaaucucgugggaagagcugucuaggccuggcccugaacagggggcugggauccgaggugcucgagccguggcuccugaccccgugaggccgcaccgagcccuguccccccaaccugcaaagucacaugaugacacacuucaauggugcacggccagggccucugguuuucacucugugugaccugggaagccaagaacauaauuagaacucaucugaauguaaugcccucuaggggguuccccuggcaccugcccagcccccuccccaggcugcugcccagcgucagaggagaccucaggcuaccuccuuguucagggacacagcggguggaccccacugugcaguacuccauggccagugggccccacaggguggauccuauuaucccccaaugacuucccuagcagcccccuaggagccccacgugcagugccagugccagcucccccaagccugccugcgcccggccugcucagcccgucccguuguguugugucagcugcugcccugcgcuucaagcgaggcucuccagcuggccagggucagaugugaaaacaaggacauaacccaacccggcccgccggcuccccugcaccagagacccccaccgaacguggcacucacugaugaggcucuuuccagcccucaggcagaacauaaaggaaacaccuguccccauggccgcacacucuaaucccacuaaacccgaauggagaagccugggggccccugcagcaggcgcaccccccaccaaggucugacuuuuguccuggacuauggggaaggcgggagagaaaacacgggaacuggccugggagagcuggaaagccgcggccgcccuucaccagggaugcaacuuccaaccagacccagggcugcagagagcagagcaccauggcgguguucccuucggccagcacagccaucggcuuggcucccaggcugccgcgguggaguccgcacagggucacacgcuuguggggccucucaccagagcucccgcaaagaugucagguauugucuaagaugccagcgccugccuagcguaagcccguuccucuagccacucaaugcucuggaaagauugcgcuccuguagcuugaaaacagggaagacgauggaaccagccgacagggccccagacucuucaggcagcagcagguaggagcuucuaccuggccauuauggggucuuucuggggcccaagaggacuugccaccaggcacgagccaggcccccauccccuuuuccuucagggggcgcaccuggcggagaucuggaggagguguucugguggaggagcaauggggaacaggcaccuugccccccagagggaccacgggcugccgacgggacaucauccacucaugccucggcugccccaccccuggccggagcaccaugggcugagaccgccucccuugaagccccagguuccucaaacccagguggggcucacugccuucccucugcacagccucccuggaggaaagacgcugacuggugguucccagguuccagcccaggggugucaaccccauucucacaaaucgcuuggacagaaucggguuacguguuuuuggagaagguuuaaaaaaucuugcaguuuccucuaccuccugccccaggccccucacugccccccaccccaccccaucuuguucugaacaaacuugauauauaugacaauucuggccugcagaagauaacgugaggcccgugugugggcugcacagaggaagccuuuguuacagaaaacgauucaccguagggccccuccacacacaaggccccguauacucagggaaguuuccgguuccagcccaggauuccuauguacucggggaacguuccgguuccagcccaggauucccacuuucacgacucucccgcaagcagauuucgcaugaaagaaugucagcuguccuccucccaagcagcugccuucagacaggaacgcagccaauccaaacccugucaaccgcgguccugggacaggggaccuggcuggggcauaaaugauguccaucgugguggagacagccugccugcugccucugcccugggccccacagaggggccugugagcccuccaacucguccacacaacauccguggggccaggggacuguccccaagccuccauguccaccgcccuucccugcccaagagagagaccaagaagggaaggccgggcagggcugcuccaggucaaagaagcugaaaccgcgugacagccaugugcaaugagaaaaaaccagccacacucacugggaccagugacgagccuuaaaugcaggcugugaaauggacagcgguguccugagagucggacacccuggcuaaguugaagguccucauuccagaggauauacacgggcuuuauacggagaaacggucauacugccuccaacuuacucucaaaugacucaggauaaaaacaaagcaggcugagugcagugguucaugccuauaaucucagcacuuuggguuggccgaggugggaggauuguuugaacucaggaguuuaagaccagccuagguaacauggcaaaacccuaucucuacaaaaaauacaaaaauuagcggggcaugguggcacgcacccacagucccagcugcucaggaggcugaagugggaacacuugaggccaggaggccgaggcugcagugagccgugaguaugccacuacucuccaaccugggcaacacagcaagacccucucucucucaaaaaaauaaaaauaaaaaaccaacaacaaaaaaccccacaaaacccauauagguuuuugcauauagagagaaacgugcagagcaaauggcagaagaugaaagccacugcugaccuggcagagggugccugggagcugcucguucugacaagccugagauuaaaucaaaauucagacacccaggaagaaagacacagacuguggaaccaaaaggcccugcgccaaccugggcacuguagaaacguggggcacggugggcuggcccggggcacacgcucucccacuucuauuuucccaaaaaauaaaauuguuacuaauucgacugcaaguuuaaaugccccuagcaacugcucuuuccaaaauuauccugcuaaauaaauagcguggcaaaccuuuccuggaaggucagguaguagaaaucuuaggcccugugggcugcauggucuccauggcaggacucaaaucugccauggcacaaagcagccagaggcauuaggcccucaaguauguggugcugugugcuaauaaagcuuuauuuacacacacagggagccacccugugggccaugguuuggagaccccuggguugcccucaaauucauaugaugaagcccuaauccccaguacucagaguaagaccuuguuuggaaauggggucccugcagauaugaucaguuaggaggggggucacaguggaguaggguagccuccaauccaguaagacugguguccuuacauagaggagaaauuuggcuccagacucacacgcagggaggaugcccugugagguaaagggagggacugggggggauugggguacuacaucuagaagacaguugcuagccacccucagaagccgggaggggccucagaagaaccagcccugcccacaccugggucucggcccuccaucguccagagcugugagagggcgaccuccacgguuuaagccgcccagccuggggucccccaucacgcagcccaggucgacucucgcgacccacguggcuggagauaggcccagcggucccucuggcaggcugggagggagagccacgcccuguguccgguuuugaagcccagccugggaagccacugcuguggcccaaaccagcucuguuggguuccagacccgccugagagagggaggucccaagaagcuguagcggguggccucaaaaucacauguuacccucccgacccucagugucucgcugggagggcucagcaugucuccccagguccucugcccccacaggccaggcaacugcugagcccugccagccacccuguggggcagggcagcgccagccuccacuccaacaaggcacucggggcacccaccccagccucccuuccuuccauaacucucggggguugagcaauggugcacgagagacuccuguaagagccgcaggcagugcggaugguguguuuaucaccaaguacaggaagccugguggggccggagucucugcugcagccuggcacagcaggaaauuucuagaaucccuuaacaccguggagccgcggcccagcugagcgccccugcugcccugagccugagcuccugucacaggcagggagcggaccagccuuccuucagcagccccugucgccgcguggccugugcauggggcuggguggcuggggacagcagcgggugugcucggcagagcauguggccagugaggcuggaccaaggcugucccgggggaacagaaccaccgggucuucaugccaugccccgugggccucaggcucugagacuguggcuucagcagcgccccugcccccagcugugcaucccacacccugaagcagaacacuggaggcagggugcccaucacaagcacuggcugccuccggggagcagcagcgccgggguuccucuccuaaacagcccucaaagcaaggcugauccuacgcccagcaaagcggccucagaagggagcauuuugauggauucccagaggcagggggccuggucccaggucuucaggggguaccagucaccugaccgcccucucucaggugcagagugggugauagagaugcuuucaggaagcucuacggccagcgcaugagagagacgccacagggcucugaaaggcagugaguggguugcacagggcuccccaggaccaggagcuccugguggauggggauuucaacagcuucagugucacuaaaggggaaggcaggagggacuuguauccggugguccucagugaucaacacugggcuccggagagccggccaagucacuucuccuguccccacagggcaguggcuucaaguuccgcuugguggauucugagccuuuguucuuggaacucuugccgggacaucaggggucgacccugacccgggaggagccuuggcagcugaagcuggguggcagcugaaguucagcccaccuggguguccccagcugccccagacagacacuugggccuacccugcuccaccugccccugguccacuuucaccuucgcuacccuuacccgcccaaagccugcaggccagugucuagcguccuuucacccugaacaggcuccgagagccucugucucccuggggugggcuccaggcaggucucaggacagaugagugagaaguuucuccuacaggcucauggggcagugaccugaagucuggcugggcagagcugcaggccaccccgugcccugggggcugugcagacagagggcccacaucugucaaguccucugggccuagcuccaggggcucagugcagacaggaaccagggcuccagcccgcacauacacagggcccugcagugaggaucccaggggugcggaaucucaguccagcucugccuuucaugagcccaugggcugcuugcacauagauccuggcacacaguaggugcuuaauaaagauuugcuggcugaacaaaugcaggcggaaacaacccugccagggagaagacgaccgcguucugaagccucagaguggccugggugguggggaccggucuuagcuggguagcucccaagugacagggacaaaaaggcaagugagcccacaggcccacagagggacacaacucuucccagagcacccugcagcccugaggagggaguggguacccccgucccugggcaaccagucuaguggggaguugcccccgaagcaagugugcaggacggggcuucgucagacccauaggagcucaccaggcagggcgaggcaggcagggaggaagacaacccucagcgggcggcagcugcagagggagucagaccucgggguggguggaggaaaauccugagucacccacugguuccccaaccugggcaaaggugccuuugcucugcgucuuuucccggcagcggcagaaauggugcugcgggaaaccgccccaggccgugcgcagagcaggcuccucaucagagcagcugcgggucccaggugaaaaacaccaggugaggaccugcgggccugcgggcgcccugagcaaguggaggccagggcgcugaggacaggacccgaccuuguuccacagagagggccgcccagggccgucacggaggcccagagacucccuacagggucucacuuugcugcugggagggaaacugaggccuugcucugagcugggagggaaacugaggccucgcugugugcugaaggcgcagcagaaacccaggcaguggaggcugcagcuggcgggaggggugggccaccgggcggggcggagggagccucagcagaggggaggaagccgcagcgaugaccucauccccuaggccuccggggccgcagcucacgggguuuuuuaaccacaggcauugcaggacaauucccugguauguucaccaccaaaggcgcggacuagccguguuuguguugugcuuuugagugccucucucuuuguguggaguuugacaaaagcugugauccuggagacaaaagccaggcccucaccugggccagggcagggucucuuacugcagagagcagggggccaguuucuagcagcagcuggcuucggcaagaaacaggagagccacccaaaccgggaacuccuucccaggcaagaacacgcaaagcacacacacgucagacacacgugugcacacacacaccaggcauauguguacgcaugugcgcacggagcuacccacaggcacgcacacguacacugagugcacacaugcacacgugugccacuuccacagacauggguacacagacgugcacaugcacguacguacacacgugcacacacagcccccucugaauucagaagccagguuggggcccucuuugcagcccaggaaguggcucuccucccugggaggccuugaggaaaucucccugcccagcagauuuccgacgugguguucacgugguguucacggugccggccggaccccagccgagaccagauuccucccgaaauggcuuuuucaggcccaccgcauaucccugguucagcagaaugccuaaucccuccgaggccgcgcugggguuuccuuagcagugcugagauaacagcuuucuggcacugcaaagcugggcguacgaaaagaaacgagaaaacaggggcucccugggaacacaucgcuuugauccauuuuuucccccaacauuuaaacaucgugcucucggaaucccucaugcggguccugcacccgcccggccccuccuggguuccccaaggcugugguuugggcuccccgcgcucagcacuccuuggcgggugccagcagcuccugaguugcauguagcacgagcgcccucuggcgucuacaggccuucccgccgccuggccccaagggcugcaaacaccuuugcuucucguaccuccccgaagcgcccccaaccguccuuccugcaacccugcacagccucccucugcuggaaucaagaacccaacagccguccucacuccuccaggccugaagccucgggaaccugcugucaggugacuucugccugugcucugauccccacagcccugugccugcuguccgcuggaagcugugagcccugggaggggucccugccugccccgccagcaccagcuuaccuccuucucacugugccccucccaccugagcgcccccuccuccaagcaaguggucacugucuccccacccagagcccacgccucagucucggcccugaugugucuguacauccgccugucaaggccaggcccacggcugccucacucucugcuguguccccaacgugcccccaccauggccaugacugagugacagcuggacccucaaauccccuugaaggauuuguuuccacgcggccagugcuucgagagacugcugggaaguguggcaaggcgagugggagggugucuccaucacgcaggggcagcugaagccgggagcacauaccaagcugggucauccucgcugggcaacucuggccuaugcauuugaugcagggagggacaugcacggccaggaagcgccaugcagagcuugugggguuagcgcagccacggggucccacccucagggaguguggaauggccugaggcagacagaugcuugugagccucccagagccccaugaacccagaacagggcaggucggcggggauggugugcaggauagugccaagcagaggccugaaaccugacaagaggcugagugcugacacucccgaggacagccagguccagagaagagggcuugcaaaggcccuggggcagccaggaauguccaaggcuuggccuggagugagugagcccaggcugggugaggugggguggguaguguuacaggugaugggccugaacguggcaccaccuuggggaauguagccuaaacgucacagggagcuucuggaaugaucagguuuuugucuuagaaaguccuccccagcugcuguuugcaggguugccuggugagacgcaagguguggcagggaggcagcuggcaugacagauaaagggacaagggaggcggccagggucucucugccuuccaagcaguggaaaaggcagaggggacugcaagggggacuacagcagaaagggggcucuaugcuuggggccacgggcugcuucucugccaugccaccccggaggagagggagcugcagggcagugaaagggccgguuccugcugaccagggguuuguggccacaguucagcaaauagccaccagguggcgcacagaccccagggaugcgcagacagugggcagggcugcugggaugaggaccaucuuggaggcuucccugggggcacagcucagcacuguguagggucugcccuccugccugggcagggcugcauccuagggagcaacccuaccuggucugcuccaugccccuguccccugccugguuuagaugccgcaugggggccuuggggugcugcuggugauucuagggcugcagacgggcacaugaagcccagggcacgucuaauucucgagcugcagacgggcauguggagcccagggcacgucuaauucucgagcugcagacgggcauguggagcccagggcacgucuaauucucgagcugcagacgggcauguggagcccagggcacgucugaaggucccugcagguccagccugggugcaggcuucuccaggcuucgcccucccagcugccugggagauaaccaccuaggaagugaggaccugaacuuggacgcuguggugcugacagacagcccuggcugggcaggagcaccugggugggcucacguuagcaccggggcuccauuuaaaaccaggcaagucccaggccaccugggggcgaggggcuaaccaccuagauccagguuaguacgugagggaugggacaggcaggaucucacgucucacacacagcacaggcaugaacacacguacauacacauagguacacacacgcagcgacacauagcuauacauaaauacacacaacacagccaugcauaaacauacaauacaugcucacaggcgcacacuacaaugugccuauauguggccacauucacacauguacacgcucagauacacaugugcacacauguacacacauugaaacagagccaaacaugcgugaaaguccccacgugcucauguguaugcacacuuacauaauacucagauacagaugcacacuuaagcacacagcucacccauaaacacgcacaugcguguacacauucccgugcaugugggcacucacauacacacauguacacacaccugcagagguacaaagggccucacacggagacucuccaggggaauguuuggcagcgcggcucucacagccugggaaccacuggcauccuuggccccaggcccuccagggacaacuaccaggucagggaccccccacagacccgccccauggcagaaccagcaaaggacaugccgugcccacuccugcaguugagccaacccugucaguuggccggggcagaacauccuccugcuagacauggccagagacuuggcugggugcucaucugagagccaggucuguggugggugaggaggacuuggggauccugggcagguaccuuggggaccccauaaaacaugaggcccaugcugccaaggguauuggacaucgcccugugggggaaggacggccucaccccaaccaagauggcaccacaagaugacacacacaccccacuucacagggcagugcaaaagucugaacaaagcaugagaguacaaugugauaggacaugaaacucacacgccaggaccaaggggguuuauuccaggaaggcaaggggggccccucacugacaggagcaccucacagaagcaggaaagaccccugaccagaauccacauggucaccguaaaaccacgccaggcaucggaccugaaggacccuuccugagcacgggaggugcgcaccccccgccuggcagccggcccgcccacagaagccaggagggccccgcuggccgcagguaccacccccagcucuggacagacccaagcagcaaucugcccuccuggaaggcaucccuuaucuggaaacgcaaaagaugcaaaggacagagggaaaaacuucuacgaccacagucacgagaaguagcaggaccacaggcuguagcagaaauuaacagcuuucgcagacgccaggaaagugccuggaaaacaugauagacuagaaacucccuaugugauggcaacaauaacaacuuauucucucaauauuauuaugaugaggaauagacuuaaacugccugcaaucuacauaaugaaaccauaaaaugcugcccauaaacacacacaccaugcuccuggagaccaccgagaugucagucucccccaguuuauucacccgcggccuucgaguuucuucccggggcuggauaaggugauggcaacguucacugggaaaagcaaggcugcaagcgccaccaggaaacccccgaaaaagaaagcccugccgaggcacaaagugacaucaugaaauugauuuuaguaccgggaccaccaagucaguagggcccugguaaaggaaaaguccaggagaccagugggacagaauagaaaaaccccaaagcagacccuuccuacugccucuggacgucugguuuacagagaagacggccccuccagucaggcaggacagauggacuguggaaaacauagugcugggagaacugggaagacgagggaagagugacagcaggccugugccucacaccacuuacccaggaaacucccagccaccauggagcacacacaguuaaccuggucagggcuggaggaaaccacaggugaguucuuccagcuauggcucaagguccagaagcaacaaaggaaagguaaaacggacucccuagaaaugagacggauaccacugccgaggccaucgcgagaggacucuggaccccggagggacgggcuccccuggccaggaagacacagugccagaaagcagcaugaaaccagcccagaucugccugugcaugccgggagcugagucgugacacucucuuccuuuguagauacuagaacuauuccacgacaagacaggaaaacacaaaagccuggccacggagaggugcuagacccaguccugccagaguccugcugcucacggcccacauucagguggcuuccguggggaccccgugggcuccagacacagcuggcccccugcaccccaccuuccaggcagccucacggccagaucaacuuugggguuucccaccaggcuaugagccugcccugcccugcucucagcaccugccuggcagaaauggcacagacaccgcucaggccaauggaagggaccauccaggugccuggggugggggcugcugcugggacaccagcagggccugugugccagccauaacccaggaacagagucacccagaccccagggacacgaaggcucgggcaggccuuugcuggccacaccagcucuacccuaccuccuccuuccuuccuuccagcccagccuggaagccccuccuccaggaagcccuuucagaccaccagcuccagguuccccucaguccuuggucccccucgccuguggcacauacaucccaagucacuuggcaagugugggggcuggggaggugcccccuguaucagggcaggaccaaugugugggcaaggggcugggaguggcucugccccccaccuuauggggcccagcgccagggagaugccagcuuccaaggcagccaugacauccagccaugcccucagaugcuacguaccauccagaagagaguccccguggccagggcggcauacugcucgaugguggacagcacgcugaagaugaggcagaccaggacgaugaggaagcugcaagacagggacacggcagucagcaucacggccucugcccaucccacagaugcaccuggggaguggaggggccccuggccucagccccgcccccagguaggaacagacagugcuucgaaaacccagucauccauuagcugguaagcacacacuagagguagguccgcacgagggaugccgucccgccacgggaagggacgaagcaccaacacaugcugccacguggauggguccgagaaacauggcgccaaggccagacacagacaggugaccaccugcugaccaccugcaguguggcuacgcccuggacagccagagccacagaaacagaaagcaggcugguggcugccccagggcgggacugcugugggcgugggguuuucuuuugggguaauuaaacguucuggauguggaugguggugguggcuacacaacucugaacauucuagagccacuuagggcccuagagccacaaaugaacugcaguguguaauuacgucucuacaaagcugauuuuacaaaucacuuccagagagcagucaacgcccccuguccaggaguucagggcccagggcagggguguugguggucacagcacagaagccagcccgccagguggggguccugacaccugcaccaagcgucugcuucccagaggagccuccaggcggcaggcugugggccgcucuccuccaguuucacuuccuccuuuccaaggccccgaggccgagccacagaacucaugaaagggaaggcgcacagagccccacccuggggccaacguucugggccugugggcccgcagagaaaagacgggccgccuucucugaucgccggaaccauaaagauagggagcugcugccacugcaaacguacccuccagggcccgcccggccuuccucccgccucuagggggauucccacgggcuccggagacuccagggacccccguggauccucagcgaccggagagccaggagauggccacauggcccccagggccaggggagacacaaacagagaaagccacacacagacccugggggccccggcauagauccucugccuggcauagggugccccaggcucccuccgcucccugagauccugccauccugaguggcuucuaacccaccccaggacagccagaaggcccccugcauugccucucauccagccuccugaagucagccccacccagaacccauccucuuccaccuguccagauguggacagcccagcccacccuccccaggcccccagagcccacaacaaacaggcuaccucccagcacagccugccucggcucauccuccugcugcacggagguuucuggggaagguggggcucuggccccccacccccuuccccaagcuccuguggacaggacaauccuuuccuggccucugguagcccuacccaaaggcccuugagggcucacucagccaaagacccugcucaggcccccucccuggguuccucccuccccacagccauagucccgcugcugggacuggggccaaaaccugcagcuaccauuuccucagccaccugccucaccgacacccugucccugccacaccggucagcucuaccugcagagccgaacccagccagccccugucugcacccugcccauccauccucaucucccccugaccacagugcccaccuccacccucggcgcccccagcccacacacccagccagucagugaacccuccaugucgugccccaguauuuacaccacgauggccccagaucaccccagcuccucccggcccuuguugccaguccugacugugcccagcccggcccaccucagggcccgugcaccugcugcugcccagccuaaaagcccagcuugaggguccugccagcgggcccugucucauaggcagaggccagcucugaugucugacccuggcccccacaacaccccaacuguguccuuuauacucaagcaucaucgcugggaccagagucuguuguccacccccuagaccaugagcaccccaagaguggggcugugggcugcaguccaugcccgggacgcagccuggugcacaguaggugaucagccccgugggacuuccuucauuuaaucucuaagccccaaugcugcugcuucauccccaccaccaugacccuuccucugcucccugagguuacucccccacugggacauucgacccaaagcacaagucugaucagccacgugguucccaggagcaccuggaaggcuggcaugcagcccuaccccuccuugggccucagucccccugacucccgccugcccaaagcgcuggcugcauaagcugccuggcauuugcaaacgcggugcuuccagccagggacgcucucugcacccccacccuccacacugcuuuggcucugaggacuccuccuggccagcuuggacaggauguccaggcccugccaggcucccucugggugcuccuacacugaccaccccugcucucaucugucucugggacuauaauccgcacagcgcuagcacgcgguggaugcagaguaauuuguucaacagacacagcuggagccuccgggccaacccuguggggagcccuccguagggugaaucuguggaucucacggggacacaagcaaagguugguuggaagggugagugcccaucugcacugggcaccauuccgggcacugggaaugggcucagacuggcucaccuugcacacagcaugcugcccacugccggagcaggguucccuccagguucuuagaagagucuuugugccaagcugcaggcccuguccccacacccugcagcccccagggcugggcugggucucugccccuugcuggugcaacuguuggcucucuccacccuaccagggcucccuccgccaugacugccacacuuaauccuccuggacgucuguuuguuuugauuugcagugagcagggaagugagauuagacacagccuggcucagccacgaggaagcagagccgggcugcccggggcagaagaugccaccugccugcuccccaggcccacggcgugcagagagggccagggcaccaucugcacauggagaugcagugcccacuggugacccaggcagcuccccugccucaguuuccuuaucaacacaaagaaguggcccacaggugcuucuucccaggcuguggagggaagugucaccugacguccagcagggaaucagcagcgagcgucgacuucacccugaggccuuggauaagccggaagcugccagugcugucuacugcaaagauguggcaaaacccaccacccaccaggggcccugggaaggauccacuaaguugcugucuguucagcaacaggaagugcuccuggggacugcaggccacugcccgcuacccacgccccugcucacugaccacuggcccagccagugcuuugcagacaguaacacagacccccacgagacccugccagacugugacaucacugccacacuaucaucaaacacaugcuacaaguagggaaacugaggcuccaagggcuucugaggucacaauugggguaaacugaggaggagacacaggacugcagccugguucccugacccggcauggcuggggucccuggaggcugggcccugggccccuuugacccucgguaugagacgacuugccaggcucuggucuuggugcacgugagcagggauagggcugcggugaggguggcacagcagcuuucccgucgccgagccuggcuuccauccucccgucucuuccuccaacucagauccuccugcuucucuuagaagaauccucacaaucacagugagggcucacccggguaacccaggacaaccuccccucucacgagccaucccucagucacccugcaaagccccuuuggccacacaaccuaacuuguucacaggacaaggacacagacaccucaggggccaccguucagccaagcgacagccaugucugcgagucaugcacccgaauccacgccacugccccagccucucagugaccugcacggaaggcgcugcacuccccccacucucagaugagcaaauggaggccugaggagggaagggggccaugggcaggacccaggucugcugacccugcagccuccaggcccagguugaaagcuuuaaacuuucaaaaaaaaaaaaaaaaaaaacuguaaacuuccuccaaggcagaggcgagcgaacagaauuaccugcagcuccucugcccuucacaggggcaccgugaugcaauguggaagcugagauaaccccacuucacagcugcccuucuaaaagaccacaggcgacgcugccuucugcaucugccaucacggcuuuucgauucucgugcuguuugggugacagccguccaucacaguggcaguuggugaccucggccacagcauagaaagcagugguggggccgggcgcggcggcucacaccugcaaucccagcacuuugggaggccgaggcgggaggauugccugaggacaggaguucgagaccagucuggccaacauggugaaaccccgucucuacuaaaaauaugaaaaaauuaacugggcgugggugguggugugcuccuguaaucccagccacucaggagauugaggcagggggauugcuugaaccagggagguggagguugcagugagccgagaucgcgccacugcacuccagccugggugacagagcaagacuccaccacaaaaaaaaaaaaauuaaauuaaauuaaaaaagaaagcagugauggaugcugguuagcaccaugugcagggugggcacucacaggccgcaggugagggcuugaaaacuuggugacuggcugcaaauaccacgcgccugggcuucauggcgcggauuccagcugcaggggccucuccugcccauguccugugcucaggagacacagcuggcucagauauguggaguuacugcagcaggaagauucuugacugggcguugcgggagaauacaggauguggccagggaagacugcacaugggugguccuggaccagcccccacagagugugcacccaagugggcguccaccccaacuaccugggcagaggugccugggaaagucccgugcaguggaaucgcggcugaggcagaagacagggcuccaggcccggggguugggagccagcaggggcugaggaacguucccccgcaggccaggcagaugguggggacaggugcccaugggccaggcuggcugucagccuugccauauucugaaggcuaaaugauucuuccgauauuuugauauaccgugcuagccucagaaggaauuauaugacaaagcuuacuuuuaucuacuccagauaaaaagaguuuuaucuuauuuaccgcuuuaucuauucuugucucgggcggagcugggaaccucacaggugccgagcuggggucccugcccuugaggcacucagggccuggggugccuguguccccuccugccucugcagggccaccuaccacccccucugccucagcuccaaggccaggcagucacagccccccacucugcagagccgggaaacuaaggcccugggagaggacgaauccuaugcguguuuuggacucggagugggaagcaggacaggcuagcgaaggggugggggagagaagacaccgacccccccccagcucaugugguccccugaaugcugucccacccgagcucccaagagggcguggucaugcggggggcggggagcugcaugagcggggagcccaccgcaccccagaaaacaaccuccuacuuguuccccuugacagcaaauaggccucaggagcagugacggcgaguaccagccccgaaggcacccggugaauuauccgacaucauuucaacaucucagccccgggugcccgggaacacaggagaaugcaggaacccugccagggucauagcccgagacgcugugggagggcucccccggggugcaggcagcgggccugggugggcuccacggcucagauggccuggggcuaacgcgagcugaaggcuggagacuccaugaccugcccugccgcacacacuagggccccugaguggugcuccuaaaugggccugguugauccaggugacccgccaagcaaauccaguccgggugggggcugugccgggacucuggccuuccaugcccacucggggacaggccccacacacagugagugacagccucuuuagcccauggggggcguuuuguaacccugagauguuucccaauaaaguugaggaaccuuaaagagagccaccuacuucacgugcaaagacacgugggcagcucaaggggugcccuuagaacuccagcuggaagccacugcaccauggaacucacccagggucgaagcugaaaccccggggcguguaaccacuggagcguuucacagaacuuugcacucucgugaccguaugcuuaauuucuugaaucuguaaacauuaaaaauuacguuaauacuugaagaguuuugucagucugaaagcaucaugcauggaaggacaugagcagagaggcaccuugaggacaccggauaacacacagugccagucacagaagcgcaaaggcccagagcagcgaaauccaccgucgcagggaagcggacagcggggccgagggagaggggaucuguggacauggggaggacggauccacgguugcggagagcaggauggcggggccggggagagggagugggauuucaugggugcagaauuucaguuugggagagaaguuuugggguggaugguggugacgguugcacaaccauguaaauguaccuauugccacugggccgugaccugacacagaguuaagacgguaaauuguguguuauguguauuuuaucacaauaaaaaaaaaacuuuuuuuaaagcaaacaacauucauagagcaagcaucagaggguucaaaauguuccccguggcuggugaaugagaucgagcaauguucaaagaccccuacuggggacgggaccucgccaggcugauaagcagacaauggguuugugaagcgaaccuaaagccgaaggcaggauagggccuugaauguguaacuucaagagauuaaauauugacgcuuaaaccccaaaccacuucuaggggcuuaaaaaaaaaagucauccugggagacuccaaaugccuccaaaucccaugugccccaggaaggaaacacugggcgcuggagaggacaggcuuccccugcucacucacuggucaccagcaggucucccuccaucccugauguggcugccggcuccagggcugcugagcucagagcccugggauguggacgcccaggggcagaggucucacagccugccagggcuguuccccagggcugaaucugcaccucagaaaaagcuaccagcuggucaccccccucaccaguggcugucaccccccucaccaguggcugucagcaggcagccucagcaggguuuggaggucgccaagguccccacagguucaccugcuuccuggcucugcauggauggagccugggccaggcaucucccgaccccucccaaaggggugagcccuggcccacaccgagggccccacgcugggcuggacacuaggcacagguuccccgcucugaaccccauguggaaggugucacaucauggaaguccuggugaggagacagaagcccuggugaggcacgucuggucccaggcugccccccagaagcccccuggauugggguucaggaggcacuaccaaucgauggggacacugaggcucagacacagcaugggacgugcccagacuggccgacuccaggggccccagcgccaccacuuggugccaugguccugaggcaggaaugccacaucaggccauacgucauccuggggggugggggcgacagggcccuuuucagccuuccagccucugcgggcucccgcguccuggguggguggcggcaucacucccgugcugugcagcauguggccggauccuccuuuguugaaucuguccugucuuuuaggaggacacgugucacuggacuugggcccccuggauaaugcaaucacgccucucgggacccucagccucagcugcaaagggguguuuucuaugucaggucacauuugcagcuuccagggauggaaaccaauguugugggggggggccaacaccugcuguacuauguaaguauuuaauacauuacuuaugaucacuauugguagauuuugaauucuuaaacaacagaauuagguauuggucaaaaacauauauuaguuguuguuguuuuuugguuuuuuguuuuguuuuguuuuguuuuugagacagagucuuguucugucacccaggcuggaggacagugguaugauccuggcucacugcagccucgauuuccugggcucaagcgauccucccaacucagucucccaaagugcugggauuacaggcguaagccaccaugcccggccucaugucuuaauuuuuaaaacauaauuaaaaauguacucaaagcucagaguuuccuuuucauccucucaccuccagauccuuaauggaauugcaucugaaaaaauucuuuuaaaaagagggucacguccacgcccacuggugucagcacagggacgccucucucaccauucagcccacagggcaucacccgaacccugucauguuggagagaagggagcuggggguggugauucccggcacaggcgggacauggcuggcccaucugcagcaggcagcugccacgucgggaguagguccaugaggcucccuagcaccccagcccuucagggaccgccacuucucaccagaacggcaacagcugccccccaaccauugccccucaggcccccacacagcacccugucugccauuguccacacugcccagcugguuggcagggccuuggaagccccuccccuggcagccacaacagggcacaaaccacagaaggagcguggaugugaucccacacccgcuucacagacccacagccugguccuccccguccagcuccgggugaauggacgccuccccaccagacugggccuccuuggcccagggcucccguggccaccccaugccucacgcugucuuauacucuuuaccuguggcuuguuccgcggcagcugagucucauuucuuuaaaaaguucuugaaagccaugggaucccagcccaagggacacaacaaugggugacuugguguggccgguggguaagauuucugcccucauugucucccgaagccccaagugugcuguccccguuagacagagccgccagcccgccuauccaggagccaucuggagauuaaaccugugucccacagcaggaccaaggcuguccccagccucuugggguuucagcugacacuuuuuccaacacagaucuggacugggaaccccaagaaacaggucccuuccugccagcuuucggcuggguccacacagaacuccugugccugcagcaccuccccagaggcuggucccccugccggggccaccaggccugcaccccaacugcagcccacuccccugguccccccgccucugucucuccugucccaaggcagcgucuacccucccauguuacaagaccccccacaugaagccuggaccccaaacccuccuucugcggaggcccuggccugggcuucccugccaggcucucaggaggccuccggcucuggcuugcaccaguucauggaccgccaggcagccacugccaccacugccuccccgaccagagcaggggcuccccaggcaggggcccaccagcugcauucccucccuccgaaggcccagugccaggcgugggaugcacguuugugaaguguuugcugaaugacugauggugugaaugaauguuaggguaaacccucaagcucggugaaugaagucucagugccgccuccuccaugcaggccuccgggugaaucuggaagugaguuaggcuccuuagacucuguucuuuuccuuccuaucccaccgcacaccacaggcucagccuagcucgcaaguggccuuugagcaggacgugguacugaggcagcguuccgccaccccucacccccaggcugcaugccaacagcacagguugacagaucgcugggagccuccuggggugggcucugacgugagcugcgggcgcaggcauggcccccccagcaggcaggugugagcgggcaggacgugcaggcauaugcucccagggccauggucccacuggccaaaccggucccucuucccugaagaagcgucuuaggggcugccccagaagaccaagucaggacaggugcaggagguggggauccugccagggggaaacccugccaucccaccugguugccacgccacaugccuggauguccugggacaagguccugccuuuacuuccauucugccugaguccugccagacagagaggugaggcgccacaggccagacagugacgcagcggggacucaacacgcguggggcccuggggaacgcgccccaaauccaacccgucccagggcuucucagcccugagcccccuucggugcagacagaaugccaugucucccaccagagcccuccagggugucccaggagcuucccaccuggagguccaucaggugcaucucaccccauccccaucgccaggaaccuggaugcccccgcaccaagaggugacaggugugcauucccucuucaacggcccugcaggguggggacugauggguccagcugcgcacggggcuccuggacgcucaggccuugcaguggggaugagggcuggccccgccuggcaccuaccaagggcucauucccaucucacccggacgcccagggcccucgaccacaccucagugcggagcguggagccugggcccugaucccuccuuuccaggagcagccuggggggugaacacagccgugcuugagggcccugccaugccaucccgagugucacgucaaagcccuucagaggcccuagagggacaggugcugggggacccucgggcagccaggaagcuucccggugacaccaggcaaacucuggggggucguggcaaggugggggagagaucaggaggggccagaacaaugucccuccccaccagaagagcccagugcagcccuggcacaccucugggccagagaggaaauguccuaggcgugguggggcagguggccucuguggcaauauucggccgggcauggcuguguccuaauaaaacuuuaucgacaaaaucaggugguggccguagcaugaggaucccggcaaagaguccugcugagaacccagggcucuggcaggauggcaugugggugucugcaccuguguguugguuucaggggacccgcuacacaaucaggagcacccaacaguggcauguaaacaucaagcaagggcaaccgaauugggaagguccagcucccuguccaucucaaaggcuuucugggggccaauuuugagcccggagauugagaauucaaacaggaacgugugcccccagagcuggccgccacauccccuuuaaaaacaggcucuaugguggcccccaagaaucccggugggucagcggucccaggcaugaggggacgcugggacugagccauuuaaagcccaccuccuccugucgccucuaaacuucaugagaagccugagaaguggacccauccuuuguucacaggagaggaggaagcucagagagguuaagggaccugccucaagucacacagcaucgagcgguuggcgagaacuggacuccgggucucccugacagcaucacagguccccacagcaccucgaagcaccccgaaaacuacaacccagaaguaagccuggaguggugggcauccaggcagccuggccuuccacagggagauuccagcaggagcccuggccugggcgugggcggauaggcccaggggcucagugaggagagcugugggaugcccggccccuggggucugggcugucacugcagccauggcacacauagagguggucagggccucagcagaggacagggguggccaggcucuggggugcaagcaggaaaggcaugagcuucuccuggggcccggagggugcagguggcccggcagagcacaagccccccagggccgagggcugcugggaacggggcucugugcucccagggccggccacaccaagccuggcucccugggcugugauaagacacccacagagaguauauuuagaaggcgccgggaggacaaacugaagugaccccauggauguggcccuaucugcccuaggacacucgucuugucucugugagaggccugccuagggugaggaggggcugggcagaccagaugcaccugugcaccccccaccccagaaauggcgaggcucugccugggcgaggccuggucccagcagccuuguccccucacccccacugauggcggcugcgcuguccuggagcagagggugguggucuugcugggcagcaggggccucggggacgggugggagggguggacaggccuccccgccccugggccaggggcuccgcccucccucacacagggcaggcguuaaagccuccaagaagugaaugaaaucauguccuuugcagcaacacggauggaucuggagaccaugauccuaagugaacuaccggaaacagaaaaccaaacacggcacguucucacucaugaguggaagcuagacagaugggaugcuuggacagaaagacggagaaaggucacucugggacuccaaaggggagguggagagggugagagggggaggguugaaaaauuaccuauugaguauaacguccaauauccggcugaugggcgcacgagaagcccaaaccccaccauuacgcacguaacagacaaguauguguacuccucaaaucuaaaauaaaauaacauaaaaaaacaagaaagacuugaggaagcaggcagagcucccagagcaccuccacucgggaagggggcgaggugcggaaggacagcgaaggccucaggugcccuggagcugccaggucaacacgacccacuggcggcucaggguguggguccucaggguucaucccuacuugggaaagucccuccucacaucuagcccaagucucuuuucgagacggagucuggcucugucgcccaggcuggagugcaguggcgcaaucucggcucacugcaagcucugccucccggguucaugccauucuccugccucagccucccgaguagcugggacuacaggcgcccgccaccacgccgggcuaauuuuuuguauuuuuaguagagaugggguuucacaguguuagccaggauggccuugaucuccugaccucgugauccccuuggccucccaaagugcugggauuacaggcgugagccaccgcgcccaugagccaccucgcccggccaagucuuucuugcuguagcuuggucuccuguauagggaaaccuccuacccacuacagagaacacugggugucccuggaaauggagcugcuguguggccuccuugagccuugguuuccccacugggacaugggaaugcgucaagggcacccggcaaccugagccacauucauccucagaucagccccagccacaccucaauauuccagagauggggcagccccaggaucugggaccacaggcaccuggcaagaugcugccgggcucuaugaccaggcuaagagugagcugggaggcagccaguguccugcacggaaaugcgccccggccagcucccucggcucuucucacugccuccauggccgccagcgagguaagguacgauaauggcaggggaggggggcaucucccacuccguggagggccaagccaggagcugagggcagcucagguuggggaagcugaccagggcaccaggagugaccugcacaccccccaaauggagacaaagagucccccagugucacuguggggcccgggagccacuugccucucugagcagcugggugagccagcaugggacaggccccaugcacacaccuugcaggccggggggcaucagaggccuugaaauaggcagguggggcuuuagccgggcaggugaauucucuuucugcaccuggccuuccucccucucccagcccacuggaaggggcaauaagggagggcuucucagagguggaggcccagucuaggcagagagaauggcaaccugugcagaucccagaggagagaggagaacccaaccugcagggauggauggaacucaggagagaggccggugcggaggcagagaaacagcggccaggguggcugggacacccccaggcucuggugauggaggcucccgacagcaggcggguggcugucucucccaguaggccccagcaugguggacuggugccuguggaacucugaacacggcagggaugccuugggcccagcagggaccucaggccagcaggugccugggccaugcccuggggaagagggcccaagacccccuaggcucuauggcucugagggacugcccagcacuuugagggcagggcagguggaucccaucccagacacuccccuuugauccacagggcaaacagcugccccacccucaagucccaugggucccuugaggucaugaaaccuuuccagcugaguccagaacugacacuuagagauagucucugcguggccauaucagggaacagccaagaagagcaaagagggcucaggugagugacggccccuggaguugugcaaugacacggccaggagaguacaaagguccuggucggagggugggggagucccugcacucacaucacacagggucaggauuccccccagacaagaccugguggcccagagcgcagcacagcaucauggcuuucuccucgggagcucucuccuccaaggaccgcucuucccagugagcaggccggggcuugagcagccuccuuccugagccgccaacucuccauccucccaagaucccugcuccaggguccacugccuucccagagccagagcuccuaaagccccaucaucugcuccccaagacccugggccaggaaaacccucugcugacacagcaaggaucucgccaaggggacagaccgcccuggggagcaggacacgccaacucccacggcuaggggugccuccucagugggguuguuuaccugaacuccaggcgggcagacaggcaggcgcccccagccuccaugaccagugguggcccugaggcauccccuguaacagcaggcuggaccagagaguguggccccagacacccagggaccuagcccagcucagccucaggcccaaggcacggacaucccugcucagagagcaagaggcggccagagggccucagggcagggcugcacauccccggaagccacugcgggacacuucaacucacacccugcuggccccaugcggucauggccacacuugucuugagggaagacugggagggguugucaucccagguggccgugugucccauugcaaaucugggugugugggggcaaggaugagggggaaauggggauucagagagggagguaggcauauugggauaggagacagacaguucuccuggcugcccaucucgggggcaucccuuuucugccaaucccaguggccccaggcaucgacggggaggaugcagaggcaggggcagccugcggcccucucccgccccggcuccagcacccguagggcccugaguccagggaaggcugagcaugugcgguucucauugucaccggcugggcaggccaagugcucagcgagcuuauggcccagguuuugugcaaaucuuguucgacugaguguguauggcccaugggaagcccuggcauuugggaggcaccuaacccugggaugagacacaaaucuugcacgccgagcccgacagcgcagccccugaugucucugcccuccaggaagcagccccauuuccuuucuccagcuggcccgagacaaaugcucacgcuuccucugcacugcuuccucaugcccuguccaugcccgcucugaccugugcccuccaccagggaaaaccgcggguuuuucccugcacagggggcugcaggccaggccgggcuccacagggcagauugaggggcccgcauguggccaagcacccccuccccugggcuccugcauggagguucccagcucccagagaaccuuccgggccacaauuccacuaggccuggcuuucaccaaauccaggagucacucaugggccuggagggaggaaguggcuaauuuugcaacaggccuggcauggggcauugaauuauucaacaacagaugcauuuagcaguuuuauuucugucucgguauccucagucccgcccaacaggagcccagcucuggcaggaggggcagguuggcaccucuacacagcggcugggagcauggagaccacucacccgucaccugccacaaaccacuagucauggaggguggacucccaggccacagacugaccaggacucagguaagccauauuaccacccaugcagagacugacccugaagggcugcugggccugacgaggugguucugguuccaugggggugggggagagugagagggcauucagaaacaggaaucaggcggugccagcugccuccccaggaagcccuccaguggcaaccucuggcucucaauucuggcccugcugccaggaacaguaggggcugcccccuuccccaccccacgucuccuccuuuuccgugacagucacacccaaggugcaucccacaagagccacaucccaugccuggcuuuugucccugcugcccccaacccaggaggcacguagugugugccuggcaccacgcugggcuccaggggugcagagacagauaacagacacagggagagagaaaauaaaccguaaaugaacacauaaaaccaccaccaauggggaaaagagaaagggugacgucucggggagaggcagggcaagagggcugccccaggagcuggugugggaucugaaucggguagagagcuagggacagacccugcaggcagagaaaacugcacgugcagaagcccugaggcauggccuggucugggccaggggagcagagugaugggcagggagauucgcucacacugugaucggaggaaggccacgcccaggagugcaucugagcgugccagccuucccaggaccuggaggcaggcucuggccuagaaucugcugcuaaccagagaagcaucuggccugggccucagagaccagcuggaaggaaggguggaacaacaccagugcggcuucaauuucacggacauugcccagaagcagagaaagcccaacauguuagccuuguuuguuccuuugagaaagggccugguucugacacccagacuggagugcaguggcacaaucugagcucacugcaaccucuacuccugggcucaagugauccucccaccucagccuccaggguagcugggacuacagaugugagccaccacacccagcuaauuuuuguauuuuuaguagagacgggguuucaccauguugcccaggcaggucaggcuggucucaaacuccuggccucaagcaauccacuugccucagccuccccaaaugcugagauugcaggcgugagcuaacauguccaacaaaccuuuauuuauuuauuuaaaaauuuuuuuuuuuuagacacagggucucguucugucacucaggcuggagugcaguggcaagaucauagcuugcugcaaccuugaacuccugggcucaagugaugcuccuaccucagccucccgaguaguugggaccacagguaugugccagcacacccagcuaguauuaauauuuuaauuuuuuuuuuuagagauggggucuugcuauguugcccaggcuggucucgaacuccuaggcucaagcaauccucccacuuuggccucccaguguacuggauugacaggccugaggcaccacgaccgaucccaauuagccuuuaaacaccaggaaaccaaagucagaugccaggacauaucuaaagagagaggcagcccuggcagugggucuguucccggcugucacuugucaccuccaugggcauuucccaagccaggcugcaucacgccaccauuggccggccccgccaggguucccuguccacaccucccaguccacuuggcucagccagcagccgcccagccccgcuccccacccccggaagccccucuuuucuuucccuaucccaggacugucuccuggcccagucccagacaguucacagcugaggaggaacaaagcagaggaaagggacguggcgugacgugcugggagugaaacgcugacaccuccguggccaucugggaccacgaccugcacuacugcccucacacccggaccuggagcugccacuuccugccugcuucccagaauagcugggcucauccucugagcaggcugcccugccuuccucugucucugcucaggacagagacuccuccuaggacaccaaacaccccccacacagcacagacccagccucccagccaacggccacucacuggagcaaagggagccaagucuggcuuuggacaggaagaugggguuugccaggcaaggggugcagagaugcugaacuugaacauggaggggaaacaaugaugaugccaagggaaggggcccugggauccuaccagacccuaccccaaaguccgaagccacucuucaugaaauaauaugugauauuaaaaacuuaaauuuucaguuucaugaaacagcaaauaaaagccuugagauaguugcucucccaaccugugcugugugcuuuugguaacagaguccuucccccagggacccccaaauuccccaguauggggcauguguuguacuaauuucaagaccucuauuucacccugagcaauagcuccuccuccaggaagccuuccagauugcucagucaaaucccaugcagacucugcacacccuugcccagggcugugccccuuccccacggcccucauccagcuggagcucuacauucuucguuugccucugugacuguagggugcccuccagugcccacaagggccaggcugugugcaucaggcacauggguguggagggagcaugcauucaacugugacuuuccuuagcccuccucaagccuguaugagagcaggggaauugauggcuuucuuccuaaaaagcuuaguucaacagucuuucccaucccucccauucggggaguuucuauagaggaagccagguggucacugccaucuucaaggauucccugggggucucugagcaacaacaggauaucugggucacccacacccucugugcucugagaagcccaccugcuagucugggagucuggguccuggugggucccagccccguacauggaggcugggacccugccccgaaaccucucaggugcgaacacccagcugguuauaucaucacccucucugcaugacagaugggacacuccacucaggacccacacuccuccccaugcagagcagccaggccucgggagcuguguccugaccugaggugcaguguccagggcacugucuggacagugcuccccaaagcuugcccugccaagcccagguuccaggacaaugaugggcuccuggccuaaagucuuuccaagacauaucuccgccggguaacggcaagucagacaagccaguaugguccccacaggagcccaaagacccuuggugaccaccauggguugguggagguugugguaccucaaacaugcaugccuaguguuugcaaaccucaccuucagcagcagcaucccugggaaaccccagcuccacugccguggggccaaggcaacacagaccccugcuggggcccaggccagcucuguggggccgagcuggguguuugugucugagagguuucagggcagggucccagccuccauguacggggcugggacccaccaggacccagacucccacauacguguguggaauaaaacucauaaccccacaucaccaagucaaggccaguuccaaaaccucucaggagggcucaacacagaguccuuuguucuuccuccauugccccuguggaggcugcaggacacccaaccucccggacuugccuuccuugcccucagccuccacagcugccaucacuuggcccuugcccucugcccuuccacccacccaggcuacaggaggcccugucuagccccugcgcucaugucauuuacacacugacaccuccccuaacuugugagcccagcccgcacucucuccccagagcucccaccugcaggucuuacugccuucaacccaccucaccuggcugccucacaaacaccuccaaaauaacauguccccagcuggacuccuucgccccaacccugacccaugucagaaacagaaagugcauccucccaggugcgaggggucccagcagcauccuuuucucuuccucccgcugcacccgccaccuuaucuaccugcaaacccuguuuucuacagcagugguccugacuucucacccuuccuucaaacccucuagagcaaaccacgccgucccaucccacagccaccucagucacagccuccugcgcaucucguguccugcccgaugaccccacacuccaugcuccacuuagaggccagaggggccucgugaaggccccagccaguggggugaacuucuaaggaagaggucucaggccacucucugagaaaagauuaccuuagaucaugcacaagagcaaacuccaaacggacaaggagcuaaaugcugaagacaagaccccaaaccuccagaagaaaacacaguggauuccccuuaaccucgguggaggaaaaagcucucaacuguggcccugaauccggagucaguagaaagaagcaugauaaauuugaugauauaaacaugcgaaauuucucauagcaaaaagcaccauaagcaaagucaaagacaagugaccagcugggaaaacaauucacauuaguccagacaaacguucccacaauauaaaugacuuaaaaauugagagaccaagaaccaaaaacccaauggaagaaguuggaaaugagaagacagacgauuuacaaauacacacacacaugacuuuuagacacagggaaaacauucaaauucaauguaauuacagaaauacagauuaaaacaaagcuauggaccuggcaaaaaguggugugacagcacgcugcuggcgcaacuguagaaaaaaccgguaugcucaugcauugcugggggagugcaaaugugcaaccguucugcagggaaauuuggucacauccaacaaaacuacgggcuucucuuucagcccaacacucccauuucuaggaaucuacccugaagauaacaccuccaacaauaggaacauccauaccuacgaaguuauucuuugcaacauuguuucaagaauacaauagacauauguauaaggcuauacuuugcaacauuauuuaucauugcacaauaucagaacaaccuaaaugcccauaaauaggagaggguuugaauaagcauggcacauccaaccauaaaguaugggguggcuguaaaaaagaauauggaaggaccccacgaacugauauguaguggucucuaggaaauacuauuacgugagaaaagcaaauucaaaaaguucacguauagucuuuucgacaaaugauggugggauaacugaguaucuacaugcaaaagaauaaagcuggauauaaaaaauuaacucaauaugggucaaagguauaaauguaagaccuaaagcaauaggaacacauaggagaaaauagaaagacuuuggauuugaggaugauuucuugaauacgacauugaaggcacaggcuccggugaacagugccgcaguaaacguaggagugcgcaucugucccugcuggacugauuuucuuucuuuuuggauauauaacuagcagugggauugcuggaucacaggggcuaagcacguggacaaauuaaauuuuaugaaaauguaaagucuguauaucaaaaggugauaucggcaguggcagaauagauaaacaugauccagcuacaugcugucuacuagagacucgcguuagagccaaagacacaaaaagauugaaagugaaaggguggaaagaguggagaaagagguuccaugcaaauggcaaacacaaaaagcagaguggcuacacuaacaucagccaaaaaugguuuuauaauaaaccuagaaaggucacaagagacaaaagaggacgcugcacacuuaaagguucgaggcugcaagaagauguuacagauaaccauuauaaacauuuaugccucuaacagcuaacgaucaaaagacacaaaggaaaaauuuacagaaccgaagggagaaauaguucuacaaugauggugagagacuucaguaccacauucucuauaaugaauagaacaaccaggcagaagauaaguuacagaauagaggacuuaacacaauaagccaccuagaucuaaccaacaugcagagaacacucgacccaugaccacagcaugcaugugcaucccaagugcacguggaaauguucccaggagagaucaggccacgaauuaagucucaaaguacucaaaaagaugccagucauacaaaggaucuucuccaacgauaaugggauaagcuuagaaaucaauaauagaaguaaaauggaaaaauuaacaaauguauggaaaugaaacaacauacucuuaaccaaugaaucaaagaaaaaggggggcagagggagagagagcaucagaauaaauaguuaaugcauguagggcuuaacaccuaggugauggguugacaggugcagcaaaccaccguggcacacauuuaccuacguaacaaaccugcauguccugcacauguguccugggacuuaaauuaaaaaaaaaaaaaaucagaagggaaauuagaaaauacuuaaaugcaaauaaagaugagaagacaauguaccaaaacuugcugggacacaacaaaagcguuacuaacagaaaaauugauacccauaagcucuuuuucuuuuugcuuuuuguggguacauaguagguguauagguuuaugggguccaugagauauucuaacauagacagacaguacauaauaaucacauagagguaaauggggguaucuacuaccucaaacauuuaccccuugucuuacaaacaaccucauuauacucuuuucgucuuauuuauuuagagacagucucacucuguuacccaggcuggagugcaguggcgcgaucucagcucacugcaaccuccgccuccugaguucgagugauucucaugccucggccacccaaguagcugggauuacagguguaugccaccaaguccagcuaauuuuccuguuuuuuguagagaaggggguuucaccauguuggccaggcaggccucgaacuccuggccuuaagugagucauaugacucggccucccaaagugcugaaauuacagcugugagccacugugcccagcucucuuuuaguuauuuuuaaauguauaauuaaaucauugacuauagucacccuguugugcuaucaaauaccagguuuuaaucauuuuucuauuuuuuuuuuguuuccauuaaccaucucuacuucccucacaacccccacuacccuucccagccucugguaaccauccuuuuacucuaucucgaguucaauuguuuuaaucuuuaucucccacaaauaagugagaacaugcaaaguuugucuuucugugccuggcuuauuucacuuaauauagugaccuccaguuccauccauguuguugcaaaugacacguucucauucuuuuucauggcuaacuaguauaccguugcguguauacacagcauuuucuuuauccauucaucuguugauggacacucaguuugcucccaaaucuuggcuauugugaauagugcugcaauaaacacaggagugcggauccuucucugcuggacugauuuucuuucuucuggauauauaacuagagugggacugcuggaucagagguagcucuauuuuuaguuuugaggaaccucgaaacuguccuccacggugguuguaguaacuuacauucccaccaacaguguacaaggauucccuuuucuccacauccucacuagcauccauuauugccuaucuuuuggauaaaagcuauauugaccaggguggggucauaucucauuauaguuuucauuugcauuucucugaugaucagugacguugaguaccuuuucauuuauuuauuugucauuuguuuuuuuauuauuauuauacuuuaaguuuuaggguacaugugcacaaugugcagguuuguuacauauguauacaugugccauguuggugugcugcacccauuaacucgucauuuagcauuagguauaucuccuaaugcuaucccuccccccuccccccaaccccacaacaguccccagugugugauguuccccuuccuguguccauguguucucauuguucaguucccaccuaugagugagaacaugcgguguuugguuuucuguccuugcgauaguuugcugagaaugaugguuuccaguuucauccauuugucuucuuucgagaaaugucuauucaggucuuuugcccaucuuuuaauuggauuauuagauguuuuccuugugcgguuguuugagcuccuuacauauucugguuauuagucccuugucagaugggcacuuugcaaauauuuucucccauucugcaggcugucucauuguuuccuuugcugugcagaagcuuuuuaacuugaugugaucccauuuguccauuuuugcuucgguugccugugcuuguagggauuacucaagcagucuuugcccacuccaauguccuggagaguuucuccaaugucuuuuuaguaguuucauaguuugaagucuuagauuuaauucuugaauucacuuugauuuguuuuuuuuauauggugagagauaggggucuaguuucauucuucugcauauggacauccaguuuucccagcaucguuuauugaagagacuguccauuucccaaugcauguucuuggcaccuuugucaaaaaugaguuugucguagacauauggauuuguuugcuggguuuucuauucuguuccauuggucuacgugucuguuuuuaugucaguacauacuguuuugguuacuaugacucuguaguauaauuugaacucagguaaugugcucccuccaguuuuguucuuuugcucaggauagcuuugacuauucugggacuuuagugauuccauauaaguuugaggaguguuuuuacuauuucugugaagaaugucauugguauugugauagggggugcacugaaucuguagauugcuuuagacaauacagacauuuuaacaauauugauucuuccaguccaugaacaugaaauaucuuaccauuuuuggguccucuucaauuucuugcaucaguguauuauaauuuucauuguagagaucucucacuucuuugguuaaguuuauuccuagguauuuuauuuguagcuauuuuaaaugggauuacuuucuugauuuguuuuucagauuguucacuguuggcauauagaaaugcuacugauuuuuguauguugacuuuguauccugcaacuuuacugaauuuaucaguucuaauaguuuuuuuguggggucuuuagauuuuuccaaauauaagaccacaucaucugcaaacaaggauaauuugacuucuuucuuuccaacuuggaugcccuuuauuuucuucucuugucugauugcucuagcuaggauuuccacuacuguguuaaauaacagugaugaaagugggcaucuuugucauguuccaggucuuagaggaaaggccuucaguuuuuccccauucaguauguuacuagcugugggucugucauauauggcuuuuauuauguugagguauguuccuucuauaccuagguuuuugacaguuuuuauguugaagggauguggaauuuuaucaagugcuuuuucagcaucaauugaaaugcucaugugguuuuguccuucauucuguugauacgauguaucacauaaagugauuugcauauguugaacuauccuugcauuccugggauaacucccacuuggucaugaagagugaucuuuuuuaagguguugcugaauuugcuuugcuaguauuuuguugaggauuuuugcaucaauauuuaucagggauauuggcccgugguuccuuuuuuuuuuuuuuuuuuuuuuuuuuuuugauguaucuuugucugguuuugguaacaggguaauacgggccuuguagaugaguuuggagguauucccuccuccucuauuuuucauaauaguuucagaaggauuaguauuaguucuugaaaucuuuggcagaauuuagcagugaggccaucaagucucaggguuuucuuuguuggaagauuuuuaaauuacagguucaaucucauuacugcuuaguggucuguucagguuugcauuucuuccugguucaaucuugguagguugcacaugucuaggaauguauccauuucuuccagauuuuccaauuuauuggcauagaguugcucauagcagccacuaauuauccuuugaauuucugugguaucaguuguaaugucuccuuuuuuugucucugacuuuaguuacuuggaucuucccucuucuuuucuuagucuggcuaaagguuugucaauuuuaucuuuuaaaaaaaaaaccaacuuuuuauuuuguugaucuuuugucuuguuuucuucacuucaauuucauguauuucugcucuaagcuuuauuauuucuucuacuaauuuuagguugacuuacucuugcuuuucuuguucuuuaagaucauuagguuguuuacuugaaguuuuucucuuuauugaugcaggugcuuuuaacuagaaacuucccucuuaauacugcuuuugcuguaucccacaggauuuuuauaaguucugggguacaugugcagaacaugcaguuuuguuacauaggcauacacgugccauggugguuugcugcacccaucaacccgucaucuacauuagguauuucuccuaauucccucccuccccuugcccccaccccccaacagaccccggugugugauguuccccucccuguguccauguguucuccuuguucaacucccgcuuaugagugagaacaugugguguuugguuuucuguucuuguguuaguuugcugagaaugaugguuuccagcuucauccgugucccugaaaagaacauaaacucaucuuuuuuuauggcugcauaguacuucacaguguauaugugccacauuuucuuuauccagccuaucauugaugggcauuuggguugguuccaagucuuugcuauugugaauaguggugcaauaaacauaugugugcaugugucuuuauaauacaaugauuuauaauccuuuggguauauacccaguaaugggaucacugggucaaaugguauuuggguucuagauccuugaggaauugccacacugucuuccacaaugguugaacuaauuuacacucccaccaacaguguaaaagcguuccuauuucuccacauccucuccagcaucuguuguuuccugauuuuuuaaugaucgccauucuaacuggugugagaugguaucucauugugguuuugauuugcauuucucuaaugaccagugaugaugagcacauuuucauauguuuuuuggcugcauaaaugucuuuuuuuugagaagugucuguucauaucuucaaggagaacuacaaaccacugcucaaggaaguaaaaaagacacaaacaaaucccacagguuuugguaaguuguguuuccauuguaauuuauuucaauaaaauuuucaauuuccuucuuaauuucuuccuugacccucuggucauucaggagcauauuguuuaauuacuauguguaugucuguauaguuuccaaaaugucucauuauuaacuucuaguuuuauucuguacuggucagagaagaugcuugauaguauuucaauuuuuuagaauguuucaagacuuguuuugugaucuaacauauggucuauccuugagaaugagcuaugugcugaggagaauguguauucuucucuuggaauugcuggaugaaauguccuguaaauaucuauuagguauauuuggucuacagugcagauuaaguuagauguuucuuugaaauuguuauaucgucuugcugaauugaucccuuuaucaugauguaaugaccuucuuugucucuucuuauaguuauuaucuugaacucuacuuugccuaauacaaguauagcuacuccugaucuuuucugguuucuauuggcacggaauaucuuuuuucaagcccuuaauuuucagucuauguguauuuuuauagguugaaauguguuucuuguaagcaacagauaauugggucuuuuuuugugggggcagggguccauucaaccacucugucuuuugauuggcaagguuagcccauuuacauuuaauauuauuauugauacguaaggacucacucuugccauuuuauuauuuguuuucuggugaagauauucucuuccuuuguuacuucccuucugucuuccuuuuagugaaggugauuuucucuaguggcaugcuuuaauuucuugcuuuuuauuugugugucugccauauguuuuagaucugagguuaccaugaggcuugaaaauaucuuacaacucauuauuuuaaacugaugaugacuuaacacuaauugcauaaacaagcaaaaaaacaaaaucaaaaauucuacacuuuacaucuggcaagauggcagaauaggaagagcuccagucuguagcugucagugagaucaacacugggugauuucugcauuucugacugagguaccaaguucaucucauugggacugauuaggcagugggugcagcccacggagggcacacagaagcagguggggcaucgccucaccugggaagugcaaggagccgggagaccucccucccccagccgagggaacugcaaacaugcaguuugcaugcaguugcugcacccaucaacccgucaucugugauacccgggacugugauacccggccuggauacuaugcuuuucccauggguuuugcaaucugcagaucaggagacuccuucaugugccuauaccaccagggcccuggguuucaagcacaaaacugaguugcuguuuggacagacauugaacuagcugcaggaguuuuuucuguaccccaguggugccuggaaccccagcaagacagaaucauuuacuccccuggaaagggggcugaggccaggaagccaaguggucucacucagugggucccacucccauggagcccagcaagcuaagaaccacuggcuucaaauucucacugccagcacagcagucugaaguugaccugggaugcucaagcuugguggcgggaggggcauuugguauuacugaggcuuuaguaggcgguuuuccccugauagugcuaaggaggcugggaggcuuggacugggcagaauucaccaaagcacagcaaagcagcugaggccagacugcuucucuagauuccuccucacugggcagggcaucucugaaagaaaggcagcagccccagucaggggauuauagauaaaacucccauuucccugggacagagcaccuggagaagggguggcugugggcacagcuucagcagacuugaacucuccugccugcuggcucugaagagagcagcugauccugacaagggggauucucgcagcacagugcaugagcucugcuaagggacagacugccuccucaagugggucccugagccccaugccuccugagcaggcaagaccucccaacaggggucaacagacaccucaaacaggagagcucugguuggcaucaggcuggugcccuucugggacaaagcuuccagaggaaggaguaggcagcaaucuuugcuguucugcagccuccacuggugauacccaggcaaacagggucuggaguggaccuccagcaaacugcagcagaccugcaggacugcaggcuugacucuuagaagaaaagcuagcaaacagaaagcaacaaaaucaacaucaacaaaagggaccccccacacaaaaaccccauccaaaggucaucagccucaaagagcaaaggcagauaaauccacaaagaugaggaaaaaccagcacaaaaaugcugaacauucuaaaaaccagaaugccucuucuccuccaaaugaucacaucuccucuccagcaagggcacaaaacuggacggagaaugagacugacgaauugacagaaguaggcuucagaagguggguaauaacaaauuccucugagcuagagaagcauguucuaacccaaugcaaggaagcuaagaaccugauaaaagguuacaggaacugcuaacuagaauaaccaguuuagagaggaacauaaaugaccucauggagcugaaaaacacagcaugagaacuuugugaugcauacacaaguaucaauagccaaaugaaucaaguggaagaaaggauaucagagauugaagaucaacuuaacgaaauaaggcaugcagacaagauuagagaaaaaaugaugaaaaagaacgaacaaaaccuccaagaaauaugggacuauaugaaaagaccaaaccuacaauugauugcuguaccugaaagugacggggagaauggaaccaaguuggaaaacacacuucaggauauuauccaggagaacuuccccaaccuagcaagacaggcuagcauucaaauucaggaaauacagagaacaccacuaagauacuccucaagaagagcaaccccaagacauauaauugucagauucuccaagguuuaaaugaaggacaaaacguuaagggcagccagagagaaaggucagguuaccuacaaagagaagugcaucagacuaacagcaaaucucucugcagaaacccuacaagccagaagagagugggagccaauauucaacauucauaaagaaaagaauuuucaagcagaauuucauauccagccaaacuaagcuucaugaguaaaggauaaauaaaauccuuuccaaacaagcaaaugcugaggcuugccuuacaagagcuccugaaggaagcacuaaacauggaaaggaaaaagcaguaucagccacugcaaaaccacaccaaaauauaaagaccaaugacacuaugaagaaacugcaucaacuaaugugcagaauaaccagcuagcaucaugacgacaggaccaaauucacacauaacaauguuaacguuaaauguaaaugggcuaaaugccccaauuaaaagacacagacuggcaaacuggauaaagaguuaaggcccaucagugugcuuuauucaggagauccaucucaugugcaaagacacacauaugcucaaaauaaagggauggaggaauauuuaccaagcaauggaaagcaaaaaaaaaaaaaaaaaaaaaaaaagcagggguugugauccuagccauuuuuuuuaauuuuauuuuuuauuuuuuauuuuuucugagauggagucucacucuuuugcccaggccagacugcaguggcgcuaucuuggcucgcugcaagcuccaccucccggguucacgccauucuccugccucagccugccgaguagcugggacuacaggugcccgccaccaugccugacuaauuuuuuuguauuuuuaguagagaugggguuucaucguguuagccaggauggucucgaucuccugaucucgugauccaaccaccucagccucccaaagugcugggauuacaggcaugagccacugcacccggccaagauccuagccuuugauaaaacagacuucaaacuaagaaagauaaaaaaagacaaagaagagcauuacauaaugguaaagggaucaaugcaacaagaagagcuaacuauccuaaauaaaugcacccaauacaggagcaccuagauucauaaaacaaguucuuagagaccuacaaagagacuuauauuccuacucaauaacagugcgagacuuuaacacuccacugucaauauuagacagaucaaugagacagaaaauuaacaaggauauucaggacuugaacucagcucuggaccaagcggaccuaauagacaucuacagaacuuuccaccccaaaucaagagaauguacauuguucucagcaucacauagcacuuauucuaaaauugaccacauaacuggaaguaaaacacuccucagcaaaugccaaagaauggaaaucauaacaaacagucucucagaacacaguacgaucaaauuagaacucaggaugaagaaacucacuaaaaaccacacagauacauggaaauugaacaaccugcuacugaaugacuacugaguaaauaacaaaaucaaggcagaaauaaagaaauucuuugaaacaaaugaaaacaaagagacaacguaccagaauuucugggacacagcuaaagcaguguuuagaggcaaauuuauagcacuaaaugcccauaucagaaagcuagagagaucugaaaucgacacccaaacaucacaauuaaaagaacuagagaagcaagagcaaacaaauucaaaagcuagcagaagacaagaaauaacuaagaucagagcagaacugaaggagauagagacaugaaaaacccuuccaaaaaaaucaaugaauccaggagcugguuuuuugaaaagauuaacaaaauagacugccagccagacuaacaaagaagaaaagagagaagaaucaaauagaugcaauaaaaaaugauaaaggggauaucaccacugaucccacagaaauacaaacuaccaucagagaauacuaaaaacaccuccaugcaaauaaacuagaaaaucuagaaaaaauggauaaauuccuggacacauacacccuccaagacuaaaccaggaaaaagucgaaucccugaauagaccaacaacaaguucugaaauugaggcaguaauuaauagccugccaaccaaaaaaagcccaggaccagacggauucacacccaaauucuaccagaggcacaaagaggagcugguaccauuccuucugaaacuauuccaaacaguagaaaaagagggaccccucccuaacucauuuuaugaggccagcaucauccugauaccaaaauuuggcagcgacacacaaaaaaagaaaacuucaggccaauaucccugaugagcaccgaugcaaaaaucuucaauaaaauacuggcaaacugaauccagcagcacaucaaaaagcuuauccauggugaucaagugggcuucaucccugggaugcaaggcugauucaacauauguaaaucacuaaacaucacauaaacagaaccaaugacaaaaaccacaugauuaucucaauagaugcagaaaaagccuuugacaaaauucaacaucccuucaugccaaaaacucucaauaaacuaggaauugauggaacauaucucaaaauaacaagagcuauuuaugacaaacccacaggcaauaucauacugaacgggcaaaagcuggaagcauucacuuugaaaaccagcacaagacaaggaugcccucucucaccacucccauucaacauaguauuggaaguucuggccaggacaauaaggcaagcgaaaaaauaaagaguauucaaauaggaaaagaggaagucaaauuuucucuguuugcagaugacaugauuguauauuuagaaaaccccauugucucagcccaaaaacuccuuaagcugauagccaacuucagcaaagucuugggauacaaaaucaaugugcaaaauucacaagcauuccuauacaccaaaaauagacaagcagagagccaaaucaugagugaauccccauucauaauugcuacaaagagaagaaaauaccuaggaauacaacuuacaagggaugugaaggaccucuucaaggagaacaacaaaccacugcugaaggaaaggaaaggacacaaacaaauggaaaaaaaauuccaugcucauggauaggaauaaucaguaucaugaaaauggccauacugcccaaaguaauuuauagauucaaugcuauucccaucaagcuaucauugacuuucuucacagaauuagaaaaaacuacuuuaaauuucauauggaaccaaaaaagagcccauauagccaagacaauccuaaguaaaaagaacaaagcuggaggcaucacacuaccugacuucaaacuauacuacaaggcuauaguaacgaaaacagcaugguacugguaugaagacagauauauaaaccaauggaacagaacagagaccucagaaauaacaccacucaccuaaaaucaucugaucuuugaccaaccugacaaaaaagcaaugcggaaaggauucucuauuuaauaaauggugcugggaaaacuggcuagucauaugcagaaaacagaaacuggaccccuuccuuacaacuuauauaaaaauuaacucaagaugauuaaagacuuaaauguaaaaccuaaaaccacggaaacccuagaagaauacccaggcaauaccauucaggacauaggcaugggcaaggacuucaugacuaaaacaccaagagcaauugcaacaaaagccaaaauugacaaaugggaucuaauuaaacuaaagagcuucugcacaguaaaagaagcuagcaucagagugaauaggcaaccuacagaaugggagaaaauauuugcaaucuauccaucugacaaggucuaauauccaaaaucuacaaggaacuuaaauuuacaagaaaaaaacaaccccaucaaaaaguggguaaaggauacgaacagauacuucucaaaagaagacauuuauguggccaagaaacauauggaaaaaaaagcuaaucauuacuggucaucagagaaaugcaaaucaaaaccacaaggagauaccaucucaugccaguuagaauggcgaucacuaaaaaaucaggaaacaacagaugcuggagaggauguggagaaauaggaacgcuuuuacacuguuggugggaguguaaauuaguucaaccauuguggaagacagcguggugauucuagaacuagauucuagaacuagaaauaccauuugacccagcaaucccauuacuggguauauacccaaaggauuauaaaucauucuacuauaaagacacaugcacacauauguuuacugcaccacuauuuacaauagcaaagacuuggaaccaacccaaaugcccaucaaugauaggcuggauaaagaaaauguggcacauauacaccauggaauaauaugcagccauaaaaaaagaaugaguucaugucuuuuguggggaugaagcuggaaaccauucucggcaaacuaacacaggaacagaaaaccaaacaccauauguucucacucauaaguggaaguugaacaaugagaauacacggacacagggaggggaacaucacacaccgggaucuguggggagaugggggccaaggggagggagagcauuaggacaaauaccuaaugcauguagggcuuaaaaccuagaugauggguugauaggugcagcaaaccaccauggcacuguauacguauguaacaaaccugcacguucagcacacguauuccagaacuuaaaguaaaacaaaaaaucucuacacuucaacuuuugucucuccgcuuuuuaaguuuuuuugucucuauaucuuauuguacugccuauuguaccgcaaaaguuguuguagucauuauuuaucaguucuucuuuucauccuucuacuuaauauaugaguaguuuacacaccauaauuacaguguuauaauacuauuuguauuucuguguauguauuaccagugaguuuuguaccuucacaucauuucuuguugcuuauuaacacccuuuucuuucagauugaagaauucccuuuagcauuucuuguaagacagcucugguguugaugacauccucagcuuuuguuugucugggaaggucuguauuucuccuucauguuggaaggauauuuucaccagauauacuauucuagagcaaaaguuuuuuucuuuuuuuuccuucagcaccuuaaauauguccugccacucucuucuggcccauaaaguuuccauugaaaacucugcugccagauauaauggaguucaauuauaagucuuuuuuuucuugcugcuuuuaggauccuuucuuuauccuugaccuuuggaacuuugacuauuaaauaccuugagguagucuucuuuggguuaaaucugcuugguauucuagaaucuucuuguauuugaauauugguaucuuucucuagguuugggaaguucuauguuaguaucccuuugaauaagcuuucuaccccuaucucuuucucuaccuccucuuuaaggucaauaaaucuuagauuugcccuuuugaggcuauuuucuagaucaugcuucauucguucuuauucugucuccucuguguauuuacaaauauccugucuucaagcuuacuaauucuuuuuuguucuugaucaaugcuguuaucaagagauucugauacauucuucaauaugucagcugcauuuuucaacuccagaauuucugcuugauucuuauuuuaaucucuuuauuaaauuuaucugauagaauucugaauuccuucgcuguguuaucuugaauuugaguuuucucauaacagcuauuuuaaauucucucucugaaaggucacauaucucuuuucuucaggauuggucccugaugcuuuauuuaguuuguuuggucaggucauguuuuccuagauggucuuguucauuggugucuaggcauuaaagaguuagguauuuauuguagccuuugcagucugggcuuguuuguacccaucuuucuugguaaagcuuuccagguauucaaagggacuuggguguugugaucuaagccguaucugcauuaggcagcaucccaagcccaguaacacugugguucuugcagacucauaaaaauacugccuuggggccaggcgcaguggcucacgccuguaaucccagcacuuugggaggccgaggcgggcagaucaccugaggucgggaguucaagaccagccugaccaacauggagaaacccugucucuacuaaaacaaacaaacaaacaaacaaacaaaaauuagccaggcaugauggcacaugccuauaauccuagcuacucaggagacugaggcaggagaaucgcuuaaacccgggagacagagguugcggugagcugagaucacaccauugcgcucuagccuuggcaacaagagugaaacucuguuucaaaaaauaaauauuaaaaaaaauacugccuugguggucuuagauaagauccagaagaauucucugcauuacgaggcagagacucuuguuuucuucucuuacuuucucccaaagaaauggacucucucucuaugcuaagccaccugaagcuuggggaggagugacacaagcuuaccuguggccaccaccacugggacugugcuggucagaccugaagccaacacaucacuggguuucacccaaggcccgcuguaagcacuaccuggcuaccaccuauguucacucaaagccccagggcucuacaauuagcaaaugguaaagccagccaggcuuuuguccuucacuuuaggguggugaguucccccaaguccaagguggguccagagaugccauccaggagcaagggucuguagucaaagaccuuagaaaccuaccuggugugguauacuacagaggcuaagcuggcacucaguaguagcacaagacaaagucauacccagaauuccuucuccuuuccauaggcaaaggagccucucccuguggccaccaccacuacaggcccauaggcaguacugucaggcuaccaugguuguccacugaaggccugagggcucuucagucagcuuguggugaaggcuucuaggcuguggacucaccuuucaggucagugggcucccuucuggccuagagcagguccagaaaugcuguccaagagccaaggccuggaaucagggaccccaagagcccauuuggugcucuaccccacuguggucaagcugguaccugaagccaguauauuucagaaucucauucaaggcccacaggauacuaccuggcacugcugguuguucaggguccaagggcucuuuagucagcugaugaugaauucugacaagacuagguccuucccuccaaggcaguggauucccuucuggcccagggugugucuggaaauguccaagagccagggccugaaaugugugcccauugacucugcccaguguccucuccuacugugguugagcugguauccaagaugcaagacaauguucucuuuacugcuccaucuccucucuuuaagcagaggaaaagagucacuuuuguuucugugagcugugcugccugggguuagccacccuggcuggugucucacuagguugugugccccccacauccacuggcucugagcccaucucagcaauaggacuugccuaggaauugcaguuauuguggccuagacugccuuacaaguuuauuuagaaccccagagcacuuuagcccgugguggcaagguuuucuggaacucaguuucugaccccugagauaugugauuccccucuggcuagggcugguuuaaaugcucccucugugcugggugugggcugaauuuagccugguucugcuuucuguggcaacagggaaucacugagcucgauggacagucccaaagcacugcacuuucccucccccaagcucucagauucucucuccaugccacauagcugggggaugggaggcacagugcugucagugauucaguacugucucucuugcccucuucagugccucuuccagcaauauaaaguuaaaagcagauacugugauugcuuaucugaauuuugguucuuaugaaggugcuuuuuuguguagauaguucucaaauuugguguuccuguuggggaggacaauuggaggcuucuauuuggccaucuugcuccacucccucccuauaaauuguuacauuaauaaacaagaaagaucuccaguaaauaaccuaacuuuaccacuuaaggaacuagcaaaagaacuaaacccaaagcuagcagaagaaagaagauaauaaauaccacagcagagaccaacaaaauagagaauagaaaaacaauagagaaaaaucaauuaaaucaaaguugcuucucugaaaagauuuuaagaauugacaaaccuuuagcuagauggacuaaguaaaaaagagagaagacuacugaaaucagaagugaaaauagggacaugacuaucaauucuacagaaauaaaaaggauuauaagagaguauugugaacaauuguguaucaacaaauuggauaaccuagaugaaauggacaaauucugagaaacacgaaaccuaccaaaacuaaaucacaaagaaauacaaaaucuucauggaccuauaacuagugaggagauugaaucaguaaucaaaaaacucucaacaaagaaaagccuggaccugauggcuuccccaaugaauccuaccaaauauuuaaagaauaaacucccauccuucucaaucuuucccaaaaaauuaaagaggaggggaaagguuucuaacucauucuaugaggagagcauuacucugauacuaaagccagacaaagacuacaagaaaacuacagaccaauaucccuuaugaaaacugaugcaaaauucucaacaaaauagcaaacugaguucagaaacauaguuaaaguauuacauaucaugaccaugugagauuuaguccuggaaugcaaggaugguucaacauacaaaaauaaauccauguaaaagagcauauuaacagaaugaagaaauaacacucacaugaucacaugaucucaauugauacaaaaagcauuugacaaaauucaacauccuuauuaaaaacucucaacaaacuaggaauagaaggaaacuaccuuaacauaauaaaaaccauaugugaaaauccacagcuaacaucauaaugaugagacugaaauuuuucccucuaaggucaggaauaaggccagggugaccacuuucaccacuucuauucaacauuguacugaaaauucuagccagagcaauuuggcaagaaaaaaauuaaaagaaauaaaaggcauccagaauggaaaaaaaagacguaaaacuauuucuauucacagauaacauaaucucauauguagaaaccccuaaagauuccacaaaaacuuauuagagcuaauaaaugaagucagcaaaguuacagaaucuaagguaaacaugcaaaaucaguugcauuucuauaugcuaacaaugaacaaucuaaaaaugaaauuaagaaaacaauuuaauuuauaauagcaucaaguagaauacuuaggaauuaacuuaaccaaggagguaaaagacuucugcagcaaaacccacaaaacauuacugaaagaaacuuaaaaagaugcaaauaaauggaaacauaucccauguucauggauuagaagacaauguugagauaucaauacuacccaaagugauuuauagauucagugcaaucccucucaaaaucccaaugacacuuuuugcaaaaauagaaaaacccauccuaaaauucauauggaaucucaaggaacuuaaaauagccaaaagcaauauugaaaaagaaaagccaagcuggaagccuaacacuuucugauuucaaaacuuuacuauaaacuuacaguaaucaagacagugugacacaggcaaaaagacagacauauaaaccaauggaacaugagacagcccagaaauaaaccguggcauaaaugguuaaaugauuuuugacuaggguuccaagacuauucaaugagaaaaggacugucuuuucaacaaauggugcugggaaaacuggaaauccacaugcaagagggaagcuggacccuuacuucacaccauauacaaaaauuaacucaaaauggaucaaauaucuaaaugugcaacguaaaacuauaaaaaucuuagaagaaaacauagggcaaaagcuucaugacauuggauuuggcuaugauuucuuggauauaacauugauagaguucagauauuuguccccuccaacucucauguugaaaugugauccccagcguuggagguggggccuggugggugcuguuugggucauaggggcagauuccccaugauuagguaaugaguucaugcaagaucugguuguuaaaaggagacuggaaccuccuuucucuugcucccugucucaucauaugagacaccuacucccgcuucaccuucugccgugauuggaagcuuccugaggcucucgccagaagcaggugcuggcaccauguuucuuguacagccugcagaaccauaagccaauuaaaccucuuuucuuuauaaauuaccagccucagguauuccuuuauagcaaugcuaaauggacuaacacaaagaccaaaggcacaggcaacaaaacaaaaaguagacaacuuggacuucgugaacauuaaaaauuuuuguacaaagacacuaucaacggaguaaaaaggcaccccacagaaugagagaaaauauuugcaaauccuauaucugauaagggauuaauauccagaauauauagagaaguucuaaaacucaacagcaaaaacaaaccucucaauuuaaugaagugggcaaaagagcugaggagauauucuccaaagaagauauacaaauggcuaauaagagcaugaaaagauacucaacaucacuacucauaagaaaauguaaaucaaaacuauaaugagauaccacugcacacccacuagaauggcuacuauuaaaaaaccccagaaauuacaaguguuggugaggaugugguagcuacuguggaaaacggcauagugguuccucaagaaauuaaaacuauaauuaccauauaauccagaaauuccacuucuggguauauacccaaaagaauugaaagcagggcguugaaaagauauuuguacacccauauucauaguagcauuauucacaauagcuaaaacauggaggcaacccaaauguucaucaaaagaugaauggauaagcaaaauguggucuauccauacaguggaauauuauucagccuugaaaaggaaaaggaaauucugacacaugcuacagcaugagugaacuuucaggacauuaugcccaagugaaauaagccagucacaaaagacaaauagaguacucaaugaucccacuuuuaugaaguuccuggauuagucaaauccauagggacgaaagguaaaugguaggugccaggggcuggggaagagagaaugggggaguugguguuuaauggggauggaguuucaguuugggaggaugagaaaauucuagaaauggaugguggugaugguugcauaacaaaaucaauguacuucaugccacugaacugugugcuuaaaaauaguuaaaaugguaaauuuugcauuaguguaucuuaccgcaauuaaagaucuacaagaguauugauagugugcuucccuuuuuguaagaaagaggggauacaggaaaacacacguguauuuucucaucugugcgagaggccugcaagagagacaugaaaggcugaagagcugguuuuguccagggugggggggugggggauggaguggggagggaagggcuggcagggugggcgccuggcucuccucugaggacacucuuugugcaccucugacuccaggagucacagcagcuuuacauucccuucacacagacccccagauaaguaacuaaaaacaaucagaaucgggggacacccaaaauggaauaccaaccuaacagauaaaucuaaacaugucacagaugaaugacauaaucacacugaagggaguacagaaguaaagaaauacucaaagucaccguggggaaaagcacugaugggacgcagugaggcugaagacaagacgcgccgugcacagacgccaugcacaggcgccaggcucuggguggucagucacuucucaugggggcacgcaucagcaaguauggagccaguucccuugcagcugggguuggacgagcaggugaaggugagagagccagguuucucacuauugaagaaagguguuacaacaaagagagagaauuggccccacuggggcagaacuggaguuggagacaguaugagcccacucauguaugaauauaucugcagaugaacacagaagcguagacgugggggugccauacacauauuccccagcuccgucggccgagugggcgcagagcagcagguccacaguggcgaugagcacaccaugcacccaggccuggguuucuaaagaccacucuccaauggaaggaacccuggcuccuuggagaagugggugauuucaagacugaggcaaggaaauacaagcugagcccagagcaucuuggggugccaggaaggcaguguccaagaaaagacagggcccaccaaaggggcauggaagcugaauggaagguuguuucuggggcaaaagccagcacaauuugagcaaugaaaauaaauaaugaggcugggugcaguggcucacaccuguaaucccugcacuuugggaggccaaggcggguggaucaccugagguuaggaguucaagaccagccuggccaacaugaugaaaccccgucuccacuaaaaauacaaaauauuaguugggcguggugguacgugccuguaaucccagcuacucaggaggcugaggcaggagaaucacuugaaccccggaggcagagguuucagugagccgagaucaugccacugcacuccagccugugcaagaguaaaacuccgucucuaaauaaauaaauaaauggaggaaaauaaauaauaauagcauuggcuuauagcccauaacacaaaagaaguaucuaugaaaccaugcugauauacauaagccacuggauacauaaccagaacaaaggggacagcucuuccuggagaagaauccaaauuaacaaacauagaaagaaagugggaaauaaacaaauccccauuuggcaagcaccacagacuuugccugucacaagcaaaaccagcugaugggcacuaaaaucagcggggcaaaaucucaggagaaaaaaggcagcugcaaugucucaauguagcuuccucaagguguuuacuaauuaugaagcggaaaaugguuaauuuacagcugagaagcccagcugacacacuccuaccugaguggucaaggucaaaugaacccgcccuaagacaugcugaccucacacagcccugccacagggacuccucgggacccaacaacacucccgcgguguucuugccaaaaaugcacaaucuugaucuaaucaugagagcauaucagagaauccaaaccgagggacguucuacaaaacagccgcccaguacuuaucuaaaacaucaaggucacgaaagacaaagagagacugaggagcuggcacaggcugcaggacacgaaaggagaccuggcagcugaaagcaacguggggaucacagaacagaaaccggaugcuagaaaaacgcgggauuugaaucagaucugcaguugaguucacgguaauguaucaggugucgguuuuggucaauacaccccguuauuaagauguuaauacuaggaguccacaggaacucucaguacugucguggaacuuuucuguaggucuaaaauugcuucaaaacaaaaugauuuuuuuaaaguacagaagccaagagaggacugauguugucccucaucacucacaccccccgcauugcucucaggaucuuaacccucguggcccucccguccuaucuccagcaccuucccugcacaguucuucacaugcaccaagcacguucccaacacaggaccuuugcaugugccaugcccucugucugggugcucuuccugcagaagcacacaccacccacucccucaauuccaucaggucucugcugaaaucccaucuguguccgacuccccuccacaaaaggcacuccuucacccucccauuccucccugccuggcuccuucucaaggucuuacugcuaagagacacgcaccaugcauuaccacgccaugccgguccaugacucucuccauucucuugcaggucacuuccuggagggugacccucgugcuccacucacuccugguuuccccaacaaccuagaugacagucuugcugcugcaggugcaccaggggcaggugggccagugaauggguggcuaaaauacaaagagcucaacaaacauaaacauacuccccucacuaagaggaggaaggauauucuauuuuugcuucaucauaauggcaguguuuuuaugauaauacccagcuuuguggugcagugugggguggggguuggcggggggagucagugauguccagcagcacaguaggaagcuaaauuaggaaaacacucccggaaggugauuuggccaaaggugucagagccauaaaaaugcaggaacccuuugauccugucagucuucuccugcaaaugugacccaaggaaauaaucuugaguuccaggcaaaaaugaguguacaaggauuugcaucacaaugcuauuuacagcagucaauuaggaaauaacccagccgucaauagagaguugauuacguucaauaacacaggggaaaugccaggcagccauugaaaggucacauuuggaggaagaacagaugugagacaugucugccaugugucaaaagguaagaagauacaaaugaguugucuaguacccucucaauuuuaccaaguauuugcacagacacacauaggcaaguaugcacacacacacauauacacacacacacacgcagugauagggguuacccugcucagcacuuccugagcuggcaagaagcuaagggugcuggacaaugaguucauucaauccucaaaccaccauacgaggugagggcucccaucguucccguuucagagaugaagaaacugaggcacaaauucauaaagcaaacagccgauggccgugguccccaaccuuuuugggaccagugacugguuucauggaaaacaguuuuuccacagaccaguggugugggugguucugggaugauucaagcacauuacuugcauugggcacuuuauuucuacuauuauuacauuguaauauagaauuaaauaauuauacaacucaccauaauguagaaucagugagagcccugagcuuguuuuccugcaacuagacagucccaucugggggugaugggagacagugacagaucaucaggcauuagauucuuauaaagaggaggcaaccuagaucccucacaugcauaguuugcaacaggguacacaccccugugagaaucuaaugccgccacugaucugauaggaggcagagcucacgcgguaaugcgagugauggggagugacuguaaauacagaugaagcuucacuugcucaccugccacucaccuccugcugugcagccugguuccuaacaggccauggacugguagugcuucauggccuggggguuggggacgccuggcugauggccacacagccucggggaagcagccuagcuguagacgugcaacucacuccugacugcacuguguguguacacgcccuuaacacacacacaaagaccaaguagaaacaugugcaugcacgcgcgcacacacacacgccgagaaaaagacuagcaggaaacuaaaagcuggcaucucuggcuuuugguacgaugagucauuuuacuuuucuucuuuaaaaauuucugcacguucucugauuaacauuucugaacuuuacaaucagaaaaacugaucuacuaaaagcauuuucuuaugucuggugaggaguaacuggaauugucaucugcuuuggaugagaacuagugacaucacacaucgcaucaguucacugcagaagagaccaccacccguucucguggcuaugagugaaauccaacaugaugugguaauucucuucuaacuuucgauuuauaugauuucauuucaaacuuauagagaaguugcaagaauagcagaaggaacucccaaacgugcucugcuuagacuugccugcgguuucuacacugcccccguccugcuccauccugucccucuccagacuucccucuuuugguugaaucuuucugagcccuuggagacaccaugccuguuuucugcuaaacgccuccucauggauuucuuaggaauaaggguguucucuucuguaaccaugugguacuguugucaaaaucgggaaacaacacugacaugcacacuacaggucucuauugcacacuacaguucucuaccucacacucucacaucaucagcugcccagacacuggcuauugcagccaucucuucccagacaggauucaacucugauaugguuuggcuguguccccacccaaaucucaucuugaacuguagcucccauaauucccauguguugugggagggacccagugggagauaauugaaccaugggggcaguuucucccauauuguucucgugguagugaauuaagucucaugagaucugaugguuuuauaagggggaaccccuugcacucuguuuucauucucucuuugccagcugccacguaagaugugccuuugcucuuucuucaucuuccgccaugauugugagaccuccccagccauguggaacugugagucaauuaaaccucuucccuuuauaaauuacccagucucagguaugucuuuaucagcagcaugaaaauggacuaauacaguaaauugguacugggaguggggugcggcuguaaagauacccaaaaauguggaagcaacuuuggaacuggguaagaggcagagguuggacaguuuggagggcucagaagaugacaagaaaaugugggagagucuggaacuuccuagaaacuuguugaagggcuugaccaaaauucugauaaugauauggacaaugaaauccaggcugagguggucucagauggagaugagaaacuuuuugggaaguggauuaaagaugacucuugcuauguuuuagcaaagagacuggcaguauuuuaccacugcccuagagauuuguggaacuuugaacuugagggagaugauuuaggguauuugguggaagaaauuucuaagcugcaaagcuuucaagaggugacuuggguguuguuaaaagcauucaguuuugaaagggaaacagagauaaaaguucagaaaauuugcagucugaaaaugugauagaaaauaaaaacccauuuucugaggagaaagucaagcagccugcagaaauuugcauaaguaacaagaagccaaauguuaaucacuaagacaauggggaaaaugucuccagggcaugucagagaccuuaggagcagccccucccaucccaggcccagaggccuaggaggcaaaaaugguuuccuggacugggcccagggccuccaugcugugugcagccuagggacuuggugcccugugucccagccgcucuagccauagcuaaaaggugucaagguacagcuugggcuguggcuucagagggugcaagccccaacucuugguagcuuccaugugguguugagccugugggugcacagaagucaagaauugagguauggaaagcucugccuagauuucagagauguauggaaaugccuggauguccaggcagaaguuugcugcaggggugggguccucauggagaaccucugcuagggcagugaggaagggaaaagugggguuggagcccccaugcaaaguccccacuggggcacugccuaguggagcugugagaagagggccacuguccuccagaucccagaaugauagauccaucaacagcuugcaccaugugccuggaaaagcugcagacacucaaugccagccugugaaagcagccaggagggaggcuguacccugcaaagccagaggggcagagcugcucaagacuaugggaacccaccucuugcaucagcaugaccuagaugugagacauggagucaauggagaucauuuuggagcauuaagauuuaacugccccacuggauuucgaacuugcauggggccuuuagccccuucguuuuggccaauuacucccauuucaaauggguguauuuauccaaggccuguacccuaauugugucuaggaauuaacuaacuugcuuuugauuuuacaggcucauagguggaagggacuugccuggucucagaugagacuuuggacugcagauuuuugaguuaaugcugaaaugaguuaagacuuuggggcaccguugggaaggcaugauugguuuugaaaugugaggacaugagauuagggaggggccgggguggaaugauaugguuuggcuguguccccacccaaaucucaucgugaauuguagcucccauaauucccacgugucaugggagggaccucgugggagauaauugaaucaugggggugguuuccuccaugcuguucucaugguaaugaauaagucucacgagaucugaugguuuuauaaggggaaacccuuugugcucaguuuucauuaucucuuugccugucaucauguaagauguuccuuuguucuuccuucaucuucugcugugauugugaggccuccccagccauguggaacugugagucaauuaaaccucuucccuuuauaaauuauccagucucagguaugucuuuaucaguaauuugaaaauggacuaauacauaacauaguggaaucauagacucccacuuaggcaucacauuucuuccuuccccuucacccugaacgguacuuuauuuagccuucuacguuuuuuggcccuggcauuuucaaaguauucaggccacugugugugucucccuccauguggguuugcccugugucuccggaugauucgacccuggacagcugugucuuuggcaggaguucugcuaccgaggcuguccauccggaggguggugaagcuggccugucccauuccuggugauguuaacuuggaucacuuggcucggguggugucgccagcuuugccucuagaaagugauucuuuuuccuuuguaacuaguaagugguggugggagacacugagacuacaaccaccagcucuuugaaccccugccccugccacgggguuuccuugauggccuuccagcccuguugauucuaacgugagaacuggauuccuuucuuccacuuauuuguuuauauacaugggugugucccuguggaugcauagauucuuuuuucaugaauuauaauccauuaccacuguugugugugcauguguguauguauggucuuuuuuuuuuuuuuaauaaaaagagauggggucucacuaugucacccaggcuggucuccugagcucaggcaauccucccaccuuagccucccaaaguggugggauuacaggcaugaacuacugugccuagccuacauguguggucauuuuuaacacacuauggguuuagucugccaucauaaugaggauuuucauugcucucuguguacauaucacuggucuguaguuuucuuuucucucugcuagugaggcagcagagagaucacuuuguucacagcuaaccugggcacccugcccauugagccacuaacaugacuggcucucucaguagcagacggcauccuaauucaauggugggaagaaccuaggucaccgugggcuggaggcuuuuccagaaaaaacuuuuugaugacuuuguaaagagcauuuccuaccuuugaucccacauuaaaaauuguucaaacauacgggaugaaaacacuguccagugaaugcccauacgguaucuccauccugccuugaacacuuugccaagcauuuucaccacgugccaugucuccacauaucucaccugccaauguguucaccgucagcuguggacguucugaugaggguucagauucaucucacacauacugagauugucuccacuucuuccuaauuuugacuuaacauuuuuucccaaagaauaagccaucucacaacauuuuucaaauucacuggaguacaauuuuacaaaguacugucacauuaaaaacugggcugggugcaguggcucaugccugugaucccagcacuuugggaggccgagguggguggaucacuugugcucaggaguucaauaccagccuggccaacauaaugaaaccuuugucucuacuaaaaauacaaaaaguuagccaggggugguggcacaugcccguaaacccagcuacuugggaggcugaggggggaggagcgcuugaacccgggagguagacguugcuguaagccaagauugcaccacugcacuccagccugggugauugagugagacucugucuuaaaaacacaaacaaaacuuuucuaaaucgauugccaaagagccuucucaugucuaaauuuagauauauacuugggguuuuuccaugauugaaauuauaagauauauauuguuuuccucaaagaaccaagaaucaccucccaaaaagaacccucaagucuguuuuccuguuuccuauuauuuucuauucuuaucucuuauuuacauucacuuuucuuacugugaacuuuuuaacuuacauauuuacuuuuuucaaaaaaggaaaaugccuguagcuauaaauuugccucgguguacagauaugcauauaugccccuuuaauguucagaucuauuacacaguaauauugcugauguuuuuacuucuaaguagacuuuucuucuuuagacuuucauuaauuaaacuuguaauuaauaacauauauuuuaaacauacguugaaaucagagauauccagcauagguucuuaauuuuagaaugucuugaaguuuuugcagucuaguauaugaucaauguuugugaguguuccaggaacacuguaaaagguacaucuuuugcuuuuaaguuacaaaguuugauauaucuauuaauuuaacuauaucaauaauucagauuauuuuuguuuucuugaucuaccagagacucgaagaggugauuuaaauuuauauuuuccuuugcauuuuaaauaguuuuuaauuuauugucaguauuaguccguuuucacacugcugauaaagacauacccaagacugagcaaauguacaaaagaaagagguuuaauuggacuuacaguuccauguggcuggggaagccucacaaucauggcggaaggcaaggaggaccaagucccaucuuacguggaugguggcaggcaaaacaugagagagcuuguguagcggaaugccucuuuuuaaaaccaucagaucuuaugagacguauucacuauuacgagaacagcacaggaaagacucguccccgugauucaauuaccccccaccaggucccucccacaacacagggaauucaagaugagauccgggcagugacaaaccacgucacugucuucaugaaaguuacagcuucacagcugacuaugucuccagccauuuagaaucgcccuccuugcccuaauucuuugagaugaagguugaauggaaugucugcuaucuuuaggugugugugcuugaaaaucuuuagccauuuuuucauuuugauggcaucauacuuaauuuugugauuuucauaagcaacacacauuugaauuuguuuuuaaauccauucuaaguaucaggcuuucaggaaggagccucuagccacaacagccaaaggcagagacagcugcacguaguccauccacaccacagaccacuacucagcucagaaaggaagggaauucccuugcguguuauaacacggcggacagugaagacaggacgcucggugaaggaaaccagacacacagggccacguuugccaugauuucaggcacaugaaacauccagaauagcuaaauccaggggcagaaagugggcuugugguugucaggagcugggggcaugggggaaaggggugacugcuaauuuccucuugcggaugauggaaauguucaggaauuagaaagacgugucggacgccuagcacugcgaguaaaccgaagaccaugaaacauggguuaaaaaggucaauuuuacguuacguguauuuuaucacaacacaaacaaugcacaaaugcacaaaggucagcucugaagucgacgccugguucccaucuggcucugcuccucacuagcuaugcaccccaugccucaguuuucccaucuguaaaagggcccgauguggggcugugaugagguucccauaggcaagucccccaccgugagcaccaccacaccaucacaaucugcacuaauccaccuggccauggacaccuccuucucgccuuaaccuagucccaccagcagcauucccagcagguguggccaccccagcucugggccucucugggagcaggggcccaagcucucagcccaagcucccgccccacauggaacacucugacgcaagggccuuuugucugggcggugaaagagccuccagcugacgcaugaagucauaaauguuucagagaccugggcuccaccgcugccccucccuaagggcaccaaagccaccugugcugagccugcagccucagauggccucugcauuuaauggugccugcuaucugcagccacuuagggcccaucaucuggcggcugcuguuuugcucagcugcagacccaggaggcuucccacagggcucgggugcccacugcagccuggacaccggcacaucaggcaaagagacccacgugagccucacugcccuggcaucugcccuaggcucacccucgcccucuucccuccuaggaggugaacaaaguagcuguggcccgggcgccacaagagucaccacuggucaccaccaggagacucgaggacagcagaguggucccugagacccugacuacccccaacgcuucuugacggacccuggacacauccaguguccccagcacagccccauggugagcccucagugaggaaagccuguuucgaaagaaagacaaaaaaccacuccacacugggugauguguggagagaccacugggccagcgguaggaggcuggggccagccacagcccuuccccaagcagcagguuggcccggcugcccgcuuaccucccucccaagggcccugcagugccccguuccuggcaucaggccuauuuugcggauuuggugaaggaggauguccguuccgggaggcagggcucucccaggcucccaucuguggagggcgaguggugagcgcaugcggcugucugcccagcuggugccacugagcaauggccacccuggccagcgggccccauggcccuaccugugcagagcaaugccucccccagcugucgggggcuucaaccugcaggcugccaucuccaggaccugcccuggcucucaaugggauggaggaaggcucuuggcuggcagccccgcgccaggccaggccaacugaggcccagucccuccagaguucccugaggaugaugccggccgcacacccucgcucuacaagccacaugacacggcugagcgucugugccaugcugagcgcugucccacggcaggggacucaacgacggaccaggacgggaaacggccuugccccuuggauuucccagcacagacccuuuccuuucccaacccgcucaccugggagggcccagccccucacaucuccaaacaccagcucuccugccuccugcuggacgggacuccaggcaggacucacugcaccaugggccucaggucgaauggaagcccuggagguccccaacccucccugaguccccagcaagcccccaaccacuauuuucuuccauuuauuauacaaauauaggaacagcaauaaaugacaucagaauuaauggagcccccucccugccagccccaccccuucucuugccugcucuccuuggcccguccuggccucuccucagccacaggcagcagcuccugcagcuuccagcacaggggaguuaaucccauggacuugagaugggugggacccugugugccacucugcccagaaggcgcuccccacucagggacaugaucuggagggacaugggacagucuccuccaaugacagaggccuucauaugcaggcuucucccagccacgcccaccccaucaccaugagccccucugcucaugcccaucucggugcuggggugauggggggcccuggaguaucaagaagggccccagagcugcaacuuggcucagagccauggagucacccccaugccucugaggacagaaucacaucugccuccacccacagcaugguugcacuuuuuccucaaacaagcuggaguggcagggcugggcagcucuacuggguaccccuagacagggaaggagccugacaaugggcaggggcugacugaggucauagcaggcagggagcucaagucccuggccagcucccuaucccacagaccuacucacaucucacgcagccagugacucagaaagccccgcaugacaccccucccagacgcucugccuugcuuuuuucagugacagagaccaggacuccagcccacaaaguagcccaggccacgacccuccuucucuggguaaaggugcuucacccugagaugaagggaccagccucagccucuccaguucuuuccagcucugcccugugagggacaugcacacaugcauacacacacacacccauaggugcacacacacccagacacaaacacacacaccuauacagacauagguacacacacacccacaaacacacacagacaugcacguauacacacaaaggugcacacacacccacacauaaaacacacaccuauacacaugugcacauacacuuauacacaugggugcacacacacccauauauacaugaacacacacaccuacacacaugugcacacauagacaugcacauauacacacaaaggugcacacacacccauacauaaaacacacacaccuauacgcaugugcacauacacuuauacacauaggugcacacacacccauauauacaugaacacacacaccuacacacaugugcacacauacauaccuauacacacacaaccauacauacaccuauacacaugugcacacacacuuauacacauaggugcacacacacccauauauaugaacacacaccuacacacgcgcacacauacacgccuauacacacauaggugcacgcauacacacaccuauacacaugugcacacacacccauacauaaacacacacaccuauacacacauaggugcacacgcacccauacacgugcacacacaccuauauacacaugcacacacccaaucacaugcacacacccauacacaaguacacacacgcccaugcacacauacacacgcccaugcacacauacacacaccuauacacacaugcacacccauacacaugugcacacccaugcacacacccauacacauguguacacacauccgugcauacgugcacacacccauauacacaggugcacacgcacccauacacacgugcacacacacacauacacaugugccugugaggcugugauacugccaugcuuaggacccagagcugggccaucagcauccuccaaguccuggggaccuggugguguguggggcgagauggaucucgcagguccccugggucucuugacacuuuagugccguggagugucagaggcuguggcguugcugagcgugaaggacacuugggucaggguugggggugcagccaagagcagauggggagagggaggagggcgggagaagcaagcagcauuugggguacagcccugcugauccccacuugcagagcaacacagagguggggucugaaaaguuggggacccugaagccacaccaguuggagguucagaguccuagguccccgagucuggcugcaggaugauugcagccgagucagcccuuguuccccagccguugggagauaucgaugagaugaguugauacaggguggugagggcggguagaacucugcuguggagggaggagggccaucccagcaaaugugcuggaacccgcgggcagaaagggagccuccaccgacaccucccagcuggucagacauuaacucaaaaggaauauccaccucagugugaaaccugacacuacaaaauuucuggaagaaaacagaaaaucugugcccuugguuuagggaaagauuucugagagcaccaaaaaacacaauccauaagggaacaaguugauaaacuggacuucaucaaagucaaaacguuugcucucuaaaagggcacuauuaagagaaugggaggcugaggugggaggauugaucgagaccaggguuuugagaccagucugggcaaugagaaauaaaaauaaaauucuaagcacccccccccccaccuaacugaguggauccccacuuggccgagggaaccccagagaaacccuggaagcugaguucagggccaugauggaugugcgguuggauacguaucaucacacccccucccuugauaacugucauuggguuuucuucccaaagggcugaacagaaaccagccuuuucauaagacgccggcuugucuuccuucccaggcacagaacaaaggcgagacgagauaacgagauguucuuccgccucccugggauauacgcuuccaugcucccucuuuccuccaauauacgucuucuguaaaauguagauuuacugggcucuaacuaaagucucgcaaguauauaaucauuugucucacuugaugccccuccccuuuucaagaaaacauauaaauaugaaugaaaccuccuacgcaccucuuuggaaaaagcagccacagaugcuucugugacuggaguuuuuccugggcgugcccucacguuggcucaauaaaccucgaugauuugaggaguaugcuucaaguccucauuuugauugucagcgacauagccagaccccagcucuacaaaaaauuuaacaaucagccgggcguggugacaugcgccuguggucccagcuacuuaggaggcugagacgggaggauggcuugagcccaggaguuggaacugcagugagccgucauagcaccaagcacuucaaccugggcgacagagugagaccgcagcucuaaaaacaaguuguuuaaaagggccgggcgugguggcucaugccuguaaucccagcacuuugggaggcugaggcgggcggaucacgaggucaggagauggagaccacggugaaacccugucucuauaaaaauacaaaaaaucagcuggauacaguggcgggcgccuguagucccagcuacucgggaggcugaggcaggagaauggcaugaacccggaaggcggagcuugcagugagccgagaucgcgccacugcacuccagccugggugacagagcgagacuccgucucaaaaaaagaaaaaaaaaauuguuuaaaagaacugaaggacuagcaagggauaagggaaggcuucacagagcagguaucugauagaggacuugguccagaauauagaaacauguaacaucucggccgggagccguagcucaugccuguaaucccagcacuuugggaggccgaggcagguggaucacgaggucaggaguuagagaccagccuggccaacguggugaaacccugucucuacuaaaauacaaauauuagccagucaugguggcgggcaucuguagucccaacuacuugggaggcugaggcaggagaaucacuugaacccgggaggcagagguugcagugagccaagcaagaucacgccaccacacuacaaccugggagacggagagugagauucucucucaaaauaaagaaaaaaaaaaaaacucuugaauucaaugaaaaaccacccacguuuucuuaacagacaauuugacagacacuuuaccaaagaagauauguggacaacaacuaagcagcugaaaagaugaccccacacagugagucaccaggaaugccagggagggccccgacacaccuguuagauuggcuaaaauuaaagaccgaccacaccaaguguugacaaggagacagaggaacuagagcugucgcacggagcugcuggacugcaaaaggggauugcugcuuuagaaaacgguuugucaguguccuagaaagugaagcccucacccaccccaugacacagccguuccacuucccagcgggcugcagagcaguucaaccacuugcuugcacaagagaagcaaaagcauuugcucgcacagagacuccagcuauuccuagcaguaucauuugugagagcccaaaugggauacagccgcccacauguccaucaacaggugcauggaucggcaaaguaggcucuacccaaacaacaggccgacacacacaacagacacacagcucaaaaucaugacgcugaauaaaagaagccagacgaaaccagcguuggcugccagaguccauccaaauaaaauuccacaaggcacaagcccauccaucgugccugaugguagggcagcaguggccuggucguggggacagggggacgcugugagggugaugggugugcccacucugcugaugcuggcuucacagggccuccaaaugucaggacucauggaacugucugcuuuaaacuggggcaguuuaccguaugccaagcacgccuccguaaagcuacuuagaaaaaaaaagugcaugccuguaaucccagcacuuugggaggcugaggcaggcagaucgcuugagcucaggagcuugagacuagacugggcaauauagcaagaccccaucucuacaaaaaauacaaaaauuagccaggcgugguggugugcaucuguagucccagcuacucaggaggcugaggcgggaggaucucuugagccagggaggucgaggcugcagugaaccaagaucacaccacugcacucuuagccuaagugacagagggagacccugucucgaaaaauaaaaaauaaacuucugggaaugggccuguggccugugaaagguugggagcccaggagagacagugcauuuuccgggcacagucuaagcacguggcuaacagcccuuuaagaagcugcuguuaucccuauuuuacagaugggguaaaggaaaugcagaggcacauggccugcacccacagggccacugggcagguccccacgcugggccagcccaucagccucccugcccugucccuaaccagguggaaggcagugccuggacucggaggucacagcagccccagugcggguggcccaugccauccagcagugcccagcuccuacccugccccacaccuugaauccaccuggccugggucugcagggaagggaucaggggagcaaagggguccccacagcccccauugcaagacgcacgccugcuggcugugugcacugggcccgugugcccaggcauugacguggggggcaggugucucucaccucaccugggccaggcccggugggcagcagccuguccagcacaagagcaccccaacgccuuugccaaaccccagcucccagccuuccccagccugcacccugacgugaucucaauggucccaugugacucggauugugguucucagcagagauacaaaaccacuuccugaggcuguaucugucuccugguggcuucucagcugagcccccggccacaccauauccucugcagaagccuauaucaagccaggggaccagggccccacaccaucccuggcugcuccagggaagagggagcagccuccuccgugaggaccaaaaggguagaggccgacaccguugaagccaguccugcccuccuccugggccccugccucccugccggacaccaaggugccacgaagggcgcucauggcucagcccaccccauggagcccugugcaauggggagauaaacccagacccccucacagcccacuuccaccccugcagaggcacccuggcccucaccccagggaggcccaggcccucggaccugcugaccaacccugcccggcucuccagccacagcuugcuccuccgaccuccaggucaccuccugccccugccuggagugcccccaucugucgggcuuccccuggaaggcacucccucaggcucccacagcccccugcagcccagcugcccacaaacccaccccaaagccccuagacuguggccaggucaugcucacugcugcaacccagggcuggcccucagagcaggaggccagguguucugggagcgggcagaggagaccacagaggaagagcgcaggggccaggcccucgcucucuauaaacuaaaacuauuaugaucccuguuuccagauaggaugacugaggccaagggaggcuaaggaacauggagcucagcccuguucucaugaggacaggaaggcccucucccucugcccaccuggcaggaggcccccuggacaaggcuggccagcauaucugaagccuggccccaggcagcagccuggcagcaagcucuccugaggacuucuggccugcugauggcugugcccccgggcaaggcuggcaccacacagaagcccccgagccugggcagaugucagugauagcaucuugaaccccacuccacgacaggccagcaagggucagaaggcuguggcugccacagccagcaacaggggccagccccuugccccucuaagaaccacagccccaggcccaggaggggacccccagcacuguguucccucaaaacucacucucuucugggagccccccuccuccugcaaaguaggggacaaaccccagccuggggaggggaagucccagccaggacuucuccccccagcaagcacccaucaggcggggcucagccaugugucaccuccccuuuggagaucgcuucuccacucugggccucaguuuccccagcuacaaaauggggcagcugggccacagccugccugcaucuccucccccaacaacgaaggucacuguuccagcuuccucagcgacacucccuaggcaaagccucaggaaaacucaaaaacgucccugagcccccuggguggaugggcaggucccggcuaggacaggaagaagcaaugcccccauagccagcccgagaacacucaugcaggcccugaagggcgggccccugggagucgaccugagccgucaccaagcuccccaaggaaaggacagggcaggucaugagcccggcaggugcagccaggaaccaaccacaucuagacccgccuggcagcacacagcuccugccugccagccaggcuccaaauggccuuccaggaggcauggcuggagcccaccaaggcccaaggggagccguggaucuguaccauucauuguucccagccugcccggaacacaggcucuacccagagggacaccagacaaggccacuccuccguaaaccuucucccaggaagcucugggaagcaugcuggugggaggcagagcucggcgcccaccccuccccucuccaauuccacccccaagcaggcacugguacaaggcaccuagcgugagcaaggugugagaggggccagcacggggcaggggccggacagggagcucugcuacgcacaagcugugugacccugggcaaguguccacccucucaggccucuacccaaccaagacaagugacgagcucagaggagucucagcccuggugggggccgugguuccuccugacucagauccuggcuggcuggaccuuggaggaucaccuaaggccaccuggcugcaggaggcaguccgcuguggggacagugcacugcccaagagcuuccagcugcagccagggccucagggccucacaccuggacuggaggccagccuggcaggccuuggagaaggggucacggugccagcuugagcccaggaggucgcacugcagugagugaugacugugccacugcacucuaaccuaggcgacagagugagacccugcuucaaaaaaaaauaaaaaauaaaaaaacuucugggaaggggccuguggcccauggaagguuaggagcucuggagggacugcauuuucucggugcggucuaagcauguggcuaacagccccugaaggagcggccguuacccauuuuacagaugggggaaaggaaacaagagcccauggccugcacccacgggggcggccggggcagcucccugcacuggaccagcccaucagugcccagaguuggugcccaggaccccagagauugcugucuuacuuccucgggcaggaggacuuugaacuaccuuaacacacaggaaaagagaagagaagcgcccuguggacuccagcuccuuccaucucugggcagcuccccacagugggauccgccucagccccagcccaccuaggaggggucagcagagccacccuuuccuccucgcccagacuguucuucccaccagcaucccagaguccaacacggaccauguaauccuggccccugagagaagcuggaaucugccacacagaggcacugcccacccccccaacuccugucccccaggccuccccaaggacaggacaugggacucaugccuggugcagggcccaaugugggggcagcagccaggggccaggagcccaugggacccuagcaccauguggacccaggaccacagugcaccugcccccaccccggcacucuccuaggucaaaucacacucaauucauucagaguucucauccaugcgaugccagaagacacuccagggacuccagaauccucuuaccagccucuccucacuuauauauuuuaauuuaaaugaucuuuuauuauuuuuaaaaagcaauauauuuuuaauuagaaaauucagaugagcaaaaaugaaaagauuaaaacccacagcccacacccaggggugaccacgacgaaggcuuguuaucugcuguccgggccauuccacaccuggacguccauguguuccggcccagggagcgccugcggcccacugcguacagcuuguaucugcugauggcaagcaccguaguccacaucccugugccagucaggcccagucguucuaauugucccguggguccugcaaacaucccggcccugccuggauccaccgggcagcaucaguguccauuuuccacaguccugcucugcagagucagggccugucaccccgguccacgguuaucaaaccagacccaacugccgacagugagccugcugggcacggagcccucggugcugccucacaccguggggagaaccuucccccugauccaucagccaaacaaguccccgcacgggggcaucuacacaagcaccuacagggagccuccacgugguagcgggggccgggccauccggcuucagggcugacccccucgcagggcaaugucuugugaggagcagaggccgccacucugaaacucgaguugcacaaacucaggguucacaucucggccugggcacccacagaccuccccgagccccuguguguugagcucagcgcagugcccagcacagggaguacacccauaaacacagcugccccagccccagccccaguccccggaagaggcagggugcccagggcagcgugacuuugagguggcaggcagccugccaaaggggccacgauaagagggagguggagccuguccaggggaccgaagccaggaaggcuacagagccccccagccccgcccgccaccugcaccaaggacaaccagaacauuccaccacuuguccugugggugcugcgccuccgugcagcuguaccaggcuccuugagcagccgccgaucugggggauagagggggcaaauguauccucagcagaaaacagccucuaccuugcaggccagugagaacuucugaaaggccuucugcauuccugccuucugugucacccacuggcagguagggauuaggcucuccaggcacacaguaaagucaauggucccccaaggucacagccgggagaggcugagccagggacggagcguccaguuccccacucugaccaagcacaacccggaauccuggaauccaccccgucccccacuucccacuccccacacccugacagcagguauaucccugaaggaccccugaggacccccgacuggccccacuucccugggcccccugccgccgcugccccgcuuaccaguucaggggccucacccaagacucuuccacccaagggcccacagccuucccccaagacccucccugucugcucagcucacggggaagaaaccugaaccccaggcugggcacggcacauggacccagguuuggucccugucacucugggcugggccccgacucaccagcccagggagggucaagggucuacuuucugcuccucaaaccuccaggccuucccugcccccggcacccucuuugccugugguucuugccagcagcgcccacccuccccuucacuccaccgcccccuccccucaguccuggcccuccaagcugucuaagucacaggcagggucaaccccuaccaagagagcaggccccagggcacacagaagucagcagaaagcaccugcaggauggcgcaugggggugugggagcacgucccugccacucaguaacaggugggggccucacggggggcacauggugggaucaugacagcugcugcccagauuacagcgaggugguggcaaugucacaggugguucccgucaugccaggaagagauggugcauucuagaaaccagcggccuucgccgggagcccccaggcaggugucaagcucaggagcaggcccgucagagagaggaggcaagucagaaggaggaggaggcaagucagaggggguggcccuagacaucgccucugauggcgacgcugcccucguccacagccacacucaaguccagaggccugucuaccuugcaggccuggcagccccaagaacagccaugaagacccacccagcacccaccaauccagaacccaaaccaccagaaggcuccucccuggcuccuuggggcucuccaugagauacacccacagcaacgcccccucagcccagggaaggauucuugugaaucccagaaagacacaguggggcugggucucaucucuggacagcugcugggauggcggaaggagcagcaaugcaucccagcuguauugggacuaggcuggcugaguccacacucaccgagaggcccucuccagaccuucccccaggacagcagacagcagacagcugcacccagugggugcuggaagcagcaugccccauccauuucucucccugcccaucccuccguccacccaccccuuucucucuccacccacccaguacuucaucuauccagcuguccacccaucuacccgccacccauaacugaccacaauucagccccccauccaccugcccaucccuuccucugccuaucuguccacccccgggguaccuacuccaugccaggccccgcacuggcucaggaagcacaggcucuuucccaggguccacagcagccacaggccucaaauucccgagagccagaaaccuggaguugugggugagagcaggggccacguaaacaaaagcagccgugaucugggcugaguaaauccaggcccggcaccagugccauccuacacuccagacacacacaugugcaggcgcaaagacagugccuucccgggccucucacagccccaggccauggaagcugcaggggaggaagggaagaggggccacccccgccccggccggcucacccagucagcaggcuuaucuccuccacacucaagguucccuucccggacagagcuucagaggcuauuucaggaacgacagcaaccagacuacaaaucugcugcgaggcggccugagaagccauccucuccaaggcugaagaaaaggggggcaucagauggccccacaggccuucaaacagcccugcacaugcagaccgagccccacacaccugaucacaccugacccaucaccaggucggacaccgaguuccagccccagagacacaugaggacaaacucagagaggcaagguggcugcccagggccucucaacaccccaggcugcccccagccacggccauuggcucacagaucgccacuccuggacccaguggaggccaggagagugaggcccauccgacucccggacacccccggaaacccagguccugcagcaguaccacccaggacaggggccauccacaggaggccacacccccaugcagcagacaagaccgacaagagggccaccugcacaggcagcaacccucaaccagaagcagucacgccccagccuggggcaaagugcuccuccagaggcuugaagcagucuuuggggccagagagagaucuggucccccacuguggagacacaccuaccacccucucauaagggccucggccacagccacccggaugggggguugcucccacccagccccacugccccacaagagcggaguccccagcguuccccagcagugggcacagggcuuuggcaaaggggcccaugcaaauuugcgguccaagguccacuuacagcugggcugacagucccuguaccugagaggccuccaaaacacauggacacagacuggagccuuucuacugugggccuuggagccacaggaaaaaagggaaggagggagggagggagggagggaggaggccuguggaggccagggccuugagcugggaagcaggacugaugccacagaguaaacaaguaccuguacccgcagggccaccugggggcuugggcaccugcuccucccuuggggcauugcugcccuccaccagccacagagcccuuugaaagaccagggauaugggcgcaguaucuguccagccagagaaaugcaggccagcagcacaggcuccgccgcccugcagccacccugcccggccugcccacagagaaucaggucacgcagggacucacccugccccggaguccugcccccagcugggccacaggcugguaggggucugggcccuguugcaucuccggacaccucugcugcccaugggcacugcaagcaaggacucgagugaggggcccccuggggguggcagucaggacaccaaggccugucuggguuuuggaggaacugagcuuccacaccugcacuggggugcggcucuggagccuagaggagaaacagggguucacgucagcuacuauuaaauucaguuugucugaaagacugcgaaaccacacaccuuuucuggcuagcagauaaccacauuuaaaaaaaaaaaaauucuuacuaaaccaguccucugacccagccgcagguuuuggccaccugugcugcaugggaaggagaguggguuuuaagcagaagggaaucccugccugauuucacgacuccauucaucuaccucugagacccaggccucucaacacaaagggggaacucuuuguaggcaggagggcggagggggccuccgggguggucuggggggagggaccacgcccucacggucagccguucacccccagggccgcccucuacuguggacggaacaacaagcugacuugucccugcccgguuggcuuagaggaagucaguacugccagucgccacagugccacagccugcccccacagagggagcuacagacuggcagugaccccuacauacccuuaaaggaaccagagcugucucagacccgcacagcuccucauuaccuaagacagguaagccuucaccugcucccuccaagcccugcagugaggaacuacaugggguuguccucuaggaacccugauugccccccaccccugccccuguuauggccugaagucagggagugucacaugcaugcuuugucucugcccagcuccaggcaggccacacagucccuggacaccacgccccacauccuaaccucacaccaccgggcgccacggggcgcccagaggagacagaccacaguguccccaccaccgcgucccaaggaaguccgucucucguuuugcaguugagguaacauggccagcugggagcugggugcaaacucuggucugucugcuccagagccccauaaagccccugugccugggaaggaaggaagccauucacaaaagcaucccaacaaccccaaagccucccaacugggcacgggaaucagaaaugcaccauggcaggugcggcaugggcaaaaauggaacaugcagcaaaccagaaguaauuuaauccaauauuugucaucauuuauugaggaccuaacuaaggccauaugucacaauugguggauaggugauucuuuccuccuucucuccguuauuucuuggucauugacuuacugaggaaaucaggucauguguccuacagagccaucccccaccacugggauucugcaaguggccuccuguaguaucauuuagcgcguuccucuggcccgaguauuuccaguaaacuuguacuuagagcacgaggcuuggugagaucgaucgauccauccauccauccauccauccauccauccauccauccauccauccauccaggcaaggaagcauuguggaugggagcacuuucugugcacuguccgaaggccuuuacugcuuuggagagguuggcagcugugacgcugcaugcggaaucccugaccucaccaggagcuggagccuggcaggacuucagcagcacugccgccucaggcaucugcgggagucccaaagaaggacgcaaccccaucagcuacuggguuuccccgaguuacaguucacagguuaaucacgacugggacacaugucagauucucuccguuugcuugccaggauucaacaucaugagcggucucccuauugaccuccacagaucuuuagagaaaugcaaaucaaaguccacugguuuugccccucaguaucaggaugaacuugggaucugaaccccaucaaugcagcucauccacuuccucuguuauuuucagugaggcuuacccacugcaucuucagcuuggggagaagggggaagacaaggaccccuucaaguuccagugacauggcccuagggggccucugauaacuucccugccuucugcugugaugaauacuccaggcuuagcuugcacaucuucugccacagaccuggaauccgccaggggcccugguuucuuucagggggaaaugguaccuagaggccacagucuggggucuagagaugcucuuagcugcugagugguccuugguccugggccuuuccaggaaacagagauauuuaaguaaacgucauccuggaugcauacugauaguccucauucaaaugcagggauggaggauuuuugcguaaccucuucuaacuuacaucuguuuuuuuuuuuuuucucccaugccaaaaguuuccauuuuauucaacuuuuuuaauagguucaggagguacaagugcagguuugucacaaagguauauugcaugaugcugagguuuggaguacaaacgauccggucucccacguagugcgcacagcacccacagguaacuuuucaaaccuugcuccccuuccccccuccccacucuuguauuccccagugucucuuguucucaucauuauguccacauggauuugauguuuagcccucacuuauaauccaugagaccacgcaguauuugguuuucaguuucugcauuaauucacuuaggauaacgaccuccagcugcauccauguugcugcaaaggacaugauuuucacgucugcauaguauuccaugguguauauauaucacauuugcuuuauucgaucuaccauugacaggcaccugaguugacucaugucuuucugccaugaauguuuaggugcauaugucuuuuugguagaacgacuaauuuuucuuuggguauaaacucagcacacgggacugcuggaucgaaugguaguucaacucuugguucuuugggaaaucuccaaacugccuuccaugguggcuggacucauuuacacucccgucaacaggguguaaguguuccccuuucucuacugccucuccagcaucuguuguuuugagacuuuuuaaacaaaggccauucugacuggcgugagaugguaucucauugugacuuugauuugcauuucucugaugaucagugaugagcauuuuuucauguguuugacuguuuguaugucuucuuuuuaagaacugucuaccauaucuuuugcccacuuuuuguuuuuuuggguuuuuuuuuuuuuuuuuuuuuuuuuuugagaccgagucuugcucugucacccaggcuggagugcaguggcgugaucucggcuuacugcaagcuccgucuccuggguucacgccauucuccugccucagccucccgaguagcugggacuacaggcgcccacccccacgcccggcuaauuuuuuuuuuuuuuuuuuuuuuuuggauuuuuaguagagacaggguuucaccauguuagccaggauggucucgaucuccugaccuggugaucugcccaccuuggccucccaacgugcugggauuacaggcgugagccaccgcgcccggcccuuuugcccacuuuuuaaugggguuguuuuuuugcuuguugauuuguuaauucuuuguagacuuugaauauuaggccuuugucaguucaaaguuugcuaauauuuucucccauucuguagguuaucuguuuauucccuuggcagucucucuugcugugcagcagcucuuuaauuaggucccacuugugaauuuuuaguuuuguugcaauugcuuuugaggacuuauuagcuauauauuauuugccaaggccaauauugagaagacuauuuucuuccaggauuuuuucaguuuguaaucuaauguuuacaucuaaucuuuuuuaauuuuuuuuuuuuuguuuugagauagaguuuugcucuugucacccaggcuggagcgcaguggugcaaucuccugccucagcuucccggguagcugggaccacaggugcguaccaccacacccagcuaauuuuuguauuuuuaguagagaugggguuucaccaccuuggccaagcuggucucaaacuccugaccccaugauccacccaccuuggccucccaaagugcuaggauuacaggcaugagccacugugccuggccacgucuaaucugucuuuaauuuuuguauauggugauagauaggagucugacuucauuccucugcauauggggagccaguuaucccugugccauuauugaauaugaagucuuuuccccauggcauauuuuuguugauuuuauugaugaucagauggcuguagguguguggcuuuauuucugaguucucuauucuguuccauuggucuauaugucuauguaccaauaccaugcuguuuuggcuacuguagccuugaaguauaguuugaagucagguaaugugaugccucuggcuuaguuccuuuuuugcuauuucggcucuuuuuugguucuacaugaauguuagaauaguuuuuucuaauucuaugaaaaguggcauugguaguuugauaggaauagcauugaaucuguagauugcuuugggccguauggccauuuuaacaauauugauucuuccaacccaucagcauggaauguuuuuccauuucugucaucuaugauuucuuucagcaguguuuuguaacucuuguguagagaucuuucaccuccuugguuagauguauuccuggguauuuuauucuuuuugugucuauuauaaauggaauugcauucuugauuuggcucugaguuugaacaucauugguguauaagaaugcugcugauuggccaggcacgguggcucaagccugaaucccagcacuuugggaggccaaggcggguggaucacaaggucaggagaucaagaccauccuggcuaacacggugaaaccccgucucuacuaaaaaauacaaaaaauuagccgggcgugguggcagacgccuguugucccagcuacuugggaggcugaggcaggagaauggugugaaccugggaggcagagcuugcagugagccaagaucucaucacugcacuccagccugggugacagagugagacuccaucucaaaaaaaaaaaaaaagcugcugauuuuuguacauggauuuuguauccugagacuucacuuacaguuccagaaggcuuuuggcagacucuuuaggguuuucuagguauagaaucuuaucaucaucggugaagggagaugauuugaguuccucuuuuccuauuuggauccccuuuuauuucuuucucuugccugauuuuucugacuaggaccuccaguauuauuuugaauaggaguggugaaagugggcauccuugucuuguuccuauucuuaaggggaaugugucucgcuuuuacccauucaguaccacauuuaccauggguuugucauagauggcucuuauugagauauguuccuuugaugccuauuuuuguugaggguuuuuuaaugaagggaugaugaauuuuaucaaaaguuuuuuucuacaucuauugagaugaucauacgguuuuuguuuuuaauucuguuuacaugugaaucauauuuuguaaaaccuccauucuuggugauaccaacacaauuacuuaccuuaaccugcaauucccaugcagcacucuuagaauaauauaacaaauaguaucacaacaauuauguggccacugcaugcagcucuauuugucuucagcaguaacccgcuagaaauaugucaccugaaaucaguccuucugggugguuaagccacuaauucagcacacauuuuuaggcucauuuguuucauuucaauuuugagggacuacuuuuucugguuaagauuuauuuagggauuuuucaccaagcgauuacgaacagcuuuuuaaaaauuacgcaagcuauugauuuacauggcuucaaagugaaaucuauaaaaccagguacauucagaggcaucuugauuccauaugccaccuccccccccgccacccuuuugagguaaacuuuuaagauuuggaggcuuccauugcuuucguuuuuaauauacauccagacuugcauccuccccuuuaucagaugaagaauagcugcuauauuuuuauucacugugcuuuuucacuuaaaaagcauccugauacgccaggugugguggcucauaccuguaaucuaagcacuuugggaggcugaggugggaggacugcuugaggccaagauuucaagaccacccuugccaacacagcaagacccugccugaaaaaaauaauuaaauaaauccugauaaucacuucauaauaagagagaucuaugcauuccuuuuuuacagcugcauaauauuccacaaaucucugauucaaccagucuccuacaaugggcauuugcaguuuuccaaacaguacuuucacaagcagcccugcacacgcagcuucuccugccuuugccagugccuucagguagguucuggggaggggguugcugggucacaggucagugaagacaguuuugcuagauguugccaaaucccuuccucacagagucuacccucuugcaugccuaccagcaaaugccaaaggauuucugccagccagaagggaccucagugacauuuuccucgacaccccucucgccaggagugaaggcggcaccuucucacauguucaaggucccccugugggucacuguccugugagugguauucacaucuccugcuggcuguggguuuucuucuguuuucagaaacucuuucuguaguaaacagauuaacccuucgugaaacaucacaucuucccccagccuggcaauuggcuguuucccauuaagauuuuuuuuuuucccugagauggaauuucacucuuauugcccaggcuggagugcaacggcgugaucucggcucacugcaaccuccaccucccggguucaagugauucuccugccucagccucccaaguagcugggauuacaggcaugcaccaccacgcccggcuaauucuguauuuuuaguagagacaggguuucaccacguuggucaggcuggucucgaacucccgaccuaaggugauccgcccgccuuggccucccaaagugcugggauuacaggcgugagccaccgcacccagccaagguugcuucuuucuuauguggucaaacacauaaaucuccuccacgcaucuagcauucaagucauagaaaaguuucuucgcucucaggguaaagaauuccaggcgcuuucuuuagguacccaagugguuuucugacccacugggagucuauccuggugugugaugugacaagugggugcagucuggucacuuuccacauggccacccacccaccccgcagcacgcaugaagccgcccaucuguuccccacugguuggagaugcugccucuuuuacgaaacuucauauacaauggaguuacaugcgguuuuuaaaaagcuguuccauuggugaucugccugccuauaaggcaaugucaugcuguuuuaauuagcaaagcuguauguuuuauaauauuugagccauccuagccaagagcacagacgugacucuucacaagagaacagcuggagacgucacggaauagaaugccaagcccagggcccgucaagaucaaacgcuugaagcgcaugguucccggggcugcuuagauauagccagaggagguucccgccccgucuccagcugcuccccucuuuggggcaggguggggaugccucugggaggggucuaccccucucagucagagcuccuucugcucccuccucuaagcugcccgggcugcucugcguggaagucgaggacacagccccuggccccaggguggggugaggggucccagugcagcugggcugucuccaugcagaggagcauuccagggccgaagggaguacaggggugggggucccuguccagcugcucugccugugguuccugcuuucugaaucucuucaaaucucugccuggagcaaguucagccaggagccggggagagcuacucagagcacccuuucagugcgccccagaguaugauuuuggaaggcagcagagaaaggugugcaccuuagcagauauggagggaaagcuaagagcccccgcccccagggaaccugcacucucugggugagggcagccguagcucacccgcugccaggacgcaggcacagaccaaggcuuugagagccaacucucaaaggggacaguccucagggugcuuccugguggcaagugcuaggugggagugggggugcccauggauacaaacugggccugaggccaggaauagugcaccaccucacuugagaccacagcauccuaagggcuucugggcauccuaagggcuucuggguguccugagggcuuucuggguguggcaugagcaaaguggccaggccuaguugucucaucuguaaggcgacccaaauguccucaucugugaguggaggagcgaaauggggagcagagcccaggccccaggucccagagcgggcaggggccuguccuggagucagcuccccagcccggcucuuccaucaggagaaguuccugccagaggcggccaggcagaugccaacagacuccaggcggcucauccugagaguccggugccgaugagggagccacgacccuccugggagccuuucugcugguccauccacccagugccugggaccacagccagguccuuccagugcucagaacccuccaagggcaaugacagugccgaucccauggccccgagccucaauccucuaagacaggguucuccaaccccggguccguggccuguuagggagcaggccgcacagcagugagugagcgucaggugaaugugcacggccaccugagcucuaccuccuguuggaucagcgguggcauuagauucucacaggagcacaaauccuauugugaacugcgcacacaagggaucuagguugcacgcuucuuaugagaaucuaauaccugaugaucugagauggaacaguuucaucccaagaucaccacugcccggguggaaaaaucuuucuuccauaaaacaggucucugguacuaaaaagguuggggacugcugcucuacggggaacgguguuucugcagaagggcucaggcacccccuuggacccaccacccuuaaccuggauccuucuggaagcaccaugccugcucagauggaccccacacccugaaccaaacauuagaacuucccaggagauggucgagaagugggaagacaccugggucccaucauggaucuuccccaccuccagccagggccugcuccccagagagaagccccuccccagccagcacccacccacguggggcucccagaagagggcugggccaggcagcagaagccacacccuaucacauggucagaugccucguguaaaagcggcccccuggacuagggucacgcggcaucccuguggucacccagccaguaccagagacaccagccgccucccuuugucaaccacgauaauuuugcaucugugaggucugggguuucucauggugguuggaggagcugcuggagagagacagcuacccaccaggaagggguguggaggccaggacggucucaccgacgugcccgcagggaccccagaugcaagcagagcaugguguaggagcauccggggcuggagugacccacagugacagcaaucccauacuggccagccccaaggcaccucccgagagugaagccagacgcugccgcccuccccucuguaaccaaauccuuggggucugggucaaaguggcccaggauggugauauucauugccucauucuccccuccagcagcagauguugggcuucuggaagcuucucugcggcaucuccccgggccgacaccaugcucucccagcacuggccacacaccagcaacucgucuugggcaucugcugucucucagcucuuccugggccuggaauguucuccuggcaucaccgcccuugggagcugucuccucccacagaugccugagaugagauugucccagccuuguuguucuugcccguggacagagucuugaaucacagcaagauaucgcaggggccaaaagccaguuuggaaugucagggcuacggagggcucguccaccucccagacaaggcggguggaaugcagggaacugggggcccugccuagggccgagcaggggcucaggaccaggacgugugcaucugcaccuuggcuacagggaccgguggcauucccaucgcuggaaggcaugagcucccuggacccgcugcaucaggaccccugcgucaggaccagcucccuggacccgcugcccuguuaacagcaucccuaggacucgaggacgcuugcucgugugagcagcucuggaucacacuggcaaggacgucaagugcagaaggagcagacuugaaaccagccuagcagcaggaggggaauucucggcacccaacgccuuuaaaaacgggggcaucagccacccggguggaguugccuggcaaccccugucacucugacacccucggugggcacggugcuccugcccaucucagcugcccccaaaggcacucagcuccgcacagccuguuuccagcucuggagcacacauaggguggguuuggagcuguucacccuuccuguccucugcaagacgugccacaugccaggauggcacguggcagaacucauagcagcagcugacgugccagcucccuggcuccaaccaccugaccccgcacuggccggcccaaaagcaucccaggccuucaggcccagcggaaguucaucccaucgguacccaggaguguccccgcaaagccccucccucagacccggcccugugacacaacgcagcccgcacguuauaugcaaagguuccaguaccucgcaacugccaagcaaaaagggacccuccugcccccaguaccccaggguuguaggcucaagcugcgggcaccaugcccacagggagcuguggcuucagugccaggcacgggugaauguucccuccaaccgaggcacccugcacugaaggugccagcaccaggagccugccacagagaaugagacgcagacucagaaggcccaggacccuggccaaggcagcccagccacagggccaugcccagacacaaagcccugccaccugauccaugcccaccaggcacugcccaggccaccugcaaggacccaagucccuaccacccuccugauccccuguccccacacaggcuggggaggcccuuucucccaggcucuaggcucuugccaccuggacuacccccuccccagcugacggccagggguaagggaugccuguguuccccccaacuaguacgaagccacaguuaggcacucgacauguuggcaagagcggaucuagaaacacugggccgggucugcgauguaggugaggggaccccagacagccaggggaugagaccaagggcucaugccccacagaagguagcacugggaaaagccccaaaaggaauucccaguuuuccugggaaucuagggcugaggaguggguggacagaucuuaaagaagauggagagaaagagaccugauggcucagagagccccguccuccucugugcccagccccaccaccugccuuggccucuggccucccugcccagcugcagaacaacugcccagcagcugcuucagacuccaaugccagagccuggagauaggagggcacuggaguccacaaaguugggugcugcacccugagagcuggcucugcauggccuugucuuuuggggaggcagccagaucagccccauccaccucugggaccugcuucuggcuccauuguugauuaacacgcacccgcgaggguucugccaacaccccuggaaaguucuugggaaacagggaaagccaaggcuguaggagcggggaacaggggcugcugagccagacuuagguuugagagccuacaggggcagucuccaugcacugcagguccccccucaaaucccucuccuuggccacaaccaggaucuccaagcaucucagcaaccagaguagaugccaccuggauguccacaccccuggcuaaggcucacagcaagggagcuaggaccgcugggugcagcagggcuguauggacccccauccccucagcuaagaugggagcugcccccagugggggcgcaagcaaccacagauaacuggggguguugggggcaggaagccuaagcgggcaagaguuguggcccaggugccguguccaccccggccagcccagggaggccagaaggaacacaggaagagcugcucuccuggggaggggggguuccccgaggaggggacaggauauccuggcuggcuuccccaggcgcacacaggagaguucgcccuagcccuguagggucagcggaacaccggcuccugccucaaccccccugcacacaugccugggcccuggcucuucaaggccaggcuugucgucuucaggccagaaaccacaauauuucucauuucacaauccaccuaaggacagggcccugucuccgccaccauugccaagacuucuuacagcaacacaaggcuggacuggcgcaaggcuggaccugauuucgugaggcugcagguggccuccagcuacucugccauccugguucuaugaccaggucuccccucaagagacugguccugccaaccuccuagggcacugagggugggagcgcaucucccaggcccccaccaagccacauguccugcccagucaggguccaccuccagucccaccccacauggagguaccuggguuggaggcuguucaugacaacuucccagggccaggcacacgucuuacaaggacaggacccagaacuggaaaggaccagccccagaucuggccacuucacagaagcaucccuuuccuggccaccccuucacagaagccauccugccccuguccccagaagccaccccugccuugccagcucugcggaggcugggcgaagguagacucuugcugagcaaacuuccgagaccuaaacaauccaaaugaggaagaaaacacaagugcaagcagagacuuccucuggggcguggcgagcccucuuccuccucuuccuccacacggguggcugcagugagcccggaggcauguguccacaaaccugaauacaagugagaauugagggggucugcgggcacuuugccuuggccucuggcugaggaggucuucccacccuuggacaucucagagagucugggguccgggaggcagguggccaccagcacacagcaccugugaaccuggcaucugcuagacauuugcacaguggcaucggacuggguuccccuggggucacugcacacaaauaucucccaaaccccaagccgagcccccgcuguugcagccacgagcagagccagcuccucucacagaccagcagcggcuguggcucaggcacccacugacaugucaggagacaggggcuugggagcugggguggggaaaagucuccaagaucaccccccaaccacaucuuugaggagggagguggguaagacuuccccuuccugauguggaaggccaccucuuagcaaggaaggcaguagcccugcgaccccuaccccacccccucaccugagacgaugcuugaagccauuuggggccuggcuccugcugucacccgcccugaggcccugguggcagcugccagcaggcauggacaggccucuggaugcccuccagccaguucucuacugagccugcccgaggcagaggagaugcuuccaccugaggacgcucagggagaccacccuucagcccucaggugagccccacagccaucagccaugggaugucuggguagaggcucccaggccagaggcuggcaccacaccaaaaggccgcuggcugggcagccaggaaguagggccacuggggcagcgggggaaggccccaggcaggcauggaggagagcagccuggaccuucccggaggugacuucccaggccugucccugagaaauccagugcccagcccugcucaggcacgcuguaccgggaauuggaaccaccugguaacaggggggccaggugccucugcuaccagcgcugcuuucuccgggagcacagcugccucuuagugagagcugcaaacgugccucuccgcucucugcaucaagccagguuuucaugagcuugguucaauuaguuaauguggggcccguggggacggcccguggcaugcugagcccucagggagcaccgccaccgucaccuuccuauccuggacagcccccugccccagaguccaccugggccucagggggucugagaugcggcaccggacaucaggggccuucucucuugggggcuccugagccucgagucucagccgaccuugaggaguuaucuuacugcacccaagggugcgcuccccagcacgcuucucuucccagaaggauucacaccuggacuacccucccggagguguggagccaaauucugggcuccaggugguccccuccccagccggcucccuccccacgccgggccugcgagaagaugcgcacccccagacacagcagcgccucugaacuucaagggagagugcagaguuuguguuucugcguuuccccacuuccuucccuccucugcuccggggucgcagcuccgacggggcagguggcgcugggacagagcucccccacaccagcucucaggaagcaccuucgugccggccgucgccgguggcgauacucacacggcgaagugguaaacgaagcauuuccagccggugggacgcucgaggaaguuguagacgcggcccuggacgugggugcgcgccaacaccgggcggcgcgugcuguagauggagacgcgcgggucuaggcucaccggcggccgcgggccaaggucggaggcaacugggggcgcggcgggcgcggccggggacgcagggggcgcgggaccuggggcgccgggcgcgaugggcgcguagagcgcgccgcccgccgggccgcccuccgccagcuccagcgagaaggggcacuucuuggccaggcccgcgcugccccgccgggcgccuggcaggcggccccaaccccagcgcuuccucucggcccugggcggggaggaggccgcggccauaacgaggagggccugccggggggccggcccgagcggcggcaccgggagcugcagcgaaggcgagcgcccgggcgcagugcgggcagccacugcugccagccccgccgcggggggccgcugccggcccagcccgggcgcucggggcggggccggagggggcaguggccgagggccggucccaugggacggcgugccccgcccccgccugcacgccccgcccccgccgguccggcgcgcacagggcgucccugcccgcgcccaccggcuuggcccgcccucuccccacggaccggccuggcccugccuccgccucacccccuggcuuggccuguccgcgcccccgcccccgccugcgcccccgcccccacccccacccccgcccgagcccaccugcuuagccccgcucgugucaucuaucccgcuuggccccgcccccuccucgcccaccuguuuggccccguuccagugugcauuuaccccgccuggccccgcccccuccccgcccaccugcuuggccccgcccucacccaccugcuuggccccgccccgucugcaucuccccugcuugcuccugcccugcccucacccaccugcuuggcccccacuucugaugcccgccugcucugccuggcccggaggaggaccccagcugcgccagggaggaagggguaaggccuggccgauaccacgaccgagaacggcacagcgggggcaggaggggcgggguagggugccggcaucuacuuucccucccucugagccacuccggaguugggguuggggggaggaaagggauguccugggugagggugugcuggccccgcgaucacugugagcgcccccgggugcccaggcgcgcgagcugcgggcggcgaauacgcucgggucgcuucccaccagggcccuuggaccgggagggugagaugggaccaccacugucagguaccucccagugggagcuguguggguggggagccggcagggcugcuggggggugggggcggcacagccggggucuggaccugguuugacugccgggcauagcaggcggggcugccugggcaguuaaagggagaggcgcuugcgccacccuaguaacuuggagaaugggcgccuuguccuccccaccgucgagaccgcgcugccgcugcgccccguggauuccccuggguggggguggguuggucacaucggaagauuuucacaggucucugcacugccucccgcccgcuacuggcauuugggucucagcacgucucaggcuugggggggggguggggggcagccaacagaagagaccggcuuuuuucaggauacugcacacagcccugaggcagggacuaaagguggagcucagcggugacucuccgccccgccaggagacccauaacucaugugacacuuccaggucgucccugagcacccugggucaauuugauguaucuaccacccccugccaaaagucugcucuuuuaucguggacggaguccagcccaggcccuugacgccugacuccccacccuagugaggugccacacaggagugcacagucuguauuugcagcaagaguggauggagugggucccagcuugugcugggcgcugugauaacacaagggaggccgaggagaggguaccuuccugggaagcauaucagugaaggugcagaagggcagcgggucagaagaugggggcagucagucagcucugcagggcacacagcacgcauucagcaguuacuuuccgggugaacauacauacaccugcauggagucucugccuuccccucccaccucagcaggaggaaggugagcuuugaauaagcagcguuuggacaacuggacagucauaaagaaagaaaaagcauaccuuggguccaucucaccgcacacgagaauaaaucucaaaugaaucagaggcucaaguguaaagggugagaugaagccaugcaaauucuacaagaauguacaggucaauuccucaagaaccugugaaucgggaaaacauuuccaacuaugacuugaaauccaaaagcaacagauaaaauaagaaaaauuaaaauagaagcaccauuagcaaaguaaaggagacaaaugaccaaaugggaaaaguauuugcaguuucgaucacaaaggauuaauaucacugauacauaaagaacaucaaaacugaggugaggaaccugccagacaguccuauagaaaagggagcagaagacaugagcaguucauaggaaaugggguucaugaccuuugcacuuaugaaaaaauguucaaccucauuuauaacaagaaaaaugcaaaugaaaaguacacucugauaccacugcuugcuuaucagauuggcaaaaauccagacuuuugauggcaacucugugggagaggcagcaggcacaggugcacuccucaucacugguagaaaagagaccuagcgauauuacuaaauguaucauuugacacagaaaccccacuucuaggaaauaacccaaagauauguaggaaaaauagaaaaguacauauacauaaugauagucaaaacagcauuuuuuauauuagcaaaagucuagagacaaucacaauguccuucaaucgcuucagcugugcugugguacagucacacgauggagugccaugaucaauaugaucacuaauacucaaccaaaggaucccaaagaacucuguguguguguguguguguguguguguguguguguguguguguguaucaaagaaugaugcuaaauuccuuuggaaccaagauuuucaguauaaaagugauacagauuuaaaaaaucaaagaaguacaaaccaguccuuaaauugaauggacuauauuagcauagacuccucagcuauuuuaucuuaggaaaaagguauauccuacuauuguucauugucaaguuugagaaggggcugaucaacaaugggacaauuugagcaucagaaagagucauggaugaaaacacaucaaauagcugaaaagcccaugcauucaugauaauacugaaaaauccuauuugaucuucugcagguugcuuugcucauuauucugaaaacgagugaaaaggcagggcggucaggcaggucaagccuccauauuuuaaaaauucuaggccggaugcaguggcucacaccuguaaucccagcacuuugggaggccgaggcaggcugaucgcuugaggucaggaguuugagaccagccuggucaacaugguaaaaccccgccucuacugaaaauccaaaauuagcugggugugguggcacacaccuguaaucccaccuacucaggaggcugaggcaggagaaucacuuggacccgggaggcagaggcugcagugagcugagaucgcaccacugcacuccagccugggugacaagagcgaaacuccaucuaaaaaaaaaaaauucuaauaacucacuagggaggcuucuuggaggcccccagggcugucuccugggcccugagcugugccacagccugcugcucuggggguauggggucccauuggcuuggggacacugaggcaggagagagacuggacaagggauugucuucaagcucccugcaagcuccaaggagcugaagggggauggguggggaacugagaggagggaguaaggccaggugcgcaggugagguaagguggggcugggcugggcugggugugggcucaggugaggccaagggcugagggugggggaguaaggguggauggccugguaggacagacaauacaaguggggccugaccgagcccaguggccacucucugugugagcaaggaggugaggagggcccccaucagcugagggagcaggaccgcaggguuguagccucccagcugccaccugcucucuccaggacacacccuccacugaggaaagccccuccucuaucauuccggugggugcacauguccagcccuggcuguccuagaugcaaagacugacagaccuaucagccagcaugaacaggaaggcaacccucucccagccucucaggcucucaggcugucccagagccucagaaccuucuggaaacauggcacucaaucuaccucacaccaaccuuccagggcuguuugccgacaucccucagcucaccaggcucaccucauguuccuccagcagggucagaggcccacagugggaggagccucagaagucaccaagaaugcaugaggaauggggaagcugaggcugaccaagggaaggguguguggcugcugugagaucagcaucugcgggccagggcugggcugcuagaacagccaggccaccacaggcuuccuggccaacauccuccuucagguagucuuccuaccuauucauucauucaaucauucguucauucccccagauccucgcagagcaccggcugagugccaggcgcuguucuaggcgcagguuacagagcugucucaccaccagguaguggugggacaaaaaaaacgaagggggcacaggaugggggugcagauuguggaggguggucagcaagggucccaggggcgucuccacagagacccuggagcaggcccuucagcaaaucugggaggcauuugcuguuggaggaggacucugcaugcaggaggcacccaaugcagaauggaugggaggguaggagauggggcaggguggcuggacagagccaccacccuguauuccucaagcugaugugucucuccagaggauccuuaugccuggcgaaugucuccuauggauaugaugcccuacaucuguaaggcaucaccccauuuaaggcccugcuguucuuuuuuagauucagaggguaugugugcagguuuguuacauagguauauugcgugaugcugagguuugggguauggaugaucccaucacccagauagugacaaugguagccaauaguuuuucaacgcuugcucccccaccaucuaccaguccccagugucuauuguugucccucuaugucuaugagcacccaucauuuaguucccacuuucccacuuauaagugagaacaugugguauuugguuuuccguuccucaguuaauuugcuuaggauaaugguguccagcuggacccauguugcugcagaugacaugguuuuauucuuuuucauggcugcauaguauuccaugguguguauauaccacauuuucuuuacccagucuaccacuguugggcaccuuggguuaauuccaggucuuuguuauugugaauagugcugcgaugaacauggaagugcaggugucuuuuugguagaaugauuuuucuuuuguauauguauccaggaauuaauggaauugcugggucaaauggaacuucuguuuugaguucuuugggaaaucuccaaacugcuuuccacaguggcuggacuaauuuacauucccacccacaguguauaagcguucccuguucugcucacucuugccagcauguauuguuuuuugauauuuuaacaaaggccauucugacuggugugagaugguaucucacuaugguuuugauuugcauuucucuaaugauuagugauguugagcuuucuuuuauaugcuuguugaccgcauggaugucuuccuuugagaagcaucuguucaucuccuuugagcaauuuuuacgggguuauuuauuuuuuucuuguugaauuguuugaguuccuuauagauucuggauauuagaccuuugucagaugcauagaugcaaauauuuucucccauucuguagguugucuguuuacucuguugauaguuucuuuugcugugcagaagcucuuuagcuuaauuaggucccacuugucaauguauauuuuuguggcaauggcuuuugagaaauuaaucauaaauucuuucccagcgcugauguccagaaugguauuuccgauguuuucucuuaguagucuuauaguuugaggucucgcauuuaaaucuuuaauccaucuugugucacuugugcauauggugaaaauuagggguccaguuucauucuucugcauauggcaagccagcugucucagcaccauuuauugaauauggagucuuuuccccauuuccuauuuuuguugacuuuguugaagaucagauuacuguagguguguggcuuuacuucugggcucucuauucuguuccauuggucuaugugucuauuuuuguaccaguacuaugcugguuugguuauagucgccuugaacauuaguuugaagucagguaaugugaugccucuggcuuuguucuuuuugcuuaggauugccuuggcuauucuggcucuuuuuugguuccauaugaauuuuagaguaguuuuucuaauucugugaaaaaugacguugguaguuuaauaggaauagcgcuuaaucuguagauugcuuuggacaaugugaccaucuuaaugaugcugauucuuccuauccaugagcauggaauguguuuccauuugugucaucuguaauuuuuuuuuaagacagggucucacucugucacccaggcuggagugcagugacacaguccugguucacugcagccucaaccucccaggcuuaggugauccucccaccuuaaccgccccaguagcuaggacuacaggcauaugccaccaugccuggcuaauuuuuguauuuuuuuguagaguugggguuuucaccauauuggccaggcuggucucgaacuccuggauucaagugauccgcucgcuucagccucccaaaaugcuaggauuacuggugugagccacugcauccagccaauuucuuucaggaguguuucuccuuguggagaugcgucaucuccuggguuagauguauuccuagguaauuuuuuuguguggugagaguguacauccuugucuuauuccuauucuuaaggggaaugcuuuugccagcuuuugcccguucaauaugauguugacuguggguuugucauagacagcucuuauuauuuugagguauguuccuuugauggcuaguuuguugcagguuuuuaucaugaagggauguuuggauuuuuucaaagacuuuuucugaaucuauugagaggaccauaugguuuuuuuguucuguuuaugugacaaaccacauuuauugauuugcauauguugaaccaaccuugcaucccaggaaugaagucuauuugacuguggugaauuaauuuuuugauguguuucuggauuugguuugcuaguauuuguugaggauuuuuauauuuacguucaucagcaagccccuguucuugauccuaaccccacaggcgguuccugguucaucacugccucaccuauucccuaacuaccugcccccgcaugcucauaaagaccggucagcucagacccaccccuaccagcaggucugggaggggaccccagggcaguugccugggggcucuguaaacagccucuaaugcagacccaguacaguggggcugggucggccccaggaaucugcauuuuaguguacuccccucucuccugugcaggagacccugagguuuggaauguccugaggguccccaaguuugggcaccacagcaggacagagccagaacuagcucaggguccuucaguucugccuugacaugguccuuccugauugcaggcuaugucagauggucacuccacagucagcaccggcauugacugugccccacacacugcacaagaggccuugccuuccugaaucccacaguggugcaggacagacacaccuucauagagaaaggcaccccccacccagaagcagguccacaugcacacugaagccagggcuccccaccaaggcaauuuucucaccugugaaaucaggagauguaggagaugggugugucaugaccugucucccaauucacagcuuggguguaccccaccuccuccucuuccaagacgacaagcugggaaccagccagggaagacugaggcuguaugugugucugcccacaugugugcaaguauguguaggugugcaugugugaaagagccuuuuugucaccaugaaggaccuggggaucccccaucccuucuccuaagacaggcagccuuaaagcagcaggauccagcaggcugggaaaggugcacccaggacagaaagcaguggggcagaguagagagguggggagcuacacccugugggcucauggcugguggcggggcccucccugaaggucacacacccacacucacuccucccagcccaggacccagggucucggcccagugcccaggugggcgagcggggugcuucuggcugcguucacuuugaucugagguuaggucaucugaugucacugcagacucucugagcuggucucaugcucccuguucuggggaagcucccagauucccaccugggcccagcccaucuggcggaaaucacuuccggagacugcuccugacacagcaucgauucuuggaguugucggcaucaccuugugugggagguuggcuucagccaggagcacgggccccucugcugacccucccgucacuggccgccaagcuucccacccccagugggagugcuggggaccagccccacaaucuaaaggucugaggccuccccagcccuggcggggccccugcccagggcagcagccugccaccuacacacauagcccuuuccugggcccaggcaggccuguccgggacgugugacaggccagccccuccccucccuggagaguggugguggcuguccuagccacucagagaaggagggcaaaugggggugggcagccugucccuacauccuuccaggccaaggugggccacuacugaccagggcacucauccgucuugccagacugguacaaugguguggggggcucacccucugaagcccaccauggcccaucacgggcuggagcccagagcuggccccgagcugagaguggaugugagguggcggcugagcagaucacccaaaggcuggcaggguuugggcaauggggccaggagcugaaugggugaucaguaggggaggaggaggugggaugacucagccagccugccgggauuuauugggcaccuacugaauucccagccuugcuggguuacggugugggggaggucaggggagcggaaggugaggcuccuggccucgaggauagugaccucuucugggagauacgcuggcuggggagaaaccacgagaacugccuacgcucuuggggugcucuggccaaucccccauggcuaccugcugccuguuccccagagugugggcauccugagaccagagacugacucgccauccuggagagacuaggcacuguggagaaguuaguaaguggugaguggguaacuggagagaggagaaaacaggugggugaagugauggacagacggguagagagauggacagauggauggauggguggguggguggacagauggacaguuugauacauggauacacagauugguggauggauggauggauagauggacagauggacagaugcacauggacagauggaugaacagacagauggaugcauggauagauugguggauggguggauggauggauggauggauggauggauggauggauggacagacagauggacggauagauggaugaaucgacagacagacggguggauggauggacagacgaauggacagauggacggauggagggauggauugccaugggugcaugggugaaugacaggugggcaggcugguggaaggcuggauggcugggugggu

SEQ ID NO: 12627 - RNA, 25647 nt, Homo sapiens
cuguuuuuccaucuuccuuccugcucaccccaccaucaccguggccccaucuaguugaggcacacagcucugggcuuaaaggaaccaaggggcaugucucagagcagucuccaaauugggugcuaggacccaagaaaugcagagagggcaguggcugugagagagguuugcauaagaaaacagacaagacagaacuugguuuuaucuuuuuuuuuuuuuuuuuuuuuuugagacagaguucugcucuuguugcccaggccagagugcaaugguguggucugggcucacugcaaccucugccccccggguucaagcgauucuccugccucagccucccucucgaguagcugggauuacaggcgcccaccaccacacucagcuaauuuuuuuuuuuuuuuuuuuuguaauuuuaguagagacaggguuuugccaugguggccaggcuggucucgaacucuugaccucaggugaucugcccgccugagccacccaaaguacugggauuacaggcaugauccaccacgcauggccaguuuugccuuaaaaccacagcuagacuccuccacagggaccaggaccuaggccaugucuguccuggcugcagaggugggucagccccauacagugcucucuggaagagaaacagggagcagcguggcuccugcacagaggcaccuggcuggcccuuggccuacugguagccuccaaggguagaugccagguaucucaguccauuugugccacaguaacaaaauaccugagacugggugauuuauuuucuauuuuuuauuuauuuauuuauuuauuuauuuuugagaugggguuuugcucuugcugcccagauuggagugugauggcacgaucuuggcucacugcaaccucugccucccagguucaagcgauucuccugccucagccuccugacuagcugggauuacaggcaugugccaccacacccggcuaauuuuguauuuuuaguagagaugagguuucuccauguuugucaggcuggucucgaacuccugaccucagguaauccacccaccuuggcuucccaaagugcugggauuacaggugugagccacugcgccuggcuaauuuucuagguuuaguagagaugggguuucuccauguuggucaggcuggucuugaacuccugaccucaggugauccacgagacugggugauuuauaaauaacagaaauguauuucucaccguucuggaggcugggaaguccaagaucaaggugccagugcaaucagggucuggugagggcucucugcuuccaagauggcacuguguuguaagugaagcgaacgcuuugggaagccucuuuuauaaaagcuuuaaucucacucagagggaggaacccucaggcuuaaauaccuccuaaaggcccuauuucuuucucucuucuuuuuuuuuuuuuuuuuuuuuuugugagacacagucuugcucuguugcccaggcuggaauacagucguaccaucucagcucacugcaaccuccaccuccuggguucaagcaguucucccugccucagacuuccaaguaccuagguaacaggugcccaccaccaugcccaguuaauuuuuguauuuuuaguagagaugggguuucaccauguuggccaggcuggucucaaacuccugacgucaggugaucugcccacuucgaccucccaaagugcuaggauuacaggcgugagccacugugccuggcccuuuuuuuuuuuuuuuuuuuuuuuuuuugacaggaucuggcucucuggcucugucaaccaggcugugguacaguggcacggucauggcucacugcaaccuccaccucccaggcuugagugauccucccaucucagccuccugacuagcacgcaucaccacaccuggcuaauauuucuuuuuuuguagagaaaaguucucccuacauugcccaggcuggucugaaaauccugggcucaagcaauccacucaccucagccucccaaagugcugagaucacaggcuugagcuacugcgcccagcuucccacuuacauuaauacuaucacauuggccaguaaguuucagacacgaauucuggaggggacauagucaaacccagcaccaggucucagguguccuuacuucucccucugcaauuccggcuucaccacagcccucagguguaaggccuuguuguccagaccaugugcuuuuucccaggacugagagugaagugcugagguugcaugauaaaaacccaugugacuauaugaccauuaaagugaauagcccccagagcacugggcgguggggaccggggcucccuccuacacagacagaccaauuaaggucuuccaggccugcauguaggccaggcuacagggauggaaucagcacccagcuagagcagaagggucuaaaggaaccaaaagggguucugggacaaaucucaaaccaugggcaagcuucgcucaagcacucaaggaacauucgagcuagaugggcccucagagacucugauccuauguucuccuuucagugagggaaaauugaggcccagggaggcuucugcacccuagacaggccccacuccuuagagggaccagugaggggaagucagaccccagcaagacggaggaagucccaaauuggagacaaucagaaagacaacaccagugcagacccuaaaccaacaccccaccugcuccaagcugggcuccagucgccuaaggaugagcugggcccaugcaaacucccuguguguuuccugcaugugggccaccaggcaaccacccucuaacuugaaccccugcccacagaccccaguaccacccaaugguuggccaggggcacccccaaaggauuggaucaugccgaagguagccacaggcagaugacagugucaaagggaagggggauaagugguuuuuguucacgcagaccauaggagugaagguuguagcauucccaaauguaaguccgcguggcuaagaccacgggcagggcuccccagcuggccuggcucccagugucugugcauuaucgugugcgugugaggcauuuccacuuggauuacuauuucagcucccaaaaauggaucaguggcucacaggaggauccaggaagcagcaaauauugacccgucaggauuucaaggugaacgugggauguccccuacaugcagggaccguccaccaagugugacacuggacacaggauguccuggauuugucccaggugcauggucucuuaagacacuuggccagaugguggcgugaggccagcagugguuuugugucauuuucaagcaaagcccagggccuucccugggagcuagcauuguuauucuagaaugaguggaaagggacacuuuccagggcaaagcugaugugcaccacacugaagaugggaaagaacccacgcuguaucuuccuguccacauugcauuuguaagaaugaaacuugcgugaguugcacggaggaagaauuugcaguugggggaaugcagugucugggaucugcuuuuuuuguuguugguuuuuuucaauagagacagggucucgcuauguugcccaggcugaucuccaacuccugggcucaagcaguccuucuaccucaaucucccaaagugcugggauuacaggcaucacccacugugcucagccagggaucugcuuuaugaaacugcagaaaggaaaaaaaaguaaaaguggaggugggaaacagauugacaagauuggaaaaauguuaaugaugguugaaacuggcuggugauguacuauucuauugcuuuugaguauguuugcaaauuuccauaagaaugcuuuguaaggaaguagcagugauacuguuacauauugcugagaaaauguaaaaccaaauacaaaguuaacaaaaagagauaaauuauguacauauagacaauauaugcacacauacauacauguguuguguguauacauacacauuauguguacguguguaugucuauaacauauagacacauacauguuauguacacgcacauaaaagaaggcagaaaggcugugggcagauacccugaucaagaguuuuugugacaucaucacaguggccuugcagcccuuacucagggguccuugcugacaugaacucacagcagugugccucucaacuaggccugcaucuuucuaauuugcuagacaggaagccacuccuggcacuuggucaggucaaacacaagaaguguuugaugauuuuuuuuuaauucuguuaauuacugaaaauccaugcuagaggaaaaaaauuguuuuuauuuugaauuuacuuauuuauugagacagagucuugcucugcugcccaggcuggaaugcaguggugugaucacgacucacugcagacuugacuucccaggcucaagcaauccucccaucucagcccccaaguagcugggaccacagguacacgccaccacgcccagauaauuuuuauauuuuuuguagugacagggucucacuguauugccuaggcuggucucaaacuucugagcucaagugauccucacaccuuggccucccaaagugcugggauuauaggcuguuuugaauucagguaacaauugcuuguggguccugaaguaaacccccccaaacaugcuggcuaucaaucaaucaccaggguuggguucuguaagaaggguguuggggcaaagauggcugcaaacccuuugccacucaagcagaaaggaucccccugccaugaaucugggauggugucaguagcuugcuugaucaaucaaaugaggcagacaugaugcugcauagcuuccgaggccaggucucuagagcugcuccuaggccuccuggaacaccugcucuugaaacccagcugccaugccaugaggaagcccaagcaggccugcgaagggagccacaggcagcagcucccagggcuuugccaggcaugggagugggccauauuggaaguugauuccucaaccccaaucaaacuacucuagcugacaucccauaacacagagccaagcuauucugccaacuguuccccaauuucugauagaaucauagguauaaauaaaaccacuggguuuuuuuguuuguuuuuuuguuuuuuugagguggagucuugcucugucgcccaggcuggagugcaguggugcaaucucggcucacugcaagcuccggccuccuggguucaggccauucucagccucagccucccgaguagcugggacuacaggcgcccaccaccacgcccagcugauuuuuuguauuuuuuugguagagacgggguuucaccacguuagucaggaugguuucaauuuccugacuucguaauccucccaccucggccucccaaagugcuaggauuacaggcgugagccaccgcacccggcuaaaaccacuguuuuaaaccacaaaguguugggauaguuguuuacuuggcaggagaucaugagaacagguguaaucaugcuaacagaagaggagguaccggcugccuguccacacccgacuuuaugccucaguguugaacagcagaguaguggcugugauuuggggcagaagggaauggugaguacacacagcugucugacacuggagcaggcaagcccugccaagaaaguccugccccugagggcuuucaaguaacagcuaagaucagagcguuuucuuccuggcgccacuaggucaucagaggccauuuucauuuuuuaucccaaggggcuugcccauggagcagagcuuggugauauaaucaauaucucagcugccccugaaacaaccacuucaaggcuuaaauaacacaauuuuuaauuuucagaauaagcaauugcgauuuuuuuuuuuuuuuugagacggagucuugcuccgucgcccaggcuggagugcaguggugccaucuuggcucacugcaaccucugccucucggguucaagcgauucuccugccuuagccucccaaguagcugggauuacaggcacguaccaccaugucuggcuaauuuuuuguauuuuuauuagagacgggguuucaccguguuagccaggauggucuugaucuccugaccucgugaucugacugccucagccucccaaagugcugggaguacaggaaugagccaccucgcccagccacuuuuuuuuuuuuuuuuuuuuuuugagacagggucucgcucacacugucgcccaggcuggaguacaguggcacaacugaucauggcucacugcaaucuccgcuucccgagcucaagugauccuuccaucucagucccccagggagcugggaccacaggugcacacacaccaccaaagcuggcuaauuuuuaaaauuuuuuuacagauggagucuugcuauauugccccaagcuggucucaaacuccugggcucaagugauccucccaccucagccucccaaagugcuuugauuacaggcaugagcguccgcacccagccaggauuucuucaggaugcuagagugugggcagccagcuccaucucugagacuuugacccuuccccaaaucacaaucauuuuauuccuucaucaaagaaaaaaaagaugacuuacuagacaguuguuaaggcacucacauaaaacuacacgauagcaggauagaugguaaccaagagggaacucaggacccgucacuaccagcuggaaacaccugaccuccagccugcaaaugugacaagcuagaccaacaccagcaggacacugaacacagcuugcagggaugagucucugcgucauuucuggacauguguccaaguaaccagaacaacucaaaaugccaccaggcccuugcugucauucccauaaaccucgaacagugaguugggucuucaaggaaccugucucugucagcuuaccuuaugcugcauaacaaacaggcccaaagcucuuggcagcguacaucaagcauggaggaucucucacucaccacgacagucccuucgcuggagggcugggguuguacuccauuuucucuuuuggaaggggcggccccugucugaggucucauuugucucacagcagagggaugaaacggcaggacccuggcuuugacgggcuccauuuggcaaugguacaugccaagugggucacguuucacugcccagagcaaguuacauggccacgucugauauugacgugcgggaaaugcagaaucuuccugcauuuggggaggcagauauuuggacaacaugcaauucauuacagggccagcuggaugaagaacggccaagggcccaggcucuucaccccgagccaggccgaaccagccggggccgugagaucaagccacggucaucaguguucguuuggaauuaugccuuguccuugccguguccacauuguaguaggguuucuguuuuuuaauucaucugaaauugguggugggugugguacacagaugagaaacaggaacucuccacgcugggcuuuaacaggagcugcggugggaacacaaauggugcagccacuuuggaagauaguuugguggcuccuuacaaaacuaaauguacccuucacauaugauccgccacacaccauccagcaauuguaccccuugguauuugcccagaugagucaaaaacuugcauccacacaaaaacuugcacguggauguugauagcagcuuuauucauaauugcccaaaccuggaagccuucaggaggugaguggguaaacaaacuguggugccuccggucagcggaauauuauucagugcuaaaaagaaaugagcucaagucauggaaagacaugaaagaaccuuaaguauuauuaagucaaagaagccaaucugaaaaggcugaugcuguaugaguucacaucuaugacauuauagaaaaggcaaaacuacaaagacaguaaaaggaucagugguugcaggagcuagggaggagggagggaugaauagguggggcacagaggauuuuuagggcagugaaacuaccuuguaugauacuguaaugguggacacaggacaguaagcauuuguccaaacccguagaauguacggcacugagaacggacccuccuguaaccuauggacuucaguuaauaauauugaaccaaaaaauaacuaacaauaaaacagugcucuucagacaccauuaccugcuaugucaccugcugggagcuggaggaggggcuuccuagccccuccuguuuuaaaggcuaggcuggugcuuggcucagcucugucccacccccccacaccaaccaccuuuguaugcaccacagcccacuggagggguuuucugaugucaccaguggagaaagcgccugcagcagggacugcugucucucuauucauugcuaagucucuggugccuggaacaggggcuggcaugcuggagccucuuggaguguccacccaacccagugccucugcccucugccuggauggccacaguguccuucugguccccucacccccuucccucuugcuggcgcuccuccuuccucacccagcagcugagaugcuucuacuacucccugcuucagucccuccggggcuccccacugcuggcugacaaaauccaaucuuuggcaccaguccaucaggcccggggagguacaggagaccaguaggacagggcagggaagggggaggcccagcaggcacacccaaaagacacccuuacacugaaccacauguacgcccgugugccggccucacacacaccagcaggccaggcccaccaaggcccccuggcaccagcagccuccccugccuuaucucuccugccucacccugauccccuggcuccgacacauucacccuucucccucaucacuuucaucuggacugucuguagguuaacggagcaacugccugucuucccagcccaguccaggggacaggauagugcaaugguuuccaggcccggccccagagcaccccagcccaacaucccucugcccugccaaggucaggagugugaccucagguggauuacuccaugccucaguuuccucuucaaacaaggaaaacagugggaccugguugacgcugauccugcuuagcauaugccuggcacagagaaaagccauugcugugugccuggcgguccuggugucaucgcucauaugaugguuguggauccccaguggagcuggagcgugacucccacacggcagacccaugagugugcuggcugccagccggugccuguguuuucagcuuggaugaggccugggggccaggacgcacgcuccuaucugcucuuucccaacagcaugggugagaagagagcuuugcaaacagugccaucagguauuauuuccauggcuguccccacgugagaaucacagaacacagugcuggaaaaaacccuggacguuucucagcccagauggggaaaccgaggccccccagaaggaaaggcuagcuugccugggucacaugugcccagagucccacgugugacuagcagcccauggaggcugguggccugugcaucccugcagccagcuccugcccuggggagaaacuccuccugagaaauggcgcugggccucaccuucacguccccacaaaggccucacacugcuuuugagaaagcuacccuugagugacaagagggugcugggcaaccacauguccugugcccaagggccaggacugcaagaagcuaagcaagguaggagccccgccggccccagcugcagcaggaggccuggcagcagaugcagcuguggaugaugaggccccaacccagcagaucggucaccacaaacaguuaacucagguuacgcugugcacccacuaacugccugccaggcacccgguccagccuccucccagcccaaggcagaaggcacugccacccuccuuuaucucagaagggaaaaggcuuuguccuccucacacaggugaauguggagguuucuccccugugggagagguuggaaggccgaagccaggucuacaugggucuggucccucauuaccgucagcugagggucccuguugcugagccgaagcagcgagaccugccacucucaggucccgggggcauuucccggagucuggccccagcugggccucgaggccaggcccaucacccuccccgcccagcccuuccaggcagcuggggggagcucaguuaauuacaugucuaaauacaucucgaccaucucaaguugagccccccuuugucccugcccccgguggaggugggaggaggaagucagcaacugucacguagggccccguaaggguccaccaguucuuuucuucucccagcccaaggcaccagcaaaaauacugcuagccguucuguuuuugcuauuuuacaucacccuuuccauuguaagccauaauuuucagagguuuauaggucagcuauuaaaauaauaaacgucucuuuuacuaagagggagcgcuuugaaacucggggcugguaggguggacagugggggcgcacaggggugcacucagccucgacuucuuccaccaaagccugguuaucagaagccaccccuccccauguccuccugauuccagggcaccucccccuugugcucccauuucugccuccccucagaggcuucgaggcugccccuccuccacugcaggugugacuagaccuugaacacuuugagugucuuguggcaagaccuagggagacccuggcccacaaaaacaggagacccuggugcaaggccugaagaagucuggaggacuggcugugucuugguggagcccugcuccacacccuccaccucagcgcauccucaaacuagcaggggcuugagcccaucagcagagggguugcgggugguuuccuugaaacaagccugggucugggcagcaagucaggggcugugcucccugccuccuggggcuacaugaaguccaggcuugucuuucugcagccccgcaggugagaggugauaaaugcagggugcagugcaggccggccgccccuccugagauaaggggacuggagcaggugggugugggccaggcccagccaggagagaggcuuccccuuuuggauggacuggggaugcccacuuugggcugcucucuccugcguuccagcucuccagcuuuugggggugcaggagaagggagcuggaggcaggcacaagcacaaacagacuggaguugcagcauuuuucggccucuuuauuuagaacccggcggacgaggggccggggcagugguacagacggcucaggaaccauuuuaacagacuugucuucaaguuucagauaaacacagucauaauaagagagacagcgaaagcgcgaagagacugcaagcuagaugggcauguauggcagcuacagcuugugagugacccccuuccccagaguccgcgaugaaaauaaaguuacacuugucaauaaccagaugugggagauggagagugccuuuggcauaaccaauaaccgagcuagugcguggcagagcgguccacgccuggacauaaauagaaaauauaaguuaguauaacuuuaaaaacuuuuuguacaaauauacaugguuuuuuuauuuuuuccuuuuuuuuuucuuuuuucuuuuuuuugcacugaguuucagcagagauuaaacauuuuauauaaaugacucuuaaagcuuuacaccuugggaccaguguaccuucucgugcagaauacauuuagauauaaaaagacguuauuaauacauugcacaguuuucaaaauuuaaaaacaaaaccgaacgcugcucugcggcagccgccgccgguugcugcuacaugaacggucccagccgaggcccagcgcccuuccaacguccgcugccccggcagguucccucggggcucuuugggcucuaaacugcgaggagaggggcggucagcaaagccggcggggacccggcgggucggcccuccgcgcccccccaggugcgcuguacucacuuggcucaccgcagccucuugcgcggggucugcuccaccgagcccacgccaggggcggcgcuuggagagggacacggcgcggggacaucgcccgacgacuucucaggcgcugaucucuugcgcuuggcgaagaaaucugcgggcgacagcgcgcgcggccggucagggcggggccggcccggagacccgagagggggccgggagagggcgcggggcgcgggccggccggggugggggcgccguccccgcccgcgccgagguccgcggcgggucagcuuuguuuacgucgccgcgcaaugugcuguguaagcauuuccccuugucccgcggccaagccccccggggccgccgccgcgcuuaacccccuccacgccgugcucacggcgcccggccgcgcccggggaggggcucccgcggccgggggcgaaaacugcgcucccggggggucgcggccgggauucagccucccaccccgcccgcgcgaagccgcuggagggcacaacaacggggcggggagggggguaagggcgcagccgcgcccugagcgcugcgggcccuuuaaugccacgggaggaggcgggaacccagcgaggcccccgagggcuggggggaccggccggccggacaaagcggggccgggccgggccggggcggggccgugcggggcucaccggagaucagaggcccggacagcuucuugaucgccgcgccguuggcgcuggcggccgcggugccggccgcgggacgucccgaaauccccgagugcagcuggucagcgagaggcuccuggccgcgcugccccugguucgcgcccugcucggcgcucucuugaggcgccgcguccggggccggggccggggcgggggccggggccggggccggggccggggcuggggccggggccgcgacuggagccggggccggagccggagccggagccggggccggggccggggccaggaccgcgaccgcgaccggagccgcgaccggagccgcgaccggagccggagccggggccggggcuggagccaggaccgggacugggggcgggguggacgccggggccgggaccgggacacuaggcagcugcuccggcgccuccucgaggccgucgagggacucagcggccggcucgaggggcgggcugacagccaccgcgaccgcgacgggccgcggcgccagcagcaggcggcagcgccccaccugcaccgucucgcgguagaacgcgggcaccgagucgcuguccacuucgguccacugcaggcguccagggccccgcagcggcauguccugcuggaagucguaaucccagcgguucugguccucggcguucagcucggccaggcgggccugcagcucgcggcucagcuccucgugguccaccggcccgaagaggcugcggcaggcgcuggugcgcacuaguacugggaaggucccacgggcgacaagacgcuccaucguggaugugcugcggagggacgcgucggacauggcccggggcugcgcaaacgcgggcagcgagagaggagaggacagcgagaagaaggggaaaggagaggaggagagggcggaggccgggcgcaagggagaccccgcgccgcccgacucugcgugugcgagggacgcggcggcuaccuggcuguccggugguggacucuucugcgucggguucgccugucucguccggacggcagccgcgcccccucgaugccugcuggcuagcucgcucgcucaggccuggccggcaccccucgagcacagcgcacuuggccuguggaacgcccagcccgccugcgcccccuuuauacgcgcgggccccacccccgugcgcgcgggcccggccgcgauuagcauaauguaguauuuucaguuucaacaacaccacggcgauuggcggccgccccgcugccccgccccgccgcggcccggcccccgcgcaccgcccauuggccgcgcgcacacccaccgggggcggggcggggcgcgcggccggggcgcgcggcugauuggcggccgcggggcgagcgcgcuguagcaggggaagggggcggugagcggggcgggggcgggaguuaaagggcgcugcgggcgguaacgugacaccgcgacgcccgcccccucgccccauccccccugcaacacucccccacccccccggcucccgccccccgccggcuccuuugucugcaggcgggggccucagcccagcgcggcaggggccggcuccuggcggguccgguguccggccaggcccaacucgaccccggcccgguccggaccccggcgcccagcuccgucccgcgcucgcccgugggccuccugcgccagcugacgaggcuuggacccgccgcugccagcucggcccuggccugcgccggauggggucuucggcugcccccgcgcggccugcugcugcugggcuggugucccuucgagggcuccgcgcgccuggagcccucacacaccugcuggcccuaaggcccucgagucgggaggggggacaggggucagcuccacucuuuccccgagggaccaugugugggacaccuugagagacucccaccagcccccuggagcuggagucugaagccgcuaucugcggaggcccacccugcccaguagauggaacaggggcugagcccaucaugucacugucgggggucccagcccuucucagccuugggccagaccacuccagccccgggaucugccuguccaggcuggcuggaagcuguuguacuggguaaaagugaaagaucugcccgaggucauaggggaaggggcugugaaggaccaugccccucccccgccugcagcccuuccugguacagaccucggucgugcgcgcacgcacacacacacacacacacacacgcacgcacacacacggugcuucaccccagccaggccagaccaaaagagaccauuauuuccugcugccucccuuuuggcccaccuaccaugaggcagggagcccccuccucaaaccaggagccucccagaucgggauggggacugucagacaccuguuggaggguccagcagcccaugagaucuaagccccuaucucaggugagccugugagccagcagagagaccucugggagggagggaaggugcgguccccugaaccccaaccagccugccuuugagucccaagacacccccacccccauggaaugcuguggcagugugcagcugcagcugggggagcagggcgggucuucugggucucagggaagcgagaucugaagugaggggggugaacuggaugggacagggcguuaacccaggagaggggccagggccauucuuggcucuugaugguggaaccaaaagccaugauuuaugugcaauuucauauucuucucugugcacaauuuacaaauuucccgcaacaagcccagaugucacaauuuucaucuuaggaaaacaaagagaagcugaagaaggcuccccaggcccugcgaaccccucaagcagggcucauaucaacuggccugggggcagaaagaggcaaagucuagucugcuccaugccccuaugcugccaccuccccagagacuaggagcaaagggcuagaguggguagugaccuagaggcccccggauacccacacuccaaccaucaggacucauuggccuuggugacaccacucagaggguguagcugccaucauccuguguuauagaagagcagcagagaccgcgucagccgcugaggccgcacagcuggaaggaagcagggcucagaacucccgggcugccuggcuuucugguuugguuuccacuuagguuuccuacuuuuauuuuuccacuuuaccagcuuaauuacagagucaaacccagugcuguggggauuccuccgucuuggccucguuagaagcugagaggugaccugcucuaagucugucacucugaauucgaucaaagaugguacccaauagcauuuuaaaccugcacgucccaggagcggggcuguguccccccagcccaagccagggacacaccuggaggaaggcaccccaggagcugggggcugggaguuccaggcucugagaggaggcccaaugggcccagaagcaagcaaacaucugucuaggugcaacaaucaagcucuauuuuuguaauuaaaaauguauccaaagggaaaaaagaaacaaaaggaacaauauuuguacucuauguugcugcagagagcagaacugcggagggggugcuagucccaagggguggacugugcugugcuagugcccuaaauccugcaagcgcgggguugggggggcgggggagaccgcugucgggggucgugaguuccgggcccuugugugcauguucacguccugucauucuugcccccagcugagagagcaguagaggaaaggcacuacauccaccagccuuugcauucuccucggagcacacagaaagacauuuuccaguuaucuugcacacaagugggcggcgggacccguuuuggccgggaacguugucaggaacgcuguacaccacuuccaggcggucacguccgagcugcccaggcaguccuucugcgcccucugcuggccagauggaggcugcagacccugcggggccaucaggagagaaccaccaagcacccucugcacaccgcauugccuguguugggcacaaagaauaaacuuuuauugcaucuuaacccacuagaaauguaggcuuguccaucacaguggggcguuacauacccuaauacauagggaaggcauagguagauuucaguuggccuuuuacagacaaggaaaccaaggcuugagaagauucaaaccuuacugcagccauggcucacaccuauauacccucaguacuuugggagaccaaggcagguggcucgcuugagcccaggaguuccagacaagccugggcaacauagagaaaccccaucucuacgaauauuuuuuaaauuagcugggugugguggcacgugucuguggucccagcuacucgggaggcugaggugggaggauugcuugagcccaggagguugaggcuauagugagccgugaucgugccacuaccucuagccuggacgacagagcaagacgcccucuaaaaaaaaaaaagaagaagaagaagaagaaagaagaagaagaaaaagaaaaacuugcugcccaagcaguuaaggcaggauuaaccugcagcccucacugcugugcguuccuucuaggaaagacccagaagccagagaagccuaggucccaauccugguggaucuucgugcuggaaucguuaagccagcuguuucccaggggccacccaugggccaguccucaccacaaccucauggguggucggucaaugucguaggcccgcuuuacagccgaggagacagaggcuuccagaggcaaacacacugguccaugaguagcagaacgaggguaggcccaggaagccauguccuuggccacaugugcuuucuggcgggugaccuccacuccagugccuccccggcugcccgaggccuccccuucccggguguggcagcuguacagcugccuugucggcauguucauggccccaucaggaaugugugccgcagguggcuucacagggcuaggaaugcccguccuagguuaggcccaaucccuacccagagccccagggaacccaaauucugggacacaggacacccggccagugggccaauggccccuaucagggagugaccaaggacaggccgggagcucuucuuuccccucugacccauggugaaaccugccucgggccuguucccuggguucugaggcccugagcuaucugucuucaaacaaacgaaggccucaaagaauguuccauugagccaugggccccauaucacccaucaaucacaaagggcuggggauugcaggcacagggucaagguggguaggaggugagggcuggacaccaucugaaucugugcuguuccagggcccacuagagagucuccagguacccggagccugcccucagcaguaccacccucccacagcaccccagggacccugcaagaggugucugugcccuucccggcugccuccccagcugcuccccagguggugcccuguggagaggaccagagggauauuauaaacaaugacaacacuugcugccuucaucuugugccugcucagggcccugcccuaacccagggcugggcucguugccucauuuaauccuuccaagaccccugagagggagguguguucgugcccauuuugcaagggaggggacucaggcucccagagguuaagccaccugccugaggucacugagacuugagguuggcccugccuuucacccagccugagccccuccauaggacuucugugagggcacaagaaagcaggaaaagaaagaagucaagggcccugggaaucuccccugacaucucccaccccaagcccuagagccagggcugggcaucugugcaggguacaacccugcccagggaugccugacucuggaaaggccaccccuuuggccucaaaccacaucacccagcagcagguccucagaccagcccuggacaggagcuugacuggcugugcccccaaaggccccagagcucccugcccccacugagccuccaccuucccauccauaagaugggguggggagucauccagcccagaggccccaggggcauggggagugacagauuaacccaaggcccccccucccgcaacaggcggcucagcacacacuuggcggggggccaugcugggccaggagagcucccccgcaccaguuccccgcgcgcaaggcucgccccgccccccaggacaggcuguucuuggggcggcugccaggcacguccuccgcaggugccggccucccugcggugacguggccacaugcggcacaagcuccgauuacagggacugccuugugcuggggguuccggccagggguccucacuccccaggaaccgaugggcggagcugggcaggcccugaggagaggcccagugggaauagggaacagucaccccugcuccagaacgggaccaggggcugcuucccuuggggucuggaagagagggacccccuggucccagccugccugagacugcugguuucggcacugaauguuccaggaaaccgagggccacuggucaucgugggcuucacacggcgccuuucugggcuaggaagggggcucccgggcuaggaagcagguaccgaggagggucucaaggacauguggggaccuaugucagacaccccugcagccagcucugagcccaccaggccuuuccuccucucccugccaauccacaggacacagacacaggggucccaggcccaguggcucacuuuaucagggaaacagcaggaaaaacaaaucuggugugagcagaucucccuucccaccaagcccccugacuuccugcuggagcucggggagaccccugugaccagcaucuccugccuacggggggcgccagggccucaaagccucuccaagccacucccucccacccugcuuuccacacccaagccacagcguucagagaagcucagggccuauuugaaaugccagagaguggggaugccuccagagagguggcaugagggcccccagaugcaccccaccacucccuccuccacugcaggaggaggggccugcaguuacugaggaagccucaccccuacugggcccucgggggugaaggggcuucccaggccuugagggagacuguauuucagaugucaguuaaaagcgccugcuacauggcgugaccucucugaauccuauuacuuuccugugcaggaaacugaggcccagagagguggagugaccggccuagggucccccagcaagucagagacagugaagccaccuccugcccugggcuggggucccgccccacugaccuccagggucagagaaggaggggagcccccaacacuuaacuccuuccuucuuuccuucauuccuuccucccucccauucuccaccuccuccuggcugagcuuugaagccagggcaguuggccagaccgagcgcagaggccaggaggugacggcaggcuugcccuggcggccucccagguuaacacacucccagguggcugcaccccacaggcgagggcugcucagaguagaugcucaaccaagagguugcccgugcccccuuccccagccgcaggggcagccagaagccaagcagccucccgcccacuggagccuggagccugagggcugaagcugggcgccugcugcccccuggcgucccgaaacggcacagccaccaggacccccacccaccucauucaugccucacaccugggggugacuugggccagggccuugcucucuggccccgaguccccucaaguguaagaugggggcucugcccaguguggcuguccgggcugcagcgggcaggagcgcauuuuucacaaaccccaacaccccucggaucuggggguggggcggugucacucgcaccucagugggaaacagcacgugggccucgcccgucuccagggggugggggaggggagacaaagagcccgcucugcggagagguggguacccgcccugccgccccucccccauuuccucucugcucccccugccccuccuccccucccuccuccuuccuucccuccucauccccagcuccuccucuuccucuuccugcccuauccccccgcaggcccggccggcagcccggcgcccucugccuucguucccgccauuggcgcugcugcccggagccccuaggugacagccagccccgaggcugcagccucugugucgggccugcaccugcccaccgcguggucacugccugggcacguauggacacucacacccuucaguccugagcacaacugugcccuggcugcuucggaacaacaaggaaucauaguccugcuucuggcugggagcugggggccagcaaucagggcagcuggggaagugguuagggagguggcggcacacaggccgagcucagagagugagcagagaaugggcccaggggagggcgcuggagagggcugcagggcuuggggcugcagcucaggagcuggcuucaccuuggaggcuaucagaccugcuccucagcauuggcccagcaaggggaacaguauggggaacaggggacaggcacugccuggccagcagcaaacaaguaggcuguggaguugggcagagcaucugccucuuacuagcuguguguccuugggcaaguugcuuaaccucucugugccucuucuuucucaucuguaaagcuucugaugaggcuuaaagggcaagucaguaugugccuggcacagcggccuuccucuugaggaugccacuacccucaccaucaucagccucucccuccaaccuagaggggcaggcagggcagagagcugccacuggccaccccuccagcugugcuguaaugaaaacuggacauucacucuauacccagagaugugggcuggcggggaggaaaggcaccuacaccccugccauguaaacaggcaggcagggugaaagggguuugguuuguuuguuuguuuuuugagauggagucucacccugucgcccaggcuggagugcaguggcacgaucuuggcucacugcaaccuccgccucccagguucaagcaauucugccucagccucccaaguagcugggacuacaggcgccugccaccacaccuggcuaauuuuuguauuuuuaguagagacgggguuucaccauguuggccaagcuggucucaaacuccugaccucaugauccaccugccucagccucccaaagugcugggauuacagguaugagccaccgugccaagccuaggaugaaauguuaucuacaugaugagcaguuugggcagugaaccccaccuuugucagaguucaggacaguccaugggauacaggucacuccgacucucaugcaucagucuucacgccagcccugagugagcacugaggcacacgugccuagcacccagcaguggccccauccccuagcugcuggucaguaccagcugccacugcagcacacccuuucugccaggcagccucaugccaugcacuugaugugcaaaugaucuugucuaaucuucacaagcaucccgugaggcagggauuaacguuguccccauuucacagauggggaaacugaggcucaagaguuccagacccaggcaagcccuggucaguggugaagaugccagccugguggggcuggcugcagagugcugggcccugucauaagcacaggccucuggcacgcaugcugacugcuggggauuuuaagauuggggccccccugcugagcccuaucuacagcugcccccuucccuggguuaccccagguuuuaauuugaagcaguuagugaauugagcuuauguggggucuuauuuguauuugcuuuuggguuuuugcuuuuugggggaguuuuuggguuuuauugagauagagagucucacucuuuugcccaggcuggaguggagugguacaaucuuggcucacugcagccuccgccucccagguucacgauucucaugccucagccucucaaguagcugggauuacaggcaugcgccaccacacccagccaauuuuuuguauuuuuaguagagacaggguuuugccuuguuggcugggcuggucucaaacuccuggccucaagugaucugccagccucagccucccaaagugcugggauuacaagcaugagccaccucgcagggcccuguauuuggguauuagccauggcagccuggcagauguugcugagggugucugggcaccugggccugggcuuggcggccugagcagugccuccuccucaaaugucaaauugaggccuggacuaagggugucugauuuauggccucaccugucuguccguccauucagcaauaucucccugggaccucaggggcaacugugccuucaggggcuuccgggugggcaggcagaagcagaaauaaguauacaaggcaggguggugcccagguuguaugaugaaggaggggacgggggauuuucagggcaacgacuugugccaagauccaaggauggaagggaagagacguacaggcaaggggaccauuccaggcaggggacacaggcagagacccauccaaagaugagugcagggcagacagugcuugaagcuggagcucucuaucucucaugcuucuuugguuugcaaaauguggcaugauccagugggggcugaggggccagggcuccagggcuggcugccccaggaacacagcagugucaccagagguccagggugggaaccaccagaguuuuagaaacucacccagccauguccagggugccuggagcagggaagggaggcugcuacaccucacugagaugccaguguggcugcccccgguggaaaccaaauagccaggcucccugaagcugccagcaagucuaggggcagggaggacaggugagagcugagaggccuccaagggucagaaguaauugcauggguuuugcgacuucuccucuugcuucuuggaaauccuuccugcuucuuucuggauucccuacugaauucugaagguucuaaaagaccuggaggcugggcacuauggcuuaugccuguaauuccagugggaagaucacuugaggccaggaguucaagaccagcccaggcgacauagcaagaucuugucucuauaaaaaaaaaaauuuuuuuuuaauuagcuggguguggugguauucaucugcagucccagcuaccagggagacugaggcaggaggaucacuugaacccaggaguucaagguggcagugagcuaugaucacaccacugcacugcagccuggaugacagagcaagaccuugucuuaugaaaaauaaaauaaagagaacauggauguggguuggauggugagagcuuggggcuguccuuuguuccugggugggggaaagggacugggaccaaaggaggcugcgguugagggagacguguguaccuaagagaugggcaguagcuaagcuccaggcccucgggcaggugccuguggggggacagaggcacugguggccaugccacccauccugccugaguuucccaguucuggcuggugagcaggugugaggcugcucucucaggaccccguucggaggcacaucucuuccugaucccacgaugcccuucacaugcacacacaugcucacaugcacacauacacaugugcacacaccccaccacagcccuugccagccugggaccgccagcugcuggcuccucccccugccuccccggauggacauccguccuuugcaagggcuguucuuccuucuuccuucuuccugaguccugaggucgggcaaggcaucccucaagggaguccacagguugggcccaccaccccgcaguucccaguuccuaugccauugccuggcuaccuccccaaccuccaccaucgucccuuccugccuccaggucaaggaccggagagagucccucuggccuccaaggguccuaugaggggagggugacccaguuuguccggagcugucccaauuuuggcaugggaaguccuacaucccaaaacuccucagucccgagcaaaccaggucucccccaagcaaugagugagcuuccuagagcagggucccagcuccaccacccaucuccucuggucccuuggccugugguaugagaaaggggacgugggcuacuccagacuacacucucacugucccccaaaggccucaagggcuccagucuucaggccccacacuggacgccucccccaugcugccaucugggccuuuaucuccuucagcuguggcuguuggccagcgugaacacaaauacgugaaccacagcccaccauguuggagccccagguccaggcccacaguggagcccagugaggggagagugcucacccauccaggaccacaggacucuccccaaagcccauagcacguugcugcccucccuccauuuggacacuggugucagggacugggcccuuggcccuaagcccgucuggguucccugguucacuagaggccaguggagaagccccuguuggcagagccuccuccggggcccuggcccuaaaggccacaauuccacacaccucucaugggaugugucugagcccaaugcccagcccggcaagaaccagcccuggaugagguccagccccugccccuccuccuagaagucucugcccaaccuccaaucccagaagcgcauucagaguccaguucuagaagguuccucagcaccugacagcccacuuccucacgugcaccugcacagccggggccuagcagaugagagacagcaugggcaccaccaggccccccgcagggcuaccuggcaagccuagccccuuugggcugaaggcugaccccugggucccaaggauaccaggucagggggugaaggaccuuugaacccagccucccagacucuuaaccugacaccucccagaugaagccgaggccaggcacccagugcccacagcaggcugaaggccccucauaaggcugugauucccaagacaacacauacaaagccuggggugcugggacagagccccagcagggugucagacacagaucccacugugggauccaggcagcccccauugaccaaggucugcaaccgcaccucaccuggcugagaagguguaaggugggcgggaaccgagguucgggcgggcaggagucacauccaacccugccuccgcucuagucccgccccaggcaaaaccuuguuggcuuuauugagacag

SEQ ID NO: 12628 - RNA, 83889 nt, Homo sapiens
uuagccuccuaaaacucgggcuuucauccuucaacucucuugaguaaaauaagcauuuaguaucuuguaccucccacauauaacaguuuuaaaauucauaccagaggagacacauguguguacaagucaacagccuuauugaucccagagucuuaugagaagacauagcaugcacaggaaaacuucuaauacaaaaagagcaccugguauuaagugaaguuaccaugccaguuaagcaacuggcguaugaacucauuuaauucucacaauagcgugaggaggucgauguacuauucauaucucuauuuuacagaugaggaaagcacagagagguuaagcaacaugggcaagcuauuuaauaggaaggagcagagcuuuguacguuuugggaaaaauggguccaaaaauauaaauauuaaggcuauugauacauauuuggaaauuauuuuagaaaaagaaguggcucuucucgcauuccuaaaagauucuaauguucagauggggaaugaguguauagccuagucagcaaauauguacugauggcuguuuucuggaggcuuuuguuauaugaaugauggauauacuggaagguacugccaagaagcugcuucucugagaucuucguacagagacuaaugucacuaugagcauguaguucugggaucuagaccugcauugcuuuguauauuuaguaguggauugcauuuguacagcuuugcuggugugggcucuacuuuacuucuggagccaguggauuuuuaucaaguuaagcauuuuaccugcacuagcauuccauucuuuaccuaauuuaguuguguagcaaaccuguugagcaucacaguuguggauucuuuggcagaaguaaaaccaguuuauguuucaguaaaacuaacacugaaagcucuuucuauuccuauguccuuugagaguuugauucacaauuuccuuguuauugcuccuucauaaaacacugaguagaaaggaggcuucuuaggacagaggggacuuguuccuuuuuuauuuuuuaacaaaaaaaagaaccucugagaauccuguccccuacgauguggucaaaacuaagccaugguguggugugcccauauccauaaacuuguguaucuccauaccuaacaacacugcugggcucaagggaaaagaauacuguuuguggaaugaauccauugucacguagauaacccuaagcagggaaggcagcuuaugcuuccguaaggcuuagcaaagucuucucaugugagagcuagcaaauaauuugaagauccaaaauaucaggguccauuuugaaagcuggggcaauagcggaggggaugucgaaaguccuaguguauaaagggugggucacuugaggugcaguccaaaguccaugaauaaacagagguuaggggcagaggaaagaaggcaccugagguagccccuguuuuccuuauuugguuauuugucuguagcuaccccacccucauugcccuccccaccacacucccccaccucccaccaaaaaaaaggaagaauagaaacuuuugaacccauguggggauuucacaaucaugucuuuuuuucuugguaauguucugcuuugacauaauaacaaaucuguuuauguuugcaaaggauuagcuauggacccugcuucuggagcaaaacucagacaaggauuuaguaaaucuucuaaaaaagauuaacuccuagaagccagguaagaaaaaaaaaucaccgcuaauccagcuguugcugaccaguuaaugacuuuuaagagaauggaugcauaguaagcaaacugaagagacaucuggacaaacuccaaguuggguuaacaaaauguaugcucuugaaacugacucugcuguuaaacauacaguuuaaagaggauauucaguuuuugauucaugacuuaauaggaaaggggaaugaucccucacuuuugaccugaaagguuacugccuuuucccuuuuucuaagcaccuuacccucacaaagaauaguucccugagggugugaauuguuuguaaaauaauuaaaagucugaagaggccuauguuauuuagcauucucaauguggaaacaaugacauucuaaaguaaaugccucuucuuucugcuuucagacugccucccugaaacccaucagccuggaugguugcguacccgagaaugccaccuaaggggaaggaacgguagaugugaugucuguuuuuacacccuugauucuucuugaagcaucacuuagaacaaguaaaacuugcuucagauuuuuauuuacucccuuugaaguuuucaaaacaaaagcauuaaacacaucaaccuguauaaugcaugauucaaauucacuugaaguuuaauuggacauuugauggguuuuuaaagacaauguugcuuugauauuagaaccuuuuuaguagacuaguaauuggaauacuaacauuauuuacuuacuaggaaaaucuuucuuuaacuggcuucauuuuauauacuagcugugaaaucucaguuuugauauugguaucuaguaaguauuaaauuauagcuauuauauuuguuuuaaauguuuauguauauacuguguagaagugucugacacauaccaaucacacagaccauaucugggaggaaacacugaaguggaagagaaaagauuaccaaaaucuuccauccugugggaagaauguucucaguggccucaagccauuuauuuaucauggccaaaucagaagcuaucuaaucauuucuuuagcacugauuuauacagagcucuguugagaagugacucuucucuuugcagucuuuuuuuuuuuuuuuuuuuggacacaagaucucacucugucacccaggcugcaguggugcgaucuuggcucaagcaguaccucccaccucagccucccggguagcugggaccacaggcuugcgccaccacaaccggcuaauuuuuuauauuuuuuguggagaugggguuucacuguuggccaggcuagucuugaacucuugagcucaagccaucugccugccuuggccucccaaagugcugggauuacuggcaugagccacugugcccagccucuuugcaaucuuaagggucaauagaccucuuuuuguagagucaguuauacuuaauucauaauuuuaaauccaagaacuuuuucuuaaccucguaaaauuuuaauuagaacaauuaaaccauuucuuucuguccaaauuuaaguaggagaaucccagccuacccugacuuguaaugcggaauaucugaaauucuuaugaucuguauuuuggggacuaaacuccaaauguuauguucuguguucaggaaaaucaaguauguguuguggaacucacaggagacaguaguaagccauguaaaaguaucuguggaagcuucuauaaauggauaucaggagguuuuagcuuuccccuuuugcucugggagauugcuuucccucugagaacaaagaggggauaugggaacugacuuaaacguccccaagcaguggacuccuacuaacggaauaacuuacaucacuuugucucauuuccuccccgcggguuucauuguaguuuaaagacccaggucugucuggcagcugggucucauagauuaaauuuccuucucaguuccaauccuggguagcuguuugccccuuaaguggucaucaaucagcaucauuguuaaggacugugagugggucagguuuucucacauuugaccagugggcuucuuggauagacagacaaacucgucuucccuuucucuaccuauccccacccuauuuagcaguaaaacaaacagaaauaggccugucagauuuaaggggcauaauaccuugagaaaaucccaauaagaaauaaguacauuuauuucuaauuuggcuagaaauuaaugguaaacaccguuguaaaaguggaucaugguagcccagguuagacuaaacucugguggauaguauucugaucuauacauuagaaauaaauuaugucacauuauagaaugauuuaaauauugcauuuuuagaaauaauaagcucuuagugcugugaauuuaauggacgcauacaagcuuccaucuuaagucauaauuauuuuacucaaaaaaagugaaguuucuaauagaugcucaguagaggucaaaacagugguuucugugggggaaguaaugaccaggagggggcaugagggagccagguggagccggaaguguuuucugucuugaucugaguguauguaguucauguuguugacacagguggagcuguaugaaaaauuaaucaagccaaauugcaagauuugaaaaguuuauuauauguaagauauauguuuacggaaaagccucuaaaaacauaagacaauggagcuuuaaaaaagguuagguuuuacaucuuuaaaacucauuaauaagauaccaaauucaagagauuauaguuacauuguaaaacguaaucuucuuuuaauaaaagcuaauaaugacugaugaauuacaaaugcacuuauuuauuggugauuacaaacaauacuuaagaacuuaagcagcuugaguaguaguuuaagcuagacagagcaaagaaaauucuuguuuaauauauauauauuuuuaauuccaguaauauuuucuuaaauuccuguuaaaaauauaaucaauauuaaagucagcaaaaugccuuugacugacgccuggauuauuuuaccacuuaaccugguuacacagugauuuuuuuuuuuuuucugucagauguaacugacaaccaguuuagucuuucuuuaagauaaaugaagugauaacucacauugcagcaucuuguggaaaauauucaaacuacauuuaaaaugcuucuguaaaauggagaacucuauugcuccacaagaaaauguauauguaaaacuacagguuggcuaugguaauaguaacuaaacuacauccaacccugaagguagaaaaaucccugaaaagaaauacacagccuagucauaguauaucauauaaagguuauuuucuuauuuugaaaauucucccagauuuggagaaauccaaaccuuuccauaguucccuuacuaggcagugccacauaaaguuauuuaguuaacauuaugaucauggcuuacgauuaaauuccauaugacaaacacuuauauauagcagccgucauuuuggauguugguuaugacaauauuugcaguuugauuacagaacacgcguucauuaaauuugguacaaagcaugaacacucaggacagauuggcacaauacaugcaguucgagaauucucuuaucaucucaagccagucaucacugaauaagccauagucccagucucguuuuccaaaucuuucucauauuguaacugacauuuaaaaugcuucuuaaaacaucuuccagaauacgaaaaauacacuuuaaaaaucaauuaucugaaugcaugauggaaaugaggcaggauggcagagccagugccagcugagaacacaugagggauggggggcagggggagcuggcccaggcucacagugcccauggcaaguggggguucuugcugcugcugccccagacagcuuaaccuguggggcaaagauuccccaggccccagggcaagagugcuauucccaaagguauuuuggguagcaggagggggcagcugccagaagcccaacaggggggacagguccagagaggcagguauuguuagguucacagcaucugcaggcagcuccuugggcagguuuacuuuaccagcauuucccuuagccagaucaaaaccuggguugagcuuuugaggugacugaggcucuugcagaggcaaguccucaaacaaacugauauugcaaaaaccuuuaguaucugcuuugaggggcaggcuugcaaguggggaguaugagguagaagugguguuguacuugugauugggaagggguggcggaggagagccaggggauaccgagggguggagggaggccagggacucuggcagcggcugcauaggcugggcggcuuguucugggggacugagggugaggcuauggaccucagcuggcaagcuacuugcaagcccguucugggcagaagcuccuaaagggaaaggaggcaaggcagcagccuucaguuggaaugaaggcgagaugguguggaaggugcucagaaggucuccggucugcaagcucucuuucaucagcuccugugagugggucuucuugguaugccgggugaggugauccuugcgcccaaaucucugggcacagaacuggcacaggaaguccuugcauccuguguggaccaccagguggcgucgcacauccuuccggguguagaagcaucuuucacaguggucgcacuggugcuucuuuuccuugguuccgcuagggggcuucucuuccgcaugggcuuugaggugguccaguagcaccucggugcucccuagcuccagggcacagaccccacaggugagguccccacugcuggccgcauggagggccaggugccucuuauagcccagcaugguguuguacuucuucccacacuccucacacccaaaggccauuuuguuggggucgugggucuggaggugguuuuucagguggucuuuccgguugaacgucuucucacagugagcacacuggugagauuucuggggagaauggguagccauaugccuaggagcagaaggagaaauuucacaauagagaguuguuuuaagagcugaagaaagguguagcaacaauauuauaucaaaauguuaauaguuuucucugggucuugguauaauuuucaaaauucuuucauauauuuuccaaauauauaaacuuuuauaauuaagaaaagcaagcaauacuaaagccauaauacauuuuucacaccuauaaaacguuuuuugagacaggaucugacucuuuugcccaggcuggagugcaguggcacgaucauggcucacugcagccucaacguccugggcucaagcaaucuucccaccuuagccucucaaauagcugaacuacaggcacacaccaccaggccuggcuaauuuuuuuuuuuuuuuuuuugagacaaggucucacuauacccacgcuggucucaaacuccugggcucaagugauccucccgccuuggccuccaaaaguguugggauuacagacaagagucaccgugccuggccagaauauucuuaaagagaacauguuuuuuuaauguauacagauuucugaacaaaguaugcaaguacuuaaaaauaccugaccaugaaaaaucuuuuucaggaagggguuaaaggggucuuuuguacucuggaaauucaagugacucaauuugucugcuacccagaaccacauaaagccccaguuuuagguuauuguuccuaguuccuauguuucuguuguuugagacaaaaaguucaagccauggacauguaacucuuaggagccucuuaaaaaguccauccuuaaccucagaaaagugucuaauaggacccugaacaucagcccacugccuugcuuucagccucagccucugccugccgugagaucucaccacugucuugauuuccuucauucaaugcuugacuaucagcucuuaucucugaugcugcugccugucucuguuacuucaaauuuucccucuaagacaccuuugacuuacuucuuaaaggucacugguaauuuaauuggcaaaauucaaaaagacuuucuucuuuaaauaugaagcugcuacuucuaauaagaguuguaaguuugucuucaacaauggcuucagggacaagccguagucugucuagucaauuuggaauuucaaaauagcucuuuuauauuugugaagcagaaauuaguuauggaaagccaucacaauuccaucuuuuucauaguuccacugaauugcuaacaucuaaacucaccacuggcuuuuaaaaacucagugguauaaggaaacccugaguuugucauccuuaagcuuuaaaaagguucauuuuaauaacuaaaaugcagagcauuacauguuagcauguccuaugaaacagaauccuucauuacaacuuguagcuucauaucccucagggcagauaccuccuuuagggguuuugucacgagagguuaaagcuuguccuaacugacaauuuaagugcaguuguacccugugagcuuucacguuagauacagaagauuuucuaacaacucauuccguaaaagagauaggaucucuuuaagacaguauguuuaagucaaaaguauacuuaauuacaccuuucagccaacaucugcccuauacuguuuauuccugccccuuuuguggagccagaauuggggaggggucuacaauagcagccguugaguggaggcccccaccuagaggccaacuggaagccaguucaaaaaauauaaagcuaaucugaaucgaacugucauuuucuuaaaaauaaaguacaaccucauaccuccuuccucugucacaaaacaaacaaacaaaaacaaaaaaggccugcugugugcaucccuucccuucccuccaguacaccacagcuuguuugcacauaaaugauaacaugauggguaccguaaggcagggacaggaaccaauacgaugggcaucugagaaaccagauugugcugguguuuccacguucuaggucuaucuaaauaaaugcacagguuggagaaaggguuuuuagagcauguuagagggcaaauagccauguuguucugcaggauauccauauguauauauauauauaucgcaggaauacauaugaaggggggagcuggcuuacacacucaguauuuaaaccuuuuuuuuuuuuuuucuggcccaguacuggugaacaggaucccauagcucuugggucaguuugugccucucucuuuucuuucauuauagaggacuuucaucugauuugauuucauuuaucacccauggguagaucaauaccagguuaacgacugcaccugguuauuuccuacgcacucuuuccuguccuacaccuguacuaccuguaaguggggcacagucugacaccccaguaguacuugagcaagaccacugccuuccagacuucacuagcucccacauuucugaauuucuugacucuuucccuugccuggcaucuacuucuuucccuuuuaauuuaucccuuacuuacucaacaauccugaucuagaacauucucauccuauagcugaaauuacuucaacgacuuguuucuuucccucaguuuuucaucuuaccuuauaacccaugaaaacagcuuuaguauguccuagagucaguacccaaugccaccaucuuuggguaucaucuggaucaugucagugauuuuagaauuauuuagagguugauugcucacauuaggaccuccaaccuugccaaaucaucuuuucuugccuguuauugucucuaacugguuucauuauaugcuguacugggacccacauucuguuuucugguuaagcaagucaguuauuuuuuccuucaaccucuguugccucaucauccuuuuuuugagaugcagucccacccugucaccaggcugaagugcaguggcucgaugucagcucacugcaaccucugccucccggguucaagugauccuccuaccucagccucccgaguagcugggauuacaggcguguaccaccacgcccagcuaauuuuuuguauuuuuaguagagacgggguuucaccaugguggccaggauuaucucgaucuguugaccucaugauccacccaccucggccucccaaagugcugggauuacaggcaucaucuuuuuuuuaaaagcaaaaccgaaagcauccugccaucucacacucuuccaguccuuuacuauaucacugcuucaggcaagagaggcgagaggcaagaaaugcugggggcugaggcagggaaggcgguucuugcauaaaguacacugacagcuucccuuuuugccucucuuuacacccuuaacugaacaagccauuuuccuugcuaagaacaacuaccuucuaaacaugacuuaagacuucuuuuucagcgcaguuuaccauaguaaauuauuucucggaacaugcgggguacugauucuaccccugucauacccaaauacacauauacucagguccugcgguccacccuguggaccacauguguaugaaaagucagccuucgguauacacagguuucacacccugcaaauacuguacuuucaaucugcaucugguugaaaaauauuuguguauaagcggacccgugcagcucaaacucauguuguucaagggucaacuguaaucccaauaguucuacuccacuaauucuucuuuucuaaacauugaucucuucuaugugucucagucuuuaucugcaguuuuaguguccucacugugacucaguugcagccagcgcugcucucauguuuggguaaggacgcuuacccuccgcacacgcaagaagcuucaugcaaaacagggagccucugcaacaaacucaugcacgugaucagcauucaauacuucuacucgugacagcuagagggaggcccauguauagaagacauuugaauuuuaaaauauguaagcauuugcaggcuaauuuuuaaaaccaacuuauuacauuacauuauguauaacagugguauucuuaagggccaggagcauaauuuccaucuuuucaauucuuucaagugccuuccuccagggucacuccaagauuucauaauguggucuaugguaauaccagucagauggaaaaucucacuugcuaaagccuggcucucuccaggcguuuguaugugaacagucaaaguugaaacuucaaaguuuauuucaugaaauuaagggcaaauggugcauuucccuuaaccaaguaucaaaagcagcacgugugaguggacgcacuauguguguggcucugagugugcacagacacaacacacaccaugcucauuaccagucccaguaccgugcagcacagccacugcauguacauggagucuuuccugugauauuaaaaagauccacuggcggcagaaacgauaucuaauguauucauuucccucauggaaguagguaccuaacaggcacucaauaaauaacuuagacuaaauguaauuuuuuaaaaagacucaucugcuaaaacagugcuuuuuauccuuuggugugucaugggugccuuuaaaacugaucaaaugcacaugcugcucaucugcauacccaccugaacuccacuuacuaggguggcuuuccacccaaguugagaaacuguguuccaaacauuuaaacuuggagaugucuccuccuagcuuuacucucaggaccuggaucagcccccacauuucaucccuggacucugagagcagguuucaaaucagccuuccugccacuucuucaaauuauuaucugaguccucuuucuaggauacuaaacgaaucauauuucuucacuacuuauacaccugaaugagacaaacccucucagacagagguaaggccugcuauacguggcuuccuuccugccugcacuuuuagccucaucugcuccuccucggauaguacccucugcacaugggugcuuuaaggccaagacuuauggcuuucccagaaccuccucucugccuccuccucuuucauugugucacagcuuaaagauuguccccaucugagaagccgucccagguuucaucaggcagugaagaacaacuucuaccaccuguauagcucugucaaagcagugagguugcauuuuaauugucuuuuccuauuucuccagccauggggagaggccugguauauuguaggugcauaaaaaaucucuguugaaagaaugaacugacacugcacaacaagacggucacauaaaaccacaggaaucacuggaugcagauuucaagaaucccucaaaggcuaaaaugcauccauauccugugucccuuuccccuugcaucguguggucugagggcuagaaaagccauuuaaacguacuucuaaaagugcauaccuuugccaaagccucucaccucaucaauuuauaucuggaaacaaaggcuuugccacagucaggcugcacacacuuguacggccgcucccuggagugggaauaauugugaaucgugaacuucuccagggugaggaacgucuugccacauaacuggcaggggaacguggccaugggcuuugcuucucacaccuuccuuuucagaugugcugaccaaaugcugugccauuuaagcacaaacagaacgauggugcugggcacaucagcagagucccugcagcugaacuccagaccacgggagaggcagcaucgugggccugguucuacccagacauggaccucucagcugucacuagcuuugcuuccugcuuucacacaucccaguuuacaugcagucucaagcugaggggagaaagucugaggcacaggugcgauucaggagcagaaagguaaucugcaucacuauagcuggggcauguccugggucccccggauuggcuguggagagaagaggaacaguuuucuugcauuagccauuugaaaacaaugcuuuuccucccugaccgcuucagaaucaacuacccacaaucaacacguuccuuuaaauggugcucauggaacacaguucuccaugugagagggccaucugcauacaagucuacacuuuuggcuucucagagggugaggagucaagcacugauggccaguggagcacacuuucccucugguaaggagaguucuuuccacggauccaguauuaucuauuucaggucagugugaagcuccauugaccaaagagaaaaacaacaacaacaacaacaacaacaacaaacaaaaaccucccucccucaguguguucaaguguuuuuacugguccauaaacaaaaaucacccacacuuacucaaaccacgggcucuuccucaucacucauuguuggcauaacauuaguugcuuaucacaccuguuuaaacuuccagaggauaagaaauaauuuguauacaccuaagucaauuuguuuguaagauuacucugcagaagggcugauauaaacagaaugugcaugaagcuagucuagucuaguugcacugaugugguggcacaaagcugauagcucaggaaccagcccaggccacguucagauuuguaggcaccauccucuaguaaguucuacuaaucucuuccuuuuuuguuuauggaccuuucuucauucccuggcccuacccuggagggcccauccagcuaccugcugguaggccaccuccaggagaugggccuacugccuccucaaacccaacuugucucaaacccaaaucauuaucauccuucugacucagccagagucaccaaaaaccagguucuucuuuuucuaccaauuggccaucauuggaggaaccugaagugucugagccugcaucaugaacaauacuccacuuacuaggguggcuuuccacccaagcugagaaacuguguuccaaaaauuuacacuuggagaugucuccuccuagcuucacucucaggaccuggaccaaccccccacauuucaucccuggacucugacagcagguuucaaaucggccucuaccugccacuaccugccaggguaaagcccuggaucacuaccacccugugcuauucuagagagagauuuucaggugggcaaaugcucaccuuucaagugccaauacuuaaaaaaauuaagaguacuguaugcuuaggugaaguacacuugaguagcuuuuguccacaggccagcauuugcugaacuuugccaguaagcagggcacuucaugguaaacugaccaauugcagugagucuuuaaagcccucccugcuccuugcagucauuuauugccaugucucuagaguugcucuuuauuguuaaaaguuaauuuuuacuuaccuuuuugguuacuuucagaucagaaaguaugagucuaacuagaugaaacuuuauuguaauaacaguuuaaacauguuuaaauauagcauuauguagcacacggacauaaccaaacacauauuccuuuucuaaccagcaaaaauuccaggaaacuuguagaguuccucaucuucuguuguagauguuuucagugucuggacagaguucgcgguaccaagcaaauaccccucaccauccugccucacccacuuggaaacgugaaagcugacucgggcacuuuuggucagcgcuaauccaaaccaggggacacacaggaguccucggccagcaccuuggcaccacaccuucuuugugacggcugugauucuagcagcacacacaaccucugcaauuaugugugacuuuaacuaauuaccugucccggcucugcccaaaccccuuucccccaaccccugguucccuuccaguauucuaguucaugccugaggcccuaucuugaggaauccucaacagcccuggucacaaacaaaauaacuccuucuaggaauucuauuccgccugccgaguuugcucugcuagguaucaugaucuguucuacuucucacccagccuaaguuuggccauaauaccggcccagcuauaaaacacacucauucacuuagaauugcucuguguucuuucuagguuuauuaaaaaagacuaacacacacagaguaugaaguuugaaaaugcaucuuuuucucauucccuuuauagcugaacucaaaauagcacucgucccacucgccccuucagagaaggagcugcuuuguuggggaagguuuuacauuucucucaccuacuuaacacccugcauauacacuuuucucaacuuaucucaguaaguugauucuccccaauucuugcuuuaugagaugacuggcauguccaacagaacuuucugcaaugauggaaauguuacagaugugauggcuacugagcacucaaaaugugccucugagaaacugaaacuuuuacuuuauuuaacuuuaauuuaaauugccacauagugccaguggcugcuguccuggacggcacaggcagacucuugguauucccaucaaaggagaggaaggcaaggcugugcuuuccuuggacacaacugugcuacugauugagccucagguguuuacccugaagcuauaaauccaggcacuuguucugugaauccaguggaaagauuccccaguucaaauuccaacuuacccauguuaucugugucgaguuucaguuuccucauuugugauaguuaccugauguauguaaacaggcugcugggacaaucgacugagacaaaauggaucugaaagcacacuguaaccuaaauaaacacccuacaaauaggcaguauuuaugaaacacuggaauuaaaaguacuauagaaccaugugucaauguacagcucauguucuaaccauuuagcuauggauguaaugggaaagagacacauucucucccuauggauacuacaccauaucaauuauacuggaaagaaguggcaguguggacaacacacguguagaaaggacacaagagguggcaaguaaaacgccugcauucuuucucagcagauguaaaccuugacucauugcuuaccaaacacacuaggaguacaaagaaaaaaauaaagcuuauucaauugaaaaacuugcccuuuggcacugaaugagguuuuccagaucucuuuccagccacuucuucccaagauucaaaaggccagcagucauggacaucacccaugccuacauuuccccugagcccucaaagaugaaugggacaaucugagcauuagacauggccaugguuuaaaggugaggcacauuuccuccaacuucaaguuucccucaaagacuaaaacacaaagucucucguuuuuaugcuuauuucaugaauaucuuuucccaaggcuuugaguuccaggucuguguguuuaauauaccuagccuaauacuaauugcaaaguugguccucagaacuaaguuaguuauauaauagugaacauucuuuaauuucuucagagaguccuuaaugaacucaaauucauaauuuuuaaucaccguaacuauguauuucuuccauaugggccuuagaauacaaauauuuguuuucaugauauaauaauaaacuucuguaaaaacaagacugucuaccccaacagacuauaaacgcuuuguggcugagggucaaagcuuagcuauuaaaaaacgacaacaacaacaacaacaacuguggguauauacaacaucucucaucaccacgcacuugaucaguucaaaggcuguuuacugaugaguccaaucuuugguugaaacccaaugcacuuucuggccacauccuuaaaacaauuuaugacaacuuucuauuaucuggcaggccaccaacgauccuaacagaacuuacagagcaaugguccugaugcgagucauucuguucugugacuugacauagaaauugcauuugagucuuaaauacggugcuauuucaacaccugucacccuagaaagauaguaagucuuaccccaaaacaucucaggacauaauuuucaguccccuugauucuaaaaauacugagugauacagaucugccaguaugccaaagaaggcuugugccaucugcuucguucugcucauguugauuauuuuggggaugagagaggaucagacgggaagaagaacauauauauaugguaacagccaggaaagacuguguucccaggggacagggguauacgaggguggaggggggagucagaacacaacuguaguuccaggacuucuccagugcuacauaacacaucaucuaauggggcacaacugcuuuacaacauucuuaaaauaaacugugacuucuggcaucuauuuccauuguccucagugacacaaucaaugcaaggcccauuucugagaggaaagugaauuuccacuuuuggucuuccaacaaggguguuuuucucaauaucaguucuuugaaggacuuugguagcagucucuaucaaauuuaaaaaagcuauuuagaaaugucaucaggagaaagaugauauccagaaccuccagguagucauggcugccauggcugcagaccucacucccaucauggccggaaggcaaggccaaggaucacuccacuugcuguuuccuuaaagugcuacuuucucucacgcuucuggcuuucucccuccuggaauguccugggaacccuugucuaccuggcaaacuucuacuuuucucugucacugccaggcagaggcacgaguuccuccuccacacggugagguguuuacucaauggcccaguagagaucuccaccuuaauauguuugaagagcuuucacucuaguuuauccucauuguaggaagcacuaccugcccuucuauucugcucugagagagccaccugcugagccaucagguuuguugccuauagauucuuuucagcugucaccuugaaagacugaauuuuguuaacccagugacuaagcucuuacuuucuaagaaaugaggcuuaagauaaacaagaaagacaaagugaauuauuucucuaauauucagggaaaaaauugagaaagcuguccagaugauuaugcuacagcuuuggaacaucaaauccacauccuagccagaacaucugaaaagggacaggguguguucuguuuacaaauaguguaauauuugguuaaagauggccaacugaauaaaagcauguagcuccagucucucugaaaauucuacuaaaacaguaauagugggauuuuucuaaaacacagccuaauauaaaagggagaaaacaacaaauuuuggaagcugaaaagcagguaaacaagcagugaucgacuuggccauccuaagaaagcuaaaguuuaagccagcauuaagaggcaacaaaacaaccugcuauacccugaagcaucuaccauaugucucugcaauuugguacaguagguacuucuggaagugaggauggaaacagguaugaaagcagcaggugaaagucuguuagugaagcacugagcccuccugaccucuccugaugccugcaguggggugccugcccuuccuuccccuagcacaagugcucgcuauggagacuguaugaaagugggggaguagccugacacagggugaauguccucucucucagggcaggaggauggaggagucuucccugggaagcugaccagcccaagagaaaagagcaaaccauaaggacaaaggggguuuccuccaggggucgccaccuuacccuauacaaggccccagcugacaagccccaccuaaguauacaaagcucccaucagcucuuuacuggcuugacucacaaauuaguaggccaaggaucaccagaaaucagaggaaggcacuuaauagggaaaacugacacaaaaaguaacggggaaaaaaagacuacggggggaaggaaacuucaaaaauaauaaucauuaauauccuagagagaacagagguccuuaaaagaagagcaggauauuauuuuuuaaagaggacaacaccaacaaaaaggcaguggcagugcaagaccccaggggcugggacaggcauuugagucaaacuugcaaggggaacacuugagaacccagagagcaucugagagucaacaccaugaggcagccucuuauaacucagcuaauauaauccagagacuaacauucauugacuaaaugguuaaaauauguaucauuucaccaagaaacaugaaaggagaggagaugauuuuuaaacuaacaaaacagaguauacuaucuucaucacaugacaaaguuaccuauuaucauugcuugcaugaaacauucauguauuagaagucauggauaauacgauacaguaagacaauaaacuaaugaaaggcauaaaauuggaauggaauaauuauuuauuugcagaggaaugucgauauagaaaaucccaaagaauccacacacaagauuagaaagccuggcaagguguuugauuauaaaaaucaaacuacacaaacagcugcauuucuaaauauccacaaacagaaauauaguuuaaauaccaucauauuagccagaaaauaaagacagguaacuagugcccagccaaagggaaagagacaauaugcaagacuggaaucauggacaggauauauucaaagauguguuuccucaggaaugaauggacagaauacaauuacauugcucuauaaugacauaugcaugaaaacagauaaauagaagugaaaaucauuacuaaaacuugagguggugguugucuaggcagugaccaucucuugcuugggagaucaagaaaggugucacagagaaguaaaaguugaagcuagcguagaaguuuacaacguguucaagagggagguggucuauuucaggccaagggaaugaauccaaccaccuggagaauaagugguucaguaagacuggaauacaggugcagaugugggcaaaggagaaaacaggcuagagagauggagaaucgugaaggguccacucuacaaggggaaggugggcuuuuuugucauaaauuguuuuuagcagauugaucuauuuagucaaguccagccacaaacucuugaauuuauguggagaugcagugaggagggcgggaagagaagagguagaaauagguagagaaugccaauaaaaugcugugaggaaugggaagaggcaguggggaaagccucagccugugauugugagccucaaagggccacagaaaacugacaaaaccaaacuaccaaggggaaaggacgacccaggcgcucaccaccagggagcugggcaauggggaccgaucagaagcaguggacuugccaccagauuucacuuuuugaugguaacucuggcagggacguauaagacaugcuggaggguggugggcuggauaaugagaucauuuaggcuucugccagaucucagaagagagaacacaggccugcacaaggagagagggcagguuccagugacacucuguaaacagaauaacuggauuaggacugagguuaggggaaagagggaauggugguggcagagagagguuuucuucugcaucccagaagaaaaacucagcaaaaaauaagcguuaggaguucauuuuuagacaugcugggcuuaauggugccuaaugggcauucgggccagcaaggagacgugaagcguggaguggcucaggagcucuucuagucuagggaagcggaugccuuucugaaccuaacuuauacaggcgauuuuauaaguuacucugagcuuuccauggguggccucauauccugucagugacucacguguucaaccuugaucaccaauguuuuccuccuagagugguuuggucaagugggcuagcccuggggguaaggaggaauuuguuuucuuuauggcaggcugcagcuagacugagacucccuuaggucaucuacucugcacuguagcccggauggaagcagccuugugggggcauggaauucucagagcuccaaagacagaagcagccuucugccucaaaauccccccagcuccucuuggauaagauggucuacugauaggccuauggugauaaaaaugagcaaaaugagaauuaagucugaguucaaaaacuugauguugguaaauaacuucuagauggugauaguacaaacaagauccuaauaaacaaacaaacaaacaaacccaaaacaaaaaucuuuugguuaucucuucuacuagaagaagguaggcuuuuuauagaugggagcuuuucuuugcuauauuuagcagauugaagauaucuaaccuauugagucaagccuagccccugacugcaucuacauggagauggagugaggugguagagguagaggaugccaauaaaacguucucaacugaaacaggaagaaguccagagaagcuauggaaaaggcaaaagccaaugaaugugagccuuggagagccacagaggacugagagaugcugaacuaccaagggggaagggaugacucugaugagcagggagcugggaucugucaccccagaagugcuucaucucucacaggucuggggccccuuccaccacuggccuuccucauccauauagcacggaagcaaggggcugggacagccaggauccccacgaaagggccaaaggccuucuuccagaugggucauccaguauaguacccaccagggggaacggaggaaaagaaauauuguugcagacucuuggaucuuugacaggccuccucaccucuccccaccauaugcauuguauuuuuaaauagaaacagucacaaaaaaauagacaaaugucuacaaguaaaauagaugugugcauugagaaaggcaaggguuaaguccaggccugguucucaagcugagaugggacugccuuguuugaagaggacuauuuaugaaugaagacucucaggagucuggugggggggugagggguggagagcaacucccaaaauccagacaagagccuuugguauuaggggaagauuuucuaauuguuacagucaggaauggggaucauuccuuuaugauagcugaaaauacaucccccuccucacucccuagaaacccuugagucucgccuuuaggcccuuuuagggucugcuucuauagcugauggcggugaucucuuuuccugggacucuuaaguguaggacauggaggaaccagaacucuaauuagcagcaggaccuauuauuuuuccaauaagguuaacauucaagggaaagaaaagccucuuucuuucucaggaagugugugaggauauaggcucacauugagaagagaaaugugaaaagcauauuaguuacauugaccaugggaugccugguuugugagugaaaaucaccggaaugaccuugaaggaucugagaucuagaaaggaugcucaagacuuggguggacuguuugauccuaaaauaacauaucacuaaauaaacagaaaaaggccuugaaguacagauaacuacaugggagcaggguaucuugacacuggauuuauagaugaccucauuguuuauuuuuugaauaucugcacuuucuaaaguuugauaaugacuacuuaggcugagucuaggaguauacccgguugacaaauggaggaggcauauugcagaggcagaggggagaacagagaagagcucggagucaugaagcagcauagggcaauguggaacacguggugcagccuggcugggaugggcaggagaggggccugugucagaaaaccaauaacagggauagugcaccuggcaggggacacuggguuuauccuacagggaacugggagccagugaaagugaggaugucccaucuacagaugaauugcagagaggaaaaaguuacauauaaucacuuaucccucccccauggguaacucaguuaccuggagagaacagcagauugaaagguacuguucugaaaugcuaacugguucuuuuuacaugagaugaacccaagaccaaaucggauuacccuagacacaaauuugaugggcaguuuuaaaguaacgugcaguaacuuuucaagcucgauguagaaauauccagaacuuauaguaaacuguguacaugcaugguuaugugagaaaagugaagcugcugcaccuguucccaagcucacuccacuuccuccagaagcaugccugucugccucucgggacacaggccguacuuuauuagacacaauuauuucaagaagcuugagaauuuucucuuugccuuuccaugucauguccaauaaauucaaaggaugcaaagcaaauuguucauccaggaauaguuaauuugagaaauaaaaauauuuaucacugguccuuuaagauuauccugauucuugauuuuuucuuuuuaaacugauuaacauuucaucagguuuccauuuuaaaagaaaauggcacugaagagacaaggcaaguuuuccaagcgacaacacuggcuuuucugaaaggggaaaggaauguuaaggaaaugggggagaaagcuuaaaaagaguggaacacuagcaagcagggccucuucuccuuuucaccuuaagucuuuuuucucucccauucacagcuuuagguccuuuguuuguuuaacaaaccauuacaaucauacccaguucaaugggggaggaaugugaacucucugaguagcuguccuugcaauccacaugugugguccaucccccagcucauccgcaggcagcuuucaugugcugcucugcgcuccccgucgccccggaggccggcaccuugcucacaauaagccucaauuucccaccgcugccugcucgcagcuccuccccagcagcugagagcaaugucucaaguggcucuuccuccccugcuugccuugcaaucauacuguccacccugcuuuggcuggcccccuucagcuccugagacagacaaggccugcuguguuagccacaccccaccuguucgcagcccauggacucgccacugaauacuucggcagacacauuccaggaucuuccuggcuagcacuccuagucuucuaaugucaggcacacuguaaacagaagauacaggcaagacgcucccccaccccaccccaacucccagcccuaacuagaacugcuagguccuaguagauauguuggcccuguugggauuaauuucaauuucuuggucaauaaauccaaauauuuagugacaauauuguauuucaguaggagucggaauacuauuuaauaaacuauuucaguugagcucauaaagcucucucaugcuauuccaauaauuuccaucucauagcccuaagagauagguagaagggcaucauuguccccauuucacaaaugaggaaacugaggcucagaggauuuaaguuuacugcccaucagcauggacuaaugacauacugcaaguaauacacuguccuaagcaaaacgccuagcacagagugagugccccaaaggcauuagcuucuauuaauaucauuacuggugaugaugauaaugaugaugaacagagguugcucccagguguucugaacuaagccaagugcucuuucaaccuacgcuuugccaucccuucuagccacacugucuacaugagcagugaaguucagcaacugcuuuacaacagcguuuucaaauaaagccucaggaaguauggcuggauugccucauguggcugggaugcgaccagcaucuuucccaggcuuaucuuucagucgacaucugccacaaagacaggacaaccucuuacacaucuuauguacacaaguuaggaguguuggcaggggcagcuuucuucuuuugaacugacaggguugucagcagaaaauuccauagaucuauguguauuacuaggcuguggaugugggacagcagaggucaugaaaaguugcuaacugcaucauccaauucccugaaacacaugugcacugagcuuuaaaaaaugaaagggcuaaaagaacccuguucucggguauucugcaguuuguggaggaaauguguuuauuuuccacuagaaccuuuuugaaguacccugaaccuccagcauguucuugccuaugauguguuuccaagcaaucguuaauaaacaugcccaacuagaaauaaucuuaaaacaugcgcaccuacugagugacagggaacaucugcugcgaggcagggaccgaguccucccagaaguuugucugaagauucaaaccugugagaagagaccuuguacaucgucagggaaugaagcuaggaaaacauuccuccauuauguuacccccugaacuucacuucuagagcacacacacgacuggcgaugugcacaggagauuuucuaguguuuuuucaugcauuuuaauagaugaucuuuaaacacucauauccuuuguccuacuugcaacuggauuaagaaaaacucucaacuuuuccccugcuuuaugcaaguggaaaaaaaagaacacacaaaauugcuuacauaauauauucagaacagcacucagaggaaaugguauuuuuuaaaaccaacaguauuaaaauaccauaaaacagguaugcaaaucuaugcaauaacagaaccuaaaacaaauucugaauugaaagaaagucagcaaauaaccaguuggcacucaacaaaggagauucauauaaacaaagauuuaucaaauuugcagugcaagaagguugaagucucuaaguugaauacugaauuaaaugguuacuaaaccuggcuaugcauuagaaucagcauggaaaacuuuuaaaaauacagauuccuggguggccacagggcaaaucaguacagacuaaaacagcaucacugggaccccaggaauuuacguuuuuaccaaaucuacagaagccaagucuacagccagcuuugugccacugaacccugaugagcauuuggaaaccagcauuuccguucaccaaguaauuaucaaacuuggcuucuuccuaccaaggcuauuccaaccaacugauccucuuacagggaaagcuuuucaggauuuucuuaacuaguacaaaggcaaaucugcuauggaacaaagccaauuuauaucucgccuaagugauuuauucacuugccuauuuucuucugugaauuugaucaaaaaggcuauguccauuuauuuuguaugagaacauccuuuuaaguuaaaaauggaaaaaccaaggccauuuugggacaacuguuuuuaacguuaaugcaucacaauacaggaaaauacuggaggugagcagguuauuugccugagucauuuagggaaauuguuuccaacauauuccuuguuuugcuuguauaaacacuuuacaaaucaucuuuaugguccaucucuuuccucaaaaugcucaacauuuauugugcugguuuaauuggguggucuccaaaggcuuguauaaaauuuuuuuugaaagagcuuuaaaaagacauuaaagcaaaagaguaaaauucuuccggaugauucuuccuuugcaccuacccaucucacaaacggacaauaccaauuuauguauucaaagaggcagggguucuucugcuucccaggaaagggugcacauaacgugagguacgcaaaccaggcagugaaguagcuuagcuucauugucaaaauauucaaauuaucacaaaaagaaagcgauuccuuucugaauucaacaauacuccuuggccuccaagggcucacacaggagcuuauucuuaagcuguucaauguaagcagcacucgugaaagaggagaacucuggcagggaggagaucaaaucccucagcuuuucccaccugccaucucugcgccagucuaaugcuuaaauaguuaacaaugcaacagagagcccaaggcaggccuggucuggggggaaaaucaugugcaguauaugacgauuuaauaaagcagagaacagacaggaaaaauaacacaucucaguuugacaggaugcuacuugcagauugcuuuucaggucagaauuuagauuucuaaagcagagggaaaaaaggguuuucauacgucaauuauucuuuuuuaaguaugugguuaaaaaugacccuauaaaauuaaacaauccuaaagauaaauguuuccgaguuccagaguaacaagaagaaucacauuuuugugggagugaagacuggcagaugguaaacagauuaguuaauuguuuuaaaugaagggggaaauauuuuuuggaaaguuuguuuauucguugaugacaaaaaccaaaguuucauagaguguaugaguuccaggauguguuuuugcugucacaauauguuuuucuaggcauuugcuucugagaacagcauuuaagaacccgucuuuuucucucuuaaugaacugguuuagccgccugcugggcauucacugaaacccacauugaacaaagggauuuccuuccaguuucagcucauucacuucuagcgacuccugguuuuacuuaagcaaauucuccaaacugacuuuuuuauuucuaaugauuugagugggaaagaauugggcaacccucaaacacugggaagucugcccugguuuucagugaaagaauccucuaggcugaagauguacaagguuuguuuuugaaaagccucucgaauauguuuuauuuuauuuuccagauggaaaggagcccaccugauuugguagauuacagacaacuaaaucuuauuucagcaagauggaucauggugaacaaugagauuauuucuuugaaaugaagccugagugggauauucagauucaccuccaggcaaugaugucauuuuaaaggugacacuggggggcaugguaugaagggguugcuggaaguuggaauagauuugugggccuggcagcuggucuucuaccuucucacauuaauacaugaucucccugggggaccccaugcacaacccaagguuacaauuacuccuugaagucagaagccucccaaaucucuaucuucaauccugaacuuucuuucaaauuccagacuaauacaucuaccucccucccgcagcucucgggauaccuugcagugccccuucaaggucacaugguggggcuucaaacguuaacccacagacuugcuccuccuccagcacugccuguucuagcuaauggcaccgcuaugcaauagccaucagagcucccggauccucaccaggugauggcuacuguuuuaagaacuuuaccuaauaccuucaacaaccgcaugaguagguagcauuaacccuauuugauuaauggggaaaguaaggcuuagaaguuaugcugauuugcccaugauccuacagccagcaagcaguuaagcuugcuguagaauccagggugcgugucaaaagucaaccucuucccaugucacuucccagccucuccaaacuuagaagcucugcagucuagauuguucucagagauuaagcuuuacaacuuuauugucucucaaaucuauuuccuucucuuaauucccauagcuaccugcuguuugggugauguuuugcuuuuauuagggccuccaaaucagcauagcacaacaacuccagaauuuuacuuuguuugaauucccaaugauucuccuuucuagcucauuuaaaacagguggcaggcuuuguaaucccuuguauuuucauccagcugaagacagaagcauucugaagaagucugucuuuguuaacaauaucuaaacccagagaagaaauucugcuggacuucugggaggcgagaaggagaagcagaggagaagcugccaaaaugacacucucccuuccauccccccauggccaaccccccaucccagggccugauaaggagguaugucaguccccagcaauagaggcccuggcaccccucuguucccuaaggcaaugaguagaauccuugagaagacagcuacgugaagagugugccucgggaggccagaccugaggcaggagguuuccagcccucacuggcggcccuggggcagacagcuacaaggauucaauaaaucacuacuuugauaaacugaaggucagagguggguuccucaucuuccagaggccaugaaaaucuccagguccuaggacacacuccaugggggaaggggaagcaccuaaaucuuacugacaugaaauuuuccucuagguuggcagaauggggacuggaguccguuuucauuauggggaaugaaaacaguaaugcuucuugcauaguugacacucugaggugaaaugcagacuuguggggcaccucaauaaagugcagaaucuuagaacagugcacaucugugcuauagacuagcuacaacugcuggaacuggagccaaucuaguuuucaaaaaaggccaccgcuucguuagagagaggaccauggacucugcauacgcucuggugaccuaggguggaggggcgggguggcggggagggcagcaggcuuaugcuuuaaaccccugaggcagauagagaaggaaggaaggaaacaagggcagauguuagaguauacucacaagauuaacuccucugauuccuaugcaaauaccuagaaagggagagacacacaaaguuaucuuuaaggucuuuaucuugagcucugaauugcuaaaacaaacaaaaacacccaaguggggggggaacggaagucuacuuggaagaggaaagagagcagcuggugcugcuggagucaugagauccaggacacccccguuucccaagccuggaugugccucccaggguagcaugcuggcacggagcgggauggcugauuuccauaagauggaaaugauugcaugcuggaaacugagaugcuuuaggggagagaagauccuaacccaaaagaaaggauauaaaucuuuaaugugucaaauuuguugacuguaagauguuguaguaauggucaguacuugcagcaccaaaugggcacgucuaagggguccgggcuuugaaaucagucacguuauccaaacaaauuccacuugaguuccguggcugaaugucugagaccuucagaagaagcuuauaaagacccugcuggaaacugaagaggauuuuagauacgccaaagauaugccggccauuacgcagagacuagaacuuuuagugcugagagcucuggcugggagaaccucacauuccuaagaaucagcaaccaagggaccccauuuuucugccaaauaggcacacuauuaaaucugaugggcaugucaagggagaagaugaccugggaaaggaguugcccagggagcaagugcccuguugcagaggcagagauugccaagauggucuccuugggguuugaggcacaaagcccccucuagcuauuuuaguuauaaggaggugggaacgcuguguuaaauuguacccaagaagauaacucacaaggcaaggaacacggaagcuaggguguguugggcaaguaagcagagguugcuugcuuuaccgaaaguggggcugcucuggucucacaagggucuagccuugguuggcacaugcuucccuugucacaccagacaggugagaccaagaagggaagacagaaagagaccccaccacuuaacaugggcaaauaccuacaggaggcuacuuuccaaucuguggugcccagaaacuuggcagggauagggugguugcauggggagggaugcuagagaauggagaacgaguucacucuauuggcccaaacucaauuuucauguggcuuccuuuaaacaaaccacaagcuuagugagucaguuaggucaguguagagagauauuuccgcaugcuagaggcagauccauauugguuccccagucuguuuuuggacgguuccccuucauucuaaucacaaugcugcugccaggcugauucuucuaacaugcaaauauguuccugucacuugccuguuuggaauucuucaauggucccauuagguuucugucgacugcaacgaaaagucuugucuaaucagaaccacugaaaguuguuaaucaggagagcaauauguucaggcuuguguuauagaaagaaacugagagagcagacauacagauuauccuccuggauuuaucaguuauauacauuaaaauggccaaacaguaauucaaauagcaaaacaaacaaaaaacccaacugugcacacacacacaccaaaaaauaaguacaauaacugaacucugaaguucaguauaaaacuguucacagagcauucuaaaucuucccugacucagcacaacaucuuugugcacucugauuugaauauguggggcaaaugagaaccauuuuagggaaacaacauaagaugacuaugaucuuaaugcgguuucaauuuacauggugauuguguguuuuaugaaccaccucuaauuccuacugcuggaacaaaaagggaaaaauuaccuugguaaaugccacaucauggaucaauuaaguuauuccccaaauaaaguauucuuuguuauaguauaagcaugcauaauuucuagcauuuuaaacauugauagagaaauuauuuucuuuucuaauuuuaauauuuaacacuccuauguuaugauccccgccucccuucaucccccacugcuuucauuuuaauuuuuuguuuguucauggagggaaguaaggaaauuuuaaugauauuccuuagauaauacauuuucuuaccuaaaagugguacaauaauggguuuuacucuaccucaguccacuaugcagcaugcauacucuacuuaauacuagguuguguuccuacaguuaguuaaaaaaccaaccagcugguaguauuuuuuuagauccaaccuaagaaagacaguguggucuaguguagagggcacuggcuuuggagucagaugggucuaaguucgaaugcuggcucugcugcuuggaagguguguaacuuuagguaaguugcauaacuucucuaagccucagucuccgucaccauaaaauggggauaucuauguaucuugcagagcugauauacgguuaugcguuacacguguacauacagaggcaaaguacauguacgaaguagauguggccugugaauaaguguuagggccaauuuuacacgauggguaagcucacaauuaggaaacaugaauaacuucuuuuggaguaauauauauauauaauggaaagucagaguauaaauaauggauucacuucaaucauguuucuuuaauguggaucaucaugacacaauuccaucuccuagcauguguuuauaaaauaaauuucuauuaucccugugcuuucacauuuucucauauauuugagaaauuccuagauucuuaagcaguguaauccuauuuaaugugcuguuaauggcaauaucauguuuaacuagagaaaacaguuacaaaugggccuggcaugaacuaguccuacaggugccauaaagcuacccaaaugguauaaugaagugaugagggcauuuggggauucugcuacauuuuuuuccuucugaacguguugguggggguaguggacuaguuuuaauuagaaucguuuggagaacaggaauccaagcacacgaccuaauauucuccuaguuagccuucggccugaggcagcuguggacagccuuccuagaagucagucucaagacaaagaauagagcgggaagugguuuaucuagugggagguuugcagggggaauugaauguaagaugggauauaagaaaacuuacaaaaacaacuggaauuuuuaaaaaauacaccauuaugaccaucaaggacauuuugcaaaaaaaaaaaaaaaaaaaaacagucuggagagaggccaagaguuaugguuaagcaacagcacugcagcugcaaaagaagugagggcugcuuuagggugacauggccuugaaccuagaauuaauguaugggacagggaaaaacaacaaacauguuagauaugaaauuuaaggcugggauuuggaaucauuaucuugaaauaggcaguucaaacaaauccuaaucuuuacaugagugauagaaaauaagaaauaaaaacuucugauguauaauggggacccugccaaccaugaauucccucaaauaaacacugguugagugacauaaccuauuucacaacucuagaaaauuuggcaagcugagaaucaucucauauuaugauuuuaggagagugguuuagagacucugaauuguaacauacguuacauucuagauaucugauucuaaaugguggacccuaccucaguuuuuuuuuuccuaauauuucuuuaagauaaaaccauuuaaaaacaucuuuuuaaaauauaacagaaagagaucacgaaguuucuagugagcaagucaugauaaguaaaaaucaacuguacaaugcccaugauuucuaauuuaagacagauaaauagcaaugaucguucuuagcguguccucuugaauuuuuagagugaaaaacaggcuuucauuaaguccacaucuuaaucccccaaccuuauuuucccccucaaggccugaaguuccucaaauguaaauucucucacaaagucuuuucugggacauaagccccucuaccauggaggaggcgaaggcucugguuugugcuguaaugcgaggagagaauaagaauacagagccaugacugauggcaggagcacuggggggcaggaguuggaggguuccgcauagacguauuuaccuuucuaagugagguacagaugaguuucagaugugacacgaggcagcagccacauuagacgugacagcaauccuaaaggaaaaacaauaucaaaaguuuaaaaaaaaaaaaagcaucaagaaaaaacacauugguacuaugaaugcugacauuuaccuaaucagaauaugaguucaaggauaccaggggucaaaaaucucucuccaucgacaugcuaugcuauaaugccauaucccagcauuccagaggcacccauuugaguccuuaagggaucuuuaguuuuagagaggcuauacagugaugugguuaagaccacaguauggugccagaaagcuuagauuccaaucuuggugccaccuggagccacuuagagaccucaugcaauugguuuucucucucuaccucagcuuccuguccuguaaaauggagauaacgauuacacccacaucacaagacccuuuugagaauuaaauaaacuaauuugagauaaaugcuugacacugucugguaagcagggaguauucauguauuuguauuuauuuuucagagaccccaaguaaaaauacagccucaagcagaaauuacaaaauacucauggcugggcacaguggcucacacuuguaaucccagcauuuugagaggccaaggcaagaggaaugcuugagggcaggaguuugagaccagccugggcaacauagcaggacucaaucucuaccaaaaaaaaaaaaauuuuuuuuuuaagucagaaccuuuuuaagagcgucaacuaagaagaacacuauuccuuuggguaagggaaacaagaaccucagcagggaugagggugaagagggggagggaagaaaaagccacuaaaaggcaaaauaugggggaaaaaaacaccccacuuuggcuuaacuucaauuuuuuuuuuuuaaagucaagaccacuauuaucagcagaggccuggagaaaagaauuugcugugcagacccaaucauucaccuugagauaaggaaaaggacagaaacuggacagcaaaugaugagagggcagcagcaaaauguuuacagacugaaaagagauggaaauauagcuuucagugaaaauaaugaagacaggaaauagaucaauaacuuaaacccaucaacccucaccuccacagauauaaauucauuacugauuagcagugcaauccaauuggaugaauacuugagcaccaacccuaaguaaccuccuucucugaguagcccacauuugugccuugaccaaaaaggcugcuguuguauguguuuuuaaaauaacgaaaccauaucaauuugaaucuuacuaaugcaaaaggcauaaacuuuuagguauaagcugaguuuggguuuuuccuccugaauugagguuuuuccuugcagaaaaaugucucacuaaagaaggcaauauguaauguugcaaaguaaacauuuaaacuacugaaaauauacuaaguauuuuaacaaccucauuaacauacaaaugauuaacuacaaaugauuagguaucuaauuauuacagaugaucuuuauaauagucauaucugaucuuauacaacugacacauuauuuaauuuuagauaguucuguauuucagaauagcuuucuugcaacuaaaucuaguggguaaggaggaugucuuguuuucaacggcuagauaaacguuuauuagggcugcuuuauuuggucagucuggguggacgggaaacugucuaagagggaaauaucugguauuuuucuacuaggaaguuagcuuacguagauuaacacacauguaaacacagagacauaacauauguccauccccaaaccuauuuugaggguuucucuuaaguuacuugaaauucuucuucuuggauauuacagcagucuucagucugaagaaaaaggcucuuuucugaagaaucacauaguugaaguuaucugauucuauaagcauagcaagaccacaauuuuuaacugcaguuacuucccuggccugucuguaguucuuuuuuauuaauguagacaaagauaugccucacugcugaaagcugaaacaucaaauggaaaagugcaguuugauuuccuacauuucccuccacucucugccucucccuacuuugguauuaugucacacaaaauuacuuccagaaacugggaggguugagcagccaaguuaugaaaucuaagugcuaugcuuaaugcuuuuuuuuuuuaucuucaaguuaauacuuaugagggugagagucuaccaaugaucaaagucaugguaauuuuucuguuucaugagaaaucuaaaaucucagaaucacaucccgcugacccgacguuauuuguacaacccauacaaaugccccuuccucuacgagauuccucccgcaauucacaaauguguaaaccucuauuuuaaauuuuaccucuaccauuaaucaaaacagaagugcaaauaaguuuccuuaaaaauaaucuugguagugaacauaaaacaaaaauaacauggagaguaaaguauuagcccguuccuguacuugucugcuuacuuacucccuccuacaacacuuucuaaaaauuuccauuaugauuuuaagauguuauuuucccaauaaauguugacaacaauuucccacuuccagcucuggcuuuaaaaagaaauagguuauaaguugagaauagcuaagaaauuggguuugucccaguguucugugaaaucagacuagucagugcuucagaaucaaaauuucccuuagacuuuucacuaagaagcaaagcuguuuguuugccuuuucugauaaggaauucaaaacaugcaaugguaguaaaucugguuaaagaaauugucaagggagguuuugacuuuugcuauuauuuaacauuacaucauagaauuaaaucauguaaaauggcagccuuauccaucucaaucacuaaauucggucaaguaaaagucuacaaaauucuaaaugaaaaguuuuuucaucucauuaauggaaauaucuaaacauuacguugugguuuauuuuuaggaaagaauaacagagaagagagcuuggaucugaaaagaaaaaugccacacacuggugaugcuuccuucuagaggcuguggacugccugacaaacuugcuaaagcaaaaaagggcauaauaguucucugcagaggaagaauuuuaaaaagcaauagcaacaaucagguaacagcagaccaaucagguucucccaaaauuuaguauuugcaguugaaacugugauaaguaauuacuuucaaaggaauguagacagagccaucaauccccauucauucagcucgcauuuaccgagccaagagcucugcuaggcuugagauauaaaaaugaauacaacacagcugcuuuacuuccagcuaaaagaauacaccuaaauaaagagcuacagggccauguguuaagugccauaauagagguguacacaaagggcugggggccaaaggaagaagccauaaauucuuccugggaaaucaagcaagugaggggagaugugaaagaagguaucucagagauguuuccuugugauaaucucaagacuuuuucuuuaguguguucuaaaaaggugguaauuuuaagauuuaucaacuauuauaaugucaggcgcuaaucuuggucugcuagccaguuucuguuugacacacacuuccaguuacaauaucccaagaauauaaauauuuuaaaauaaauauauuauuguaauauucccaugcaauacacacaauccagaauggcaugaaucacuggcuugaguggaacguagcuuccaaguucaaagauguuuuaaaauauaaugaaugaaagauggauuuuagagaguuucauauaauaucaauaaugcuuacuguaucacuguuuucuuuccucucaaggcaaaaauaaaagaaucaccugauuguaucaugguuaauauuuguuuuacucuacuucuguguuuaaaaaaagagggcggguggagaaucaacuucuacuuaacaucauuuauuaugcagaccauauuccuacuuauaacauaguugugacaaaaccuccauuguucauuacacacuagccccaaacuugaguaauucuaauguaagcaugagaaacucccgucuccuuuggggugaauuucccaauuccucuguguuaaauugaggucuaauuuucccugugccugguuuucacaagaagguccauuccaccccaugugcuccuuuucagcugucaauaaacagaggcagugaauuccccacggcuucacaaagcuaguuaggcagagccauucauuccuucaggaaaacagggcauugauuucagcgaguucccagggagcagcugcaacaaagagaucaaaggcccaccucucuuucccuccauugcuuucauuaggcccagcccagacaaacagcgacagguuuccuugagacaaggagagggcucagcagaccaccucaugguuuaauucaaauucauccguuuccuacauuccagugacaguucagaaugcuaaccaugacaaaccagcacaaucacccagcauaauauacugcucgcuaguucauccaaggucagagggagaaaacaagcacggggggaaguccucugcuucuagggccugcugagcuucaauggcccccugacauuccauaaauaaacuucucccucucacucucccuuucuuccuccauccuacaacccuacaagcgauagucucacugaacaaucugcaacuucuuucaugucaccguacccaaacuauauggaaacuuuauucucaaucgaaugguucguucuaauagccagaggaagauggcuauacacgcagccucuauuaguucacugcugugcuaaagccagucggcuacacccaauaagcuacuacaacgugaugaauucagagcugcaguuucuaggguuaccuuaguaaggggugaucuccagagcugcaguuucuaggguuacccuaaggggugaucuccagagaaagcaacacaacuuaaagauggaguuaguuugcauaaauucuguuuguacaacaaaagugugaacagagauauaacagguuuuuuuggauccagguaaucacccaaacuggguaauccaagcuccuguguauaaaugaguuguguguuuguuggggugaggaugguuagucaaggagagaggagagagcaagagggacuaugaaagaaaaugaauuacucugacugguuaccuacacggaacaaauauaacuaagagguuuccaaauucaccauugaauucugaauugcuuauuucacaccuucauggaacccuauaacaaaaugccuucauuucauugugcuccguuccauuugucacuaauccugaguacacaugggaaucgauggguuaaguuucaaaauugugaaaccaaaaagaaaauaaacaauauuggaacgaaagguaugaacccacucggugaggcagaacacaaccuucccacgugcccacaggcaucaguacugaucucgguggugggguugcgggggaggucaccagugaccuccagggccaucuauucaccaauuacucaccuuggacugucaaagaugcuauuuuguauagagagcugaacagcccucaaggagaaaagacauucccuuauauucaaauuaggacagaaauggacuuugcauauacagaacucucaacugcacaggaaagguagcuugugacaaaaauggugugacaauuaauuaggaaccuuaaagcuaacucuggcauugacuugcuuugggccuaggggacacauuuaaccccucugucuucccacucuuccaaaaucacgacagaaauaucugugaauuccuugacgcaguacuaugaaauaaccauuccucaaaaacuauguaucucaucaaagaaaccuaggcuuaugaguagaacuuccuuauauaaugaucacccuguaacucaguagagguucucuggaaacuugcuacauuucuauaaaucaaauuguuuuuuaaaagcacucaggaaaaauacuacugaaagaaagucuuuggcaaaugaccaaaaacacuuaucaauccauuuacguaucuuucaaaagcauuuacaaaacacugagaaacauuauccauuggaucucugccacaaccaccugagagagaugguuuuauuaaucuauuuuugaaugaggagauaauaggcucaagagagguaaauugacuugccaaagucauagaacuaauaaucagcaguuaaaacuuuaaauucaaguauucuaucuuugagucucaugcuguuuccauuacaccagcuaccauguacuggggauauaaucauucacuggaguucucucaccaagguuauauuaaauaagucauccuaguuuuugaggccaauggguuguaccacuuccauucaaugagguaguugcuuaagaguauggacucuggagucagaucuguauuuaaauuuuagugucacuuuguaauaauuuuauaaauuaagcaauuaacaauauuuuuggaaccuuaguuucccuauuuguaaaagaggaauaauaaccucacaggguuuguggaggaucaaauuagauaacuaauauaaagcuccuaaaacagcauuggcauacagugaaagaucaauaauuauagcuauuaucaaugcugaaaaucaaaacaguguaaacuuguuaaaaggaaaaauuucuuuuaaagaaaaagacauaaaauuuaacauucagucucuagauugcaugauuccuugcauuaaaaguuuagccuucaaaucuaggauuuuaugggggacaacuaaugaaccaagaucaaacuauuauaaaagagaaagaagcuacuuuacaaaacagaaacacuaauugaagugucguuuuaaaaggcuaauugaggcaaauccuugcuacuauaaagcagcagugugguuuuucugcacaauucagcuuuacuucuugccacuuagccauuucgaguagaaauguauugguaaaagaagaaauucacagacuguuaccacuugaagagaaaaauacacacagggauaucuguugucuguagauagugcuuucauguuuucaaagaacuaacacauaucuuacuucguugacccucacauuacuaagagaaaacagauuaauuauguagcacaagagaagacugccagugguaaacagcaaaccuuauuuuuuauuccuugucucauuuuuucaugacacccuauuacugggcgguggcauagagaugccacaguacagaguguacagaauacugugggaagacagaggccacuaagacugagagaaccagaaaaggcuuugcagagaaggugacauuuauccaaccuuuuaucuaguacagacguacuucuggaauauuccuggucgcccuugagccugagauuucuuuucuuuuuuuuuuuuuuuuuggugaauucugaauaucucacuuagugauuuaguucuccuuauacugcuuuuuguucacuugaaaaccuaaauggauguccucaccuccuuuuaaaaauuucauccaaggccuugauauuaaagaggcaggagcugaagccacucuuguuugacuuaauaauaucaauaccuaaggcaccuucucauucuacaguucugugacuuuuaaaauuacugcuuauucuuauauugcauuaccuacuauacaacacaucacuugaaaugugcaauuuacuuccuguuaauauuuuaaaauauuuucuucauuaccauuuauaucagaaacaguuuaaaagaacucuuaugaauaucuaaaggaauaugucuugcuaaagaaacucagccuagagcuggugaaguaugacaauuguuucuauccuaagagccggguuccuuuuuguaaguaaccaccccuaauucuaucuucucucacaacaugaaagaaacacauuuuuuaaugaaagauguucagacauuuugaagaugauuaugacaaucucugaugaguuauuaauuugagaccauucuucucuucuaacauagacauguagugcuacaaauuccugucuaagcauugcuauaaguugcaucuuagucacuugaaaauaugguuucauuuucauucaguucaaaauauuuucuaauuuccuguucgauuuuuuuaaaauaggcuacuuuuuagagaaguuuauguucacagcaaaauugagccuguuacagcaauuucccauauacucccuuccccccccccaacacacuuagccuucuccauuaucgacaucccccacuagagugguacauuuguuacaacugauaaacuuccauugacacaucauuaucacccagaauccaugguuuagaguucacucuugguguuguacauucuauggguuugaaaaaauuuaugacaguucuccaucauuauaacaucauacagagaaguuuugccgaucuuuuuacugucuaguuuugcauuuucuaaaaugucauauaguugaaauuauauaguaugcagccuuuugagacuggcuucuuuuacuuuaguaauacacauuuaauuuucuuccaugccuuuucauggcuugauagcucacuucuuuuuuuuuuauuuuuuucuucuucuucuucuuuuuuuuuuuuuuuuuuuuugagauggagucuggcucaaucgcccagacuggggugcaguagggcaaucucggcucacuguaaccuccaccucccagguuaaagcaauucuccaccucagccucccgaguagcugggacuacagguauagucuguauaccugagauuacaggcgcccaccaucaugccaggcuaauuuuuguauuuuuaguagagacacaguuucaccauguuggccaggcuggucucgaacucccaacuuucagugauccacccaucucggccuccaaaggugcugggguuauaggugugagccacugcacccggccagcucauuucuuuuuggugcugauugauuucguuugugucacacuggcuggcugguagaauucaccaguacaaccaucugggucugcugucuagaagcuguuuuaaguuuauauguguauuucaaggaacuagucuauuuuaucuaauuuaucaaauaugugagugagagcuuauuuauacuauucucuuacuaauccuguauuuuauccaugggauuagcagaauaacaccucuuucauuccuaauauuggcaauugguguacucauuuuuccuugguugccuggcuagagauuuaucauuuuacugaucuuuucaaagaaccagcuuuuuauuuuguugauuuucuccauuguuuuccuguuuucaacuuuguugauuuccgcucuaauuuucaguauuuacuuucuucugcucacugcagguuuaauuuguuucucuuuuucuaguuuccaaagguggaaacugagguuauugauuuuagguucuuuuucuuuucuaauacaucauuuaaugcuacaaauuuugaagcacuguuucagcuguaucccacaugguuucauaaacuguauuuucauuaaaauuaaaaauauuuaaacauuuuucuugagauuuuucuuugauccauggguuauuuagaagcauacuguuuaauuuccaaauauuuggaaaauuuccagcacuuuuuucaguauuaacuuuuaguuuaauucuguagucucagaaaguauuuuguaugguuucuauucuuuuaaauuuguuaagauguuuucaaugucucaggaugugccccuggguuauuuggaagugugauguucaguuacaagauauuuuuccagauuccuuucuaauuuaauuccauuauggucagugaacacucuuuguaugauuuaaauccuucagaauuaauugacuuauuuucccacccagaauauggucuaucuugaaaaauguucuggcuaugcuuggaaaaagugugcaguuugcuguugaguagcguucuauaaacgccaauuaagucaaugugguugauagcacuguucaagucuucuauagccuucuugguuuuccaacuacuugaucuauuaucuauugaaggaagggugcugaaaucugaccacaauugugaauuugucuauuucuucccauguauacugaaauuauuuuacuaggugcauaaacauuuaagaucauuuauucuugaugaguucaccacuuuaucauuaugaaacaacucuauuuaucccugguaauauucuuuguucuaauuucuacuuugucuaauaugaauacagucaccacaguuuuaaaaaaucagugcuaaaaaugauauuuuuuucauccguuagcuuauaaucuauuugugucuuuacacaugaagugcauuuuuuuguaggcagcauauaguuaguucucaaagcguuuuguauguauuaaaucugacugugaacaaucaauugagguaacucauuaccuucagacuggccaauauguguauuaaaucugacauucuuugccuuuuaauuaugacaguuagaccauuuaugcuuaacaugcuuacugacaugauuaggcugaaauguacgaucuuguuauuuguugucuaauugccucaauuauucuuuguuccuuuucuuucuucuuuugaauugauuauuuuucucuaguuuuaucuccuuuggcuuauaacuauguuuugauaucuucgugguugcuguagaguuuauaguuauaucuuuaacuuaccaugguguacuuccaagggauauaccaguucauguagaguauaaaaacuuuauaguuauauuuuuccucaccugaccuuugugcaauuauuguuguaacuuuugcuuuuauauguuauauaccccauuugcuauuuuuguuuaaaccaucuuuuaaaaaauauuaauaauaaucaucaucguauguauuuauuuaccuaggugguugccauuucuggugcucuuuacugcuaucuggcauuauuuuccuucuuuauuaaaucaacugacaauaaaugugagaguuuaaaaaaaaagauuuccuuuaguauuucuuacacugugggucuacuggugauuaauucuuucagcuuuaguacaucugaaaaagucuuuauuucaccuguuauuuuccuaccaaagaaagugcuugcauguuucaccuuuuuugaaagauauugucacaacuauagauuucuagauuaacaguuuuagcuuucacuacuuggaaggugucuuuccacugucuucuggauuacauuccuucugacaggaagccuucugucauguuuguuccucugaauguauaguuuuuucuucucugcuuuaaaaucugucuuuacuacugguuuuaaacuauuugauuacggugucccuugguguaguuuucuucauguuuuugugcuugcuugauauuuauuuaacuuagauuuguggauuuauuguuuucaucaaauuuggcaaggcuucagccauuauaucuuuauuuucuguccucucccuccuuuggggacuccaauuacauacauauuuggucauuucaaguugucccacagcucacugaugugcuauucacuuuuuucuaguuuuuuuuuuuuuuuuuccauucaguaucucauuuuguauaauugcuaugcaguguauuuugggauuuuaauccuauccaguguauuuuucaacucagguguuuauaaaaugucuagaggucuagaaguucaauuuaggucuuuuuauagcuuccaucuuuucuuaaccaccuuaugcuuuccacuaccaucuugaguauauggaacauaguaacaauaacuauuugaauauccuuauuaaaucuauuuaauuuauuuuaguaccuccacuuauuagaugugugucacuucugggucuguuucuauugauugaguuuucucuucacuguugaauuuuccugcuucucugcacaucugguaaauucugacugaaugcuacauauugcauacuuuauuaaugggugcuggauauuuuguauuuccuuaaauauccuugagcuuuguucugggauacaguuaagcuacuucaaacaauuugauccuucaaaccaagugucugcaaacuaggcccacaggccaaaucuggaccacugccuauuucuauaaauaaaauuuuauuggaauacauucugauacauguaaauacauuugcuuacaaauuguuuauggcuguuuuaacacuagaagggcagaagugaguaguuaaaacagagacuacauggcccacauauccuaaaauauuuuccaucuggcccuuuacaaaacaguuuuaugaccugucuugaauggcuuacuuuuaagauuuuuuaggcaggaucagauuagacuagucuagggcuaauuuugccucaucgcugaagcauuagucuucugaguacaccaucuaaucccacuuauauacaagguuuuuccacucugaaugguggggguggggugggggggacacacucuucacugccuuauaugagcuacuuucuucuucccagugccucuuuccucauccauggguaguucucuuaugcauaugcacuaaucagcacucggcugaagccuccaggagagcccucugaagaucucuggagcucacucucuguguaacuaacucucucuucucugguacucuguccuucaaauucuagcugccucagccucccagaauuccuaacuccaucaucucaaccuaggauaagcuguguuuggguucugccuuccugcacugcagccuggggcaaaucauuuguuuuuuccuucucucaggguucacugucucgugccacuuguccaaugucggaaugccuuuguuucauauguuuuaugggcuuuuugugugugucgguuuguuaggcuauuuuaggcgagagaauaacuccaguuccuguuauuacaagauggcuggaagcagagguccucucaguacgaaguuccaauccuuuauauuugccuuagugcuuuauauuuacaauaaauugucccagcucaagccauuuacccaauucuaugaucagucagcaacuagagaaggguguaauaagcaaagucaaacuacuauagcaucccuuuccccaaucccacuuuccuaucuuugugggauauauaugguggacuugguuuuuaagauuuuucuuuuucauuaaaccagcauuuauugagugguuguuuuuccuggcauuguucuaggugcuggggauucaccacugugaacaaaacacgcaaaaauuccuacccuugugaagcgcaccaaugaauuaagcuuaucuuugaauuaauuguuucuaguagcuuaacuguaucccauaacaaagcucaaguaaaauauguaucagauggugauuuuaaaaaaaaaaguaaugaagagacaggaagugcuaagagauuuagcagugaaaacagugucaauuuaaaacaggcuggucagggaaaaaggcaugggugagaggaugacaauuuagggaggaucugaaggagguaaggauguaagucauguggcuauuucuggguacaauaauugcaaaacucgaugcagaaacaagaaaacugguauggcuaaagcagucagugaagggaagcgguaaaagauuaggccagaaguaaugggacccauagcacauaggagaugauaagccuccguaagcgagaugggaaggacuggagacacuggagcagaaaaguaacacgaucagacuuaacaguuuuaaauaauuuaucgggcuguuguguggagagugaauucuaggggagaaaguaugaaaccagggagaccaguuagaaggcuacucuuauaaagagaugaugaaggcgugcaccagugcaguagcagaagagcuggggagaaguggucaccuucuggauuuauggaagguggggcugacaguaucuccugacagcugaauguguagagggugagagagacgaaaugaggaugcugcaaaggcaccuggccugugcaacuggaagaagagucuuccucaucucgguaaauggcuacuuaggaugaaggaaguuugguugggaacagagaagaacucaggagcucaggugcagacauguuagguuugauaugccuauuagacauccagcaauuggauauuuuaaucuggaguuuagagaagagguccauacuggagacaauuuaguagcugccagcauauauguauuuaaagccauaaaaaugaaugggagcagcuagggagugagaaucgacagaggacaaguacagagacugugcucagggacagccaauguuuggaggucaggacaaugaggauguaacugcaagaaagauaagaguagucacaugcaauaggaaggcaguugggaaagugugcagacucagaagacaagagaagaacauacuucacagagcagcaugaucaguggggucagugcuucugacaggucaaggaagauacagacugagaauuaaugguugaguuugcaauaugaaggucgcuggugacacuugagaacuuugguggaaugcccagacagaacugagaaauuguguaaaaggaagcagggacauuaaaugggguaguaaguagagaggaaugggaguuaaauaauuuuuuuaaguaaagcagggaggugggaaugcaugaugcaggagagagaagggacaacuacuguagcuauauccuugagcaggugagaggagaugggacuaagaauauaaguacaaggguaagcuuuaaauugagcauggcuggguaucuuucuccagcuacguucagcugcacugcugcaggcauggaaucagcaaacaaaggcacugggauauagauggcuaaguacaacaaagcaaaggggagggacagagaagaugaguggaugagugauuuuaaugagaggguaggcuauugacguugaguaagggaggaugugagauaugaaggaagugugcugcaguguaaaaguuguaugucuagguggaguuaaaaauguguuggagugggaggacagauggagaauggggugcugggacucaagaucauggagugagagcaguucuuauuaaugacuaggcccacaguaugacuaugggagaaaguugcuaaugugguuuggaagacaaggucauugaaggagaggaaaucaagaaaccgagaagccaggcuguuaagacucuacgaagccugaaaaucaccaagaauuaggacacauuagucuuacagggaaggacagcuccugaaucuucaaggaauaaggaacaaugauguauuuuuacuuuccagauuuuaaauuuuuauguugucuuauaacuauauuuauaauaaugauuuaggccuaacuccaagucagcuguuuuaagcuaauccaacuguccuuuuaugguccaacuugcguucugcucaaauguccuucuucucuuucacuaucauucugaaaaauguacaauuaauucugucauuuauaucaguuuccuaaauucuaaagcaaaauuucucaaacuuuucuguggagcaccaguucaaugguauauuuggugagguagggguuguauggugaaauaugcuggagaaacaccacagaccaaaggccaucgauaaucacuuguuggaaacaaacaagucuaauuugauuuuaacucagcuuuuuucccaaauuuaaaugaccauaugcucauuuuccauauaauaucaguuaacauccuaaggaaugaguaugccaagguagguacuaucgggaagacuguauuagaggugcgugucuucuugguggcuucaaaagaggugaaacagaaccugcuagaacaagauucaagauacagacuuagaaucugucagagaaugcaaauccuuguuaaguuacuuuguaacaauauucuccucuccugcuaagaugaugaaaaacaaaaccaucucagaaaauaacuucucaaagauguauuuaaaauugguuuaguauauuucaauucuccuccguaaaaaugacacuucauagacuauuuaaaaacaaagauacauaaauauguuuuggaggaagacuaaugcccaacaggacgucugcaucuauauacaaccucagcucugcccuuugcucccacuaaccauaacucugauaagaagucacuauaaggaaacaaaugccccuaggccaagacauguacuucaaaaaucauuaucaaaauaacuauuaucuaagaguaccagaaaaagugagacagacuuuaaaauaauuuaagaaccaaauaacaaaaaaguuuugcuccaauuuuugcucuaggagcucuaaaaaaccauuaucaaguuauuagagaagacaagguauugggggaagaggauaaaagaaacugaaauaucagcuuacaaaagccaaucacgauguuuaugaaucaggcaggaacaaucugcaaacaaaaauaaaaauuacuaguuuuguauaauauuugcacaugcauuuguuaauuauaauuuugagaucacuguagguucauaugcaauuuuaaaagaggcuuuacucagucucccacaauaguaacauuucacaaaacaacaguacaauaucacaaccgauauguuuauauuaauaccaucuacuagucuaucgcgauuucccauuuaauuguauuaguguguuuuauaguuuuaucacauguguaggcucacauaucuaccacuagucaaaauauugaacaguuccaucacaaggauccaucauguugcccuuuuacaaucacacaccaccuccuuugccaaaaucucuuucugccccugacccauugcacaucuauuuuuaacacuaaaauaauaacagccauuuacaaaaaguauuucauuccuuguccauaguucuaugucuacuacuacuacuacuacuuccuauaugucaaaucuugaaugaauacuuuuaguuuucugcauuaaagguuuaguuuaaggaauaccuucuccagggagaaguuuuucucauuguuagcauggcauagaucacucauuucaaaaaucaaaacgcaaaaaguaagggagucagaaauguugucugcacucacagauuccauauuuucaauauauuacuaacaagaaaccucugagugcuuaccaucggccaagcuacauauuauauauuauuauguguguguguguguguguguauacacacacauauauauaaaagauauauauacacauauauaucaaauuauauauauauaaaauuauauauauauauauauauauauauauaucauuuaauccuuuuaccaaaccuuugauguaugcacauugacccuguuuggcccaggagaaaauugaggcaccaagagguuuacaaguugccugaagucaaacaacuagcaaguggcaaauccuggaaccugggaccagacucugggcacccagacucuaccaucccucaaggaaacccaugauaaagucaagauguuuugaugucaucauucauugcuaugacaaauaaaucaccuaauuauugguaagcuucauuuuaacauaccagaauucaacaaggaaaauguccaaagcaaugauguguaaaauggaaggaguauuuuauucaagcaugaaaucauaggaaauugccaaaaacaaagguugggacaugcagaaaagacuuuauauuauagcaacaaacuguucaccagcccuaaaaagauagucuuaacauucguuggggauugacaggcagcaguuuauacauagucaagauuacucuugaaaaagacauauucaauugagcagagaugaugaugggagaacugaaauuuuugaacagauaaaagcuucaaaauuaggcucuucagccaauagagacaucuaaaacuccaaagaucauguucagauuauaguaauuugacagacaccuauugugacaaacuuucuguagguuuauuagcuuaauaauauagcauuauuacugaggacuaauauucucuucugugaaacuacacagcacauuuaugcauagcugugacaguuuugccuaucauucaacagugcuuaaaaggcgccugcucaauaagccauugauaugcugccccaaauacccuggcgaggcuuucuuuacagugcuaauuuuacagacgucuccuggaugaucuaaguucaagaggcagccaggggaggagaaugcauuauuagcaugguuuggugugcguauaaccaaguuauacauaggaacuagggaaauggagcucugaaguucaucuuccacaggaagauacaugcuauuauucuugacuuucugggagggaaguuaauucauuacuucguuaacacugaaauauauuaaaaacauuuucaguuaaaagguagcuaaaaagaaaccuuuaaauuaaaaugcuuacaucuuacgagauuucuagaaaucacuauuaauugauuuuaacuagcuuuauaaucucccccaguuacucaaggcuuuuauuuauuuauuuauuuauuuagagacagggucucugucacccagacugaaguguggugacgugaucaagguucacugcaaccuugaucucgugggcuuaauugauccucccaccucagccuccgaacacagcagaguuaauggcagguuggcucuacuucaucagagguucuggaggaggaaaccaagaucuucccugaaaggcaagaucuggcaugugccaccacacuggcuuuuuuuuuuuuuuuuuuuuuuugguagagacaaggugucacuauauugcccaggcuagucuugaauuccugggcccaagagauucucccaccuuggccucccaaaguaaaaacucacauuuucuuaaagguggguaagcaaaagaucagggugaaggaaacccucuccuuuucagacaccacccuacgaugccuguuugcccuucuucaccaagaagccagcuguccguggcugggccagcgugacagacucaggggacauuggauacagcucucuuuucaauggcuccuagaguuaagacuuuuauaagcauuauuauuucaagaaaacacuguguccuggucuucuuaaguaaauacaaggcagaugguaaccuuaauuuucucugaaaacucugucuaaaacaugggacaaaauagaugucaacguucuaagaaugaagaaaaaucagaauuccucauuuaucuccaauucuucucccagggaaauacauauacaaagccuccuugaaguuuaacaugacuuguuucucauaucuuucuaaaagcauauuguuuauuuagaauaaccuuucuaucuugucugccaagcuuuucccauacauauaagauaaaaacugagaaacacuuuuccauucccagugauguuuguccaguaagucuugguaaguaauaacgauuaugccuaaacuaacaucacucuuccucugcggcuaaacacagucaucuggugguguacgguaugaccuguaugguuccucagugguucaccauucuagaacauccuacaagauuaacuaaauuuuucaaguuuguguaucaccucagcuguaacauuuauguuuaugucacuguuuuuaaguuguuaaauucuuagaggauaaagacuauaucuguauaacuuaguuuacaaauaauagccaugcacgaacaucccauaaaugcccuuggcagugaugaguacaaucacagcagaguuaaugguagguuggcuccacuucaucagagguucuggaggaggaaaccaagaucuucccugaaaggcaagaccuggcaucaggggcuacugugggcacuuuccuuugaauugcauuuaucugccaggaagaugauauccuuuauuguuuuacaugaaagcauuugaaaauucuaaaaacugaccaugccugccuuggucaguucagguuguaauaacaaagugccauagacuggauggcugacacauuuauuuuucacaguucuggaggggagaagucugagaucauggugccagcaugggcagguuuuggugaggaaccuccuccaacugucuacugcuggcucuccuauccucacaagguaggaagaaaagccagcuaguucucuguccuuuucuuauaaaggcacuaaucccauuccugagggcuccacccuuauggcccaauuucuucccuaaggccccaccuucaaauaccauuucauuaggauuaggguuucaacacauggcuuuuggggggacacacacauucaguucauugcaaugcccuuacauagacaugaagacaggucacguauguuugaaauaacucauggucugcaaaaucucacaccaaaaauaacagagggagaaaaauucagaguagaccacucaaaaccuaugcacuuuuguaaucacagcgcuaaccaaauaauaaugcauaccucagggauaacuuggaaagcccagauaggcagcucagugugucugggggugccccaggggacauuaaaaacgcacagaaacaauagaguggaaaggcuacuacaguagaaaugcagggaggacucagagaugaguucucaucccuggagagugugauaugacagugaauugugucaacgugacugugccacaagugccagguuaaacauuauuucuggcuacguccaugcagguauuucuggaugaaaucaacacuuguguugguggaguucggagcauaccacccucccaaauaugggcuggcaucauccaauccacugagggcccgaauagaacaaaaagguggaaggaggaggaauucacccccuuuucuuccugccugccugagcugggacaucagucuccuccuguccuuggacugggauuuauaccccugguuccucugcuucucaggcguucagccuuggaccagaaucacaccaccagcuuucccgagucuccagcuugcagacaguugacugugggauuucucagccuucauaaucaucagggucaauucuuuguaaucaaucucucuuucucucuccauauauguauccauggguaaacauacauacacucuaacucugccaacucaaauucacuuggguucuagaaacugcccaacaauuaugcaacauuucccuaaucuuuggucauuucauuucacaccuucucuccuaucuuccaauugccuuccccacuccuaauacuuaacacauaacaucucucuguuaacaucccuacuuaaugcuucugugagaaaacaaaagcuguuggauagggcaucucugccuucuaucucuaaacucagaaacuuccccauauccacaggaggaugcacccucccuaaaaccagaggccaacuccaccucucuauucaaaauuucuuauacauuaucuucucccuuuuuacuaaagauacuugucaucgacacauacuaugcucugauauuccccaauuuuuuuuuuuuucuuuuuugagauggagucucgcucuguugccagacuggagugcaguggcaugaucucagcucacugcaaccuccgccuaccggguucaagcgauuaucuugcuucagcuucccaaguagcugggauuacaggcaugugccaccaugcccagcuaauuuuuguauuuuuauuagagacgggguuucaacauguuggccaggauggucuccauccccugaccucgggauccgcccgccuuggccucccaaagugcagggauuacaggugugagccaucgugcccggcugauauuccucaauuuuuaaagaacaaaaccuucauugaccuccuggucccacuauacucccacccuuucucagacaaacuucugaaaagaacagaaaacuuagauaauccccauuuccuuaccucccacucacuuuccaacccauuccccaggcucuuaucucuaccacucuaucaaaagaucuuuaucaaggucaucaaagcaauucuuauuauccucauuuuaaaaaccaggacacugaggcucaagagagauuacuagguugagauaguaaaaacguaccuucccuucaagauaugcaagagcccagagcugccccaaggcacucuuuucaggauauuaaagacuucaucuucccgggacccaaccccucuuuccucccuugugucaugccgcugcauuauauaucagacacauuccuuagaauaucucauuguuuuucauuauuuuuaauugagaaaaaggaccuugcuuugccuaugaauguuuucuguguugaccacuuggugucaauuauuuaauuguuccaaccacaugagaauagguggcuuuagccccuuuguacaaauaagaaaauuguggcggagaaagaauaaaaccuuucccaacaucagacagauaauaagcauuucauuguuucuuaguuguuuccauuagaugauggcaagauaggggcaucacucugacagaugugacauugucccauuauguccacaagguuggaaaaccuagaacugaugcaaauuugcuaugaagaaacaccucagaaacugacuuauauaucauaauggaacuuuaugaugaggauuuuaauuuaccauacaucuaaauauuuauguuauaaauuaugcagaccaacuaaguucaaagcuaaccaaccaaguccaaaauauaucuuuccuugaccaauuuaccucauauuuccuggaaaaccauguuugaauguggacuucuuggagucuguaccucuagaacauggcacuggggggccgugauacugaauuuuggugauuagggcaucuucccucccuaguucuaccauggaagccaaauuggugagcaugaggugcggaacagaguuaugugcuuaucccauaaccugucugguuuucuagguauucagacauugcacucgcucagcacugcccuuaacccaggugaguggagcucugccuuaggauccauguuccauucuggccuuucucuagcugcaccauuuccuuuaucaugaggaguccaaaggccuaaggggaaggugcccacccaggccuacacucccucuccuaggcuaugcuccugguucccagaaccauggcauuccuuguccaaagagcuucaagccugcuaaccaggaacugcacaggcucuuuccuagaucuguguuuuuaagggcagacugugcccuguuauaugcaguaccuagacccaagggguggccaaggggugucuguuugcaggagauguggacauagugggcagagugaucccagaacauuaagagaagggaagacaggccagggccuaguagccagcuugcucuccagugccauguucuagagguacaggcuccaaaaaguccacauucaaacaugguuuuccaggaaauaugagguaaaguggucaaggaaagauauauuuuggacuucguugguuagcuuugaacuuaguuggucugcauaacuuauaacuuauaaauauuuagauguaugguaaaaguguuucuauuuauauccuggcuugaacucuacccccguauaguuaggaggggcaugagauuaguucuagacuuuaauaaaaaguugauuacugaggaaaaaccauugaauauucuuuuuuugaaccacaguggcugagaaggccaaguguuccagaaaguguacaaugacaaaggugguacaaucacaggcuugagucuuucugugugaagcauagucuucugcaaguccacaguggauguuuauuguaagcaaaaaauaaacuguuuuugaaugaagccacugagguuuggggauggcuuguuagcacaacauaauguuagcccauccugacuacauagaaauugguaccagaaguaggauguuuuagcaaaaaccuaaaauauaugaccuugguuuagcggucagcagguagcaaggaaagugaucucaagggccagaaagauagugauguguuuuauacaguggcaacauaucugguaaaacauuugccucugcuaguucaggaggcagaucuccugucaaauuuacuuguagcucuaggagaagagguaagaaaaaacaauugaaauaugguugggcgagguggcucauagcaccuugggaggccaaggcagguggaucacuugaggucaggaguucaagaccagccuggccaacauggugaaaccucaucucuacuaaaaacacaaaaauuagcugggugugguggcgcgugccuguaaucccagcuacucgggaagcugaggcagaagaaucacuugaaccugggagguggagguugcagugagccgagauccugccaccgcacuccagccugggugacagagugagugagacuccaucucaaaaaaacaaacaaacaaacacacacacagaaaaaaacagaaaacggccgggugcgguggcucacgcuuguaaucccagcacuuugggaggccaaggcgggaggaucaugaggucaggaguucgaguccagccuggccaacacagugaaaccccaccucuacuaaaaauagaaaaauuagcuggguguggugggugccuguaaucccagcuacucaggaggcuggggcaggagaauugcuuggaccagggaggcagaguuugcagugagccaagaucgcgccacugcacuccagccuaggugacagagcuagacucugucugaaaacaaaaaaacaaaaaacaaaacaaaacacacacacacacacacacacacacacacacacacacaauugacauguguauugguuauuauuggcuucauuugacaaaguauuucaagaaagagcugagcuuagaaaagaacuauccgguuuccaggaagugaaagggagugaggagacggcagacauuucagauuuugcaacuacaaaaacuaacuucuucuccaccccuacacuaacaguuaaagguaagacuuugaagaucauuagccaaggaaaacuuuuuuuuaaaaaaacuaaauugucucaggacaaggauagauaauauauccguuaaaucuuuucauguggauaaaaugacugagagaauagaucagauuaaaaguaaagcuuuccaauagaagccagccagucccaagauaacuuccuuuaggaccagaaagacagcuaugggagugagaaugcaaaucaauguagcaaaucugaaaaccaggacucaugcaugacaaaagaaaauucuagggcuguguuuacuagcacacagaauugacuggagacaaacagauaagaaagcuuccaaauuuuggagagcacugugcugccgaaaagaauaagacuaucagcugaagucuuaaaacgauccuuuggcccccaguacucuauaugcaggauagaaagguuugcucaguucccaacuagggcaaauucucaaauguucacuucauauauggcuaaggaaaaaaaaaaaaagaaaagaacucccuaggggcaaggccaguacuucugaaaaugaugaacaagaagguagaaucagggccuaaucaagaagcauuuuacucuccagguuuugaaggauuucaaaauuguuauggaccagggacucccuaaaguauacucgugaaauuuauaacuuacaaugugggaaauacuagguuuggaucuguauuauuuuaauaaucucagaaaggugucagaaaaacgaggaauuuuccuauauauuguaaauuuuaagacuucacagugcaugggauguccacauguucugcacugugucaucugagaauaugaacaucuuuccuccgcuguuuaaaagcaauuuucuagauugcaguuuuaaacaucucugaaugugacaagguauuaccauuaaagcguaugacacugauuuuacacucugcagaagugcggacagauuuaacaaggcagcccuacuucacaguagcucuugaaaucucaaguaggaacgaaaugaaacuaauggcauuauaaauacuacuauuauucgcaaaaaaauguauggaagaugaugagagacagcagugugaccacuggagcagcucauauucggucccaacauuuuauuccugcuugcguuucuggaaaauccacuguuacagauucaaauguguccucaaaauucaaauguugaaaacccaaacccuaaugugacuguauuuggagauagggccaucagggagguaauuaagguuaaaugaugucuuaagaguggggcuuuaauccaauuaaaauucucauuauaauacaugucaguuucugauguguuugcucuuagcaaauuugcauuaauuucagauuuucugaacucacggagguaauuggacuaugucacaucucucagugaugccucuaucuugucaucaucuaaugggaacaauuaagagacaauaagauagaaccaucacaaagagcaggcacccugugcucagaauccaaguaaucagaggucaaaugcuugcuguauuacuuauuaacugucugauauugggaaaggcuucauucuuucucagccaaaauuuucuuauuuguacaaaggagauaaaacuauucucagguuguuggaacaauuaaauaaaaugauucacaacaaguggucaacacagaaaauauucacaauaaagcaaggucccuuucaauuuauccuuaaaguuaauuaauaaaaagcuuaaacuucaguauuaugcagauuauuuguaugcacguaucaagcuacccuuuucauaucauucaauaaaugaugcauaauuuuuggcuuuuguuguuuuguuguuaugguuuuuuggggguuuuuuugcuuugcuuuggaaaggggauaaauguuaaacuaauuugaggaauaaguuaagccaaggaaacaugauucuaaacuacauaauuuaaacagauuucuauacuuuguauuuaggugcgaaccauuuuagucaaaguuugaaauuauguuuaccuccuauaaauauuuguugaauaaauuuaugaauguuuucuaaguuaaauagcuuuaaaagcuauacugucauaagauacucauaccacuuaaaauucaaacacuauuaugauauauaugcuuauauaaaauguuucaaaucugaaauauaaggauuuuuuuuuuccugaagacuaaaggaagaaagaucacccuuucuacauguuucauaauauauuuuccagggaugaaagagaaaauuuaacacuugaugggcucaaaucuuaauuauaaaacagagguuuuuguuucaaagcccaguaauaauaaguauuuccauaaaauaccuacauuacuggcuauauuaaugguggccagccauaaaguuaaagcaaagagaagaacugaaaucuagaccucuaaucuuuuuuccaaaaauaucaaggauaaaggauggucaggagcucaaccaaaaccaaaaacgguuuaaccuggucacccucccaccaucguccacucuauuuugugaccugcugagccacaucgugcuuuaaauuuucuugauuuagggucucauuuucucugaacuguuaugaucacaauggugucacauaaagaagaaacauggggugauuugagagaacuuuaacaaggucuggacauuucucucacuaggaaguagcugaccccauuacuacagggcacgcuucuuauuagguggaucugggagaauccuaucacagagcugcgaugucugcauguaugauuacaagcaaaaguugaccaagaaggcuucaaugagaaguagaugaaauugaaucaaaugaacguuuauuaagcaccuacaaagcgcuuguaaacagaaaguauggcaaagacugccaauuuucucugauauccauucuuccuuucuuucuuuguaauauaaucucugaauuuuaaaugggcacaugacuccccagaaugaaaacauuuuccaaugucccuugaagauaaagguugucacguuacugacaagauguaggcagaaaugucaugugcaaauucugggaauuguccuugaagcaggagcagagucuuauuuauucccuuuuuuuuuuuuuuuuuucugacugaaauacagacaucauagcuagaacuuggcuagccaucuucgaucaugagguagacgaacagaacaaggauauagaacuuagaguucaaaaacagacacacauacucaggcacuugauuuucaacaagggcaccaugcaauucaauggagggaaagaaaaauuccucaaaagauucuagagcaauuaaaucucgauccugaaaaaaauuaaccuugacccuuaucucacaucauacagaaauuaauuugagauagaugauggaaugggucacagaucuaaauguaaaaauaaaauugauaucuucaugauugagggauagacaaagauuucuuaaacaggacaaaagacaaaccacuaaaaacccgauaaacuggauuucauuaagacaccaaaagacagcauuaaaagauacauagaaaagucaugaaaucaucaaggaaaugcacaugaaaaccaugagaccaugaagccaugagauaucaccucaaacccaccagagggcuuaaagcgaaaaagacuaauaucaagugcugaugaaaaugugcacuccaacuacaacucuauugcuagcaaaaguguacacauaugcauucaguuuuguaaacuguuuggcuccccuauggccuaacaauucuagucucagauuuguuccuuggcaaaauacugcaaauguccaccaaaagacuugugaaugaguauucacagcaggucuauuuguaagaacccaaacuagaacacacccacauagcuauuuacaaaauggauaaacaaauugugguaauggaguccuacucagaaaaaauacaaaaagaacuaccuauugauagaugcaucaacacagaugacucuaaaaaauuuacgcugaauaaaagccagacacaaaagaguacauccuguuugguuauacuuaaaauucaagaauagacaaaacagggaggcucaggugggaggaucgcuugagccugggagguugaggcugcugugaacugucauccugucaucaugcaaucacacuccagccuggguggcagagugagauaccaucuuggggcggagggggcuggcggggaaggaauagauaaaacuaaucuacagugauggacaucagaagagugugauccauaggggagguguugaccaggagguaaaugagagaauuuuauccucgauggauguaauauugucuagcuugcucuugaaugugguuacacaggugugcguauguguguguguguauaaacucaucaagcuauauacuuaagaauggcagauuucauauguuuuucuuccccauguauuuuaggccucaacagaagcagagaaaaaguacuuuaugaaagauaauuagacucuuuuuaccuuauccauugcccagcaaagguuauuaggcaaauguaaaauuuucuacuuaaaauaaaacaaacaccaagcaaaguguggcuaaacuuuacaguuuuucuuacccccaaauaagccaaaauuagaauauucaaaccuuauucauuaguaucaacaaaaacuuggaaggaaaguccaaagaaaauaggaguacaccaguuaauccauagcaacuaucauggucaccaaagugaagauucuauaguauauuggcaaugaaagcaaagcuuucacuguguaugucauuuucaguguguguuuuaccauaaaugcuucuguucauaauuuuauuuaauuauuucuucauuuuuagcacaagggcaguauggcauagaagaaagagcaagagcuuugauucagacaaaccaguuuugccacuuacuaacuauaugguguuaggaaaguuuccuaaucucuuugauacuaaguuucuucacaauuuaaaagagauaauaauacuuacuuugcaaaauuguagcacaauuauaguagguacuuaguagugguagcuauuuggcaauagcucuuuguaugcaaaguaucaugucagccacuugaacccuaucuaagaaccugaccaucuggaaaagacauuuagauauaaagauuggugacgaaagguaagaauuuaacaagggcuauagauuauaaauuauaggguuucuauguagcuaguaggguuguagagugaguauucucugaacagagcuugaaaaaaaaugguugaaaauuaguuggggagaaaacauuuaaggcaggggaaauggcacaaauaagaacacagcugcaaaagcaggagagugaaaccuuuaggggcugaugcgugguuaggaccaccugugccacuggauuaguuuugagaaaucggagaaggccaguaaaguaaguuaggaccagacaaaaaaaaggaccauugucaugcuaagaagccaagaaucuuguaaguauugggaugccacuaaaggacuuuuucagggaacugaccccaguggucacuacacaugauaggaagggaagaaaagucaauacagggaaaaauagcauagggugacaagggccuaaaccaaggugcugaggggagugaaagaagcaggaaggaaagauauuagaaaguucaaauuuuuuuccuguauuucagaaugcaaauggaagagaaaguucaauuuuauuaauuuaaaaaaaaugaucacugaguuucccugaaugauauaaauaggccugccuucaacuucaggauugauccuaauugaccccuaaguuccucgagagcaaacauaagcccccaagccaacaaaacacauugccuggcacauagaaagugcucaguacaucauuggugaaugacucuccaaauauuccaaauauggaaaucuccauacacaaauaauacaauguauuaaugaugcaauauaaaacacgcagaaaagcuaaaaucacuuuuccuuuuuguuuagugaccauuuuccacaauaugccaaguucugaauuugcucaugcaagagcuaucucuaucuccagcuuaucaaaagacucagauauaaaucgcuccagaaaguugggaauguugccaccucaguugcuaagcucuuguguaauguuguucuaggaauccaucauucuuugcuauagcaaaagaacagucacuuuaugacucaugaauauuacaugaaaaaauuaaaacaguaaauuaaauccaaaucaugugaauaaauauguguaagguuacuuucgagugcaagaugauuuaguaauuaauuuacuuauuaugauaauuuaaauuaaaauaaccuaacacuaaguaaugaagaaaaaaacgaguacuuccuagggcuaagcacaauucuuaccccuuuuuauguauuaacucauuuaauccucucaacaaccuuauaugguagacaguuguaccuaaauuuaaagaugagaaaauugagauacagagaaguaacugcccaagauuauacuacauggcagcagaggagcagaacuaggaauugaaugcaagcaaucuggcuucacaguccaauagauucagaaaaaauacuuaauaaaauccaauacaauucaugauauaaaacucuuagagaacuagaagaagagaacuuuaaauaucccgcaacaacaucacacuaagcuucagugcuacaaaagcauucuuauguaagucagaagcaaaauaagaaugcccaugaucaguaccacuauucuucauuguacugguuguccuagccagugaaauuagacauaaacaaaagaauaagagauuugaagaucagaaggaaaagaaaaaaaucauuucuugcaaauuauguauuuauguaaauggaaauauaauguuauuuaugaaguaguaacuagcugguuagaaaauaagaaacuaagagaaacuauucacaguagcaacaaaaaucaucaggaucuagaaauaaauguaacaaaauauguacaaguccuuuauuuauaucauaucauugaaggacacaaaaaggacaugugagauaaaugaaaaaauugaguauugcaaauauacccauucuucucauauugaucuauaaauucaaagccauuucuauaaaaaucccaacaggacuuuucaagaaacuucauaaacagguacuaaaacucauauggaaugggaaaggucuaaaauugccaaacaauucagcagaaaaacaaaagaaggcuucugcucuaugacauaucaaaaucauuagaguuaucuuaggaagauuuguucaggaaauauggagagcuagacauucuaaaacaaaccuuuuaauacuugcaaaguucuaagaaauacuggaaaaacauccuuuaaaaugucagauauuuguaauucuucaugucaucaaacuaagaaaagucauaaucucaauagaugcagaaaaagcauuugacaaaauuaaaaauagaguauacguacauauaacuccuagcucuguccacagagggccaagaaacaguaucaucucaauagaagcaaggacaccuagcacacagauuuugguuucuaauaccauccuccaauaaaaggaaucaagacauuuuggagaaauggcugauucuaagguuggggaagggaaaauacuaaaugagccuggagcaucucauagugccagacaguaaggaaaugauaaaaaaaaaaaaauaaaaauuuuuaauggggacauuucaaaaggacaaaaguaccaaccugaaaaaaucccaaugccaaagcuggaacaauuuaagcaauauaaaaaugguauuagauaauagcucaaagacuaaauaaauauccaucaauauacauggauauaaauaacugacucaauaauaaaucaaugggaaaaaagggaccaaucuuucuuagagaagaauuucuauuaauaaauguagaaagaaggaaggaaauggaaaaucaccauuagaauaccacaauaauaauugcugcaggcaagauccauugaacacuaaaauuauuggacaaaacuuuaaagagaaauagaauauuuguacuaccucaaaaauauuuauuaaucacuguggugguuuuaacauaugaccacaaauuauuugauaucccucccuuccuuugacuguggacuuucuccuaacaaauagaccauggaaagggggaaaaaguaacauuacaauaagaaaccuugccagacaccaucuugccaugugaucaaaguuaucaucaguugauguggcuaucauaugcugccauaugugauacaaugagaagggcacaacagcucugcgauauucuucucucaaaauccauaaucucagucuaauugugagaaaacaucagauaaauccaaauugagaugcauuuuacaaaacacauaaccaguacucuucaaaagugacaagauaugaaagacugagaaacugucacagauuggaguaaacgagggaggcaugaaaacuaaacaccaugugguauaugggguggauccugaaauuaaaaaaaaagaacauuagagggaaaacugugguaaucugaauaaaguguauaguuucauuaauacuauugugccaauguuaauuucuuaacuuugguacuuuacaaggguuauguaagauguuaacaugagaggaagcugggugaaggguauacaaaaacacugcacuaucuuugcaauucuuguaaauuuaaaauuauuucagaauaaaaugaauuugaaaauucaauacucauuugcgaaagcaauucucagugaacuagaaacagaagaaaauuuccucaaucugguaaagaacaucuacaaaaaaaguacaguaaacaucacccuuaauagugaaauauugagguauucuccccuuaagaugaggaaaaggcaaggauauccuuuguuaauacuucuguuaaauauuguucuagaggucccagccagugcaauaaggcaagaaaaggcgaaaaagagaauagaauuguaaaggcauauuuaaaccauuuuuuuuccagauggcaugacagcacauuaaaaacaaaaacaaaaacaaaaacaaaucugcauacugccaaaacuauaagugaauuuagcaagcgcacaaaauacaagaucaauauauaaaaauaaauuuuguuuccauacacuaggcaagauguuuggaaaauaaaacugggggaaaaaaaaaacuccaccacuuacaacagcaucaaaaaaacauuaaaugucuagaaauaaauugaacaauguguaaguccucuauacugaauauacaaaacaauguugaaaguaacuguagaagaacuuaugcaaugaagggaaagacucaauucuguuaaaauguucacuuucccaaaguugcucuguagagucaaugcaaucccaaucaaaauucugguaggcuuuuuuuuuuuuuuuuaauggacauugacaagcacauuugaaaauuuauauggaaauguaaagcacuuaaauagucaaaacauuuguuuaaaagaacaaaacuggaggguuuacaauaccaugucaagacuuaccauaaacuacaguaauuaaaaaaguaugguacugaugcaagaauggauaauuaguccaaguggaaagaacagaguccagaaacagacccaaauauaugaccauucauuuauuaacaaaguccccacgcaauucaaugggaaaagaaagguguuguuuuuuucaauaaauguguagaguagauggauguccauauacaaaauaaaucuugaucccccccucacaccauacacaaaaaucaacuggugauaaucacagauccaacagcuaaaacuauaaaguuucuggaggaaaacaaaggcaaaugucuucaaaaucuugagagugggcugggcgcgguggcucacaccuguaaucccagcacuuugggaggccaaggcggguggaucacgaggucaggagaucaagaccauccuggccaacgcggugaaaccccgucuguacuaaaaauacaaaaaauuauccaggcauaguggugggugccuguagucccagcuacucgggaggcugaggcaggagaauggcaugaaccugggaggcggaguuugcagugagccgaggucgugccacugcacuccagccugggugauaaagugagacuccaucucaaaaaaaaaaaaaaaagagaauaaauaggcaaacuucaggguagaaaauuccugcaaacauauacccaagaaagauucccuauccagauuauauuaggaacuaaaaaucauuaacaaaaagguaaccuaauuuuuaaaaaaugggcaaaauauuucaauaggcaggugauaaaggaaaucuaaauagcugauuaagauauuuuaagauguucaacauuauuaguguuuauggaaaugcaaccaaccuaccaaaaaccaucaauucaacuccuugguauauagcugagagauauaugucuaccaacggaaguuggaagaacauuccucacaauucaauucuuaauggcccaacaaugaaaacaacucaaauguuaaucgacaagaaaaugaauaaguaaauugcucauauuauauauccacauaauguaauaccguagaagaggugucaauaaauuuuuuucuguaaauggccacgugguaaauaguuuaggcuuugugggccauauggccucuauaacaacuacucaacucugccaaauggggauaacuauguuccaguaauuuuuuuuuuuuuuaagauggggucaucucacugucacccaggcugcagugcaguggcaugaucguaguucacuguaagcucgaacuccugagcucaagagauucuccugccucagccucuugacuggcuggaauuauagacaggagccauggaacacagcccaauaaaauuuuauaaacagaaacaugcaguggguuggaauuggcccacaggccauaguuugccaacccuugauacaaagcaaaaauaaaaaacaaacaaaaauucuuauacaugcaacauggaugaauacaaugugaacaaaagaauaaacuguaugacuccguuuauaugaaguuuaaaaacauuugaaaauaauacauggucauagaaaucgggacaguaguugacugggggaagcgaguggcuccauugauaggaaggggcagaaggaaugaaaauguuuuauauguuuaucuggguaguaaucacaaagguauacacauauguaaauuucaccaagcuacacacuuuuuuuuguuguacauaaauuauagaacuaaaaaacauauguagaauucaacauggauaaaaaauauauuaaauacauuaaaucuaccuuaaaagaugugggugauagagugaggaagucuaacagaagucuaaucauagcuccuaaagaauaggacaaaaaugugugaaaauaaagagauaaaagacaaaacuuuccugaauuaaugaaacauaaaccuuagagacaggagauuuuauucauauauauauauacauuuauauaaauauauuuaauuuuuauauaaacucuacagagagauuauauauaaucuauauauaaaguguauguguauauauuauauauauacacacaccuacauacauugccucaaaagucugugaguacaaauuauucuugaugauacaaggagcaguuaaaaccauaaagcaauucucgaauuucaaagaauuguuggccuugacacguaugcuaacuacagugcaaauuagaaaucaguaacaaaaggauaacucacaaaaccuuccacauuggaacuagacuacuuucuacaaaucucuuaggggaagaaaaaauaucacaaugaaaaaaucuuaaauucuuagaacugaacaauauacuacauagaaagcagcaguaaaugaaaaucugcaguauuuucaaaugacaaauaaaccaggauuaacagccuggaaauaagcccaaacauaucuggguacuguaugugacagaaguggcacugcuaaucacugauauugggacaauuaccuuuucaugugggaaucugaaaauuaauuaagcuugaucucauaacauaaaauauauacaucucaauauauacaugucucagguaaauuaaagaacaaaauguggacaaaacauaaacuuaaaaauucuuagaaaaauauucagaauacauuucauuaauaguagaguaucuuaagacaaaaagcauaaggauuaaugucuacaguuuaauaucugcaaguauauaacaaauauuuguauccagaauguuuuccaauauaaauuucugcaaugauggaaauauucuguucuauaauguauaauguaaaauauauaacauaauaaaauauaauaaaauauuaaagucauaugaggcuauugagcacuaaaaauguggccugaaagaacugaggaacagaaauuauugagguaaauacaauauguuagcauuuuaaaacgcugaaagucuguaaaguucugugauuuuuauauacuuuuuaguauuucguuuuucauaacaaaauuugauuuuagcuaaaauuacuauauaaaauauuccaguuguguacaaaacauguaaaugugacuuuugggaaagcaaacacaccaaaugauguuuucuccuaaaugcuuuuugaaauauuauaaauuaaguuauaagaauacauaaagaauaauuuaaugaauacugguauguccaccauggaauuuaugaaauaaaacauuacugauaaauucccuagguacuccucccugagcaagauuuuuuuuuucuaaaaagaagccaggaaauaagaauaacagacggagagcccuagacucaggcuucuucaguuugcaacacccauauuuuaacauauuuggggggaaauguaacauucaaacccaguguguaucauuuaacaaagaguuacaaagcaaacacccauguaaccauugcacaggucaggcgauaaagcauuuccagcaucucugagccccugacccucuccuccccacuaggagaugaccauuagcuugacuuuuuuucuuuacuacuuuuaaugccuauacaugcaucccuaaacaacagcuuugcuccaccagguucugaauuuuacauagaagauaucacacagcauucuccggcaacuuuuuuuuuuuuugguucaacacugaaaggcauuuguguugaaacacaaaaauacuucauuggccacuguacagugugcccuuuuuaugagugguguauaauuuaucuuucuccuucagguaggcaugaaggcggcauccaguuuucugccauuacagucaaccuucuuguacacgucugcuuguggacauguauuaaaauuuaucuagggcaguggcuuucaaacuuuuuuguccaugacucauacuaaggaaugacguuuuacaucaugacacacauuuguguauguaugaaacugaggagggggagagagauucauaaagcgaacaccccuaugaccugagagacacugauguucuauucuccgucuguguuuuacaaauucugaucauccauuuaaaugacuuuacgacccacuaaaauggacuucaaauucugaaaaacauuguucuuaaggaugaauacccaggcgugcaacugcuggaucaggaaacacggacaucggacgucgucaacuuuuccagauccuuaacuguuaaauguucuuaucuaagcgcauauaaauuuaccacuauuuaacuucagagcgaaaagcgugaaacaucagagaacauuuuaucuuuucccucggucauuaaacaguauuaaucacuuaccaugugcuaaguaagcaaucucugagcccagcgagaccgguggguuaauacgcggaggggcugcgggggaggacuuaggggaccaggaccucagugaggccccagaaagcacccgggaggggccuccgauccugccugggagggagggguuagaggaggauuccuggaagaaggaggaccuaagcuggguguuucuauuuuugauuuuuauugguuuccuaaaacaugaaaguaacacauuugaugagaaaaaauauucaaaauuacaggaguauauucaguaaaagguagaaauccccauuccgcccugaaaguuggaugcggagacuaacagaagucgcauuaucagcugucccgaucuaggaaauuuuuaggaccccacguuuuuaaauacuuuuaagaguaugucugauacagucuguaauacuaaagcaucaaaauaaucauauuuuccauaagagacgaaagugcaaacaguuacugucuagucccauuauuacuuggaacagacuuuuucuucuuuuccuuguucuguuuuuuuccuggcccguuggcgagguuagagcgccagguuguaagaaucgggucuguggaccucauaccagauaggcgcgaacgccucuggcagcggcguccaggggguccggcggcacucgcgguggggcugccuggguugcgggugacgaucugcggggucccgcacccggccccgcggagcccggacccgcacguaggcggcgcggcaaaggcacacccuccucgcggccgcgaacccagcgccguccucgcagcgcggcaaugcacggccaccgcugcccccagcccgcccgccgcagccgcgagcacccaaacaccuacccugcggggcgacgacccccggagcucaggcgaggccgcucgggcgugccaccuccgcggccaugacggcgacccggggaagcgccccgcgcgccaaggccccgcgcugcugagcugugagcacggcugccccguccguccguccguccagcacccgcccggagagugaggccagagcacgccccagccgugucuaaaucaaggcucggggcgguaccgacgggcugaaugacaaauggcagaugccgugggcuuugccgcccgcggcagccaagaggauggcugcgccgaggaggccgcgcgcaggcggggcucgggagccggaacggcgcggccgcgaggagggcgcuggggccccuggcgggggcgucacguggcaggaggaggccccgccggggagcugggggucggcggccgaggcggggggagcugagcggcacccacacguccugcgggccgggucaccggugggggcaaagccaaggucgcccagguacagcgcuggcgcagguagacccgagccggccuggggucugcagcggggccugcuagccgaagucuccgccaggaugggccgccagagcccaaucacacaugagaaacgcgacagaugcugggacgcugcaauaggccaaacuaacuuaccuccugugccagcagcgcccaagugcagcugcccaaacgugagcacugaccgugagccaggcacuguccuaagcacuuugcagguaaauacguguaauccucacagcaacacugggagaaauacccgucucacagcugaagaaacgaagacgcagaaaggguagacagaaguaauuuucuaauuacgguaucacacuacgucugcuucauauaauuucaaauuuuucauguuacuggaauuuaagaaaaauaaacugaagggaaucucuauugcuuucuucccuaaaagacgugcuuuuuaaaaggccuauaagcauuacguaaaaagauuaagagagguguaaggagcucacuacauguucggguuuagaaagucucauagcucugaaagaugagguuaauuagcaucauacaccuccaccuaccuuuaggggguaacccugccucucaauuuccauuaguucuguuacuuucggcuuccuagcaaugagaacauuugcaauugcucugcaacuuuauuuuuccagauguugucuuaauucuaucuuuaaaugaauuugauauucacuguaacuuaucuaucccugaauuuuuauuuuuauuuaguucuugauggacuuccuucauuuucaagucauauuccuaaggaggguuuauagagugcugccauguuugagaagaucugguguuuuucucuauacauaaauaaaaagugaguuggguaaauauuuucaauucacaccuuccuucaaaaccuaacagaacaagauggcaauugcuuuauuuauuuuuuuauuauacuuuaaguuuugggauacaugugcagaacgggcagguuuguuacauagguauacacaugccauggugguuugcugcacucaucaacccgucaucuacauuaggcauuucuccuaaugcuaucccuaccccacuagccccccacuccccaacaggccccagugugugauguuccccucccugaguccauguguucucauuguucaacucccacuuaugaaugagaacaugcgguguuuaguuuucuguuccuguguuaguuugcugagaaugaugguuuccagcuucauccaugucccuacaaaggacaugaacucauccuuuuuuauggcugcauaguauuccaugguguauaugugccacauuuucuuaauccagucuaucaccaauggccauuuggguugauuccaagucuuugcuauugugaauagugcuucaauaaacauacgugugcaugugucuuuacaguagaaugauuuauaauucuuuggguauauacccaguaaugagauugcugggucaaaugguauuucugguucuagauccuugaggaauugccacacugucuuccacgaugguugaaccaauuuacacucccaccaacagcguaaaagcguuccuauuucuccacauccucuccagcaucuguuguuuccugacuuuuuaaugauuaucauucuaacuggcaugagauguuaccugauaagcaacuucagcaaagucucaggauacaaaaucaaugugcaaaaaucacaagcauuccuauaccccaauaguagacaaauaagagagccaacacaugagugaacucugauucacaauggcgacaaagagaauaaaauaccuaggaauacaacuuacaagagaugugaaggaccucuucaaggagaacuacaaaccacugcuuaaggaaaucagagaggacacaaacaaauggaaaaacauuccaugcucauggauuggaagaaucaauuaucaugaaaauugccauacugcccaaaguaauuuauagauucaaugcuauccccaucaagcuaccauugacuuucuucacagaauuagaagaaacuacuuuaaauuucauauggaaccaaaaaagagcccguauagccaagacaauccuaagcaaaaagaacaaagcuggaggcauuacacuaccugacuucaaacuacacuacaaggcuacaguaaccaaaacugcaugguacugguaccaaaacagauauauggaccaauggaacagaacagaguccucagaaauaacaccacacaucuacaaccaucugaucugugacaaaccugacaaaaacaagcaauagguaaaagauucccuaguuaauaaaugguguugggaaaaacugguuagccauaugcagaaaacugaaacuggaccgcuucguuacaccuuauacaaaaauuaacucaagauggacuaaagacuuaaaacaucagaccuaaaaccauaaaaagccuagaagaaaaccuaggcaauaccauucaggacauaggcaugggcagaguucauaacuaaaacaccaaaagcaauggcaacaaaagccaaaauugacaauugggaucuaauuaaacuaaagagcuucugcacaccaaaagaaacuaucaucagacugaacaggcaaccuacagaaugggagaaaauuuuugcaauuauccaucugacaaagggcuaauauccagaaucuacaaagcacuuaaacaaauuuauaagaaaaaaacaacuccaucaaaaagugggcaaaggauaugaacagacacuucucaaaagaagacauuuauguggccaacaaacauaugaaaaaagcucaucauuacuggucauuagagaaaugcuucaaagauuucuguggaaagaucuuaaucccauguaauuuuccccuuggagguggcuugauuuuucugcuuggauaccugaagaauucuuuaacauuaauauacccuuuaguauucuuaucugggcuaugccucugugucaguuauucuagaucaauuuuuccccccagcauacaguaugaucuuccaauuuauagauuauguucuuuucuaaugucccauguauauuauauaucugaauacgcugcuuuuucagggcugaauguuguuucuaucuacuuguucugugauccaagguuuuucggacaaggagaggugggggaaaaggggauguguggaauucagcucagacagaguauaaagcuugcuggaggaacucaaccuucacaucugagauuccuuuaaguccucuggcagcuggacuucaagcuagccaagggaacaucccaugccucagaguuucaguucauuugcucaguucagcacaguaucccagaaagugggaaacuuuccugccucuggcaagauccaacagugguaugcaaagguuccucaacaucucacaggugugcccugccuuuccacauugggggacguuugugagaauucuuaggauuuggucugaucaucuuuuuccucaacaugucuugcagcgguggguggagggcugggcagacauagguucaucuggagacaaagcacgccuccauagaaucuucuguucucuuuguuuuugcuaucaauucucaaauuuuacauuauaagguuguacuuuuuucuucuuugguugcagcauguaaguuuuuuguugcuuucuuuccuuugggugauuuaguguuuuguuuuguuuuugagacagagucucgcucugucacccaagcuggaguacaguggcaugaucuuggcucaccgcaaccugccucccggguucaagcaauucuccugucucagccuccugaguagcugggauuauaggcgugcaccaucacaaccggcuaauuuuuguauuuuuaguagaggcugguaugggggugcuggguuggggggaaguucgccauguuagccaggcuggucucaaacuccugaccucaggugauccgccugucucagucucccaaagugcugggauuacagacgugagccaccaugccuggaugauuuaguauuuuaauuuugauuuuuuuagugcuuccuugugccaucuuuauccagaagucagucaagcagucuuucuuucucacugguaaugaacuauaugaaauccuuuuuuaucuuuagguuauuuccacaguggucucuuugaacaugacuauguugaccugguagcugugacacacucuuuuucuccugagcuuucccucaaugacgcaugcuuuggcauuacagcaugcccuagcaaagcuucuggagcagggguugcaaacucaaaucucuacaaaguuuaaaacagugaggaacaaugggacugugguaaagugaaaaggacauucuuuguguaaggggcagaugcucagcucaggccaauggcugccauguuugaacucagggcaggguugccacaucugcauaauuuucaagggaaguaugcuaucuaacauuuuaauauaaaaucuucuaauuuuggaaacacugcagaggccacaugaaguauuucuccaggucaaacuggacccaaggguugccagcguggucacuguaguagacagaaccccucaggacaaauuccauaaucacacuuuuucucuaaguauuuggagauuccauuuuauucugcagacuauugaaugacuucuuaacauuucuucagcaaaugcagaacaagaaaauucaugcugacacaucuauagguugauacaaugugucaggacccaacacuuucaggaacagguguuaccagggguaacagcuaugauggggcuaaaauuaauaccacaugggcagacaaucauacagauuaugcccacauuaacaaaauaauggagggggaaaauguuauuuucaauugaugcaaaaagagcauuugacaacuacaccccauccugaaaaaaaugacaacuaggaauggaauggaacuuccuuagccagauaguggcuauauuuuauccuauagcugccauaacaaauuaccacaaacugguggcauaaaacaugaaauuuauuuucugaguccgaaaggccagaagucugaaaucaagauaucagcaaaggccgcaggcgccaucuaguggcucuaguggagauuccuuccucacaacuuccagcuuuuggugaccacugccauucccuggcuuccucggcuuccuuggcuugcggccacagcaugccaaucucugccuccaucuucacaacgccuucucugugcgugccaugugcuuucuccuguguguaucucucuuauagggguagaugucacuguacuuaggacucacugaaauaacugaagguggucuccucauuucaagauccguaacuuaagucacaucugcaaagacccuuuuauucaacucagguuacauucugagauuccagagauuaggacacaaauauuuucgagggucaucagucaguccucaugucaaaguugacaugggcaaaauccaugucagcuuugcuauagaaauugacaagcugauucuaaacuuuauauggaaaugaaaagaaccuagaagagaaaaaauaaucuuaaaaagaaaaacaaaguuggaaggcuuaugcuaucugauuuuuacgccuacuauaaggcuagacuaaucaagacaauaggguaauggcugggcaugguggcucacaccuguaucccagcaauuugggaggccgaggcgggcagaucauuugaggucaggaguucaagaccagcuuggccaacauggcaaaaccccaucaauacuaaaaaugcaaaauuugccaggcauaguggugcacaccuguaaucccagcuacucaggaggcuaaggcaggagaauugcuuuaaccuuaagguggagguugcagugagccaagauugcaccacugcacuccagccuaggcgacagagcaagacucugucucaaaaaaauaaaaauaaaaaaaagacagucggguacugacauaaggguaccgacaguaggguacugacaaaagacagcaggguacugacauaagaaaaaacaauaguguauugaguccagaaauagacccacacauaagaucuauuggguuuuguuuguuuguuuguuuggagacacagucuggcucugucgcccaggcuggaguaccgugacaugaucucggcucacugcagccuccaccucccaguuucaagugauucuacugccucagccuccagaauagcucggacuacagagagaugccacggcacccagcuaauuuuuguauuuuuaguagagacaggguuuugccacguugcccaggcuggucucaaacuccuagacucaagugaucugagcaccucggccucccaaggugcugagauuacaggugugagccacuguccccagccuagaucuauugguauuuugacagagguauaacauaauuccauuggaaagagauaaauggugugggaacugguuaucuauauagagaaaaaaauaaacuucuacaugcauuucacgccauucacaaaaaacgaaucaagugaaaucucagaccuaaauaaaaagcaggaacuauaaaacuucuggaaucaccuuguucaauacaguacccauaagccauguauggcuaugacguagcuaguucaaacugaaaugugcuacaaguguaaaauauacucuggcuuucaaagacuugggauuuuuuaaaaauguaaaauauccuauuaauuuuuauauugauuacauguugaaauaauauuuuagauauauugcauauaauucaaaguaacuuaaacuauuuuuaaaacguggcuacuggaacauuuuaaauuaccuaucuagcuuacaugauauuucuguuugacaacacuguuuuagaagaaaaccuagggauaggcagagacuggcuggacaggacacaagaagcaaugacccuaaaagaauaaacuggcaauuggauuuuacuaaaauaaaaccugaucuuuaaaagagaccauuaaggaaaaaaaucuaagccacaugggaaaaagucuucacaaugcauauaucugacauaggacuugcacuaaaauauuugaagaacccaauaauacaauaaacaauacacuucacuaaauaagacaugugaagggccaagaaguccaagaaugacauuaaacaucauuuccccaaugauuaaugcaaaucaaaacuacagugaaauaccgcuacauacccacuggaaaggcuaaaguugaaaagacugaaaauaccaaggguuggugacaauguggaaaaacuggaacucucgcacauugcuagaagaaauauaaaaugauacagccacuuuggaaaacaguuugaaaguuucuuauaaaguuaaacauacucuuauuauaugacccagcaaucucagucuuagguauuuuauccaagagaaaugauaacaugucuguggaaagacuuaaaugcaaauauucauauucucuccaaacugaaaacaacucaaauaucaguaauaaaaugggcaaacugcugauacugucaacacagaugaaucaaaacaacaacaacacugugcggagucaaagaaaucauauuguauuagucaggguucucuagagggacagaacuaauaagagauauacauauguguauauauauauauacacacacauauacauaugaguuuauuaaguauuaacuuacaugaucacaaggucccacaauaggcugucugcaagcugaggagaaaggagagccaguccgagucccaaaacugaagaacuuggagucugauguuagagggcaggaagcauccagcaugggagaaagauguaggcugggaggcuaggccagucucuccuuuucacauuuuucugccugccuuacauucgcuggcaccugacuagauuaugcccaccagauuaaggguggaucugccuuccccagaccacugacucaaauauuaaucucuuuugguaacacucucacagacacaccuaggaucaauacuuuguaucuuucaauccaaucaaggugacagucaguauuaaccaucauaauauguaaacgacacauggucccauucauaggaaauuuuagaaacacaaaauuauagucuuucuaaagcagaucaauaguuuucuacaguggaaggaggggagguguuggagaauuuuacaaggugauagaaauguucuaccucuugguuaguaagaagauugcauuggggcuauguauuugucauacugcacugaaugauacaccuaaaauacauccacuugauuacaugcaaaucauacuucaguaagugucauuaaauuauuuccuuucuuauuuggauaggaugaggagaaaucacaugagauugguuuuaucucuauuaccagcaauuugaauuagaauugaccuucugcuguuuuuuuuguugugagcuuuuucauuagcacucucuugugcauuaucagucuguuuucuaaccugugagggugucaguggcagaggugaaaccugaccuagagccuucucuuggacuccuaauccaguguucuuuuauaauaguaagcagccacagagaacagccucauuauggcauuuacaguccuucaaacagauugugcaccauaaaaacucgaaaaaaucuuuuaguguguucaacucaacagauauucaacaaaugcuuagauuuaauuuucucuaaucacaauauaaauaacccuuaaaaaccuguauacauauguaguuuuuuuuuaaagcgcaucgcuucuggccaaacuaccucuugcuggucuuauugcuggccauccucaaacuucaagucucuucuccuuuuuuugaaacuguaaucuuggcucagaggauuccugcccccuucccuccucuugccacuauuugcaaugacuucuccaucuagguaucacuuccccaacaagggcucccaugauaacaucuuugaaguuuuccccaagcaaaacugacuaauguccauuucuaucuucaacugacugacauuuagucaacauagaagacucacaaggugaagucuggcaccucuacuaaaauguccuacuuuacgugauaaaguuuuuccauguacucauuaucgagccugcucaagggaggacuuuggcaccugggugguuaaaugccucugcuaguugccccaucauccugggccaauuagacaaccaugugggugauuuauucaauagccuagucuuagaauuccuucacuuccuccuaauggaaaaccuccucuccauuuaaacaguucccugaauccauggcaaacccguagacuucaacaaccaggaucugcucuccccuggaaaucuucaacuccaaaauucccaccucugaucauaacuuccugcucuuccugguuucucacucucucacucacaggauguuuacucugacugcaguaagacucuccagucuccuucacuggauucccuccuuguuuccacuccuucccuagccagccuacaccacaagguucaagauuguaaucauuuucucaccacuguccagaucuugacauccuguccuugcaccaaaccaaacuccaaagcuccagccccacuaaugaaugagcacagaaggaauaauuuuaaaaaguuacauuuuguagccaucagaguaauaaugaauacaugaauuaucaauggaugcuaaaacuacuucggggaacauugaagaggaauaggauauuuauauagucuauauagucucaaaaaaguuaaagaaagaaauccuaucauuuacaacaacaugcaugagccuggaggacauuauguuaagugaaauaagucagacacaaagacaaacacagcaugaucuuucuuaccuguagaguauaaaaaagugaaacucauagaaguagacagagaguagaaugcugguuaccaggggcuggcgggggugagaggaugggguagcggguauuggucaaaggacacaaaguuucaguaaggaggaauaaguucaagauuuccaguguacacuauggugacuaucguuaauauaauuuauuguauacuugaaaauugcagauuuuaguaaguauucuuaccacaaaaaauaaguaugugacaucagggauuuguuaauuagcuugaucuagccauuuggcaaggcauacaaauauaaaaacauguuagacaccauaaaauauaucauuuuuauucaucaauuuaaagaaaaauaauuuuuuuaaaagugauguucacucuaacaucuaaauucucucugcaagaacuuuaaaaaaaguuaauaucaccaguaaugccacaaauugacauguaccuccuaaugugauauacugaucaagacacaucacauauguaguauuccugccaaagacgcacaaauuaaaucuuaaugauggaauaauuagaugaaccaaagucgagggacauuaauaaagagcgaggcauaguggcucaugccuguaaugccagcaacuugggaagcuaaggugggaggaucacuugagcccaggagaucaaggcugcacugaguuaugaccgcaccacuauacuccagccugggguacagagaaagacccuauauuuaaaacaacaacaacaacaacaaacuagacuauguugcaaaaacaucaauguuauaaagacaaacgcugagauuccagauuaaaugagauuacaaccacuaaacugaaugcaauacuucauucuaaagugaucccuggauuuuuaaaaaaugcuauaaaggccaggcacuguggcucaugccuguaaucccagcacuuugggaggccaaguggguggaucacgaggucaggaguucaagaucagccuggccaacauggugaaacaccgucucuacuaaaaauacaaaaauuggccaggcaugguggugggcgccuguaaucccagcuacccaggaggcugaggcaggauaguugcucaaaccugggaggcggagguugcaaugagccgauauggcgccacugcacuccagccugggugagagagggagacucucuugaggaaaaaaaaaugcuauaaagacauugaacaauuggauaaacuugaacaugggcucaacauugaauaauaauauuguacuaauguuaaauuuccugaguguaauaauaguccugugguuauguaggagaaugucauuguuccuaggagacaaaugcugauguaguuaaacaaucauaaaucuaguuuaaccucaaucgguucagcaaaauaaguaggcauucuauauuacugaaucuaaguggggggguaggggagcacauuguacuguucuuccagcuuuuuguuuugaaaaauuucaaaaccacaaaaaaguuacuuaaaaaaaaaaaaaggaaaacccuccagcucagauucagccaucugauuaugauguuccuuuauucaagcugguaggaacugcuggaacaacucccacaaauguagaaaugcauagcuccca

SEQ ID NO: 12629 - RNA, 39586 nt, Homo sapiens
cuuuuaccagcuuggaauuuguucaccucuguggcagguucaggagaguccuuccaaagauugggcgcagcuaggugacugccacuggcacccaccucugugcccaccccacagcuaucacucaugcaugaaugccucuguccaggaauggggacuuaugcuaugcaggacaugaauccugggucucuugauuuuuauuuacuuaacaggaaaagauuuuuaaauugaggucaauaaagaagaggcuaaaauggucacuuuucuuguaccguuacauuaaaacgaauuuuuuuuuuuaacaguuggggucuuauuaugucacccaggcuggccuugaacuccuaggcucaagugauccuccccgcuucagccuucugaguagcuacgacuauaggcaugugccacugugccuggcuuuggacugcagcauuaaaacacacaaacacacacacacuauaagaggaauacaugccaguaaaggaauucauaaaaguagaaaggaagaagaaaauucacucagaaucuauccauccagcacaacuaaugguaccauuugggggcauuacccuccagcucuuuuucauuggcacuaguuauuauaaaaaguagucccaaagagcaauguccccugccuguccacauaccacgcuccuccagaggcugaugaggaaaagggcaacucugugguugaacauuuacucuuggguuacuguuagucaacggggaauggcuggaagucuagcuaacucaaauauacagaugcgcugccuugaaacccagcagucuaccuggaauuaaacuucauccuuggccgucugugaaaggcguugaacuuuauuugucuuuuaguaucuacaauuuggcaaacucuuccaugcaagguuggggcugugcccagaacucugguuuuaaggggagcagaguguucccggcacugggagcuggggucgguguguuuucuagaagagcugcugucaauuucaagaucccagaagauaggccugguguguuugaucauuuccuccaaauccuugacuacuugaugucaagccucaccucuuaugggaggcagacauuguauuugacaaugacaggcuuccccuugucccacgagaaggaaaaacucagccccauggaagaccgcccaugcgcucaacugcuucucugacuugagcugaggucuauggcagaaugggaggggguucagugauguucagaggcuugaagggccagaggcuggcacuagagcuggggauugggacugcaguggcagcuuauauaggaagaagucaaagcagccucccuaucccggcagcccccuggggggagugcagaagaggaacucaagagaucucuggugcaugcuaaauuucaaggguacggggaaaacugggacgucggcuuagagggguaggcacuugggguuugcuguuuguaaaaguucagaguaugcuuuuugagaagagaguauauuugcccaugccugggagauggguauaggaggaccuugucuucauuuccuggcuggcucuuaggagguuuguccccuugcccauaaguauguacauguggauaggaggcugcucacauggcuuuugaggguucucaaguaugaauuaaaaaaagaagaaaaaugugugcuuugaguuagaucugagaaaaaaaaaaaaaaggcagcaagcuaagccaugcgucugggacacuggcucgccuccaggauuucaggagaguuggguuucagcaugcacagagagaaagugcuccauuucucaaaccuggauuuccuugucuguuuuccccuauagauacaaaucugagcccuugaauggccuuuuugagggaggaaggcauguauagcauugcucagauugagaaauaguucagauccaaauauuacuauagguuuggcuccuucaagaauuucuuccauugcuuuggaccaauaaauauuuaaaaaguuagguucugagcuccagaaaagccaacaaaaacauuuaaacauauggauuuuuuuuuuaaauugugguuaaaccauguucaguggagauuaguuugcagcagucuuuucuuucucucuuugccucgcauuccugcuccccccccucaucauuuucuuucuuucuuuuaggaagccagaaggguaaacauguugccauggaguucuguuuaaaauaaaauacaauggaaagaaaagcagcaugaugaaguaaccacauggacugcaggauacaccugauacuaauuacugucaugcagaauguucuggaagacauuugacucgccugauguauacauucaaaucaagcaaaguaggacuggaaggcuccuuagggaccaucuuguccaagucuuuccuuuuuccagaugaggaaguaggggcccacagagagggagggccuggaccucagccucccagcgcggagggagcagagccgggauucaaacccguggugcuuuguaggaaacccguaauuuccacggucuuuuuccuugggcugucaguaaggcccugaaauaggagagugggguuuacugugaaccucgaaggagcaggcucaagagccagggggcccagaauagggcagaggcuggcuucucacugggaggcucaacuucccgcaggggcgccaggcccugacaggagagacuggacauuaggugucuggaaguuucuccuucuaggggcuccaggagcaucccaccugaggccuggggcucccaccggaacgucaacucaugcccuuguggggcugcagggcugacgcgggcuggcacugugucuacgacagccucccgggcccccgggugcguggcugcggaugcucucuggcggccaccacaguucccacgcgcggcgggugaaugcgagccccuugucaaugcgugccccucgccucugcccccgagaggcuagcaaccgggccugccggcgucugauuggccgugggggccugacgacaggggcuccugguugcugauuggccccggccagcucuggcuguuuccuagcuauuaauacuguggcuaauaaacguucuccuguugacgcgggugcucggagccaugauuuuuugaagcguucuugacgucuguggcuggugcgggcguuucugcugugcaaggccugcuuccggggcucuagucccuggggcuccuggcaagcuccacaggcuguaaaggggguguuuucuuucuccuucguguuaccugacauauuaaagcagcgccccaugaggaccccaacgucccacgucucuaucuccccaacagugcgccuguuuaugaaaaaacgagccccccacacgccgucccaaggcucggcgccucuagugaccugacggucaauguucaccucccuagucauuagcuguggacguagaaauagccuuucucccuucuuuucagcccuggaaucucccgucugcuuuacagucaccuugugggaucguugggcauggggggcucccucugacgccgcuuaaaccccccaaagaagugcgggggagcgauucugacuugaugcccucggcggggccucucugcuguccucuuuggggccccuugcucauccucaccugcuuucugucaccgagcacuccauccuuguccuccuggcugccacccaccugucacccuaagauagauccucggucccuuucaacagcauuuugaccuuugcgagaggacauuugauugacggcccugcacgcucugccacucagagccgggcagagcugccgagggcucccaccuguuagggauuaacucccaugugccagcuccggagccgaggccgcggcagggcucggcgcaacaugugucgcugccuguuuuucggggcgcuggggcucuuucaaagggcauguguguggggaucaccccaacuuugagggguagcucaggcaucuccacaugggacacaguccgcccucuaaaaguacuuuccuuagagggcacggcuccugucuggauucuuauuacaacccugguguguguggugggggguaccccugguuaagguggaggaagcggacccaguggaagaggaaggggcauagcggguuccgcgaacaugaguuguaagcggcagagcccgggacuccacagccaggguuuucugacucggagacgcggagcucugucucccaugucaaagagaaccagucagaaacgcacgggugggcugggagggggugacagccucuggcuuacaucugggaaccaguuaugucgcccgggcauuuuauuuuccugaacaauaagagaaagcaugauuuucuuucgcuaagcccgcauccuccgauggauguuccgaaaccgccaggugugggaucugcgccccgacagccccaccuuggccaucggccgccugaggacggccagccaucggggcgauuccccccacacauugugccugaauucacccugccuggcgagccgggcucacgcagggaaaaagcacccgcgaccacaggguguuggucauggcggccaggggcacugcggcagaauuuuuuccucccuucuuugcugcaaucugggugcggcuagagcaauuugucauagaaucuggggggcucauuuuuccggccaaucacuuuuagagaaaugagcgcauugcagcagaaugcgcugacgucagagaccaccccuucugcgccuccauauaaaccccacccagccagccccuagcgcagacggcggagagcagagagggagcgcgccuuggcucgcuggccuuggcggcggcuccucaggagagcuggggcgcccacgagaggaucccucacccggugagugguuggccauccuugccgcaaaggaugugcaaaaggaagacggcauccgcuucugggaugggcucuguccuccuggacaugccgagagccugccugauccuggguccugcugcuggaggcggccacuucgccugguccccgagcguccgcaacaaaauuugucagaaagaaaaucuugaggcacauuucccuggggggaagucagggcuccucucuggaggguccaguccuuaagggugggcugggugguagggacuucaguucagaggagcgggaggaaucagauggaacuccucuuggauucggguauacggcagucacuggggggcgaaccccggauuuccuguauuagaagccgccucuagaaucgcguuaauagugggagauauggcggcgaugccuucugcgugccccaugaauuagggggggaagcacccgaauagaagggucucccgggcauauuugccucgccagcuguuggccagguuuuugguggaucgugggcgggaggaguggagguuccucuucgcgagguuuuccgaauccaaauacacagguuuagugcaguguggaccccaggcaaaauguggaguaaaauuucuacccgauaucaucugguucugcccugaucagccacuuucacaguggagagagauggcgcccaagugcaaaccugccaguagcccccuaggaucaguccuugccgaaggggggucgugggauugggggcacugggagaauagaugcaggggguggguuggggaggagagaaggccguguccuugggucugggaagagggaggagagaaaugcagaaaaggggguguguugcuggggucuggacgcugggagcuggggauggggugccgcgggggucuucagagcguugcgugguggucgcucgaaaauccugacauguugcagucuuggacuuuuggucaaaucgccuuuugccauuuccuuugucagagucaagcccccccaggccgcccccucccacccugggccggcgggccuggugggggcgcaggcggguggcuacguggcagguuucuggaagguuuccuggcuggccgcgagagggcgcuggcggcacugcggaauuuuggggggcgggguggggaggggagguggccuuuguucuccugauggagggggucgggcgcgggaucuacuggaggauccuggauucguuuacccaagagggaacaguuuugagaccccccggauucacugcggaguggccgcagaggccggggucggccuuugcgccguggcuucggguguuguggaggcgcacagaggcacguuaguugauuuccagugguuuuugguuucgggggucuuaggaagguguggcucauuugagcaggauggagagagaggcugugacaaggucagugaggggccaucgugcgggggcuagaaauuguuguuguggcgaaggagggaggcacgacuuuggaggcgugauguugaugccugggggcgaaggcggggagcggcgugguggcccccuuugcguuacuuuccagcgaugucacagguucugucucucguuccgagaccacccacaugcgugacagcggugccuggaggacugggucuuucugacuuuagugaacguguguuuaauuggauugacgaaggugggagucgggauuucugcuuuucccuguagcaggcggagcggcgcuccagaggggccuggcgcagguccgcuggguggcccaccuuccucuggggcuggggcccgguggcugggggcgcaggaggcgccuggugcgggcgggaggcgcugcgccgcagccacaggugggcucuggcuggugguggcuggagaggcguccagggggcguagcgaccuggcgcgguggccuggggugggcuguggagcccuuccuagccugagaccuguugggcacccccuguccauccaggcccgccgggcgcgggccggggcgccgcagguggcugcugcacuccuggguuacgggugcgggccgcgcgcccccuagcggugugugccagccccgcuaccuuggguuuugaguugcgcacacgcacacagcuaacacuugugaccugucagucaaaucauccuuacccccucccacuccucuccuccaccucccauuucuccucucccuccacccuuucucauuuccucgucccuccucccccuccuauuuuucuucucccuccucccucuuuccucuucccuccucccucuuccccccucauuuuccucaucucucuuuuccccuccccuucucuccuccccucucccugccccccuccuuccucccuccauaccccucccucuucccucccagccccucccuacugccuuccucaguccuccccuuugccacuccucccugccuuucccucugccugcccccuuuugcucucugcuguuccggugcuggccguuagaggucacgaagaugguuucuaaccugccccccucccaugccauagggucucuccucagggaugacaucauccguccaccuccuugucuucaaggaccaccuccucuccaugcugagcugcugccaaggggccugcugcccaucuacaccucacgguacuucaacccuccugcuaucauuucauaaccaacguggcgggcagaaucucccaaccccaccaccauccuugcaccacccccagacccacuagcaauuaaaagacaauuuuaaauuuuaacuaaucagcuuuaauuguaauuaaugaacuuaaacuguaauuaugaucuaggcuugggcuuuuaagcagguucucuaaccuuugaucaauugcagagggcacuaggagcacgguuuccuggaucccaccaacauacaaagcagccacucacugacccccaggaccaggauggcaaaggaugaagaggaccggaacugaccagccagcugucccucuuaccuaaagacuuaaaccaaugcccuagugagggggcauugggcauuaagcccugaccuuugcuaugcucauacuuugacucuaugaguacuuuccuauaagucuuugcuuguguucaccugcuagcaaacuggaguguuucccuccccaagggggugucagucuuugucgacugacucugucaucacccuuaugauguccugaauggaaggaucccuuugggaaauucucaggagggggaccugggccaagggcuuggccagcauccugcuggcaacuccaaggcccugggugggcuucuggaaugagcaugcuacugaaucaccaaaggcacgcccgaccucucugaagaucuuccuauccuuuucugggggaauggggucgaugagagcaaccuccuaggguuguugugagaauuaaaugagauaaaagaggccucaggcaggaucuggcauagaggaggugaucagcaaauguuuguugaaaagguuugacaggucagucccuucccaccccucuugcuugucuuacuugucuuauuuauucuccaacagcacuccaggcagcccuuguccacgggcucuccuugcaucagguaggggcuuugcagagaccaucgacgggcugacuugaguaagaacacgaauuaugcauguggccauuuccagagcacuuucuaugugauaugaacaugugauuuuuauguaauauguguauguaaacgaggcagccucauuuccaggugaggaugcauuugguaguguugauuuuuguaauuuaaagaagcugaaagggagagaggacccgugaggacugaacucucugucccaugggguagggcuuacauuuacauuaaagaaacagaaacuugcugggagguguaaguauuuggucacauugcuggcaacagaagggguuggaguuggacccagggugccacgcuagcugcccucaccccuucuuccccucuggcccagaguuauacuaagaguccuuuuauuucaaaccaaauguuugacaaugggacagucuguuugaaaucccagcugccugggguggucuugggggucuggguggccccagugcugguaccaugugcuggcuucaccuuuuaauaacagugugaccuuaaacaagucgcuuaacuacucuaaguuucaguuucuuucauggucuaaauggagauuaaaacacacacacacacacacacacacacacacacacacacacccccucguguaucuaccccacagggcgcuuuugaagaccaaaugcuguaacuacuaugaaagugcuuuguaaauugcuguggaaagugugagcuacucaagcacccgaggcugucccuccuugcucacauguccagcccaauucucccuuagugagaacagcacucaguaggugcuguguguguuuguguucaauuaagaaauuccagaauaaauaaaaaugaauuaauucaacaaacauuuucuggggcaccgacaaucugcccagugcaccaggcuagguaucugauacaaagauaaugaaaacagucucuuggaaccuaauugggguccucauuugaccaggaauuucuuucgucccguuuuaagccaaccaguuuuguccggacaagacaaaaacaacuugggcugcuuuagagaagcccagcucaguguagacaauagcugcccagccucugaaaggggcugauuggauuauguggcaaauggaggugcaaggaugacuuggacggugacaaaugaagugggcggagaccugcuuugaguuaauccaggcuauuaggaggggaccuuuugucuuccagagacuggcaggagcuuuuaccagugguuuuuacauccuuaauguucaggacgaauaauuuauggucagugaaaauccaggccccagugagauucgagugggcuguaaaaucgagaguccugcucccagugaguaaugguagugaauguuucugucacuuuuugcaaccguccauucauuugauccucacaacucccuguccugagccaggaccggccacugccacucccagggaaacagaggcugucaagaggcuccacagauugggccccacuggaucauugaaccccuguucccugaguucuagaggaagaauuguaccugucucagucccggccaccuccagaaggccucccucugcauuucugacuuugcugugccggcagccuggagccucccaggucccugcugucaucuuuucuagccacuacagucucugucuuuccuuucacagccaagcuucuugaaaggccugucuacacuugcugucuuccuuccucaccuccaauuuccucuucaacccacugcuuccugacucgcucuacuccguggaagcacgcucacaaagguaaagacuuuucuguggcuuaauccuugucauguuuucggcucauggacacaaggacacauuuucaugccuucucucacagggcucugcgucuccgguucacuucugugucuuuacacucccuucacagagacacuugcucccccuucucucguucuuagcauccccuaggaacuugcacacccaggucucucgacuucuggaccugcuucuuaccaugccgucuuaagcagucaggagucgcugccuggguucgaguccuaguuaaauuacuuagugcugagaccuugggguagguaaacuuuuccaagccagguuuaucucaguuucaaaauaggguuaaucgucuuuaucuggcaggucaggugggaugucucacagguaagcaccagaugccauuugaaaggcuugaagcaaagucaauaaagcauucaugggaaaauacaacuggaggcaccacuagauuuucguauacauuagguucccacggggaggaccgaagagagaagaaagaaguggaaagggaggagcgugcaggagagacaggagaagagaauaacuaaacaaagacauuaaagacaaaaaaaaaguaggaaagggagacuuagaaaauauuaaaagccaccaaaaacacauccaaagacgguuuccccuuacguuaguugggcuaaaagaaagcaaaugggaagaagguuuuaaauugauuaucccagugacaaaucccaggaagcuuucacaucaaaucacccuauucuggguuuuuaacuccuuccaucgaguuuaaccucuuuaccucccacauccugguaaacccugcccccucccuaccgcccccuuugcuggugauuaaauccugaagguacacgaaguauuucagugaaugaauggcuaacagaaaagggccuccccucccccuuacccuggcgguguuuuucaguuuuauuccacuuuccgcccuuuucccuuaaugaacacagggcuaaucucgggccuugucgaaggaagaggcugcagacguuaaugagguuagcugcuggauuccaguauucgucgcauaaggauccuucuuugucugcgaaggaaaaacacacugauuaucauaaugaggugaacuggccaccgccgggccggggcgauguggcuucuuaagccacacuucuaauuuuggugauggagccgacauuucuuuggcuucucauuuaagucuuugccucugucccagugcgaaguccauucagcgggguugaaaguugcaggcagcuuugggaaggggggcgucggacaggguugcauuguagaaaguggcuuuguucgauccuucgcacagaugcaaauggccagagcauucauucccuuucuucaagagcugaggacugggggggccacuggugaucaguucccaacucuagcucuccucugacucaucucaggacccauugaggacauccaaaacucacucaagaucaccaagugguaggaaaguacuaacuccugggcauagcccuaggggagugacuacaaugugaauacucauggaaugccuagccaggugaagaagugaaugcauguuggcaucccagagggaccccccuuaagagggcauaguuugggguucagauuugacuccagcauacuguugaaauugggcacagggggcuagugauuagucaggaucaaucaguggagaggagauuaaaacucacaucugggaguccggaaucagaacuuguaguucuuuuuuuugaaauggagucucgcucugucgcccaggcuggagugcaguggcgugaucucggcucacugcaaccucugccuuccggguucaagcaauucucccaccucagccuccugaguagcugggauuacaggcgcccaccaccacagccggcuacuuuuuguauuuuuaggagagacgggguuucaccauguuggucaggcuggucuugaacuccugaccucaugauccaccugccuuagccucccaaagugcugggauuacaggcgugagccaccaugcccagcccuauaguaguucuucuuuugccccuuaauaucuucacccacauguccuguacccugccugaacccuccuccucuuuuuguucugaucuuugagcucccuagagcccauaauucuuuagagcagguaugucccgagucugaaacaugcccuuauuugucccaagcucuggacauuucucaccccaaggcggaucaaucaugauuaaaucacuccaauuaaacuuuaggcuccagucagaccuucagccaaauggaaaaaaaaacuaggggauaagggagguaguuggagcaagaaaauguuauuaguugaaaccuuacgggaccuuccucccuuagugagucuguuggcuaaagguucucuggcuucgugaauuagaaucggauacuguuuccaaguuagcaaaaccaacucuaccccagcaccccacgaggaagaauguggaaggaucucccauuggccgguuggggcaaaagccugaggcaaucuuucauccccuuuugccaaggcgagacuuucccagugacggugauguaguuggccacucugacuauggguggacucggguguagaccucugaagcugagaucacacgaaaaccuggccuccccgccauguagcuguuggagaguagaaaaauagagcacgccugauguuucuaaaugagaagacuuucaauaguaaugaagaauccauggcacucuccucacccucaaacacauggcagucauucacauacaggccccaaagccacuguuagugcugcaguagcuccuguggacauuggaaagcccggagagggcguggaagaaaucagcuggcccccggcagguucucugggguuuugugcccaaggcuccuggagcccuaaaaacuuucaaaaguuaacuccccacguccccauccugcuuggguuucuggacuuuucugaggcaccggcagaggggucucguugcucccuugaguguaggggcagcccuuuaaccuggcuccuugagucccugcuuuuucugcuucuguugccuucuuccucgucuuccucucucucaauaucucccucucuuugucccuccccaguuccugaccuggccaucccggggugcccuugaccagccccgugucuccucagggugucccagcaccagccuggcacagaguggggcucaguuagaguaugugggauguugguuucgccaggugagugaaugaaaggacucgaccaccacagcugagccacuagcugggccaugcgaagaguucuaggugcaaaggcuggaggguggaauucauuuuugagaggugugugagcagcuuccgaccccugccccauuugaacgggggccuugcuggucgcgucccugcauucacccgcgcggccaucccgucauccaacaguugauccuaacugagcacgcccacggcccuggucuggccugggcaccggccaccguagcccaucccuugauggccucuguguccccaggagggcgggccgggggguugcccaggggcuggagcaguggacuguggcuccauagagguaggccggagggugugagggcagauucaagcuauccccagggcucugcucuggucggagccagccccuucucccucucugccuuccccgccccauuccugaugcugaacuguucuggaccccuggcccugagucucucaggaccaaagugggcacgggaacagcuguagugugugcccccccgggcuuuggccacaggucucccucucgaggugugguugugacugcgacccuucccuugccgugaugccuuccucccccggggcuugguccagcuccuucacucucuagcagcugcuggggcccaccucccaugccgaggaccagcaggggaaaccuccagggagcaucugcaggcucugcuucugcccggcugcuggcuugcucucccugguggcucuccagcggccagcuuccucacccacccggcacuccgcuuugcucugucuccugaggugggccugaccaaccuccccuucucugccucagucccugggcuccagggcucagcuccacagcccucugccuagcaggcugguucucccugccaagcccauaccuguggucaccuggcccuccuguggucugaguaccacuccccugccccaggagccacucccacuccagcugccuguuuccagcagguucccagugcccccgacaagccccugcuggugucuccaucuccugccaagcauccuccagugccuccuccugugggccuggccucagggcuauggacagacuccugucccaucccagagaccccucgugaucgugcccugguggguguugcccccgccugccuuugccuccgccguggcccugagaguccugggcucugccccgcccggucccuugcuccccacucaguucuggauuuggggcugccccuaacccagcccguugcugcuuugcaccuuuuccugucauugggcaucccccaguagucaccccacuccaccgaaaaguaaacugcaggugaggccgugccccgagucuuucuucgguguguuuggcuuuuccggggcgcuugccuugccaugauucuaacucucugcccuuccccaaggcacgugggccguggcccggcugggucggcugaagaacugcggauggaagcugcggaagaggcccugauggggcccaccaucccggacccaagucuucuuccuggcgggccucucgucuccuuccugguuuggggugaguuucuugcuuucuugagacccaggauuuuauuagggucagcucaugucucuccucucugaucaacaagagugucaacauuuaauuuggggaggaggcacccugccaaggugaauucucuucacaucagccccaggggucugggggccggagagcugccuggaguggagacccuugcuauacccagcaagcauguguggggguccacccuggcugauggcaugcugugggccggcgacgguagguggggaguguccaccuccacucuagacccccgagagcggcucgggccaggcacucaggagcccucaguacggcuuugcugaacacauugcaaaagggauccagggggcacuugcccugcccacacccggcccagggaccccuucggagaggaggaaaugggaaugcuugccugcuccucagcuaggaagacauuucuuuccaccagccaugguagcgucacccccugugagaaccgugguuucucacacaugaggcuuugauaauguccuuuaaucaaauagugguuuuugagcaaguucuucucuuuccuccuuuccucaccccugaaauugcaaugagacgggaauguuuuuguuuguuuaaauaaaacagcaaugguagagaagaagaaagcgggauuggagccacacaauucacucgaggacccaucauuuguuuauuuguguuuuacuaauucaagaugcagccgggagccguccagggcucgggccugggguuguucuggggcgccuaaggcugggcuuugcacuaaggaccagagggucuacuugggugccguggagcacccaugcagcaagguggcuugcacagcagccaggcgaggugucgucgagggcgggggcucaggguggcaugcuggacggccaugccaggcugaaguuugggcuggcaggaagagaggaggcucagcugaggccacuuuccuuucugggggucccagggacugagucuguggcucacucagggcgaugggguguuuuuagagccacugcccugggaggcagugucaggauccuggcaccccucauauaugacgccccugggguggccauuguggugaaugagugcaguuagacuucccagagaagcugggugggcgcugagaaaggucugaaccguggggugaggcuggcuccauucccccagacauuuauggaggcuugagggggcccuagcacuguccuuggcccagaugccaauacuccccucuggacgcccacgaauggggucucugagaaggaaguggaugaacacagcugcacgcuggguggggcccagccucuaguccucagccaugugcacgcaucagcccuugugcaggccuccgcccuccgccaccccccacccccggagugucucugguuuccgacgcagccucguaaugcucuuuaaucaaacagaggauuuggagacagcucuccugcagcccugcacuucuccccugaaauugaaaugggauggggauauuauuuuuaaacaaaaucuggcagcguaggcagagggggcagaggcgcucuaaccuggggcuguugccuuugucugcuuguuucugcucucuggagagccccagagccuggagagacggggaggggagugugugcccagggcuaaacccagggagggggcccaggaaggcucugccccgugacauuuacuccaaggcuagcauuugcugagccaccugcaaacacagugauguggagaagaggcccgggaggggagguuugcacaggggcaggcugcugggguccuggggggauccugucccaagcuuacuagaaugcauucgaguaacuggucugagccagaugcccucagcucuuggacugguuucucacggacaucucaggacuuucccaagguggacuaagcccagggacaaagucaaagugaaggccaggggcacacaggagaggcccagauaggaccaagcuuuggcagccccuggcucucagggguugaaauggaacccucuuugcacugaguuguauuucagguacucaugaguguuucggucucaggcaaacacauauuugggguuuugugugucauuagguauaaaauagguaaaauaugccacguucucaaugaaagaaguugaaacgugacuuacuacgucagccuugcuggugaucuucucgggaacugccgaaaggccacuaguaagugcugaaagacaugaucauuuucaggaaaauucuauuuugauggauuggccaaugccugagccauagcggguggagaugagacccugacugacuaggcagugagccacagaggacccugucacaucagcggagggcggugaggggucucuggccauuugucaucgugcugauuccuagggggcugccucuagugggacucuucugggugggugcaagugucaggguaaagacggcggucuggucuggaaacuggcucuccucucgcaccugcccgcccugggugguugggaaaggaaaccaagaggguagcucaggccugagcucguggaaaggaagaacaugaccccucauucgcucacucgcccccacauucucucaccugcgaguugcucauugcugcuuucagggccccugaccucaugccuccugaguugugauucaaaccccaaaugaauuuccaaguacauuucuccaaauaaugucaaaaccuggcaagacuuaagggcaacaggaugcauguguuucuuauucauucauuuacauaaaauaacuuaaguguguuuuuuaugagcaaucugacuuccaaaaagaaugaaaaggaaaaucuacccaucuuuaaugaacuugcuaaugaauuuuuccuugcaaagaggaagggagcuuccuacagaaggggguguggagggagacagauucaggucccaaaggguuaaagggcaguggacaaugcggaagccagcauugugagcugcaguggaaaagcccugggucgcugggaguggcuucuuuuuaggagacuggaauuaaugaguugugaagugucccaaggacugguucccccucccugcuguuucucugagcccuguccccucuuccaaaggaggaauaaggaggucuagcuucgucucccauccccgauuugagcagauggaagagucuagaaaagagguguaccuuuugaaacgaggccucagaugugggguuccuggucuggaaaggggaaggaugaaucugggguaggagagggucucguauggagccccauucagacagggcagucccacaccugggcugcccacagguucuugggggagucuaaggaaaggggagccacagaacaggcuugccuccuuggcauggauugggucaguguuucagagccaggaaaggugggaguguggggggcccucggggcugaugagggcgugcagacccuccccucccaccuccugucccaggagcccugcagacacugcagcaggagggcacucugccagaagagggguuccagcuccagccggauccagcagacauggagagaccccuuaucuuugccaagacgagcucugcggugccugagaggcccguaggucuggaauucuagggccuucuggguuugagucagguccugaggccagggccugggcccugauccucaccauggaaaacuggucacuuuacucaggauaaacugugaugaggacuugggacauaucucugucuguccucucagcucgcgucaccccugagcccuuggcgaucgugggcggcccguguacagagcaggugcugggucacuggggccgccgugggccucccaacaugagggacugugugugagagaggaguucauuaagggagaggaugguggugaaggguguagccaugacuuucuuaacugcucuccaauuucuuugagcuuaaaaauaaauccagauggagaguucuuaaguccccuauccugggagaaaggaaggcugcccaccaccuucggcuugccucgacucugagcagugaauagggucuuuggcaggggcuuaaggaggagacucuuagccugggagcucccagggcuguuucagauggaaacaaaggcucaggccgagaggaaugugggggagccccccguggggaacagccaccuggggauaauugggagggcugagcgcagaugaguuuucccagguucugugaaugcgcccuuucaauggaaggugccuuuuuuuccagaugaaaagaagaaaacgucaauuaccuuccccugaaacggaguguguguguguucccucccagggguuguguggggccccuugcccuugugugugugucgggagcuccaaggcugcacaaugacgcacuuaaccagccacuggguucgcgcgacccugggaugcucacgcucuuagauucuagggcuugauuuugaaaguuucuuagcaaaggggaaucagagugauugagccuguaaacaaaaauuugaucaaccugggccugaugccugaaauauagccaaagagacagaauggggcugcggggagagagguccaggauggaaaguuggggaaggaggacagucgggggccaaaggcugaccgcaugucugcgccggccuccgcgcucacagcugggcugcuccuucugccaccccagcccuuucucugggccuuccuggcaguggacauagagugauucccuacucaggaaguuggcgguagggggcucagaaauccacagggcuguuguuucacaguuagccaggagaggagggggucaugguggcccgcagggauggugggcagcugcgagagaggggacgcuucagguuagagcgaagcuguuugcaccaccacugccccagacugccguaaggguagggccacuccagaggcaccagggacaaagucccugccgugacaggaggggggcacaggucucagucuuggcuggucacugacuuugcugcugcuggcuucugagccucagagaggucagcagucuuccagagaccugguuagagccugugcucagcccugacuaugggugugaccuuggccccugucuccagccccuuaggccucaguuuucccgucuacgaaaugggcgagugcaggcccauggucguccgaguggcucgggguuucuucaggccucccuggaggucaucugucguuuguuugcugggucuuuggaguuguugggacuuugggggucacugguccgcugcccccucugcuuuagagguggggaaaccagcgaucccagaggcccggagccuugcccgagguugcacggugagccggcagcaggcccuggaggugaagccccugccaguugccagcuccugugugaccuguguggucggggggggucacagucaccggucauuagugugggucagagcucuugcccaaagaagguuccaaggggcugccccaugagcugggaugcagggaucguguuuuauggggcauuauuccaaacaggcaggcugcuggucuggucuggaacaccuuuuuggucuguagagugacucuuguuuaaugagacuggacuuguggcuucagaaccaggagauguucguucccccaacccccguggcucaccuugugccuuuuggguccugagacccucgccagcgccucuguuggcacgguggcccagucggcugagaacuuccugaaaaagccaacaggaugacaacuucuggaaaagugaucaucacccgccugcacuggcugcccaucuuagacucagcuuugccaacauucccagcuaucucugugugcugcaguguguaguaaugaacagcucacaaaaccuccggcugggccugcaccugguuauuaccguggugggcugcagcuuuuguuuugugaccuugguugcuacaauaccugcgagcugaaaugaggaaucgaaaaauugccagcuucaauuagacgggcagacugcuuucccaaggcugccuccgccacuccauccauuaacgguaaacaggcaccaaauaggcccuaauucucucuaauugcccacuccugaagcaaagaggugaaauuccaggaagaggcguauguaaacauccucuguaaccugaccaaguaaaauuagagggcugaugggggccugcgagagagaggggacaugauuucaaaagaugucccaauuaccucuccuauuuucauaaaugggucuguaauguccagggccccggccucacaaagguacaggaaauuagcucugcaaagagcuugcauuugucaggggaaguuguaagggggugguguuuacucaacagguaggaaguacgagaucugaggcaagacugauuauuuguguaacgacgggcucuauuucuugagaucaacauuuuaauaaaagucauccuuuuagguccuuuuguguuugaaacagccauaaguuguuuauaccaaagacaugccagaucaguuaggugcuguuugccuccagaaaagaggaacuuuuaaaauccuaagaugcagagcuagaguuuucuaaucccauuaagcuguggaagauguuuuuggaguguucaccaaugcuuucugcgugggucaugagcucacugcacgcacuuaugaggucuuccaucaaaugcuugugacaauuacuccucuggacucuauaaggaggccucguguuuuucuuugguuccagacagugacucaucucugcagcuuuucugacauuuguuaagauucuagcccagcacugcguuauuaacacaucacagcaagcccagagcuggcacacgcagcuuuuaaaccaaggcacgaauuugcuggggcuucucuguagcagagcagccugcggucugcacacaagaguuaauuaaggacggucagggacucugagguuucauggggucccuggagcagaagcaggaaaaaacccagaugcuccuuccugcuucugauuucuccgcuccuauuaaaaacacaaaaaagaacaaaacaaaaacagccaaacaaagcacccgccucugauuccugcgggaaauggcagugccuuuggucgcgcuguguguucuuggccugagucucguugccaccuuaggacguggcgauggugagaggccaccccagccacgcacagucucggagggagggugggaaacggucucgagugguggucaguagauaauggguggucuggcagccuuuagguaaccgaagucggccccucagucacccaugcacugaucauugcuucacuaacacuuauuuuaagacuuguuguuucuugguuaucaaauuaaccaguuauggcagaacaggguuuaugaagggcaaggccagggaaggagauuuuaggaagauuuggaggcaagaaguguccccagugcccuggccgggucuuggacauccuggcuggagacaugacuaggaauagagaggcagaggcagcagggguggcccagauggcagggguggguuggagagaucccugagaggccugaggacaggcggcagucuugggagccccugaagaccugcaguggggcaggcagcuggagucaggugucucccgggaccuguuuuuuuuuuuuuuuuuuuuuuuugagacagagucuuguucuguuguccaggcuggaggguaguggcgcaaucuuggcucacuguaaucucugccucccacguucaagcgauucuccugucucagccucccgaguagcugagaccauaggcacauaccaccacgcugagcuaguuuuuaguagagacgggguuucaucauguuggucaggcuggucucgaacuccugaccucaggcgauccaccugccucagccucccaaagcgcugggaugacaggcaugagccaccccccuggggcugguaccuguggucuguggcuucugccugcccuggugcccccacaucucucucauggccuuucuguuuccuggguggcuuugugggggugucccauggucucccccuggcuuccugucuccaccugugccuaauccaggaaacgguccccagagaugguguuuucaaacagaccuuggcccuguccuccuggcccagccccuggcugcccuaucaccuagcuugcugcguuggugggaccucagcugucacaggcuaccuuucuaugacgccuccucaccuuaaguagacucugaacagauuuuaaaagccauucauucaacacauuuuuuaaaugaauaaacuuuuuuucuguguaguuuucaguuuacagaaacauuggugggaaaguacagagaauucccagaucccguccccaccaucuccccugucauucacacguugccuccgugugguguggucuguuuguuccgaucgauggaacgacucugauacaugauuaacuagaggccuugguucacaucauuagggcucacucuuuguggcgcacauccugugggucuugacaaaugugucaugauacgugucugacauugcugaagucaccuuuucuuaaagcuuaacauuuugggaguauucugaacuauguuuggcccagccugcugcccgauuuuuauaaaaaagaaaaaacaaaacaaaacaaaaaaacaaguuaaaacguaaggcagaucuugacacugaagacucgaugugccuggccauggugcuucccggggccuacugcacugugaacaaaauugccacaguggaguugucuguccaggcacacaacgugugugccaugguuuugggaaacgcugcccauuaauagcccugcagcccucugugggcugcccucccggccacaccccgcuucccuggucuccuccagggccagccauccugcucgccgaccugggcaccuugcuucugccagagcacagguucaugcccugucuucagggccugggccacccccguuucucaucuaugcaggguccuaagccuuugggucccacagagcacgacuucgcuccgugaacagcaccaacccaagucuguuccaugucuccacaccugccccuuccgcuccauaggcagcuggugggugaguggagucaggagagaaaugcguggcuucuccaauuccacacuugcuggagguuggggagucucugcuccaggccaccccugcccgccccccagagcuguuguccucauccgcccuccuccuccucgccggccugagugagguucuacucugugaccuagugccuucuuguuacagcggaagccaucaccuggaugccuacgugggaagggaccucgaaugugggaccccagccccucuccagcucgaaaucguaaguggcuggaguguaaagaacacacauguggccuugcugcugaggguggggccagcugcccggagcacaccgccaggcggaccucguggaggggcuggcgggcacuggccgggggucugugcaccgggaggugggugcccaucgagucaagccaagugcagaccugggggcuccuguuuucuaagacaggagcccccugccuccuuguguugucucuguggcaaaagaauucuauaggcgggcuucaaaugucggaccccaaaagaauuucuucuuuuucacucuucuaaaugaauggcucuuucauuauugagucucccuuuggcucuugugccgcagggcagacuaggauggaagugcccugugagcuggggggcccuucaaagggccaaggagaaaacgcaggccgagggaccagccuuccaaaugggcuucaagcuccaaugaccuccgcucgcccccucgaaaugucuggaaaacauaaugggcagauuuucugucuucaaaguuuccggcuaaaccucuucaaguucuuuauuguuugggacugagacacucagccauguuaauggguaguuucuuuuguauuugccuugaaaggccaaaauauuuuuauauugccacagacaaagccaccuauuuaaaaaugaacuccauguccgucguuucccaccaggagacuauguaccaugugugugucucuauguauucuggggucuugaaacagguuucucauggggauggucauucaccacgguccagaggggcagaacaggcggcgcuugccuugcccagggggccuggggaacgugggcccucaucucagaucugcccccaguauguuuaggacgcgagccccagaaggaucugggaguaaacuuaacauucacugugucucugcucugcauccgccauuuguguguguuucuggacugugggcuguguguaccuugguuggugacucagugagaagaagcaggaaugccaaagauacugugaauguucugaguuuuguugcuguuguuguugagagguuguuucacugguaucuauugcauuguauaauaaaugaccagaugaaugaaugagugaagcaagagagaaugaauaaacaaguaaauagguaaagaaguaagcaagccaggaugagaguguguguacacaagaccaugguucauccgcuuugauggcuaggcaaucaauauauaaauagaaaaaaaccagugaaucacuaaguaauagggcaacacacaaagcgauaucaggugauuauggacuaagggguauguguaacucaaauauaugccucugacauuugacaaugaaaaagaaccuaaaugaaagaaagaauggauguaugaguagugaagugcagaaugagacauagauuuugaggcccgucaaaaugaaaagaugcaaguuagggaacaagugaucaaaagggagaagggaaagguuuuuuuuaaaaaaccaaaacaacaaagaaagguuaaaaaaaaaaacagacuagaggaugaguaaugaguaacucuguaaggaggaccaugucagacuauuguaagcuaagcauuaggacugauacaaauaauauaugcuccuggcauagaaaaauaaaccacagagaacgaguucaaagaauagcaaagaaagaaagaggacccagugggcgaaagaugagaguguacuuuuaccaaaaguuaucuaagccugagcacuugaagucugcacauaaauaaauaaaugacaaaagaaagaaaaaaaggccaaaaagucuacauugcguguguggauggaugaaugagcagugggagugcagcgccaggugacaagauguugugagggguuuugagucauccaguccugggcacugaggucuguuagaugaaaggauaugagaaagguaauauugguaaauaaagaaauaggaaacaauguaacaaauguuaaguacagaaauacauuaaugggugguaaauaaagauguaaaagaaggcaaugcgaucgaugguggcaaaagaucaucacagauuaagggcuauggcugguccacuucuagaaaaccacaggcuguccauuaaauaaugaacaucuaagugaacaagucagugaguaccuaaauagacaaggaugaggugaaugagaagacauggccccauggguccuccugaugaggguguugggguccccccugggcaccccagcugcaugaaaaugaaggacaggagguauggaaagcuaugacagaagagagaaaggaacgguaaaaagaaauaacaaccaaauggauaaauggguagauccacgagaagaguuaggcuaggacuugucauaagggcaccugacuccacuaauagaggaauaaaugccuaauaaaaagagagcaagcaggaaggaaggaugcuaugaaugcaggaaggaaguaaugagugagacguggaaccgcacggccaaggauggacguuugcggguggcuuuuugaugcguacagccaagccacuccauggcaaugagcuccgaagacaaagugcaagagagaaugagugagagagugagagagagagaaacaauaaaaaaugggaagaaauguaaaaaggaagaaaggaagagagguaauauauuaaggaauaaauacaugcaugcagauuuaagacagagccaugcuagaacaggaaugaaaggcugugugaaccaagcagaccgcuuaauuggcaccagugcugcugguauggucaaucaccuacucaacuaaggaacggcucaaagcauacacaugggagggaggaguggggccacagagagagggcccauuaguugcagauuacgauguauccaguuaggugcaccugccuucgagaaguguaaaaauaaguauuuacauagaaagaaagacugaauggaugcacggugaaugcaugaaugauugaacgacagaaaagauuugcauugaccgaugaggagggcauuguagacagggaugagggucauugauccugggugcagaucuccaaaagaaugacagaaagaaagagggagugguggaaagaaacaauaggaugggaaaaaaugaaaauagaaaaaaggaagugaaagagauaauaaauaauuagaucaaauaaguugaugaaaggggacugguuuagcacaagccauccacauuaauucaaaccuguggcucugaaguuuguuuuuuaaaugaccacaaguguaagacugaaugaaagaauaaaugcgugcauuccauaggaugcaagaaaaggagugaggaaugggaaaauuggaagaacgagagagggagagauguaagaaaagaaaggaaaagugaaguaggcauaugaaagaaaaggcacuucuuggacaagcacugaaauauaaugagacaguuuuacccauuaaauauaauaaacaguaaacguugagguucaucaauaaaagcacagauaccugaauagaggagugaccugaauagaauucguucagccgaacgaaugagaauggaugauuuucacuauccugugcacucaaggcccaaaagagaaagcaagagaggagagaauauggaaacguaugacaggauguauauaagcaauacaaacauauugaaugaauaaauaaagacauaaauaugugggagaguggaccacgcaaggacaaaaagaggagagaaggcagcaagaauuaugacuaauucaaaacuggguuccugagauaguuaaauaaauccugcaccaaauccccagggggagaaauuaacaaacaaaagacagccccacacggaccagugugcagaaggcuccaggaaccgcagauuaugguuaauccaauucugugcaccugagguccauaaauaaaagaauaaguauugaaaugaaagaaugacagaaagaaugaauggacacaugaacgacugaauuagaaauggaaaugccuggcacagccaggaaggagcugcccaugggauugucauucaucucacucugggcaccugagguccauaagcgugaaaagaggcaggaagagaagugucagggagucaaagauagagcuaaggaaaggcaaaaaugaaacuaaaugaaagcgaaagggaaaauaaagaaaaaccaauaaaaaagagaacgaauacguggguguaucuguaagaguaggaucuguuaggauuagucauaagacugucaguaauccugaagauggaugagauaauccaggcccagguucccagggggagggaaaauggagaaaauauaaaaagaugugaaaaaggaaaaaggaaagguaauaaacaaacaaccaaagugauaaauggauaguuaagggagguugucugaacagggauuauaauuaguuuacauacauacuccuuaaacagauaaauacauuacaccuuucaaagaauaaaugaaaaauagagagacauaccuggcuccaaaacaaggcuguaucuucugccacuguaauaaaauagaugcaauugagguucauaaauaaaagaauaaauacuuaaacgugaaaggugacuaaaugcggggaagaaagauugcaaauaaauacaugggccaaagauguuugguuugcccauggaguuuuaauuaaaaaaauuaauaaggaaaacaaauacccaaaauaaggaagacugacaaaugagugaguggaugagagagugaauggugcuugacguaggagcaguagugcuuuagggaccagcaugaagguggugaccgggagcccugauucaugggauucuguccaccugacuuuauaagaaccaagaauggcugggaaugguggcucacgccuguaaucccagcacuuugggaggccgaggugggcggaucaugaggucaggaguuugagaccagccaguuugagaucagccuggccaacauggugaaauuccaucucuacuaaaaaaauacaaaaauuaugggcgugguggcaccugucuguaauccuagcuacucgggaggcugagagaggagaauugcuugaacccgggagguggagguuguagugagccaagauugcaccacugcacuccagccugggcuacagagcaagacacuaucuuagaucaaaaaagaaaaaaaaaaaaagaaggagaaagaaccagagaaacauaaggaagagugagaggaagaaagaaagaugcaauuugggaagaaaugaaaaagaaaugaauaaagaauaaaauaauguaacggucaauaaauaggacuugugaauggaggccuuuaggccaaaggcuaugauuaauuucaagcuauguuacugaaguccauaaacaaaggacucagaucuaaauggaugaacgaaugacuggaagaaagggugguaggaagguaggaagaaaggaaggagggaaaaagggaagagaggaaggaaccuucuuuccaguccuguguucuagacaguggaaugaagugguccccagggaggguggcuguaggcaugucaugugcuugucacaugcacuugcccuggcagggaggagcuggcucaggaagacccuggucuuggggugcuguugcccuaucuuggcugugugggccauuucacugcaucugucucuuccucaguuuccccaucuguaaaccuggaguggcaccagcugccuacuagaguugaucuuaugugucucuguugaugguaccccaucuauggccuggauaggcaggaagggcuuggacccugagccccgcagaagguugcaugaacgaguggugugaagccuguuggguagcuuggccacucccgcggcaugggucaccugcacaggagguuuugcccaccagggggcagcagagggucagggagcaauaggcccuggguggagcaugggccccgccugcugugugccacccuggguguggcaccuacucacauccagggguuggugcagggaaaggccagaagguggccaggcgcaccugagaagggggacccagaagccccgggacccaggagcccugggcaagccaccagaaaccuuguucuugcaacucucugcagugugcccaggccacccucuggccuggucuuccauggggcagggcgcccacccuucucaacucagguuucccugggcagcaggugcaccucagcaccccugggguugcagaagugguccggggacccuggcuuccuugacaugccauccccagagccugguucaaggccucucugucuucucggcuguuucacgacguguuuuguaacuuggcgggauugcguuucgcugugucgagguugucucuucucugacucgcccuccgggggacugccgggguaaaucuggagaguugcucgugcugacaguccucccccagggccuccccgguucuguugagucuccuuucucuguaguggaggaaauguguguaguuuuguguugugugccuguguuugucuguaaaagcaaggaccaaagucucccuuguugaccucucaauuccuauuugggacauauaaaaacacuggauucuuaacaagcgcccggagcaguaggagcacagcuuggauggacucaggacuuguggcagggagcacgugggaggcaggggagugggguggggccaggccaucuggagugggaggcgucaugcucagagugacucuguagacgcugggugggauggggagugcgggcgcaggcauggauggggcuguuagcuagugugaugcuugaggucugagcugauggcagcaaaguggggugcucaggaaucaaagcuaugggguuauagacaggauaugaaggagggagggaggcaagaagaagggggugguucccacgcuucuagcuccggccgaguggauggcaacagcauuuggaaggcggaggacauggaauucaugugucaggagccaccuuccgagccuccaguaccacgugucagggccacaugagcugggccucgugggccugauguggugcuggggccucaggggucugcucuucuucucuuucagaaucuggggcuccaggcuaugccuuggcuggacugaggucugggggugcacuuauuaucccuggggacaccugcugaagcuucucccugacaagcugugucacuguuggaugaggauggggcgggagggguucagggcagaagaagaccgggagggucuuucaaaagaacucauguacggcuguuaaaaaaagucagcagaggcucaggaagacuuaaagugugcagaaggcggggaagggagggcccauugcaugcaccaagaggaaauuggaaggaacaagcgacguuggcugcuaggagagccugcucccaacaucuaggggcuguccugacgggucacagugggucgaacugagccaaugagagcagcucuggggagacccacuggugcccuggaggcuggguggguuuggguuggaugaauucuguguguccuuuuggaaauguggaggccaugaggggggaucagggcucuuaggguuuugacccuuaagaguuuuguaucuguaauucaaagguucuuuaguucugggaugcugagauucgggauaggguuccuaauggcacaaaagccagagauaaaacauccuucacgugcucccuacccgguucuuucuguaccagacccacaagguccgaguugggauccuagugcuccugucuggucagggccuaucuuuauguguucguuaaacuuuuaacaaugagaauuaauucugucucuugacauugucauuugcaugcuccccacacacaaauccuuuccuggugacaccaggagcuacaacucuccuuggccuccucuugugacucccaacucccuccuugggaagcuuggccucaggaccucugggauagacaggccacgaauccugcugugucccguuguguuccuaauauaaaugguguggauggcacuugaccuagagcagugggaaaugcaugcaccacucaacauucugacaugucacccauuuuacauucuuacaggcauacuuuuuuuaaaaaaagagugucuauucuuuaaugagcaucccuucuuuaaaaaaaccuaauugccauuauucaccacauacacuuuuuuuuuuuuguauccugccucuucuauuuaauuuucugucaucaacauuuucccuuguuccaugaaucuucauaaccucacuugcugcguugugccuuguugaguggcuauggcaucauucacagaaccauucuguuauucuuauguauaaccaccuuuuaaaaauauuaugaauaaugccacaacuaacugcuuaaaacacccuuuuuuucauucuuaagaauuauguucuuccacccagaaauuaucauugcuucacuacagaucaguuuccccugcuagacugugagccccauaagggcaaggagcuuauugaauuggccuuuguaucucugaugcccaacauguuguagacuauaaauaaaugaugaaugaguggauggaagaauggaggaaggagcgagugagugaguguuuggcugauggauaagaggguggaaggauaggcggaaggauggauuggugaaugaaugaaugaauuuccuuugguuaagucucuugaaagaaaggcuauggaucuuuguauggauguugaauaauuucaguaagcuuacagcauuuuacaauguucagcaauguaugaccacuuaauuaagauauggcuaguuugucucuguuauaaaguacuuuugcauuacuuuaacuugcauugcuuuaauuacuaaugaugggugaacacuuugaccuauguuuguuaacaaauuguauuuuaucuucugugaacuguuuguccaaguccuuugggucauggcuuucugaagagacuggucccagauguccuugggauguagggagcccauagcucacuggaggcauucaaggaaccagccaggcagcccucagagaaaguaguguuuaggagauucucauggugugggguuggccuagguggccuuucaggucuguuugauguuaggauuugcuucucccugggaagugggugauggggaaaaagacaccuuccauuggcagguguagacacugcaggcuggaccuccugggugugcuuguggacuccgaucuugcccuugauaaaaccccugugggacaggaauagcucuuugaaccuccaagguccagacagccacauccuagcacccuguacaaucaguuaguggccuucccaccagcgcagucacucauuccuauuagaucccgaugaagccaggcccugggguuuccauuuucccaccucuuaggggaauuggguuccccgcguccugugauaugucagcaaauguccucagcccuggccugcacauguggccucagugguggucuuugggguuuaacugacgaauggaacauuuuggaucaggacugaugggagaaucuccuuucauuuuucuucaccuggggcaauuacauucuaaggagcggaauaaagggcauguucugcccaaagcaucagggcucacaggucagucacagccauuuagggagggcaugucacccaaggagggcucgcccuucuuuccagagcauccuccgcucucagcagagcugcuucugcccacccaucccucuacuauagcacugagcacuguuugcccgugucagaaucccucacccacauguuuagcuugguauccgaguuugggaggccggcaaugacuuucaacaugaauugcuccaucuacccauccaugcauuuggccuacuuaucuugaccccgugcuuuuggccuuuucuucuccugaaagcaaacccuuucauuuugggugggcuguguagcgccaugggcugugguuaugaagcaaacacccuuucuuguagcugccuccuccgggguuacugcccugagcacgucccagcuggaucucgucugccacugucacccauagcuucuuccccauggugcuuuccaugugucacacaccacgacugugacccagggucggggucaagaguagccuggggccaagcccucccacccaugagcggagaaguccuccccaggccucaccuugccuggcgcauggucccucccaugagcuuugcuuucagccuuucagcuuccuccacaggguggcagugguuguaacucauccauucaucccuucaucccuucauucauucacucacagccaacagacguuuuuaaaaaauuagccagugcuauacuagagcuggcucccaaggacccgcugccgcauugccuuuugaaacaaaacaaugaacacguugguaaaggggccgugcuugugugucggugacaaggcgagaucccugagucaggucaggcuuguagauucgaguucuguugcgaguuugauugccccucugacuuuguccccuguacaacuagguugauuaggaaucagccaacuguguucccugggugcucagaaaucacagcccauauccucgagaggccaaaaugagagccaggggguuccaagaugaguggcugcuucuggccgggagcagguuuucaagucauuagaacacucuggccuuuccuggaggugaucuuggagccauuccugccccuuucaagaggaguuaaugcccagcucuguuuagagaaaauugggggagaugauugcucaugugggugauaagaaucaccucccgugcaggggucugcauagaacacuccauaggcaaaccuggguguccaaggcacguggcauuuugcaaacucugggugcagcuccgagcuguccugcaggucccagaccaggugagaacucccugaguuccugcugccugggucgggggugaggcauaggucuuggggguucaaccuggaauucugaaugucauucauugcauuggagaggaaggagaguaggcaaagccaagacccuggaacuggacaaacucgugugguuuaaagucacugugagagcuggaguugagucugccuacgggggaggacugcggcaccuaccucgcagggcuguugugaggagcaauguaaccgugauuuugaacugugauucuggaagggcggugugcguguccccgggggugugccaggggagugaggagaaaaggccagggagacagccucacucaggcagcugagugggagagcauuuaucucuaaaccuggagggguauauggugggacaggaggaauuugggcaggaacuuucaugcuagggguuugggggacucgcuggacaaugccccuggaccccccggggguacgcguucacgcucaccucugagaggcuggaaacgccuggcugugcuuucugaaugcugugugcuuccugccucugugccuggccugugugcagcaccuacuuguguccgccuucaaaaggcccuucuggguggcguccuuuuccccaaaauauuaggcaccagccaucaaagauacugcauuguugccucccccaccccuccccccaacugacaacauuugggcucaaaugcagcaggcugggugcccaacacagugccuggcgagugguagcgcuuacguuucuuuucuguugaauggauggauagcuaaugaaauuguaaccaaugacaagccuugauguuuauaaccuuuacuaagagauuauuauuuugcucuucauggaccuguuaacaaccaccauauuguaucuuacggacguuuguaugccacguuugaagagcaggagccuuguuucggcgucauguugauggaacuugagcugucugaugcgaaucuguguuuuauguuagaaagcgcguagccuuaggaucuggcagacccaggggccacuuaauuaacccuuugccucuuugacccucaaucuccuuuucucuaagccauaggucaccugaaagccuaccucacagggcuguugugagggccgaggguggguguguuucaacagugugcagaugcuggcuuucccugggaaugggcauauguugggauuugucuugaaagcaugagugauggcuuuacuaguccuaagugaauaaaaagucagcccugaccuuacgcugggauugcauuucccacagucaguggcaugugcagaccacuggcagagcagccugcaggugcuuagcgaugugggcccagaguaaauauuuguuugauugaugagugauggcuuuuuccuuccucagaguuugcccugccccccauuccaacgugggcugcugcuucuccccagcggguuguagcuggcagggccguugugcuuugggguuugcuguaccugucgcugccgugaggggacgaucugucugcccggagggguuucugcaaacauucauguaugccccugcuuucguuuguuagggagaaggaguggggugaccuagagagaggaugaggaagggguucuggguggcauccuugggguaccaacccugcuuccauccugcgcucugaauuuccucacagcccuuuucugucucugguagaaggugcagaagguaggcuuugccaccuucccugggccuggcaccaagcucgggggucuuguacacacuuucccuucucuaacuggggugugggcccauuuccuagaugagcuugcugagaaucaggacagcugguaucagagccaggacuucccagucuugcacaaacaaccugugcauuuuugaguccaccaaauaaggccuccugccugguccggcucaccccugccagcccccagcaaaugcagccuggugcguccccaccccugccaagagcccaggagugcucuggcagagaagugcagggaugaggaaggaggcugugcccuccaggggacucagcugcguuagaggaggugcugcugcaguggcaggggucuccagacaucccacgcagggguccuuucagaucaggcaucucuucaccagaccaccguauuccuuuuucagcccucgucucuugcacgugggggugcaguguuuggcucucacauccccacauuccagcugguggggguuugagcuggguguuccuucugcuccccacuccccacucacggcccccaccccacgcaagccucccuugcccccacucuuugucuccagcuuucacagccuuggcgggcaggcugcugcgccuguugcugccccggcucucuuccacccgccucuucuuucucagccugagcuuuaccgugaggucugggcgccacaccuuggccccugccaugccugcucccagaagcacccacguggguccccugauucucuccuccccugggcuuugcuaaggagcccuuucauuguggccuuuggugucugccucaugcccauccccuguucuugagaacuuggaagcagagggggccccuccuauugcucccaagaggcuccacaguagggagccccucccaggagauucugagucuguguuuaggugucgauuccugggugggccuugggguccccucaggccaggccugugugugaccuaaggcuggggggcucugucaggcaccuagugucccuuggaggugggcggggcuggguccuggucuccugaggacggguggggagacaggcucagggagauuuccacgaagcugcccuugaaccccuccucugaggcccacacugcccuggcccuuuacacccugccuccugcacuaguaggcacauaauagaugcucgccaccuguggagggcaggguuuaaauggcuggaaagagcugagugggcuguuuggcuagcguacgcgcauuuguuuaaaaggaaaggguguguuucuuggcaaagacucuucggaggaaacgcugaacuggggaugggucucuaccuguucuggggccucacugcccuuccugccggggacaggcagucacugguggguuuccccccaguggaaacacaauauuuuggaaauauuuguaucuaggauaaaacuucaucuggaccaacaugucuuuguugguguuguggcccaggugauuuugagaauguagaauacauuuggcaauuuccaaacggagugaugaccugcuccuccgccccccaugcccucccugaggcuggaggcuucagaagccccugccuugggaggaggcuguucuaccugagaagucuuuguccccaccguuggugacaaucagcauugaccugugaggcaccugccagguucgggacgcagcuuuagacauccagaaaaccggggguggagggguggggugggggcuuaagaccccagagcuugauuccuuuuaacugucucauccccaaagaaugguacauggguaccagguagguuacuugaaucacccugagccucgauuuucccacccguuagaaacaggguaauucaugacaguguccgcuugggagacggcugugaccccugagaauucucgcugcaugccgugggcuggcucgugagacucaaggucuggguucgaggcccccgcaaccccuucugacuguguggccugggcgaguuuguuguuuguaaccuggaaagcgucacaccugccuggcacgguuauugugggcuucaaugagauuguuugugugaaauaaacgcuuugugacuggcacacaggcgcucucaucccggcucuccuggugggcccggaccgcugggugcuggcugcggaggcccugugcucccuggaacugucugcgcuggucccagggacucuugggcagaguggagggcaagggggaaagcaccagccugcucuggggagacaguggcagagggaaguguuugcuuuuaaauacacucagcagguucagacaggagaggauccgaggggaaauguuuagagcccucaggaggaggaagagaccgaguuuuaggaaaaacaucaaagcuggauagguugggcagaagagcuggggauagcauuuagagaggcugagaguccuggguucuggguuaucaaggugagagaaaccagagguugccaguuguaggugggcgucaggacuagagugaugcuuccagaaguuucugcaagugggccgagucuaagguagggcaggguacgccagaaguugaggggcacuagguagacaggccgagcugguggcugggugcuccccucacccuccaugcugcuaggagcccgugagcagggacuugcucuccucucccucccuccuggggccugccugucugucugugaacucuugucggccagcgaggccgggagcagguggccuucaucugcaacugugucucucucagccuccacagccacggggacacccugcaccuauucccacgggacaggcuggacccagagacucuggacccggggccuccccuugaguagagacccgcccucugacugauggacgccgcugaccuggggucagacccgugggcuggaccccugcccaccccgcaggaacccugaggccuaggggagcuguugagccuucagugucugcaugugggaagugggcuccuucaccuaccucacagggcuguugugaggggcgcugugaugcgguuccaaagcacagggcuuggcgcaccccacugugcucucaauaaauguguuu

SEQ ID NO: 12630 - RNA, 27862 nt, Homo sapiens
cucaucucuggccauuccagccuccaucacccgccucaccuccaucauccucgcuucggggcucauucuggccuccagggcuuuguacaugguaggcuuucauucauucguuugcacauucggugaaggucuacugugugccaggcccugugccaggcaucguguagauggacguugcccuugugagugcacgccucggggagacgcacgccagccgguggauggcaggagagccugggccagggcugggggugggggcgugggugugggcaugagugcagaggagggugagcugguuuccagaagggcgggaucagcugggguggugggcagggggaggaagugcgggcucagcugagguccugcuguguggagccuggagggagagauugcauguccccucucuauuccccaugggucaucucaguaauggcugccggaguucaggggucccuagauugcucccaagguccucacucccaaguccuuggcaagauuccugcgccccaggagccuuuuggcaccugaacucugccaccuagucugcuggucagccucugugcugcccgcguuggugggugucauuggauuguuaacgauguacguuuugcucuaaaaugauggugauugaagaugggaauuauuuugucaguugauuuuaauguuuucuuuuuugugugugaaguguuuguugugaaauaucuauuuuggaaguuuuuagguguuggaaagccagaaucuggggcccucuggugucuaggaagaaccugugaugcccuggggugaagggauguggacucccagggacaaaacaguggacucugagguccucagggucaccucccuuuagggacuagagcacacucaguauucgggggccucuguggucuuuaaagaugucccauguuugcuaaggaaauguuacuuuugcuggaggaacuucugaaaaauguuuagaauuguuuaccugcauguuuuaucucguucagaauuagaauugguggcauguagauaugcuucugggucuaccgagaugaggcaggccuacugggucuccaccuucagcucaggacacccaucauucaccugggaggggcuugcuucauuagauguucacaaggcugaaaagugucccagccucaagugucacguggagccucuuccacaugcaucgccagaagcgccuccucccccaucacucugaccccgccccacacagacgugucacacuaggcuccuccucgagucaugugucaccgguggauggcaggagagccugggccagggcugggggugggggcgugggugugggcaugagugcagaggagggugagcugguuuccagaagggcgggaucagcugggguggugggcagggggaggaagugcgggcucagcugagguccugcuguguggagccuggagggagagauugcauguccccucucuauuccccaugggucaucucaguaauggcugccggaguucaggggucccuagauugcucccaagguccucacucccaaguccuuggcaagauuccugcgccccaggagccuuuuggcaccugaacucugccaccuagucugcuggucagccucugugcugcccgcguuggugggugucauuggauuguuaacgauguacguuuugcucuaaaaugauggugauugaagaugggaauuauuuugucaguugauuuuaauguuuucuuuuuugugugugaaguguuuguugugaaauaucuauuuuggaaguuuuuagguguuggaaagccagaaucuggggcccucuggugucuaggaagaaccugugaugcccuggggugaagggauguggacucccagggacaaaacaguggacucugagguccucagggucaccucccuuuaaggacuagagcacacucaguauucgggggccucuguggucuuuaaagaugucccauguuugcuaaggaaauguuacuuuugcuggagaaacuucugaaaaauguuuagaauuguuuaccugcauguuuuaucucguucagaauuagaauugguggcauguagauaugcuucugggucuaccgagaugaggcaggccuacugggucuccaccuucagcucaggacacccaucauucaccugggaggggcuugcuucauuagauguucacaaggcugaaaagugucccagccucaagugucacguggagccucuuccacaugcaucgccagaagcgccuccucccccaucacucugaccccgccccacacagacgugucacacuaggcuccuccucgagucaugugucacaugagacacccccgugugucacuuccagcccugacuacucagugucacuuggagccuuuugucccuccccaauguaccacuugaaccguccccaauccaugugacacaccaaaucucugugucccacugaguuccaucugcacucgugucacacaguuccacccucaugugccacacugagucacuccuacaucaugugucacagagagguccugucgccucccuugagucauccugagaaccuccuuucuccgcuuugucccauggaacccucuuucacccaggguuccuccucagcaccucauccacccgugugucccacggagcucucuuccuccaccugggguucauccugagcuccuccuccuccuaugugucauccucagagcuccuccucccucgugagugucccauggggcuccuccuccccccaugugucauccucagacacuccuucaccugugugccccauggaacccccuucuuaucucaugugccauauugagcgccuucuccauccuugugucccauggagcuccuccuccugccaugugucauccucagcuccuccuccuuccugugugucccauggagcccccgccucuucccaugugucauccucagcuuccuaucccuuccgugugucccauggagucccuccucuucccacgugucauuuucagcaccuccuuccuccagggugucccauggagccccuccucuuccuaugugucauacucagcaccuccuuccaccuccuguuccauggagccauuucuccuuccaugugucauccucagcuccuccucccucccaggugucccauggagccccuccuccuccauccuugugucauguucgacaccuccuccacucauaugucacauggagccuccacccaugugacacaaauaauuucucaucuacuuguaucacacugaauguucuaucuuucuuaagggugucacagcaagccccacuaaugugucacaggacgccccucucccacucuuguagcacacugagcuccuuccaccacuuaggugucacucugacccuguccucugcgugugugucacuaggagccccacccauucagcugcacucuaaguuccuccucuaaucaugugucacacauguagucucuccccacacucauaagucauacagaaugccucuccccauccauguaucacauugaguuucucuucaacauguguuacucagagcccuucccugacucaugugucaccuggagccccugucccuguccauguguuacaccgaguucuuuccugcucauaugucacaugaagcuccuccucuacucacaaggcacacagcacccccugcccguuugucgaauggaccccucaccucaugcauguauaacacugagccgcucucccaccccgugucguacugagcuccuccuccacugauguauugcauggacuccuucugacacgcggagcccucccugcacccuugugucucacugggcaucucuucccaaccuugugucccgugagaucuucccccacccacgugucacaucaaguccucuuucuuguguuacuccaagucccugcccccauaugucacagagagacucuucccacccacgugucacaccaagucgccuuucuuguguuacuccaagucccuuccccccauaugucacacagagacucucuucccacacacgucacacugagccccuuuucugucucacauuccaccucuccuucacucaugugucaugaggagccuuuucccuacuaaugugucaccugagcuucucucacaugucacuugaaguccuccccuucccaugcaucacccagagaccuuccccccacucaugcauugcccugagccccucccuuacuuaugugacauggagccccucuccacacccaugugucacaccaacccucucuccacugaugugucacaccaacccccucuccacccaugcgucacauggagcucuucccccacccgugugucacaccagcccccuccuccacccaugugucacacuaaccccccccacccaugugucacaccagcccccuccuccacccaugggucacaccaacccccuccuccacccaugugucccauggagcucuucccccacccgugugucacaccagcccccuccuccacccauguguuacagggagccccuccucccuccaugugucugucaaucugagccccuuuuccauucaugugucacucugagccucuuucccaccuccauacccuccugccaccccuacuucuuaaucuuuaaccccuuucccuaaagguuucccuccaugggcucuuucagagaauguuauauuaucaggucauuuacucacagauauuuuugcaccaccuaccacgugccuggcugcgugucccugugcauguguguuggugguguggauggcuggagaguguaggacgaggcaggcaguauggugguugagaaagaugucaaagaacaaaggaagguguuuugggguacaacuuuauugagauguaauccacauacacacaauccgcccauuaaagcucacagcgaaguguguuuuaguuauucacagauaucugcaacuaucaccauaaucaauuuaagaucauuuucaucacccccaaaagaacuccagagccuucagcugucaccuucacccuccaugcacaccccccagcccucagcaaccaaaaaucuacuuucugucucugggaaauucuugaagugccccuggacuucaugaguccucacuggguccccagaggugccuguugcaacccauuucacagauguagaaggcaaggcuggagaaguaccagggagucaaagcaguggguggguggggucgaguccccgauguccacucacagaccugggccagaaucaggccugucucccccuucaccuccccauccuccgucccuuggccuggcugcacagucaccugggggcucuguggggcuaagggaggcccaggcccuggccauaggaggcagguagggcaaggcugggcaggguggacagguaccccagcgcugcaggugcccagcaguggguggcacugccuaggcuggcugucccuugcugucacugcucuaaccacuagcagcaggcguccccucugccauccgagcgcuugcacugcgcuuccgggaggaggguugcggcccguagucaguaguuggggggugggaacggcuucauacaggaguugaugcacaguuauccagcuccuauaugaugccuuucuucauccccuucaaccacgcgcagcccccggacccuccucugcacccuuggcugcacggggacgcguccucaaguccgcugcuguccugccagccucuucccggcaugcuccuugggcucuucucucucucuucugcagcucucugacuuccuggaggggagggccuggggcugggccaucucugaggccccuccuuggcagggaacuaugccccuggugggacacccccugggcugacuccacagccaagggcagauaggccggagggggaguuggguagcccuggggcuucucccacugaggggcuggggcugugcucccacacagagcccuccaaagggacccggcccacaggauggauggacagacguuggagagauggugccccuuugugcccaggguggaggggguggggcuuuggcggaccagggcuggcccuuucugugccccaagaggagggucuccucgaggggucucugccucuacccaggacucuuucaugaccaggaggcugaggccccucacaggcggcuucuuacucucuccuuaaaccuguucuggagacauuuccccucuccccaaggauucccaacucuggguccccagaagcugucagcugggcucccuucuuccccugugcguacccugcucaggcuggguaccugagggugcccaauggcaacaugagcagggggcacggccguggccccugguucuuggaccucugucuucugccucucugacuaacucagguccugugcauggcagaggugacccgcaccaagcccugugauauuggcaucauuaaccccauuaacaagccacgacagccagcccaggcaugagcaucggggcagcagggcagccaguguggggagagaggccuugcaguagcugaggccauuagagaggacaagagggugcaggagggagcauccucaccucugcccuucccacuuacaucccaucuccccuuccucaccccuccuuccccaugcaccccuucuuccuguaggagggagcacccucaccucugcccuucccacucaccucccaucuucccuuucucaccccuccuccccaaugcacccccucccuuccugcaggagggagcacccucuccccugcccuuccuucccaccucccgucuccccuuccucacccccgcuucccccaugcacccgcucccuuccuggucuaccccucagcuucuguggugucaggauggguaugcuugucuuuguugaucucagacagguggacaggggucuggacgaggcuuacuguuugggucugaggucagugcucaugggcuuggggcaugacaagggucuugucguccccgcagcagggcucugagcggguggguggagcuugggagugggggugauggcuucuauuuguugucuuucucuuuuucacuuugggagcaaccggggucaccaggugggcaggaggggaccucacgucucugcccugggcagauuguuaagagcuggucaagcuccuggcacgggggccugaguccaaggcccuaacuggaccuggggccgccugcaggagggaugagcgaguccggacccgagcggugaguagcccucagcugccuggguggugugcuguugaguguuccagaaacuggcccugugugcaccagggcuggaggcuggcacguugggcaucucaugggggugggcugggucgggaagggagguugauggacaagacucagcaggaguggagcucagggcucccuccauccccugacaucagugaccuggggguggacagagaagguggaagaugggugcauuuaguuguggcccgccaggucccgugggccugugugccaguguccgcgccaggcugugcugucugcuguucagaggaguuuucaccuuuuuuugugguggccaugaugucauaacccagcaugacauuuaacauuaaccuuccuuuuucuuuccccaggagaaaaaaagguuuguauuauuuuucuuuugaauuuuuuauuuccauagguuuuggggaacaggugguguuugguuacaugaguaaguuccuugguggugauuugugagauucucgugcacccaucaccugagcaguacacacugaacccaguuuguacuuuuaucccucacccccucccacccuuuuccuggaguccccagaguccguuguaucacuuuaucaguaguucuccucugggccugggggcugccgcucuucucuguaaacuaaaccugcuguggcuggauggggcaggggagccaaggaggcgagguccucacugucugcugguguggggggccguggccacucuagcaccgggagcccccagucaauaugugugugugugugugaacuguggauaaauacgcuuaccuuagcgcgugucuggauucccccacuguggggcacgggugauuacugcugguaaauucucuguuuggccuuacccugcaagguaguccuguucaucccuccaccuuuuuuuuuuuuuuuucuugagacggaguuucacucuuguugcacaggcuggagugcaguggcgcgaucucagcucaucgcaaccuccgccucccagguucaaacgauucucugccucagccuccugaguagcugggauuauaggcaugcgccaccauacccagcuaauuuuuuguuauuuaguagagacgggguuucuccauguuggucaggcuggucucgagcuccugaucucaggugauccaucugccucggccucccaaaguguugggauuacaggcgugagccacugcacccggccuugccccuccaucuuugauggccaggaggaaaggauggcggucgucgacgguccuggcugcagggacacggggacugccaauccaccccacauuuacccaaggagcccuuaccaagcagggacagagauuugccauuaaaauccagccucugggaccccccagggguggccuucaggagaccugaucuagggacccuccauuaugaccccaggcucuaucccaagguaguuuacuucaagggacuugggagccccaagaagaaugucaucugggaacagaggggguuuuaggagccagcggcccuuggagacugggucugguuauucuggaaaugacccucccucucacuacaucccccauuugaugaugggaaaacaggcuggaagauggacagccacuaccugaggucacccagcaagucaaaguuggggccuucuggggccaggucacuaaaggggaucugcaccucuugcagcugagccccuggccuuaacccauggcagccugucuugggcugccaucagaggcagagugcuaggugaacggacagacagacauggugcccuugagcuccuggagcugcugugauguugguuguuguggaggucauugcugggccuugugacuggaggcagagugggugaaguggcccaggugagaggacaaagaucagccaccaggaaggggccuccauccuggcucuguccucagcuccucugcagccgguucugggccuugauuuccccaaguuuaccuugggaaauugacaugagaagucuguggauggggcugggagcucugagugccagcugugcccagcaguuuauuccuaacucugaauccucacagcagccuugguggguuggagugacagaugaggaaacugaggcugggagaggccuuccugcagccagccaguggagggagagagaagcccagagguguagccccugccuuugaaccuggagauccugaccaugaucuccuggugcugcuaucagggguagauucuucagacagguggauggugggugaaggccaggcaccccuggggacuugugagggcaucgugagcccuguguggggcugggcagugcagggaaggaaggaggcugagcuugcagugccagccuugggcucccgugggguguguccuuggucaggggcuccccacugugugcccagugguccugguccacgauggguaggagcaggaggcagagccacacugucuggaggcugucaugcucccgugccuccccucgaggacacaguagggucucuuccaugugggagcugagaacucuggggccagguggaaauggcuuuccuaggggaugggguggcuccaacucaggcuagucagaccccugcggggccccugagcuuugagccugagaucuguuggguggucucacggugugucuucaggagcagguuccucagcagggcagagagggcagagcugguguguccuggcaugggggcccgugugcacagagcuccaguguuuuugcccuccuagaugaaguucaaggucaugcugagagaggcccacggcuccuuccccucuguguccucgcagagcucucaccuguggaggggugcaguggggcgggggugcucugggagguuggaggccacuccuggauaggugugacccauggccaggaagaggggucagcauguccuggacuguggagggggaacucagagugggugagugccaccugcccuaccuccccaacucccugugggaccccuggcagcuccccuacccagggcagugcacccucacccucacaacagccauuuugccacuuuggggacagcaugacccucugaaaugggacccaggacuuuuccucucggaguggggguuagggacugcuugagaccagggcuuguggacccugcaguguggggcucagaccgcaccucguuaaucacauggcgaggaggccaaggccagaggugggaacuggguuucggggcucccuuuucuggaacccuuaggagagacagcccccacucccccgccucccacugcccuaaggcaccucuucuguccucucuuugacaugagccuguggggggugcacgucccugguggccucagugggggugggugccuucucauggcagaaagaagugcccagagucuugguggggacgccuucaggaagguugggggaggccugcugcccaugugccaggcccccaggggcuguuucagggcagagcguuuccugcccccacccuuccugcccaguccacuugcccccucguccaccccaccuacucccucccuccucccaugcguguccccucccccgccuauccucccaccaccuccacuuuuagaacaaaccccaaagucagacagucuuuuaguuugcuuuauuugaggagugcaaaaagauuggggggugagaaagcucgggggguggggaagggucuacuccccuugcaaagcggugguguggccagagccucucugugacucggcaugguccccugggugucugugugccuucugggacuccaucccuguaugaggggccccugcaccccugcacuguccaguguucaguguugggagggaaaggcgccccaaggcaugcaggggcccucuuugcugugcaagucugguaaguggcacugguacguccggaugccccaaagagcggcuuuguccagguaaguccagagcucagggcaagaggaaggcggggucaaaaaagcugaagcagaugugguggggguggggguggguuugcuugcagggugugaugggggugagggaggcaccacaucaucagaugucgggagguugggggauggggguuggggggcgggggcgggagcucaggggagcaggagcaccggcaguggagguagaagaagucaguggagcacccgaggucagugucccaggguggccaucaccaggccggguggggggccccgucaccugcuugcuuggcugcgccugcugugccugcuucuucaucuggccacgcgucauggggucacuuccugcucaccacugcuuucucccucauggaugucacucccgggcaugggcuugggaccuggagaacggagaacucguagcccagggcuggcgcugggucucugaggacuggguaguccguuagcacagguggcauugcugguugaugaguugaagaaguuguugcccuucacaaguggguuccucuugggucaggaguggcaggaagggaagcgaagcaggcugaggcgcggggaggccaggggacgucgggagguguuggggugagaaauagaggggacucuuugcuggagacagggaggcgucuucagucgagguuagcaucuucguccucaucaggcagcucuucuagccuugccugcucccugggcuggcucucccaggcggggaugggcagggcccgccuguagaucagggucaggaacuggcucagggcccuggcugccugcucccggcugagcaggugcagcuggccaucugcacuguggauguggagcaggcggcuaccaaggaauuccaggaccuggggauccaucagguggcgugggcgggguggguggguggcugcuguguggcuggguggggccuccugcacgucguuguccugcuuguccugcgaggugucuugcaggccgucaugcaggccacacugacgguaacguugcaggucgucuugcagggcuucucgcaagacgacauccucaucaccaacgacgugcagcuccagguagcgguucugacgcagggcagggagguggcccuccuggggggugacucugacaccgaagaacucacacagcgucagccagaagccaggggugaacugcaggccucggugggccugggagugcagagcauuucgcugccagcggccagggcccaggaacagcucagccagcuccugggcugggaugguguuugcaccuacgagagcgggcaucugggugagcagcugggugauggcugucgugaugcugcugccugcgaugagggacgaauccaggaugagucguagggagcgcuggggcuggggccgagccacccgcauggcgggugccggccgcagcgagaggcauugccucacgcgcaguagcacgaggauggcugccagggcuaggguguucuuccaguacaggaggccucggaagaagugcagaaugacggcccugaucugggccaugcugaagugggcgaggaagcuguugaggaucuggucgauggguaucauggccagcagcucuugccguaggaucuguucauugagcucauccuguucuucauucucuucuuccccggauuccgucgauggaucccuggggaauccccuugaggccagcagcaggguuugccuggcggcaguguuccucuggaaggcucuccuccaccggagguuucucacagguggcagagcucggccgccgucuuguucuggcagcuccaugacgucaaaguugaagugggagaagaagaagacccaaugcccggggagaaguacggugagccugucauuauucagagaggcuagauccucuguguugagaaggaucaugaugggcuccucgguguucuccagguagcggcaccacaccaugaaggcagcccguauuggaagaaucuucaucuccgcuugagaguacucaaccucgauaggggagauguugcgggaguagaaagcgcagcaggcucucuugccgguuuggucgucgauuuggaucagggaggcgugcagggccgugccggugacgccgguuuccaaguagaauggguucuggggcuuggggugguggaggagaggcgccuugcggaaagcccucuucaggcacucgaaggccucuugcuccucgacuccccaguagaacugguaggagcucagcagcugccgcaccaggggcucugcgaugaugcugaagcgcuccacgaaguggcgguaggggaagacgaauucgaugaaguuucgcagagauagcuuggagccagggguaggguacccuguuaugauggucaugacguucuuguucaguuucaccccuuugggggugacgacgaagcccaggaauuccacgguuuggcgguggaacuggcucuuguccagggagcaguagacguugugauggcggaagcggaccaggacuuggcggacgugguggaggugcuccuccugacucauugaguagaucaggacuuccuggccauaagaaagcacaaagaacccuagcauguccuuuaggaugaagugaaucacguucugagguaugauagggucuggggagagcgcaaacggcugguagcucuucaucucuucaagcuccaaaccaaacgcugcuuuccacacaucuucggugcggugcccguucacgcuuuccuccacaauggucccacgcagcuccaguuuugugaaccacucggcuccguguaacuggucaaacaguuccggaaucaucuguauguaguccugucuguuggucagcauguccugcaggucccaguauuccuccuguagccuggcucuuucuugcauccuggcacccacagguucccaaggcgcgguggagggacacucguaaaaggucucgcugugaucacugucuccagccugcugaagcucagagggcucugauucagaaagaucaucggauccgucugagcuuggcuggucggaagucucaucaucugcuuccuucggguuaaacacgucggccaggucugaguauggguguggcaguccggguagcaggcucaugccgugccucucuagggcaaugcauggcgggggcgggcggaagcaguucuucaggcaguagggagaguggaaggugcagcggccuuugauccagucgacuucgggggcguggacucggagccagcggaugccuaggaccacagagaaguucggugaagguacgaugucaaauucgauggacuccuggugguucugguggauacacaccaggggcuccguguagagccagacaggcucguugccaaucagcgagccguccacggauuggaccggcuguggguacggcuucucguagagcucgacguagugcucuugggcgaacuucucauccaugaaguugccgucagcucccgaauccaccagggccuggaccgcgacgcugugguagggguucacucucaccaugagcagcaggaagaggugggcgcgauugauguccggauggacuucgcugggcaaccagcugcugaccauccaccucucuggagcaggugagucgauccaggucagguuccgggggcgggccucggggggcagccugagcauagcucuucucucugccagcuucucuucuauuugcaggaugagcacaaucagacugucuagggaauccggcugagggacccggaauagauagugccugaucuccucguugagccccuggcacaagugggccugcaggacuucaucuggccagcccaagauggguaccaggcucuggaacucaucgauguacucaguggcagagcggccgcccugccugauggugaacauggccucuucugccacacgcagugccuggcgguacucaaacacuucggacauggccuccaggaaggcugggaagucuccgaucagggggcuguuuuccugcaguagagcuuuggcccauucuaaugccaagccggacaggugauugaugacauagccaacucucagacggucguuauagaacauucuuggguagcucuguaaggucaguuggcagaguacgaugaacucguggaauucucugcgaucgccagagaagugcuuuggggcgggcaguuggccugcauugaucccuuugaucaagaucucuucugcuacucucuguugcucuuugaggucuugcauucggaaguacagcgagaugauggaccucaccauggccauaaguucugcgguugagugcucggucugguuuugcucuugaggagucuccucccuucccgauuccuucaggucagugugagccucuuguucuucucgggcucccgauggguugacugaugcuucuuucauccuaucagaugcuccacugaguggauccccccuugccuggugugaaccguugcaugacuccuccaggucuuggaguaggucauuggguggauccucuauuuccuuacgugggccacuggauggcuccuccaugucuuggaguagaucagugggcagcucuuccauuuccuggagugggccacuggggggcuccuucuuuuccugggcugggccgcuggcuggcccugccucuccccgcacuccacugcccgacgucgccucggugguguuggaugagcccucggaggacuccauuuguuuugaugauggauucuuaugcuccaucaucgucucaaaugagucuucagaggguucuaucauuucgucggauggaaaggaguguauucugaagauugguaagguugugauggcguccagucaguagcugggaccguggagaucagaaccuggugguggaaggggaguguggggaguaaaggcaguaguuuaggaucuugugaaguggcaguaucagggucucaaggacaaaucagaugcccaacuaaucagagcagagagaaaugggggaaagccuucuuguaucgagccagccucuuuggcuggucacuuggggugcccccagggagggaagaucugucaaccccugaccugccucccaggcuuauucagucugccuguccuguccuuuuccuccauagaugugagaaauucacagcccauaaauucuguggcugggagcagccaccguggcaggcggguaccuggcagggugcacaggcugcuccauuccccccuggcacaugcaccuggucaauccucuuuuccugcuuuggucaccugagaaucacagaggucacaucucagcaccauccaaagccaccccuggcaggcucagggcucuggagcaagcccagccaccuugguuguggagcgggaaucucuagcaaagaugccuacuguuucaccagugcaguggaagaggagaaaaugggcacuuggccacugucccgucaguugggucagcagcccaaaauaguucuuauuuccuuccccauguucaaaauagaaauuucaggggguguguacaggucuggguuuuuuuuuuuuuuuuccauaaauuuuauaacauaccuacuaugugcuggauaacugcauauuuguuacuugauucuaacucagacuuuuggccaauuucucuuucucgauuuggucuccuuccaaugcuauguucucccgaccucugagcuguugaggagaucuucaaauaaucuccuucucuuccuacaaucuccacucucccaggacugcccucuuugugaggcuucuggaacuucacacaucuggccucaauuucaccagugcaagcauaucugcacgccucuccaaucuuauccucccagguccccuucuuaacgccagugggucuggucuccucuuucuagcaaauaucuuuuucucucuguugcugguugagcccucccaacagacauguaucuggcagaguugggacauugaguguggggguuggggggaacaugugacaucuuuggaaucugacggucccagaguggauuuuuggaaaucuaguguugggugguuuuagugggcugagacagaauugaaagggaaugucuugguugggguuauuugcacauuucuucucugcuggggcagagcaaauuaagcuuugauuaucugauagauuaacuguaaagcuacugcucuuuauaaauuuaacaccuuuuguuacuucugaguuuucuucuaagccacuggacccauccguaaaaaaaaaaaaaaaaacugcguucccccuuacgugaaacucauuggcuaaaauccaagcuuuccaacaggauacaaaauucagaucugcuguuucucaaaauuaaguacacccuuguuagcaugacacuuaaauuugaucaugcagucucucugauuaaagccuuccacuguuuauuuacugucugcaauauuaaauccaaaccuucuagcguaaacauaucugacauguaaacucaccaaaacuauucucugguuaaaauguaagggccuuaauauaauauaaaauucuuauuuugucauuccucaagguagagaucacauuuuuuuaaagcacaguauacaaaucagcaugguauaggaauuauaagaaucaucaucaucaucaucaugauguacauagcacauugcagaaauuaacucauuuccucuccauaaaaguccucugagauaugcauuauuacuguaaaauuccaaaccucuaauauaaaauucuaauugaaauacaaauaaauaauucuaauugaaauacaaaaacuaaguaauucaucugcagacuuaucuaucaggaauaaaaaucucagcaugucucucacuuaaaacucuuuauuggugaaaauuuaaauuucuuagcaagacgauuuaaaaacuagauuaugcccccucuuaauauaaagucuacacugcuuaacauauuuacaaauucgaccaugugaaugauuaaauccuucaauguuccugccuucagcucaaaaucuaauauccucggcauguuagaaaaaucuuaauacuucuuaacaucaaaguuuaaacuguuagcaagaugaauaaaggucaucucauaauuucucuauuuaacacauauaaaaauucauuuuuauugccuguaaaguuucaaccacuuagcauaaaaugaaaauuuucaccguguaauuuacuugccaacugauuaauacgaacccccaaaucucaucaggucacuccuaaaacccuuuauuggcuuaauuccaaaccucuucgcaugauauaaaauucugaccaugucauuccucaaaauaaaaaggucacucucccuugcaagauacacgaauuugcucuuauaacuucugcuuaaagcuuuauucuaucucuuaauuaccuaugagauaaggucuaauuauuuuuagcauagaacaauacauuuuacuauaaaauuucucugacuacucuacccaagacaaaauuucugccauguuacugccuuaaaaaucucuuaaugagccaggcacggugacucacagcuguaaucccagcacuuugggaggccaaggcagguggaacacuugaggucaaggguucuaggucagccuggccaacauggugaaauccuguuucuacuaaaaauacaaaaauuagccgggaguaguggcucaugcccguaauccuagcuacuucuccuaggcugaggcgggagaaucgcuugaaccuuggagguugcagugagccgagauugcgccgcugcacuccagcuugggcaacagagggagauucccucucaaaaaaaaaacaagacucuuaauggcugaaguccaaauuccuuagcauggcauaaaaauguaauucugucaucccucaaaauaguguccaaacuucuuagcaugcuauguaaauuuaaucauauaacuucuuuuuauaaaaacaugcuuugucuauaaaugacccgucuccucagcauggagcccagccugggugcccuugugcccaggggauaccucugcucacgaguggucugaugcuuauucauuaucugguucagcaaauccagauaccuuaacuuaaaauauguuuacaauccaguuucucuggagacaaaacccucaucaauuuacuucuuaaaacgcuuuacuggcugacauccgaacgccucugcaugagauuucaacaaugagcucaaugagcucaucccccaccccuuccaaacacagcacuugaaugccuucaacucuuuuguaaaaucacaucuccuuagcaugugagcaaaaucugaucauaucaucuuuaucauagagauccugucuuauagcugugccaaaaugcacuuguuugagcauguaacuucucaacuuaaaacuucucgagguuucuucauugccuguaacauaaagucccaacuacuuaacacaaaaugcgacauuuuaccauguaguuucucucaggaugaucuauuaaaaaaccccaaaucucauccuguuccugcuguaagcccuuuauuggcuuaaauccaaaguuauuaacaugauauaaaaauuugaucaugucaucccuuaaagucaaauucacacuuccuaggacaauauauaaaauuugaucuuauaacuccuuuuaaaaucuuacagugucucuuaguuguaaauggaagaaaagucaaaauucuuagcauaaaaugugaauuuuauuuuguaauucacugcauacuauuuaucaaacgcaaaaaacucaccaggccacucuguuagaaaguuuuauuggcuaaaucaaauuccuuggcauaugcaacagucuaaucauguuggagccucaaaauaaauuccaaauuucuuuucauauucgcaauauugaucauuuaacuccucugauuaaaaucuuucaacuuuggugucaacauuaaucacaccuccuaggcaagcucugcagguugaaauuggcacucccccaagauagaaauucaaaauguuugcgcaugauuguuaaauugguggcuguuacuuuuacaauuuccaguguuuccuuguugcuuguaaugugaaucccaaagccguuacccguaaaauauauuuuaucauguuuuucugcauacuuaucucccacaaacaagaaucucaucaucacauuucuuaaaacccuuuggcaaaaauccaaacuccuuagcaugauauaaaacuuugauccugucaucccucaaaacaaaguccagauuucuucccaggaaacucaaauuaugaaacucuugcuuaaaaucucaacguguuuucaucacuacaaaaagccucaccauuuuagcaaggcacccacuuuuaaucauggcacucccagcuucaaaccugucaaauuucauguccucaacauaaaaucuaaaugccugagcaugaaaugaaaauuggaccaauuauuucuuacauuaaaaaucuuuggauugcucuucucuacuuaaacuauaaagcugaaguucuuuucgcaugaaacuagaacuuuucaccaccuacaguuuccagcuuccauuuccuguuccucacgcuucucucugaaaagacugaguuucccauucuccagccuccaaaugcauuucgauuuuauuguccccaaauguuucuuuucuuuuuuuuguuuaaccacgucccucugcccauaauucauuaauucauacagcagcauguccugauucuuuuucugggccaggcacggugcucgauccccaauggaaggaaauggaggcagacccaucuugcaggucaucaccaggaaggagaugagacucauguccuggagacgaauaccccacuggaggugagugaggggccuuggaagcagggccaggggguucccuccacaccugcugagcaucugccucucugggagggcuuugggcguuguuggggccugucgggccuccaaauucuggcuuuagaugggcacucugggauucccaucuggcuucaccugccuaccagcuggccugccauagccugggcccugccucuucucugcgcuuugcagaaaucauauucucaguccuucagcuguggcucaauacauguuguucucaaaucucaugacaguuucuuuaagaaauaucuacugauuugaaaauucccgccuuauuugaaaaaaaaaaaaaaaaaaagaagcccagaauuuaaugcugcugguuuggggucacaacugccuuugaggucuucgaaugggacccucuuccccccaacacucaagagacagacgccccagccucaccaccuucagugcccagagccucugucgggucagcuccuugcuugccucugagccaguggcccauugggucagggcugccaacgugugucuaugaaggguuggguguggggggggccaugggggggacaaaucccucagcaaauaccucucucugucagcucgccuguacaguaaaggaaaucugauuuuaaaaauagagcuuggaagaggagaugagaggauauuuaggagcagaguugagccuggggcggggggccggggugggggaauuaggggagaggugaggacaggggaggagggugggaggcugggggcugaggaggaaggugaagcuggugaggaguggggaggcugugaggauggaaaggggaguaagggagagguggguucucuggaaugcuggccaugccuccucuccuggccuccagaaacuagcccagucacaccuggggccccuggcucucugggcugccaggaugggugucaggugaagaucccuguccaucuuggccuccuuguagguggugcucagagcuccuuggguuugagggacauagcuacugggucuuaggagggaaguggccucaaaaugaauacccccagcagcucccucugcugccuggccugcuguggccuccuguggauggaaggcacagcgucacagugaggguggacaugcagggacccugggaggguuuguuauuauuuaucgauuauuauuauuauuuauuuuguugaacucgugucaagguuaagauguguccauggcagcuugaggcuuggaagccuuccugguuucccugguaugaacaagugucaaggauggcucacuugaugggacuuggugaggaggcuggugagauuccugggggcuuccugagggccucauaaggaguuuggguuggguccuggggaucccaguggacuguggagucugcaggggcugcuggccuggcauagcuuauguuggagucccuccccccgggacccuucaaucuugcacaccccugacuuguggcuaaagacgacuugagccuuacagggugggaggccguuggcaucucggcccagggcagcccagucucggacauucccucucuuccccuauggucuggaccgagguccuugaaugccaggccccaugggccucggacuucaucguagugauggggaaacugagucuuuggaaggaggaacagggaguuacaguagaacuacgcuguccccagggcgugucuaaaucccaaaccacccagcagggugggggucuucuguagagggacccccagccccucaccuugcuaagccacugaggugacagggagugccugggcccagcagcgcuccugcugcugugucccugcccccucuaugcuugacuggcagcuccagggggcagcuguaucacucugcccagaauaacccugggaaggggcgugugccgccugcgggaggggcugugcgaggggucacgggugagcuuguccuucuugucuugcccaaaucagcggggccaaucagcugcuccugaggcugaucuugccuuucaaggcaagugggcagggacaggucugcaccggccuccuagccuagaugggcucugacugucaacaugaccuuccucucccagguccucaguuuccccaugucugcagggaggguuucggugguggucuucucacugugcuccuguagcucugggguuccuaagaggugccugcgggggucccugggaaacaguaaugagaggagguggcuggcccaacagguggagcucagggacacccauugcugccuuaguuccaccagcugcuccuauaaauuggggucgucguauuauuucauuuaaacagagguugccagaucugagcaaugguugaaagcacagacuauguggucucuucuaauggcuugucuugauuuuccaaccugggcugggagggguguaagaguggaaccugcucaucucuggugggcucucuacucucacccagugggcugcauggacaagcccagguggcugcaggccuaggaguggagcuguucuuagaguaggaaggugaagacuuugaggcaaacaaggagggccccaccucagggccugguggaacuagaaugagggcagaaggcagaugagaggcuggcuaaccuugcagaaccucaguuucuaaggggaugauuagaaagguaggagcaccuccuuccagggaagacgggugugugaagcccuuuguaaacuguaaaugcuauggacaagucagggauagcuaccgucauuaggauucuuacgacuguuacuuccagaacacccacuguaauuguauggucaagauuuggacagcauuucaugcauggugucaacuuuaauuuucccguuaaccccacaaggggacgaugcccugcuuggagaguaaguaaacuagaguccagaggggugaaguggcuccucuggaaccauaauuaucggcgacaauggugcacagacccagcauacaggaccuuccccgggaggggcaggcugaugacuggaguuggugagggguacgugcggaagacggaaugugacccagaaagggacgacuagaauguauuuauuaaauacauucaaaugagucucugaguaccugcucugugucaggcgugauucuagccacucaccccuaaaacugacuuugcuccuaacgaguugggggaugugcugccgucuuacagaguuaaacugggauucggagggcgaggugcuggcacaaggcccccgagagacagaggcaggguuuaaagccagguuucuccugggcaggagcagaugcccagagugggguuggcaguugccauuugggaaacuguugggaccuucagagccagagaugccaucuucauuccaugguguugauacugccagccucguggccugaggggcauccagaccacaagagugggggucucagugucugccuccaucucccccaaaggugcuugcugucauucccaacucauucuagcuuauuugguguucgaggagggacaggacagcuggcccaggaccugcuaauuauagcugcucaaguauuugaauagaggccuugaguacacaccaccaugucaugguuuuuucuuacagacgaaugaacacuuuaacccuuguccugagugccaggccaucccauucacugccccaccuccccugccugcccacccgaucccugggggaggucgacaugggaccucugccccacaucuuaccuuggcugcaagcguucaaguggaucuccucccguccugugccacucgauccucgcugcuugcuaaaaaguuauugaauacauuuguuucuuuaauugugaaaguccagucuuuuugacaugcguacauuuucuacaguagcaaccacagugcacacacacagucuuccagccugcucugcucgcgugccuuucuguugugagcuuuuuuccacguggcuacguuggggaccuccgugaugcuuccugagugcuuacuaugcgccaagcgcugcuuucaccauuuuacagguuuucacucuuucaaucguucuaagaagcugcgagggccuuccuuuuauuauccccauuuuucagaagaggaauccgaggccuugggaccuacacccacccucacacccgggcccacgcucacuuuaauaacccggacugggcaaggacuaaguccagccagagcgucagccucgcuggcguccucacuggccauggcccugcagccuugcucuucaguuccuggaagccuccugcccuugguggacaaccauuuugcucucuagcaaauggauagaaaaguuuaugugagucuggcugggcgggguggcucacaccuguaaugcagcucguuggguggcugaggcaggcagagcauuugaggucaggaguucaagaccagccuggcugacaccgugaaaccuugucucuacuaaaaauacaaaaauuagcugggugugguggcgugcgccuguaaucccagcuacuugggaggcugagguaggagaauuacuugaaucugagagauggaggcugcagugagccgagaucaugccacugcacuccaaccugggcgacagagugaaacuccgucucaaaaaaaaaaaaaaaaagaaaaaaaaagaaaagaaaaaaacguguauuugagucugggccccggccucuguuggacuuugaguaaaucuuaauuuagcacccugagcugcaacuccuuucuccugacccugccaccugcaugcgccauucaaguggcugcgccccaggcugcucaucccuuccgcccuggguccccauacacagcaaccccaugggguuuuuguccugcuccuucauauuaaucugcauuggugacuccuuugucccaucuucccucagcacacaguagggcugcuggcagcaggugaggccuggggcaagggcucagagaggcaagaugccauuuggccaugccaccgagugagcaguuucucuucuugcccucccagguggcgugaaggggagauggcugcuuucuccugggaagggagcagaugccuggcccaggaccaaaucaaaaggucugaaaaaugauauucauuguccuaauguguaaauuucgacaauuugcaaauuuguagauucuuuagaauagaacuaacucaagcccuucauucugcagcugaggcucacugcccccagugggcaguggguccaggggguuucugaggacagggcaugacccagcccugcugcccccaagauggcaccuggcuuggaggggugaggggcccuguuagucugacuuugaagaagaccagccuuccagacucgcuuggugcccugacagguaugugugcucuucucucucccaccuaacagccccuuuugggagacagggucugagaggagucagggucguauaaccuuaacacaguguguuauccaaaaacccacuaacccuguuacucuugucugucugcuaugugaaaccaagggcgguguuaaaguuuaucaccaugauauacagaugugcguggggacaucugggauggggcucaggggucuaccuggaggucagagagggcaggaucugcuuaggggagauggaugacugugggggucagacagggcaggguuugcuuaggggagauggaugacuguggacauguggcuguaaaucauccuccccgucuuacauaggauggggaugcaacuuucaagaguugccuugauugguaccuuaaaggaaauaaaacauaaaaugcuuggcacauaguagaugcucaacacauguagaaaaggcacuuauuuuagguggaucugccgccgaauggcccuuuugcaagcucuucucauuuuuuggaauccaaagggaagguguggggagcagggucgggguggaggggaaggacgacgugagguugcagagggcauuuucuugaggcaauggcauaucuuucauugguacuggcuggguuuaugcggacuuugagaggaguggagugucuccaaguggggcuaccccagccugcagguuggaugcagguaaccucagucugggcacugcauuuuuauuuaccauaaaaauauuucauauuugcugggugugguggcucacgcuuauaaucccagcacuuucggaggccgaggccgguggaucaccugaggccaggaguuugagaccagccuggccaacauggugaaaccccgucucuacaaaaauacacaaaauuagcugggcgugguggugcaugccuguaguuccagcuacucaggagacugaggcaugagaauugcucgaaccuggaaggcagaaguugcaguuagccgagauugcaccauugcacuccagccugggugacagcaagacuccgucucaaaaaaaaaaaaaagaaagaaaaauugcaaaacuauagcaaucaccucaagguuuucacaggaaucaaacucaguccaaacuaaaaugcuguguaauaaauaguggggcuucacgugcaggaaaggcgauuaagagcgaggcaugcaggccgagggcugcuuaaccugucucagauuucuuccgcacaaagucaugguugaaaauaggucucugccuggcagaggguaaagaaguucucgaaggccucugucugcauuagcuuggugagagggaagacauuuaaccaauuaaccaauuagugaucugugcggauggagacugagcaggacgagggugccacccgacuggguguaaagugggcuuaguuuugucuucuuggugucugggagccucagugccuuucuacguagaugggaguaugcuugucacauccuugucacacaaguaacccugugccuguuugaggauuccaagagccugugacggcugcagggggcccugaagcuuagugugcaagcaggagcuggggacagaggggcuucugacgggagucggggugccuccucuggaugugggggugggcuagggugggcaaagguugcuucccguucuccugcagcugacaguuagaaaugccagugccguuuagccacagucccucuggguuagagucgggaagaaacauggcaguuguguguuuugcacaggaaucaagcugucagggggcacagugaggccccagcuccuuaccagcaagccgucuaggcugcgaacgcgagccgc

SEQ ID NO: 12631 - RNA, 27862 nt, Homo sapiens
gcggcucgcguucgcagccuagacggcuugcugguaaggagcuggggccucacugugcccccugacagcuugauuccugugcaaaacacacaacugccauguuucuucccgacucuaacccagagggacuguggcuaaacggcacuggcauuucuaacugucagcugcaggagaacgggaagcaaccuuugcccacccuagcccacccccacauccagaggaggcaccccgacucccgucagaagccccucuguccccagcuccugcuugcacacuaagcuucagggcccccugcagccgucacaggcucuuggaauccucaaacaggcacaggguuacuugugugacaaggaugugacaagcauacucccaucuacguagaaaggcacugaggcucccagacaccaagaagacaaaacuaagcccacuuuacacccagucggguggcacccucguccugcucagucuccauccgcacagaucacuaauugguuaauugguuaaaugucuucccucucaccaagcuaaugcagacagaggccuucgagaacuucuuuacccucugccaggcagagaccuauuuucaaccaugacuuugugcggaagaaaucugagacagguuaagcagcccucggccugcaugccucgcucuuaaucgccuuuccugcacgugaagccccacuauuuauuacacagcauuuuaguuuggacugaguuugauuccugugaaaaccuugaggugauugcuauaguuuugcaauuuuucuuucuuuuuuuuuuuuuugagacggagucuugcugucacccaggcuggagugcaauggugcaaucucggcuaacugcaacuucugccuuccagguucgagcaauucucaugccucagucuccugaguagcuggaacuacaggcaugcaccaccacgcccagcuaauuuuguguauuuuuguagagacgggguuucaccauguuggccaggcuggucucaaacuccuggccucaggugauccaccggccucggccuccgaaagugcugggauuauaagcgugagccaccacacccagcaaauaugaaauauuuuuaugguaaauaaaaaugcagugcccagacugagguuaccugcauccaaccugcaggcugggguagccccacuuggagacacuccacuccucucaaaguccgcauaaacccagccaguaccaaugaaagauaugccauugccucaagaaaaugcccucugcaaccucacgucguccuuccccuccaccccgacccugcuccccacaccuucccuuuggauuccaaaaaaugagaagagcuugcaaaagggccauucggcggcagauccaccuaaaauaagugccuuuucuacauguguugagcaucuacuaugugccaagcauuuuauguuuuauuuccuuuaagguaccaaucaaggcaacucuugaaaguugcauccccauccuauguaagacggggaggaugauuuacagccacauguccacagucauccaucuccccuaagcaaacccugcccugucugacccccacagucauccaucuccccuaagcagauccugcccucucugaccuccagguagaccccugagccccaucccagauguccccacgcacaucuguauaucauggugauaaacuuuaacaccgcccuugguuucacauagcagacagacaagaguaacaggguuaguggguuuuuggauaacacacuguguuaagguuauacgacccugacuccucucagacccugucucccaaaaggggcuguuaggugggagagagaagagcacacauaccugucagggcaccaagcgagucuggaaggcuggucuucuucaaagucagacuaacagggccccucaccccuccaagccaggugccaucuugggggcagcagggcugggucaugcccuguccucagaaacccccuggacccacugcccacugggggcagugagccucagcugcagaaugaagggcuugaguuaguucuauucuaaagaaucuacaaauuugcaaauugucgaaauuuacacauuaggacaaugaauaucauuuuucagaccuuuugauuugguccugggccaggcaucugcucccuucccaggagaaagcagccaucuccccuucacgccaccugggagggcaagaagagaaacugcucacucgguggcauggccaaauggcaucuugccucucugagcccuugccccaggccucaccugcugccagcagcccuacugugugcugagggaagaugggacaaaggagucaccaaugcagauuaauaugaaggagcaggacaaaaaccccaugggguugcuguguauggggacccagggcggaagggaugagcagccuggggcgcagccacuugaauggcgcaugcagguggcagggucaggagaaaggaguugcagcucagggugcuaaauuaagauuuacucaaaguccaacagaggccggggcccagacucaaauacacguuuuuuucuuuucuuuuuuuuucuuuuuuuuuuuuuuuuugagacggaguuucacucugucgcccagguuggagugcaguggcaugaucucggcucacugcagccuccaucucucagauucaaguaauucuccuaccucagccucccaaguagcugggauuacaggcgcacgccaccacacccagcuaauuuuuguauuuuuaguagagacaagguuucacggugucagccaggcuggucuugaacuccugaccucaaaugcucugccugccucagccacccaacgagcugcauuacaggugugagccaccccgcccagccagacucacauaaacuuuucuauccauuugcuagagagcaaaaugguuguccaccaagggcaggaggcuuccaggaacugaagagcaaggcugcagggccauggccagugaggacgccagcgaggcugacgcucuggcuggacuuaguccuugcccaguccggguuauuaaagugagcgugggcccgggugugaggguggguguaggucccaaggccucggauuccucuucugaaaaauggggauaauaaaaggaaggcccucgcagcuucuuagaacgauugaaagagugaaaaccuguaaaauggugaaagcagcgcuuggcgcauaguaagcacucaggaagcaucacggagguccccaacguagccacguggaaaaaagcucacaacagaaaggcacgcgagcagagcaggcuggaagacugugugugugcacugugguugcuacuguagaaaauguacgcaugucaaaaagacuggacuuucacaauuaaagaaacaaauguauucaauaacuuuuuagcaagcagcgaggaucgaguggcacaggacgggaggagauccacuugaacgcuugcagccaagguaagauguggggcagaggucccaugucgaccucccccagggaucgggugggcaggcaggggagguggggcagugaaugggauggccuggcacucaggacaaggguuaaaguguucauucgucuguaagaaaaaaccaugacauggugguguguacucaaggccucuauucaaauacuugagcagcuauaauuagcagguccugggccagcuguccugucccuccucgaacaccaaauaagcuagaaugaguugggaaugacagcaagcaccuuugggggagauggaggcagacacugagacccccacucuuguggucuggaugccccucaggccacgaggcuggcaguaucaacaccauggaaugaagauggcaucucuggcucugaaggucccaacaguuucccaaauggcaacugccaaccccacucugggcaucugcuccugcccaggagaaaccuggcuuuaaacccugccucugucucucgggggccuugugccagcaccucgcccuccgaaucccaguuuaacucuguaagacggcagcacaucccccaacucguuaggagcaaagucaguuuuaggggugaguggcuagaaucacgccugacacagagcagguacucagagacucauuugaauguauuuaauaaauacauucuagucgucccuuucugggucacauuccgucuuccgcacguaccccucaccaacuccagucaucagccugccccucccggggaagguccuguaugcugggucugugcaccauugucgccgauaauuaugguuccagaggagccacuucaccccucuggacucuaguuuacuuacucuccaagcagggcaucguccccuugugggguuaacgggaaaauuaaaguugacaccaugcaugaaaugcuguccaaaucuugaccauacaauuacaguggguguucuggaaguaacagucguaagaauccuaaugacgguagcuaucccugacuuguccauagcauuuacaguuuacaaagggcuucacacacccgucuucccuggaaggaggugcuccuaccuuucuaaucauccccuuagaaacugagguucugcaagguuagccagccucucaucugccuucugcccucauucuaguuccaccaggcccugagguggggcccuccuuguuugccucaaagucuucaccuuccuacucuaagaacagcuccacuccuaggccugcagccaccugggcuuguccaugcagcccacugggugagaguagagagcccaccagagaugagcagguuccacucuuacaccccucccagcccagguuggaaaaucaagacaagccauuagaagagaccacauagucugugcuuucaaccauugcucagaucuggcaaccucuguuuaaaugaaauaauacgacgaccccaauuuauaggagcagcugguggaacuaaggcagcaaugggugucccugagcuccaccuguugggccagccaccuccucucauuacuguuucccagggacccccgcaggcaccucuuaggaaccccagagcuacaggagcacagugagaagaccaccaccgaaacccucccugcagacauggggaaacugaggaccugggagaggaaggucauguugacagucagagcccaucuaggcuaggaggccggugcagaccugucccugcccacuugccuugaaaggcaagaucagccucaggagcagcugauuggccccgcugauuugggcaagacaagaaggacaagcucacccgugaccccucgcacagccccucccgcaggcggcacacgccccuucccaggguuauucugggcagagugauacagcugcccccuggagcugccagucaagcauagagggggcagggacacagcagcaggagcgcugcugggcccaggcacucccugucaccucaguggcuuagcaaggugaggggcugggggucccucuacagaagacccccacccugcugggugguuugggauuuagacacgcccuggggacagcguaguucuacuguaacucccuguuccuccuuccaaagacucaguuuccccaucacuacgaugaaguccgaggcccauggggccuggcauucaaggaccucgguccagaccauaggggaagagagggaauguccgagacugggcugcccugggccgagaugccaacggccucccacccuguaaggcucaagucgucuuuagccacaagucaggggugugcaagauugaagggucccggggggagggacuccaacauaagcuaugccaggccagcagccccugcagacuccacaguccacugggauccccaggacccaacccaaacuccuuaugaggcccucaggaagcccccaggaaucucaccagccuccucaccaagucccaucaagugagccauccuugacacuuguucauaccagggaaaccaggaaggcuuccaagccucaagcugccauggacacaucuuaaccuugacacgaguucaacaaaauaaauaauaauaauaaucgauaaauaauaacaaacccucccagggucccugcauguccacccucacugugacgcugugccuuccauccacaggaggccacagcaggccaggcagcagagggagcugcuggggguauucauuuugaggccacuucccuccuaagacccaguagcuaugucccucaaacccaaggagcucugagcaccaccuacaaggaggccaagauggacagggaucuucaccugacacccauccuggcagcccagagagccaggggccccaggugugacugggcuaguuucuggaggccaggagaggaggcauggccagcauuccagagaacccaccucucccuuacuccccuuuccauccucacagccuccccacuccucaccagcuucaccuuccuccucagcccccagccucccacccuccuccccuguccucaccucuccccuaauucccccaccccggccccccgccccaggcucaacucugcuccuaaauauccucucaucuccucuuccaagcucuauuuuuaaaaucagauuuccuuuacuguacaggcgagcugacagagagagguauuugcugagggauuugucccccccauggccccccccacacccaacccuucauagacacacguuggcagcccugacccaaugggccacuggcucagaggcaagcaaggagcugacccgacagaggcucugggcacugaagguggugaggcuggggcgucugucucuugaguguuggggggaagagggucccauucgaagaccucaaaggcaguugugaccccaaaccagcagcauuaaauucugggcuucuuuuuuuuuuuuuuuuuuucaaauaaggcgggaauuuucaaaucaguagauauuucuuaaagaaacugucaugagauuugagaacaacauguauugagccacagcugaaggacugagaauaugauuucugcaaagcgcagagaagaggcagggcccaggcuauggcaggccagcugguaggcaggugaagccagaugggaaucccagagugcccaucuaaagccagaauuuggaggcccgacaggccccaacaacgcccaaagcccucccagagaggcagaugcucagcagguguggagggaacccccuggcccugcuuccaaggccccucacucaccuccagugggguauucgucuccaggacaugagucucaucuccuuccuggugaugaccugcaagaugggucugccuccauuuccuuccauuggggaucgagcaccgugccuggcccagaaaaagaaucaggacaugcugcuguaugaauuaaugaauuaugggcagagggacgugguuaaacaaaaaaaagaaaagaaacauuuggggacaauaaaaucgaaaugcauuuggaggcuggagaaugggaaacucagucuuuucagagagaagcgugaggaacaggaaauggaagcuggaaacuguagguggugaaaaguucuaguuucaugcgaaaagaacuucagcuuuauaguuuaaguagagaagagcaauccaaagauuuuuaauguaagaaauaauugguccaauuuucauuucaugcucaggcauuuagauuuuauguugaggacaugaaauuugacagguuugaagcugggagugccaugauuaaaagugggugccuugcuaaaauggugaggcuuuuuguagugaugaaaacacguugagauuuuaagcaagaguuucauaauuugaguuuccugggaagaaaucuggacuuuguuuugagggaugacaggaucaaaguuuuauaucaugcuaaggaguuuggauuuuugccaaaggguuuuaagaaaugugaugaugagauucuuguuugugggagauaaguaugcagaaaaacaugauaaaauauauuuuacggguaacggcuuugggauucacauuacaagcaacaaggaaacacuggaaauuguaaaaguaacagccaccaauuuaacaaucaugcgcaaacauuuugaauuucuaucuugggggagugccaauuucaaccugcagagcuugccuaggaggugugauuaauguugacaccaaaguugaaagauuuuaaucagaggaguuaaaugaucaauauugcgaauaugaaaagaaauuuggaauuuauuuugaggcuccaacaugauuagacuguugcauaugccaaggaauuugauuuagccaauaaaacuuucuaacagaguggccuggugaguuuuuugcguuugauaaauaguaugcagugaauuacaaaauaaaauucacauuuuaugcuaagaauuuugacuuuucuuccauuuacaacuaagagacacuguaagauuuuaaaaggaguuauaagaucaaauuuuauauauuguccuaggaagugugaauuugacuuuaagggaugacaugaucaaauuuuuauaucauguuaauaacuuuggauuuaagccaauaaagggcuuacagcaggaacaggaugagauuugggguuuuuuaauagaucauccugagagaaacuacaugguaaaaugucgcauuuuguguuaaguaguugggacuuuauguuacaggcaaugaagaaaccucgagaaguuuuaaguugagaaguuacaugcucaaacaagugcauuuuggcacagcuauaagacaggaucucuaugauaaagaugauaugaucagauuuugcucacaugcuaaggagaugugauuuuacaaaagaguugaaggcauucaagugcuguguuuggaaggggugggggaugagcucauugagcucauuguugaaaucucaugcagaggcguucggaugucagccaguaaagcguuuuaagaaguaaauugaugaggguuuugucuccagagaaacuggauuguaaacauauuuuaaguuaagguaucuggauuugcugaaccagauaaugaauaagcaucagaccacucgugagcagagguauccccugggcacaagggcacccaggcugggcuccaugcugaggagacgggucauuuauagacaaagcauguuuuuauaaaaagaaguuauaugauuaaauuuacauagcaugcuaagaaguuuggacacuauuuugagggaugacagaauuacauuuuuaugccaugcuaaggaauuuggacuucagccauuaagagucuuguuuuuuuuuugagagggaaucucccucuguugcccaagcuggagugcagcggcgcaaucucggcucacugcaaccuccaagguucaagcgauucucccgccucagccuaggagaaguagcuaggauuacgggcaugagccacuacucccggcuaauuuuuguauuuuuaguagaaacaggauuucaccauguuggccaggcugaccuagaacccuugaccucaaguguuccaccugccuuggccucccaaagugcugggauuacagcugugagucaccgugccuggcucauuaagagauuuuuaaggcaguaacauggcagaaauuuugucuuggguagaguagucagagaaauuuuauaguaaaauguauuguucuaugcuaaaaauaauuagaccuuaucucauagguaauuaagagauagaauaaagcuuuaagcagaaguuauaagagcaaauucguguaucuugcaagggagagugaccuuuuuauuuugaggaaugacauggucagaauuuuauaucaugcgaagagguuuggaauuaagccaauaaaggguuuuaggagugaccugaugagauuuggggguucguauuaaucaguuggcaaguaaauuacacggugaaaauuuucauuuuaugcuaagugguugaaacuuuacaggcaauaaaaaugaauuuuuauauguguuaaauagagaaauuaugagaugaccuuuauucaucuugcuaacaguuuaaacuuugauguuaagaaguauuaagauuuuucuaacaugccgaggauauuagauuuugagcugaaggcaggaacauugaaggauuuaaucauucacauggucgaauuuguaaauauguuaagcaguguagacuuuauauuaagagggggcauaaucuaguuuuuaaaucgucuugcuaagaaauuuaaauuuucaccaauaaagaguuuuaagugagagacaugcugagauuuuuauuccugauagauaagucugcagaugaauuacuuaguuuuuguauuucaauuagaauuauuuauuuguauuucaauuagaauuuuauauuagagguuuggaauuuuacaguaauaaugcauaucucagaggacuuuuauggagaggaaaugaguuaauuucugcaaugugcuauguacaucaugaugaugaugaugaugauucuuauaauuccuauaccaugcugauuuguauacugugcuuuaaaaaaaugugaucucuaccuugaggaaugacaaaauaagaauuuuauauuauauuaaggcccuuacauuuuaaccagagaauaguuuuggugaguuuacaugucagauauguuuacgcuagaagguuuggauuuaauauugcagacaguaaauaaacaguggaaggcuuuaaucagagagacugcaugaucaaauuuaagugucaugcuaacaaggguguacuuaauuuugagaaacagcagaucugaauuuuguauccuguuggaaagcuuggauuuuagccaaugaguuucacguaagggggaacgcaguuuuuuuuuuuuuuuuuacggauggguccaguggcuuagaagaaaacucagaaguaacaaaagguguuaaauuuauaaagagcaguagcuuuacaguuaaucuaucagauaaucaaagcuuaauuugcucugccccagcagagaagaaaugugcaaauaaccccaaccaagacauucccuuucaauucugucucagcccacuaaaaccacccaacacuagauuuccaaaaauccacucugggaccgucagauuccaaagaugucacauguuccccccaacccccacacucaaugucccaacucugccagauacaugucuguugggagggcucaaccagcaacagagagaaaaagauauuugcuagaaagaggagaccagacccacuggcguuaagaaggggaccugggaggauaagauuggagaggcgugcagauaugcuugcacuggugaaauugaggccagaugugugaaguuccagaagccucacaaagagggcaguccugggagaguggagauuguaggaagagaaggagauuauuugaagaucuccucaacagcucagaggucgggagaacauagcauuggaaggagaccaaaucgagaaagagaaauuggccaaaagucugaguuagaaucaaguaacaaauaugcaguuauccagcacauaguagguauguuauaaaauuuauggaaaaaaaaaaaaaaaacccagaccuguacacacccccugaaauuucuauuuugaacauggggaaggaaauaagaacuauuuugggcugcugacccaacugacgggacaguggccaagugcccauuuucuccucuuccacugcacuggugaaacaguaggcaucuuugcuagagauucccgcuccacaaccaagguggcugggcuugcuccagagcccugagccugccagggguggcuuuggauggugcugagaugugaccucugugauucucaggugaccaaagcaggaaaagaggauugaccaggugcaugugccaggggggaauggagcagccugugcacccugccagguacccgccugccacgguggcugcucccagccacagaauuuaugggcugugaauuucucacaucuauggaggaaaaggacaggacaggcagacugaauaagccugggaggcaggucagggguugacagaucuucccucccugggggcaccccaagugaccagccaaagaggcuggcucgauacaagaaggcuuucccccauuucucucugcucugauuaguugggcaucugauuuguccuugagacccugauacugccacuucacaagauccuaaacuacugccuuuacuccccacacuccccuuccaccaccagguucugaucuccacggucccagcuacugacuggacgccaucacaaccuuaccaaucuucagaauacacuccuuuccauccgacgaaaugauagaacccucugaagacucauuugagacgaugauggagcauaagaauccaucaucaaaacaaauggaguccuccgagggcucauccaacaccaccgaggcgacgucgggcaguggagugcggggagaggcagggccagccagcggcccagcccaggaaaagaaggagccccccaguggcccacuccaggaaauggaagagcugcccacugaucuacuccaagacauggaggagccauccaguggcccacguaaggaaauagaggauccacccaaugaccuacuccaagaccuggaggagucaugcaacgguucacaccaggcaaggggggauccacucaguggagcaucugauaggaugaaagaagcaucagucaacccaucgggagcccgagaagaacaagaggcucacacugaccugaaggaaucgggaagggaggagacuccucaagagcaaaaccagaccgagcacucaaccgcagaacuuauggccauggugagguccaucaucucgcuguacuuccgaaugcaagaccucaaagagcaacagagaguagcagaagagaucuugaucaaagggaucaaugcaggccaacugcccgccccaaagcacuucucuggcgaucgcagagaauuccacgaguucaucguacucugccaacugaccuuacagagcuacccaagaauguucuauaacgaccgucugagaguuggcuaugucaucaaucaccuguccggcuuggcauuagaaugggccaaagcucuacugcaggaaaacagcccccugaucggagacuucccagccuuccuggaggccauguccgaaguguuugaguaccgccaggcacugcguguggcagaagaggccauguucaccaucaggcagggcggccgcucugccacugaguacaucgaugaguuccagagccugguacccaucuugggcuggccagaugaaguccugcaggcccacuugugccaggggcucaacgaggagaucaggcacuaucuauuccgggucccucagccggauucccuagacagucugauugugcucauccugcaaauagaagagaagcuggcagagagaagagcuaugcucaggcugccccccgaggcccgcccccggaaccugaccuggaucgacucaccugcuccagagagguggauggucagcagcugguugcccagcgaaguccauccggacaucaaucgcgcccaccucuuccugcugcucauggugagagugaaccccuaccacagcgucgcgguccaggcccugguggauucgggagcugacggcaacuucauggaugagaaguucgcccaagagcacuacgucgagcucuacgagaagccguacccacagccgguccaauccguggacggcucgcugauuggcaacgagccugucuggcucuacacggagccccugguguguauccaccagaaccaccaggaguccaucgaauuugacaucguaccuucaccgaacuucucugugguccuaggcauccgcuggcuccgaguccacgcccccgaagucgacuggaucaaaggccgcugcaccuuccacucucccuacugccugaagaacugcuuccgcccgcccccgccaugcauugcccuagagaggcacggcaugagccugcuacccggacugccacacccauacucagaccuggccgacguguuuaacccgaaggaagcagaugaugagacuuccgaccagccaagcucagacggauccgaugaucuuucugaaucagagcccucugagcuucagcaggcuggagacagugaucacagcgagaccuuuuacgagugucccuccaccgcgccuugggaaccugugggugccaggaugcaagaaagagccaggcuacaggaggaauacugggaccugcaggacaugcugaccaacagacaggacuacauacagaugauuccggaacuguuugaccaguuacacggagccgagugguucacaaaacuggagcugcgugggaccauuguggaggaaagcgugaacgggcaccgcaccgaagauguguggaaagcagcguuugguuuggagcuugaagagaugaagagcuaccagccguuugcgcucuccccagacccuaucauaccucagaacgugauucacuucauccuaaaggacaugcuaggguucuuugugcuuucuuauggccaggaaguccugaucuacucaaugagucaggaggagcaccuccaccacguccgccaaguccugguccgcuuccgccaucacaacgucuacugcucccuggacaagagccaguuccaccgccaaaccguggaauuccugggcuucgucgucacccccaaaggggugaaacugaacaagaacgucaugaccaucauaacaggguacccuaccccuggcuccaagcuaucucugcgaaacuucaucgaauucgucuuccccuaccgccacuucguggagcgcuucagcaucaucgcagagccccuggugcggcagcugcugagcuccuaccaguucuacuggggagucgaggagcaagaggccuucgagugccugaagagggcuuuccgcaaggcgccucuccuccaccaccccaagccccagaacccauucuacuuggaaaccggcgucaccggcacggcccugcacgccucccugauccaaaucgacgaccaaaccggcaagagagccugcugcgcuuucuacucccgcaacaucuccccuaucgagguugaguacucucaagcggagaugaagauucuuccaauacgggcugccuucaugguguggugccgcuaccuggagaacaccgaggagcccaucaugauccuucucaacacagaggaucuagccucucugaauaaugacaggcucaccguacuucuccccgggcauugggucuucuucuucucccacuucaacuuugacgucauggagcugccagaacaagacggcggccgagcucugccaccugugagaaaccuccgguggaggagagccuuccagaggaacacugccgccaggcaaacccugcugcuggccucaaggggauuccccagggauccaucgacggaauccggggaagaagagaaugaagaacaggaugagcucaaugaacagauccuacggcaagagcugcuggccaugauacccaucgaccagauccucaacagcuuccucgcccacuucagcauggcccagaucagggccgucauucugcacuucuuccgaggccuccuguacuggaagaacacccuagcccuggcagccauccucgugcuacugcgcgugaggcaaugccucucgcugcggccggcacccgccaugcggguggcucggccccagccccagcgcucccuacgacucauccuggauucgucccucaucgcaggcagcagcaucacgacagccaucacccagcugcucacccagaugcccgcucucguaggugcaaacaccaucccagcccaggagcuggcugagcuguuccugggcccuggccgcuggcagcgaaaugcucugcacucccaggcccaccgaggccugcaguucaccccuggcuucuggcugacgcugugugaguucuucggugucagagucaccccccaggagggccaccucccugcccugcgucagaaccgcuaccuggagcugcacgucguuggugaugaggaugucgucuugcgagaagcccugcaagacgaccugcaacguuaccgucaguguggccugcaugacggccugcaagacaccucgcaggacaagcaggacaacgacgugcaggaggccccacccagccacacagcagccacccacccaccccgcccacgccaccugauggauccccagguccuggaauuccuugguagccgccugcuccacauccacagugcagauggccagcugcaccugcucagccgggagcaggcagccagggcccugagccaguuccugacccugaucuacaggcgggcccugcccauccccgccugggagagccagcccagggagcaggcaaggcuagaagagcugccugaugaggacgaagaugcuaaccucgacugaagacgccucccugucuccagcaaagaguccccucuauuucucaccccaacaccucccgacguccccuggccuccccgcgccucagccugcuucgcuucccuuccugccacuccugacccaagaggaacccacuugugaagggcaacaacuucuucaacucaucaaccagcaaugccaccugugcuaacggacuacccaguccucagagacccagcgccagcccugggcuacgaguucuccguucuccaggucccaagcccaugcccgggagugacauccaugagggagaaagcaguggugagcaggaagugaccccaugacgcguggccagaugaagaagcaggcacagcaggcgcagccaagcaagcaggugacggggccccccacccggccuggugauggccacccugggacacugaccucgggugcuccacugacuucuucuaccuccacugccggugcuccugcuccccugagcucccgcccccgccccccaacccccaucccccaaccucccgacaucugaugauguggugccucccucacccccaucacacccugcaagcaaacccacccccacccccaccacaucugcuucagcuuuuuugaccccgccuuccucuugcccugagcucuggacuuaccuggacaaagccgcucuuuggggcauccggacguaccagugccacuuaccagacuugcacagcaaagagggccccugcaugccuuggggcgccuuucccucccaacacugaacacuggacagugcaggggugcaggggccccucauacagggauggagucccagaaggcacacagacacccaggggaccaugccgagucacagagaggcucuggccacaccaccgcuuugcaaggggaguagacccuuccccaccccccgagcuuucucaccccccaaucuuuuugcacuccucaaauaaagcaaacuaaaagacugucugacuuugggguuuguucuaaaaguggagguggugggaggauaggcgggggaggggacacgcaugggaggagggagggaguaggugggguggacgagggggcaaguggacugggcaggaagggugggggcaggaaacgcucugcccugaaacagccccugggggccuggcacaugggcagcaggccucccccaaccuuccugaaggcguccccaccaagacucugggcacuucuuucugccaugagaaggcacccacccccacugaggccaccagggacgugcaccccccacaggcucaugucaaagagaggacagaagaggugccuuagggcagugggaggcgggggagugggggcugucucuccuaaggguuccagaaaagggagccccgaaacccaguucccaccucuggccuuggccuccucgccaugugauuaacgaggugcggucugagccccacacugcaggguccacaagcccuggucucaagcagucccuaacccccacuccgagaggaaaaguccugggucccauuucagagggucaugcuguccccaaaguggcaaaauggcuguugugagggugagggugcacugcccuggguaggggagcugccaggggucccacagggaguuggggagguagggcagguggcacucacccacucugaguucccccuccacaguccaggacaugcugaccccucuuccuggccaugggucacaccuauccaggaguggccuccaaccucccagagcacccccgccccacugcaccccuccacaggugagagcucugcgaggacacagaggggaaggagccgugggccucucucagcaugaccuugaacuucaucuaggagggcaaaaacacuggagcucugugcacacgggcccccaugccaggacacaccagcucugcccucucugcccugcugaggaaccugcuccugaagacacaccgugagaccacccaacagaucucaggcucaaagcucaggggccccgcaggggucugacuagccugaguuggagccaccccauccccuaggaaagccauuuccaccuggccccagaguucucagcucccacauggaagagacccuacuguguccucgaggggaggcacgggagcaugacagccuccagacaguguggcucugccuccugcuccuacccaucguggaccaggaccacugggcacacaguggggagccccugaccaaggacacaccccacgggagcccaaggcuggcacugcaagcucagccuccuuccuucccugcacugcccagccccacacagggcucacgaugcccucacaaguccccaggggugccuggccuucacccaccauccaccugucugaagaaucuaccccugauagcagcaccaggagaucauggucaggaucuccagguucaaaggcaggggcuacaccucugggcuucucucucccuccacuggcuggcugcaggaaggccucucccagccucaguuuccucaucugucacuccaacccaccaaggcugcugugaggauucagaguuaggaauaaacugcugggcacagcuggcacucagagcucccagccccauccacagacuucucaugucaauuucccaagguaaacuuggggaaaucaaggcccagaaccggcugcagaggagcugaggacagagccaggauggaggccccuuccugguggcugaucuuuguccucucaccugggccacuucacccacucugccuccagucacaaggcccagcaaugaccuccacaacaaccaacaucacagcagcuccaggagcucaagggcaccaugucugucuguccguucaccuagcacucugccucugauggcagcccaagacaggcugccauggguuaaggccaggggcucagcugcaagaggugcagauccccuuuagugaccuggccccagaaggccccaacuuugacuugcugggugaccucagguaguggcuguccaucuuccagccuguuuucccaucaucaaaugggggauguagugagagggagggucauuuccagaauaaccagacccagucuccaagggccgcuggcuccuaaaacccccucuguucccagaugacauucuucuuggggcucccaagucccuugaaguaaacuaccuugggauagagccuggggucauaauggagggucccuagaucaggucuccugaaggccaccccuggggggucccagaggcuggauuuuaauggcaaaucucugucccugcuugguaagggcuccuuggguaaaugugggguggauuggcaguccccgugucccugcagccaggaccgucgacgaccgccauccuuuccuccuggccaucaaagauggaggggcaaggccgggugcaguggcucacgccuguaaucccaacacuuugggaggccgaggcagauggaucaccugagaucaggagcucgagaccagccugaccaacauggagaaaccccgucucuacuaaauaacaaaaaauuagcuggguaugguggcgcaugccuauaaucccagcuacucaggaggcugaggcagagaaucguuugaaccugggaggcggagguugcgaugagcugagaucgcgccacugcacuccagccugugcaacaagagugaaacuccgucucaagaaaaaaaaaaaaaaaagguggagggaugaacaggacuaccuugcaggguaaggccaaacagagaauuuaccagcaguaaucacccgugccccacagugggggaauccagacacgcgcuaagguaagcguauuuauccacaguucacacacacacacacauauugacugggggcucccggugcuagaguggccacggccccccacaccagcagacagugaggaccucgccuccuuggcuccccugccccauccagccacagcagguuuaguuuacagagaagagcggcagcccccaggcccagaggagaacuacugauaaagugauacaacggacucuggggacuccaggaaaagggugggagggggugagggauaaaaguacaaacuggguucaguguguacugcucaggugaugggugcacgagaaucucacaaaucaccaccaaggaacuuacucauguaaccaaacaccaccuguuccccaaaaccuauggaaauaaaaaauucaaaagaaaaauaauacaaaccuuuuuuucuccuggggaaagaaaaaggaagguuaauguuaaaugucaugcuggguuaugacaucauggccaccacaaaaaaaggugaaaacuccucugaacagcagacagcacagccuggcgcggacacuggcacacaggcccacgggaccuggcgggccacaacuaaaugcacccaucuuccaccuucucuguccacccccaggucacugaugucaggggauggagggagcccugagcuccacuccugcugagucuuguccaucaaccucccuucccgacccagcccacccccaugagaugcccaacgugccagccuccagcccuggugcacacagggccaguuucuggaacacucaacagcacaccacccaggcagcugagggcuacucaccgcucggguccggacucgcucaucccuccugcaggcggccccagguccaguuagggccuuggacucaggcccccgugccaggagcuugaccagcucuuaacaaucugcccagggcagagacgugagguccccuccugcccaccuggugaccccgguugcucccaaagugaaaaagagaaagacaacaaauagaagccaucacccccacucccaagcuccacccacccgcucagagcccugcugcggggacgacaagacccuugucaugccccaagcccaugagcacugaccucagacccaaacaguaagccucguccagaccccuguccaccugucugagaucaacaaagacaagcauacccauccugacaccacagaagcugagggguagaccaggaagggagcgggugcaugggggaagcgggggugaggaaggggagacgggaggugggaaggaagggcaggggagagggugcucccuccugcaggaagggagggggugcauuggggaggaggggugagaaagggaagaugggaggugagugggaagggcagaggugagggugcucccuccuacaggaagaaggggugcauggggaaggaggggugaggaaggggagaugggauguaagugggaagggcagaggugaggaugcucccuccugcacccucuuguccucucuaauggccucagcuacugcaaggccucucuccccacacuggcugcccugcugccccgaugcucaugccugggcuggcugucguggcuuguuaaugggguuaaugaugccaauaucacagggcuuggugcgggucaccucugccaugcacaggaccugaguuagucagagaggcagaagacagagguccaagaaccaggggccacggccgugcccccugcucauguugccauugggcacccucagguacccagccugagcaggguacgcacaggggaagaagggagcccagcugacagcuucuggggacccagaguugggaauccuuggggagaggggaaaugucuccagaacagguuuaaggagagaguaagaagccgccugugaggggccucagccuccuggucaugaaagaguccuggguagaggcagagaccccucgaggagacccuccucuuggggcacagaaagggccagcccugguccgccaaagccccacccccuccacccugggcacaaaggggcaccaucucuccaacgucuguccauccauccugugggccgggucccuuuggagggcucugugugggagcacagccccagccccucagugggagaagccccagggcuacccaacucccccuccggccuaucugcccuuggcuguggagucagcccagggggugucccaccaggggcauaguucccugccaaggaggggccucagagauggcccagccccaggcccuccccuccaggaagucagagagcugcagaagagagagagaagagcccaaggagcaugccgggaagaggcuggcaggacagcagcggacuugaggacgcguccccgugcagccaagggugcagaggaggguccgggggcugcgcgugguugaaggggaugaagaaaggcaucauauaggagcuggauaacugugcaucaacuccuguaugaagccguucccaccccccaacuacugacuacgggccgcaacccuccucccggaagcgcagugcaagcgcucggauggcagaggggacgccugcugcuagugguuagagcagugacagcaagggacagccagccuaggcagugccacccacugcugggcaccugcagcgcugggguaccuguccacccugcccagccuugcccuaccugccuccuauggccagggccugggccucccuuagccccacagagcccccaggugacugugcagccaggccaagggacggaggauggggaggugaagggggagacaggccugauucuggcccaggucugugaguggacaucggggacucgaccccacccacccacugcuuugacucccugguacuucuccagccuugccuucuacaucugugaaauggguugcaacaggcaccucuggggacccagugaggacucaugaaguccaggggcacuucaagaauuucccagagacagaaaguagauuuuugguugcugagggcuggggggugugcauggagggugaaggugacagcugaaggcucuggaguucuuuugggggugaugaaaaugaucuuaaauugauuauggugauaguugcagauaucugugaauaacuaaaacacacuucgcugugagcuuuaaugggcggauuguguguauguggauuacaucucaauaaaguuguaccccaaaacaccuuccuuuguucuuugacaucuuucucaaccaccauacugccugccucguccuacacucuccagccauccacaccaccaacacacaugcacagggacacgcagccaggcacgugguagguggugcaaaaauaucugugaguaaaugaccugauaauauaacauucucugaaagagcccauggagggaaaccuuuagggaaagggguuaaagauuaagaaguagggguggcaggaggguauggaggugggaaagaggcucagagugacacaugaauggaaaaggggcucagauugacagacacauggagggaggaggggcucccuguaacacauggguggaggagggggcuggugugacacacgggugggggaagagcuccaugggacacauggguggaggaggggguuggugugacccauggguggaggagggggcuggugugacacaugggugggggggguuagugugacacauggguggaggagggggcuggugugacacacgggugggggaagagcuccaugugacgcauggguggagaggggguuggugugacacaucaguggagagaggguuggugugacacauggguguggagaggggcuccaugucacauaaguaagggaggggcucagggcaaugcaugaguggggggaaggucucugggugaugcaugggaaggggaggacuucaagugacaugugagagaagcucaggugacacauuaguagggaaaaggcuccucaugacacaugagugaaggagagguggaaugugagacagaaaaggggcucagugugacgugugugggaagagagucucugugugacauauggggggaagggacuuggaguaacacaagaaaggcgacuuggugugacacgugggugggaagagucucucugugacauaugggggcagggacuuggaguaacacaagaaagaggacuugaugugacacgugggugggggaagaucucacgggacacaagguugggaagagaugcccagugagacacaagggugcagggagggcuccgcgugucagaaggaguccaugcaauacaucaguggaggaggagcucaguacgacacggggugggagagcggcucaguguuauacaugcaugaggugagggguccauucgacaaacgggcagggggugcugugugccuugugaguagaggaggagcuucaugugacauaugagcaggaaagaacucgguguaacacauggacagggacaggggcuccaggugacacaugagucagggaagggcucugaguaacacauguugaagagaaacucaaugugauacauggauggggagaggcauucuguaugacuuaugaguguggggagagacuacaugugugacacaugauuagaggaggaacuuagagugcagcugaauggguggggcuccuagugacacacacgcagaggacagggucagagugacaccuaagugguggaaggagcucagugugcuacaagagugggagaggggcguccugugacacauuaguggggcuugcugugacacccuuaagaaagauagaacauucagugugauacaaguagaugagaaauuauuugugucacauggguggaggcuccaugugacauaugaguggaggaggugucgaacaugacacaaggauggaggaggaggggcuccaugggacaccugggagggaggaggagcugaggaugacacauggaaggagaaauggcuccauggaacaggagguggaaggaggugcugaguaugacacauaggaagaggaggggcuccaugggacacccuggaggaaggaggugcugaaaaugacacgugggaagaggagggacuccaugggacacacggaagggauaggaagcugaggaugacacaugggaagaggcgggggcuccaugggacacacaggaaggaggaggagcugaggaugacacauggcaggaggaggagcuccaugggacacaaggauggagaaggcgcucaauauggcacaugagauaagaaggggguuccauggggcacacaggugaaggagugucugaggaugacacauggggggaggaggagccccaugggacacucacgagggaggaggagcucugaggaugacacauaggaggaggaggagcucaggaugaaccccagguggaggaagagagcuccgugggacacacggguggaugaggugcugaggaggaacccugggugaaagaggguuccaugggacaaagcggagaaaggagguucucaggaugacucaagggaggcgacaggaccucucugugacacaugauguaggagugacucaguguggcacaugaggguggaacugugugacacgagugcagauggaacucagugggacacagagauuuggugugucacauggauuggggacgguucaagugguacauuggggagggacaaaaggcuccaagugacacugaguagucagggcuggaagugacacacgggggugucucaugugacacaugacucgaggaggagccuagugugacacgucuguguggggcggggucagagugaugggggaggaggcgcuucuggcgaugcauguggaagaggcuccacgugacacuugaggcugggacacuuuucagccuugugaacaucuaaugaagcaagccccucccaggugaaugauggguguccugagcugaagguggagacccaguaggccugccucaucucgguagacccagaagcauaucuacaugccaccaauucuaauucugaacgagauaaaacaugcagguaaacaauucuaaacauuuuucagaaguuucuccagcaaaaguaacauuuccuuagcaaacaugggacaucuuuaaagaccacagaggcccccgaauacugagugugcucuaguccuuaaagggaggugacccugaggaccucagaguccacuguuuugucccugggaguccacaucccuucaccccagggcaucacagguucuuccuagacaccagagggccccagauucuggcuuuccaacaccuaaaaacuuccaaaauagauauuucacaacaaacacuucacacacaaaaaagaaaacauuaaaaucaacugacaaaauaauucccaucuucaaucaccaucauuuuagagcaaaacguacaucguuaacaauccaaugacacccaccaacgcgggcagcacagaggcugaccagcagacuagguggcagaguucaggugccaaaaggcuccuggggcgcaggaaucuugccaaggacuugggagugaggaccuugggagcaaucuagggaccccugaacuccggcagccauuacugagaugacccauggggaauagagaggggacaugcaaucucucccuccaggcuccacacagcaggaccucagcugagcccgcacuuccucccccugcccaccaccccagcugaucccgcccuucuggaaaccagcucacccuccucugcacucaugcccacacccacgcccccacccccagcccuggcccaggcucuccugccauccaccggugacacaugacucgaggaggagccuagugugacacgucuguguggggcggggucagagugaugggggaggaggcgcuucuggcgaugcauguggaagaggcuccacgugacacuugaggcugggacacuuuucagccuugugaacaucuaaugaagcaagccccucccaggugaaugauggguguccugagcugaagguggagacccaguaggccugccucaucucgguagacccagaagcauaucuacaugccaccaauucuaauucugaacgagauaaaacaugcagguaaacaauucuaaacauuuuucagaaguuccuccagcaaaaguaacauuuccuuagcaaacaugggacaucuuuaaagaccacagaggcccccgaauacugagugugcucuagucccuaaagggaggugacccugaggaccucagaguccacuguuuugucccugggaguccacaucccuucaccccagggcaucacagguucuuccuagacaccagagggccccagauucuggcuuuccaacaccuaaaaacuuccaaaauagauauuucacaacaaacacuucacacacaaaaaagaaaacauuaaaaucaacugacaaaauaauucccaucuucaaucaccaucauuuuagagcaaaacguacaucguuaacaauccaaugacacccaccaacgcgggcagcacagaggcugaccagcagacuagguggcagaguucaggugccaaaaggcuccuggggcgcaggaaucuugccaaggacuugggagugaggaccuugggagcaaucuagggaccccugaacuccggcagccauuacugagaugacccauggggaauagagaggggacaugcaaucucucccuccaggcuccacacagcaggaccucagcugagcccgcacuuccucccccugcccaccaccccagcugaucccgcccuucuggaaaccagcucacccuccucugcacucaugcccacacccacgcccccacccccagcccuggcccaggcucuccugccauccaccggcuggcgugcgucuccccgaggcgugcacucacaagggcaacguccaucuacacgaugccuggcacagggccuggcacacaguagaccuucaccgaaugugcaaacgaaugaaugaaagccuaccauguacaaagcccuggaggccagaaugagccccgaagcgaggaugauggaggugaggcgggugauggaggcuggaauggccagagaugag

SEQ ID NO: 12632 - RNA, 101782 nt, Homo sapiens
uuuuuaagaagacaggagagcuggguccaacaaauguccccuuacuacgcaugucugauuauucugggcauuggguggggguaggugacugagggaacggugaccaaugccauuuccuggccaccagucacuaugcugucaccacauccauuuuauuaaucagagcaacaaaugccuggcagccucugcuuugugcccagggcauccagagagggagcuggggacagagauguguucccugcugcccuagaggcccagcuccuuagcccagcccuggaucgcagugagagccugugggcagagacacacacuguccucccacagccgcucaccccucuugcuuuggaacagcaggguaucccuggaguaucaacccugccucaccucgguuaauaagauccucauggcggacauagguuucauaccugcugcagccccucuugggauguguuggccagaggagccucugcagauuguccgauugauccuggcagccacuugugcagugcagcuauuuaugggucaggcguggagaugggcagugguucaggccgcauuaagaagccugauauccacuaaucagauuuccucuaauaaagcaagggcaagugcaugugugcagcuugguguggggggggcguccuuggcuuaagcagagagggccuugaaggaggggggcuuggccuggcuuuucccuccuuugcuaugugaucuugagucuaagaaugaucugcucaucuauuaaaaugaaauuccugcucuuaaaagccccuagcucuggggcagauccgccccacucugggcccgauuccaccucccauccuguuccugcacaguguggguguuagccaugccagcgccuuugcccacguggccacaaggacaccccauggcacaccaagaagcuucgagcuugaaaaugcccaggaagaccaccagggcuuggcaucuaagggagagaccccauccaguuugggcucaauucacccacucacuuccuuggcagcuggaggucuaauaacucaaaggucaccugagcucagccagccuggccucgguuccccucuuccaccacuggcucugccccuugucucucagaaauuccgagccagguuccugccucccuuccuccuggcacucaccuuaucacuaacugaguccuggggacuccucuugccauuuuuggauucaucagggagccaaugaaacaaguucugagcaccuacugugugccggggccugggucaccucucugucuuccaucucaaucuucuggcugccacaguggcccaaacccuuaucgccugugccuguugaagaaggacaccacuuuccccaacuccuggcccugcagaggcagugccuuucaaaggacuccucccauagcaacugucguaagcccagagagccuuggcuuugucacuggccagugggaaugauagcaacagucucacagaguuauccugaggacucaagcuagagcagggaacgugccagcccaggcuccacauccagcaggugauugagacaugugcacucacuggaaucagcacacaggggccuccuuucucugugccacauacaccaucacugccacucucuccuggcuccucucuugucucacacuggguuuaaaaucuucuuugccuucucagcuggggucuugaaaggaaacaggucagugcugaguccaggaauggccuuauguguaccccugcguucaagauucucaggcuguaauagaccccagccggagacagugcugggaucgauuagcaaugucugcucuggacagagguggagggaagggcaggcuguaugccaggaucagugagcccacccauggccccacuccucucuauagccucauuccccucucuuuccaccacuugagccucuuucucugcuuuauuauuucucuuccaccucugucugucuuguuccuuuuccucccuccucgcuauauuggacauccacagacauuagagccaaggccuaaaccuugggggcacucucucagucauggccugggccaucucugccauaugcacagccuuguguucccugacucuccugcaucuacuucuucugccuuccugugagaggucucacaaggagugaugacuggugauugaaccaaacucuguucuuucauucucaucaaacauucauugugcaccuacuguguggcaggcccuuuguggccagguugggucagauguggccccugccuucaaggagcugaaagucugggggggggagaguggcagucccccaaaugagucauugugguagaagcauucugccaggaguacaugcagggacacaggggucuaguccagucugcaggggcagggaaacuucuggaggagacacugccagagcugaauccuaaaagaugaggaggaggggcugggcgagagaggucauggaggccagcuaucaggaugggaaugccaggcugagcuuagacuugacccacaggcucauggacaguuuucaccauggaugugcaagagucagccuguuaagaagguggcccugguggcagguggagaagagaaggggagguucaguugcaggcagcagggacagugagguggcugaaggaucagaacuggugcagggcuugucuaugcagagcgagaagcggaaccaagaccuccugccucccaguaaagguaucugggcuggccagcaauuccccaaagcacaguccucaggacccgaugcugcagcugaaugaguuugggaaacacugcucacagcacucccaucuaggggucaccaugucuguuagcagaacaaaggcucugagaagucuugcacuugcccccguuuaacccaauguuucucaaacuguguaaccacacaacacacuuguucacauccugaagaggaggcugggaaccccuggaugagcauggcugccugucuugggagugcuuuucuccggaaucugacacugcuggaggucuaaaguuaucagcugugccaucaacugugcaaaugucacuggccuugagaaaucagcuaagagcagagugaggaauaucuacuuugggcagggaggccacugaggaagaggagacucaucacagacucucucugugauuuggggccacuggacuccuuggugccuuaccuuccuugaaaggacauaggucaguguuaaguccaggaauggccuuauguguaccccuguguucaagauucucuggcuguacuagaucccagccaaagacagugcugagaucaaugagcgaugucugccccgggcagagguggagggaagggcaggcuguacgccaggaucagugagcccacccauggccccacuccccucuuuagccuuccccaucuguaaaauggguaugaugagugugcaccccugccuauuuucaaagaugugggcauuaaugugacaaagcguugaacauaccaaggaaucaggaugucguggagcagcagacagcccacccuggcccagacacacugcggugauguggaagaaguacuggccugggaauuggguccucccuuacucacugugggaccaggauaaacugcugggccucucuggguaagaacaggggcugcaggcacacccacuguguguaaagaaugaagcaaacaaguaggcagcaagcagauagaguuauaaaaccaugauguucuuuauuagcuaauaagguacaucuguuuuuacagaaacugagguccaagggaggcccauguuggggcugcuggagggcgcagacaggcuguaaacacagcgcaugggcaccaggagcaccggacaggcuugggaccaacugacuguggcuuaagcccacaagagaaugcacuugcucaccccaguuggguggcucgcgugugcgccacgugccugcauugggguucucaaagagucgggaaggacccgccucccuccucaggucaccuaucugcugacagcccuacccagaggagggcucugauugguugaggugggccuucacacguccaaauccagccaaucaccguggcucuggggaauucuggacucugauuggccacaccucaguuccacacgcuucucgagguggggcuagaguugggacacccagacccacccgggcugccagggaggcaggcacgcagaggcgcugcccccagccagacucucugggcugcuguguggcacacaccauccgggauggaugcuggggauguagggaggaugcuugauugagccccaggcuuugcucccaggagcucccauuccacccgcagguccagcgccuuggaaaguggcacaugugggguguggacgggcggacgaggaacccucugcuuccacggcucagacacugccugggagguccugaguccacgggucuauucccacggguggaagagaggaagaaccagggucugggggcugguagguggccacucaaggcacucuaagcuuggggccagaaagcagcggggguccuuaagccacggagaggcuuccagggcuggcuccacaucggaaucacugugggauccugggcacgugauccugucuugcuggaaguuuucccaucuguaaaacaagggguuuggaguaauucaucucagagguccuuccaguacucauacagcgguugcgcuuuccugaaaggcuguaugcaaauggaguuccguaaaccaaaucgaaguggcucugcagagcgcggcgucugccggcgcgccccucccccgcccgcgcugccgcggggacagccuggacuuccccgcagcgaggccggcugcgcggccgccgcgugggucggaguccagugcccccugguggcgccgaggcgggcaggcggcuuccggaccgcgcggaggcccgacggcugugacucagggguggcgccgcugccagggcggcgggaggccugacugggguuccgucgugggcugagccacggcgcaauuaauuaccagcugcugggaauccuugucgcccgcucgcggugacucacccggcagccaggcucacuugccgagcgcgggggccuugguuuccaaaaugaaucuggggagagugccugcucgggguagggcuccccgcucccucgccccagggcgcccgcagacccagcgaggaccugacggcucagacguagcccacagcgcgggcuccccuucccuggugggcacccgugaucccugaaaguggggugcagagcgucccagcugggaggccucggugaaucacuggggucccagacccucugggcccggggucccugaggccagggagcccgagcaccgcuccagggggcgacccacagaagggacuggucuccuggagcccgcgagcugcccgaggguuaggucugauuccccagccaccccuuggccagcugcuagccugccgccaggcaacucuuucccaucuccaucccuuccuuggcuggggucaggagaggaagaggagcccaggggucucugaggcuugggucuguccuuuuggagcuccagggcuccaggcgggauucaggaagccgaaggucaaggaaaagccccucgauagccuaaagggagagggcggggagggggaggagguaaaggaggccaaaaugggaaggagauaaagccuggagagggcucaucuggaagcagggaauaggugcgccccagcccgagccucguguuccuaccccagguggucucgagggggcuaucgcguggcucagggcugcauccacggcgcaccuugcgcccagcuguggggaaccaaagagugauuauauauaucaaagagugauuauauauauauauauauauauauauauguguguguguguguguguguguguguguguguguguguguguguauuuuuuuuuuuuccuucaguaaagcaacagagagguuacugggucgggggauugcgaugucuuuccccgcuguccugacuccaaaaguggcggcccaugcuguccuuagcgcucuccagggaaacgacucgggucugcaggugcuggcccaagcgggcugugccgcugggaggcgagggggccgaggcagcccucgggaccccaccacuccacgaggccaugucccuggccaaugacacgcucccgcgccggguggcuagguggggggugggggguggggaagacuucgugaaccgcugcugccgcucuccugugugcccauggcccccuccccuucugcuccccacucucugcccaaucugccugaagcugucagccugccaucucuggcugaaucccguuuuccuccuccaaccccgagucccucaaacucuccacccgccagggcugcuugcgcucuuggggagcggggcuagaaggacccaagaagccgcguuuauccucccaucccccgccaaaacccgccggcggcuccgcccccgcccccucccuggcggcucaggccgccccucccgggcucccuccgcgugcgcccugcgccgcgcugggucugcagcgggagcugccacagcagccucgccagcuggcuggggaccaggcgggagguggcgcgcccuggaggcugcgggagggagggagggagggaggcccggccucggcguagcccggcccccgcuccccgaggcccucccgccggagcggggcugccaagcgcacacacacacacacacacacacgcacauacacacgcgcacacacacauucgggcucccaacggcgcgcacgcacguagcgcccggggcagaccagcgcggcggccgccucccgggacgcccggacgccggagggccccgacccccgcgcggcucaugcgcccgcguccgccccgcugcuccgcgaggcccgcgggaccccucccgccgccgccgccgcgcccgccgcccccggaggagcgggcuggccgaccgccaccgcgccgucccccggccgcccccgaagccgcuccaucgcggucccugccguccuggggccgcgccccgcucccgcgccuuggggguugagccgagcaaacuucgcgcaccggccgacgcccggcggggaccccgcugcgcacccgcgcgcccgggugggcgcugggcgcgcggaccuuuggggagcgggcugccccucccgcugcaccugcucggcccccuccccgcuugcaggggacuccagagacaccgccacuucgcaaacuuuuccuccccaccaccgagagggggcgaggagggguaaaaggggaagcagguuccgcugggcgcgcggaccugcaggcuccuugcugggcaccgccacccgcgagcuggacccacagggguaccgggccccgcggccgcccuccggccgcuuucuggcuccgguucccgucccugcguuucccgcgggagcggggggcggggugcggagggcagcaaggcccgcgcgguacccagcggggccgcccugcauggcccugcgcaguggggcgggcugcuucggccgggucuggcgcagggugucgggguucccggacgccuggccccggcgcucgagcagccuccugugccuguccgccuucucggcugagcccgggcccgcgccgccccugccccgccagccgccucgcgguggcgguggcuguggcggccccagcggagggggccccccccagccuccccgccccccgccuccccgcugcugcugcugcugcugccgccgccgcuuacaacuuggaggcggcggcggcggcggcggaggaggaggcggcggcggccgccgggcgcugcagugggacgcgcgcggcugugagccugcgggacaugccccccgcgccggcuccuugcuggcggccaugaagaggcagaacgugcggacucugucccucaucgucugcaccuucaccuaccugcuggugggcgccgccguguucgacgcccucgagucggaccacgagaugcgcgaggaggagaaacucaaagccgaggagauccggaucaaggggaaguacaacaucagcagcgaggacuaccggcagcuggagcuggugauccugcagucggaaccgcaccgcgccggcguccaguggaaauucgccggcuccuucuacuuugcgaucacggucaucaccaccauagguaagggcugggcgcgccgcugggcucccgcgccccgggaggaguccggggaggcggcugagcgcgccgcgccgggcugggugcagggcgucgaggguuaaacgcagccucccuugggggccuucccgcagcgcccccuccucucuagggagcccccccuccgcggcgccuccgagccucacccuucggggaccccacccggugcucuccaccgcgcuggugucugggccgggcgugcgagccccgagcgagugugccugagccgggagggcggaggcgccacuuuugcgaagagaguggagcgcuaagaauaaucccauagcagacacccacccacccaccgccccggcgcgggcugggcugcgcggggcucugagccuuacacuuacuaccucucugggaguuggagagggcuggccuggcacccauggcuccuagagggacucagguggcaggggagugcgccuggggcgugagaggcacugacccuccguagccccugggccccgcuccaggcuucucugagcucagauuucaucucucuuccccccgcccggcuccuuuuuuccccugaguuccaguucuggagcuuggacuucccaggccccugggaggagagaguuugcucucuggugcuugcguuggggguggcagccccucaauugcucucaguagagguggagagugggggcagggcagaaccugcccacucccuaggcugugacacugggaaaggccagucuagacauugcccagaaaccagggaacuugagccccagucacgagaggggguccagcugguaaacugcagggaugcccgccagccccacugccaagggcgcuauucacagagcagggucucuggucggucccgagggcaguguccccucuaaggcugggggcugggaggacucccggacguuauacuuggagaccugugggagcuggggcagguaccuucauucggguggacgugguggauacccugcauggcaggaggcaggguggugucucugugguucacuugccccagugaggcaggcugccucucuagggccaucuccuuggacuugccaaggccaguguguuaguggggguggucuguuuccugcaccccucagggcuucacaccccugugcccugggcagggaccuccuccuuccccccucccuucuucccagcuccuccugucucgcuucucuggaccuccuccucuaauuucccucuugauauuuuucuuugucuggaaaucucugcauacugaaaaaaaaaggauuucucagugccauaugcaacaggaagcgccagcacaggacggccugucuuuccuucuugguugaaaauacuuuuuagagagucaucuuguuuuaaauguuuaauucauuggugcagguuuuucuguuugugaaggaaauuguccuucuguuaucuacauaaucagcuuggcucuugcuugccccacgcccuuugcccagcaccccaaacacagaugacuccuucccuucccacacuguguuuccagcuucugagagggccagucauugccauuuucucuggcuuuaaacuguggcaguggcacgcagaugcacagggcagugauucugggagacaggggccuguuugcuggagagcuggagaguaagaaauaugccucugaaacuggccaccccuggggaaaggagaaagccccaaggcccuuaaacaugccuuuaggguugaagauggaagacaggugaauuuggcuagcaugcuggcuuccaguaguaaaacaggcacauaaaaugcuuggcugaucccgagaguugagcgacaacaucgaggagaggauugguguuaaaagcaaacucugaaaugugccaguuuuccuuaagaaaugcauuguggagacugaugaaguucuuacugagguguguuuccaugguugauucugauugguagcucuggguguaugccuguaacgguuaaaacuccaaagagaagcugucaagggaaguguagcuaaauggagggugucggcuucgccucaggggcugugggacuuguaugaauaagggaccagaggccaucugaggaauucgcugauuuuccucgcuuccuucuuugggcuuuccacugauuuucuggaaagaaagguugggaaaaaaaugugugugugugugugugugcgcgcgugugugugugugugugugcgcgcgcgcgcguguguguguguguguguguguguauguguaugugaauaaaagacagcucuaacacuaacacagcuguccuguuguggaaagauguucaacuuggaacccacagaccuggcuuggaaucugaauucggccauaguguaaagaccagagagaggucauuucccaacuccugaccucaguuuccccaccugcagaagagaugucucacaauaacuaccugacaggcugacuuuuaagguccagcugagaucccgcgggcugcagcugccaggcacaguguggccggcacuuaguaggaacggaauccacgcucuuggacgaagccugaucgagccuccgcucucugcccuaagaagcuguuuagcacaagaguucaaauuuacaggaaacaaagcaccuuuccaguuaauucuguuuguuuuuuuuucuuuuuuuaauauaaaugcaaauuaagaugcuccuaggccuagaacaaaacccggccccaagccucgcccuccaaggauuugucuccuauugggcagugauauuaaugagucagguuaaucuucauuggcguuuugauuuuuaaucuaaccuugagcuauuucuugagcaugcuuuaacuuuuugcccaaaucuccaaggcugggacaggagccgcuggugcugggcggccacgaaugaaggcuucuucucagaugcagcuauuagcuugcccugugaaauggauuuuuaaaacguauguaauuaccacuuugcguugaaucuguggccgagccuuccuaaaaggcuuuggagggauauuacccugagucucaccccagcucucuggggaucccggggcacagugaccauugucauaaccagggaagaacgggaguccagcugggccccgcaaagggcaaauucaguuacaucauuuaucaggcucuguuuccauuccuccccauuugcuuccuuugaugucugugccacuuguagcuauuucugcggagauuauguuuaguucuaaacuugugaagugcuagaccuuugcaugggagacccucguagguacccuguaguuuccuuuugauuagggguucagucugaguuuccccccaacccccgccccaccaccuguugguggaaguggugaaagucaggagugcugggccagggucuggacagggguggaggaguuuuauuuggauuuggccugcuuggggccaaaugguguguaagggaccccuggaacacacaugugaccuuccuucagcaggcgcuuuagccucuccccacgauccaacagaguuagagucuccaugacacuucuuucuccaaucuaacaucugugaccugagcuguuaucaccuucaggaucauuaaaaaagaagaaaccaucagaucuuagaaaucagaucucaucugcagaguguagaggacaauuugaaaucgggcuuagguagggaaggagagguggguuuuuccuuuucuugcuacaguuugcaggagcggaagccguacaucaggggcaguauuuccccagaaccucggggcccagcugaagcuaggagugguugcuguggggauugagcugacuggcugggggcaggguacacucugagaaacagcuuuggggucccuggaggugccuugcucccaggccuguaccugcuggaaaacagagugccuugagauagcuuccuuuucucauucauaaacggcaccuuaaacagacuuuucgugaaacagacagcauuuuccauuuuuuuuccuggcacucuuggugcaguuuuugguacgugguucacacucugggcgagcaccuggcccugccaggucugugcugcuccaaggcucugaggcucuggggacagucuagaugacaagauaaggccuggccuugagugaggaggagggagcuggaaacccaaacaguugguugcaguccagggugcagucuaggggcagcuaagcccaguggcugcuucaaccccuucccugccacccugcuuagcacaugcaggggguauguuccuugguuggcucuuuuaaccugucuuacaggggcuuguccuccaagaagucuucccagccuuuccucucacugccugccucagucccagccuuuuucuuuaauaaauacuauguuuucugcuccaggcccuaccuguguguguuuucccgugcaccugcagggccagcacaauuccugggccagagugggccucuuggaagggcugcagaauacagcaccaagcagaccccacaggcuggugccagaggagcacggagccuccacacgcaugcacucaccucccccacuuuacagaugaggaaccugacgcagauaaggccacacacaccaaggcagagggccuugaacucugucaugcaguugggaucuccuuacugaaggcuccaacugugguguuuucccugggaccagggcugggcuccuggaguaguccaucgcguuuuuccuucucccuuuagcuccacccuucaguagaacugcccagcagacccagaugaagggccuacuagggcgccauggggugggcccagaggaguggggccuccuugguaauguccagcaggguagcuggccaugcuggggagccaggagaugccugugggcagcuccucuuccccacacccuucucggaccugggcucgcucugcucugggcccucuaggaagcacugccucuuuguagaugucauggacacagccaagaaauggggcagaagugggguuucuucugauucugggguacaucaaagagacaccucggaaugcggagacacccagcauggugcucugaggaggggugggaaucaggugagacccaggaguuggagauacccauugcccucaccuacucuuuccugggucacuuucaucaguggagucuaaugaggucagagcaguaggugaaacaggccccaguauacaccucuuccuccaugcagcgguuauucacaccuccaucucuccauucacaauguacucacuuaguccuccaugcaccugcuuauucacacauccauccacccacccacccagcuauccaccgugcaucugccacccaucaauccacccaucuacacauccauccaucugucuauccccauccauccucccauccacccacuuauccauccauccauccauccauccauccauccauccauccaaccauccacucacccauucaccauucauccacccaccaucuauccauccacccacccauccaccacucaucuaccuauccauccauccaccauucacccaucuacccaccuacccacucacccauccauacacccaucuacccacucauccacccauccaccauccaucuguccacccacccaucuacccauacauucauucaccauucauccacuauuuauccauccaccuacccaaccauccaccauccaucuguucacccacccguccacccguccaucaauccauucauucaccaugcaucccuucacccaucuacccauccaccauccauccguccacccauccacccauucauccaccuacccacccacccauccauccaucuauucauccacccacccacuccuucauccaucuauccauccacccacucacccauccaucuauucauccacccauccauccaccuacccaucuaccuacccacccacccacucauccaucuauccauccacccauccacccaccaacccacuuacccauuuauauccauuuacccacucauccauccauccauccauccauccauccauccauccacccacucaucuauucacccacccacucauccauccauccauccauccauuuauccacccauccauccuucuguguacucccucccuucuucccucccuccuucccucccuccucuguguacucaguggguccucaacucacuugcuuauuggacggauuucugccucugccuuuccaugugcugggugggagcccugugcuggugggaggcacacgguggugagcaggcacaguacccucauuagagccucaguguuaaugccucaauggccuccaugaaggaucuccaagauguucuagacccaucuccuuccugcaaauggugagccaaucccaaucacuucugauuuuuaagcauuuuuauuuaaguauaacguucuuauagaaaaguguacauuucacaaauguauugcucagugaauucucauaaggaaaucauguccauguaaccagcacucuuaacaagagacagaacauuacuagcaccccagaacccccgaagcuagucaucucuugaaugccuccagugguaaagagcucauuauguaacacauaaugaagugguaguggauguguuuagacgaauguugagauuaucucuugugggguucugaucuggugaggaguggugugugcauggggguugggauggcuucucuucaaggggcugcuugucucuauaguagucaccugaggaggacccagcagauguacauuuagaaacuggaacguggggggcuuagaccuggaagaugagagggauuucagcucacagaugcgaaguugagccuggaguggggacaguaugcuacaguggcccagggagcuggccccagaggguuggccccucugacucagacuguagcaagcagcucugggcuguguauacaccagccuccuagaggaugagggaaacauggagaaagagaugcaaugcuuguucucaguagagccccaggaacuaggaggcaaccagcccagguaggcuggcugauaaaggaaaggcagugggcauucuugagagagucccaugggcagagaaauucuggggccugagaauuggaggaggguccuucccaccuccagguggagcacccugcuauggccagccugaaggagccuggagucugaggucccuuuccucaagggauuuuuguuuugagggucucuuuuccugcccauccccaccuggggaccuccaccuguagaaagcucucccuuuuuaggucagugcacucaccguguagcuuaugauccuccaaagggagggcugaguggagcuuggccucccuccuguucuguaacagccuguagggauuuggggauagcccugggcuccugaguuucucccaauaaugcccuuuguagccaguuccucuccucugagaaauuuuagccuguaugugcuuucccaguccagucugagcauucagggagagcugaccaucaccuccccuugucuacacaauauacuucuguuaauguccucaguuggugcacuagcuuuucuggguagccccuuccugcauuaacuuguuuugagcacauguacuuccauuuugugcuacuaagcaaaagugucccugucuugcauugguauggucccaaauacaaacccuggcauugauaccugagcacaaaguagaauuaugugcuagggaccaagaaaggaaggggugguugauggaaaaauucauggcagggaagaugagaaaauucaggugcaucugugaguguguuggccuggcuugucgggacacugugggcagaugucagccacugggccugaaagucccuccagcucacaguuugcuggccucagcccaaccaugcccuugccuggggucuuggggucaaccagcccugagugauggaagagccuggccagggaguggcugcucgaagguggugcuaggugagugggguggaccugcccugagccauccucauccuuaucagaacuugagcccugggaggaaccaguagguggcaaugggguggagggagggggcuggaguagaggagggugggcugaaguuugggguggcaggugauggguggaauguuggugugacaagagggaugcugggccaggcaucuggagaguggggggcaggucccuacccuacgcauggccagccauccaaugaaugggccaugaugccaccugucaccugggcaggauuucaggggcuccuccguggccucucuuaugaaggcacacagcugggaagcaggcagaccugggaugccagugcccugcagggcggcucacgucuggcucaugccccaucccagaggcccaaucccaggcacaccccuuaagccugggcucccucaucuaugaaacggagacuuagagcucagaauuuguguccuuguaaggaugggaggaaaugugugugaaagguuuccucgccuccuccacccaggaggcagcuggugaguggcagcuuuguugugaugguggucauuugggcgugcucauuaggggacagucaccugggucugguugugcucuguccacucuuggcaaauucacuuucagcuuccccuugccacuuccccaccacccccuuucugcugccgccgaaccccugaucuaaucucauggccccaaucuuagcaagggggcaccugaggccgcccugacugagaaaugcuccucagagauggaaaagcuccuaccauccaauggauggggguugggauggugucaagccgggggcuuugggggccacaggcugcauucaaggugucucuguguuggauugcuauggacuggaauacaagcccuggcucauucaaggaguaagauuuccccaacucaguucuguugggauacuauggcuuccugggacaccaccuuccacuccaccacugcagugaccuuuaaaagcccauggcugccaucuucgcccugccccagaccccagcagcuccccauccccugcagaaucagacccagguccucagcuugcagcccuuuucauccuccagccccgcucaggcccuguucccacaccuucugcccugaguccggcucugccuuccucuuuuccccaauuguccuuuauccucuugagcaaaggacuuguuucuuugcuccccagcccacugugcuacucaguuuucugaguagacaucaguauucccuaggggcugcuggucucaggcucccuugcaccuggccaggcccauagcaggugcucagggaaggcuggcuggacacuggcugguacuccuggcuccccgagagcaggagcagcugagagcugagcaguuuggggugacaucuuucugcuugguugugccuugggaccacuggguaggugcaggacaggcugcagccuuuugaacucaagcuguugcuuuuaauggaagacaacagguuagggaucuguccugcugaguggggagcuucucacuccugaggcuuagaugugugaucuugguccccaaggccagcugcuggcgccaggccucugugagucugcagggcaucuggcaggaagagaugccuacuugugaaauggacuuuggcugucacuggcccugucagacaugugaggugcagcccacucaggaaggugagaggccuuuaccugcagcugacaggcacgcagcgcacaugugguguuugucagagguguggaaggugggcauacaucugggaugagcuugucagguggggcuggggugaaaacucaggugagguuggggugaaucucucaggugggccugaggugagccucucaggugagcagggugagcugcucaggugggcagggugagcugggugguauugagaacugugggguggacacuugguucccacauuugaagcagaagcucuaggcagcauuuugugucagggcagcuugggugcauggucccauguggucuggaaacaggcagugccaggccacucaugggugccagggcaugggcauucaguuggacgugggggggagcugauugccacugaugccagguggaccuaggcugagcuuauccgggcugcagggaagggcccagcccagggaugccacggggugugggagaacguuccccagugagucuggucaugaugagaggcucucccugugcgguuucccagagagaacuucuuugacagcacccaagugcugaggagcucuggcaguuggggaaauuggucuggugucugucugggacaauguucaggccauagguauucaaacacuagugagggggaagccaguguguguugaauccccaaauagcucucauacuaugggaaagggaaaguuggcaagcaacggcagaguguuucgugaaagggaggaaauucccuacgacucuccugagaccccaugaucacauccaagaauggcuucagcauuccauguucaccuucuugucauugcccaaaugugcuugcugacuuuaucauuucaucagaguggauuauuuagggaucguguucaggagccucuagcagaaaagccagguaacaaggacuugagcaaacagccguuuugucuuucuugguugcgaagcguggggcaggcagacgggcugacagguggcuccacaaugccuugagagagcagguucuuuccagcuuucugcucagucaucuuagcuuggcauuuguccucuggcuggugucucaugguuccaugguggcugcuccaccuccaacauccucuccagcaucccucccagcaggaagaagaggaagaacacaagucaaaggcgugugccagcugagccugcuucuuucuaaagaaccuuccuggaugacccgcccaacagcuucuacuuauaucucaucagccaggacuaugucuuaugaccaacucuagcugcaagggaaccuggaaaauggggcaugcugcuucucaaagcaagcugggguguggcuggugaggaguggguggagucagguauugggaggugcccacggggucuguggugauaugcauagcauuucagagccccuuuucucuuuaaguuuacaucacacauuaccuugaguuuccacagacugaagggaaaugauuuuaauggcuauauauccacugaaugaauggacacuuaauuauugaaccaugccucuauuuauaaugauuuaauguauuuuuucuuucuuuaggcuaacuauagauaaugguuuguuggacaucucuguguguguggauucugugagauccuccuuuaaggguuugcuggcuguagugggaucagcaggucagggggcacagcacucaguuguguuacuauguuguucccaucaacaacuguacaagcaggggugggucuucuggcuucacugcaacuucagcagcccucggcaauguugaaaaaguuuuugauguucuuacuauuucaggauguuuuccuaguggucuucagguggccuuggaaaggcagcugggacaagcucauguggaguuggaaagcugguauccacggugaaauccuugcucaccccagacacagccagugcagggggaucugcaggacacuuguggacgcaugaaaugaggagggggaggggaagggagccuguagacccauuucagcuccagggauggggacaguuugccuugucagucugacccagccgacuggcucuggucacuggagcauuguaccacgaagcagucucaguggggaagggugccgugugugauugauuagucaugucugacaugggugugggucaggcagugguagcaugcuugccacauaagcccacccugggcugguggaagacagaauuucagagguagaugccuuuucaucagugugccaggaaugaugucacuauggauaauugcuugaccugggugcaaucuaguuuacaagacagguucccauccacaaccaucuuucauccauuaacaagacuaugaaauagggccaaugguuaccugguuaugcugaugaggcucugagagaucuggugacuugcccaaggucaugaaguggagcuuaggacuugaacccaaaucucuccucaagcuugauguggucuccauuacacccacagccuguccagggugcagucccagacacugucccucugccuggaauuaagagcuuggauacaggaaggauuagccucagugauuaucaccugacaauaucaagagaacucagaagcaucuggucccacccucucaggauggcagcaucacugaaccuuccagugacagggaguuaacugccucacucauagagaaagguagaaauagcaucaguuuuaaaauaaaaggccaaaaugacccucauugguuugucuuaguucuccugaccagagcuccccaggauaagugugaccucaauucucuuaccacaaccaaagagcuauuguuuauggcaugcccaugggauucuguuuuuuuacagucacuaucucaauuaauuccauccucucgacaauccuaugagauagauauuuucauguauccccguuuuacagaugaggaucuagaagaucagagagacuaagcaacuugcccagggucauguagcuaauaaguggcagaaaggaguuaugcccgggaagucugacuucagagucugugcuaacuauguuguuacauacagugucuuuucaccuuuaucaguuagcuagugauguguauguaacaaaucauccacaaacacagaggcugaaaacaaccaccaucuauuacuguucacagucugaggcucagcugggcagcuuuuacccauuacuggucugcaggcugaugggggaagcucugcuucaagucauugcauguuuuucgcucaaugauggcaaagguggccgggcgugguggcucacaccuguaaucccagcacuuugggagcugagacgggcagaucacgaggucaggagaucgagaccauccuggcuaacauggugaaaccccaucucuauuaaaaauacaaaaaauuagccaggcaugguggcgggcgccuguagucccagcuauucgggaggcugaggcaggagaauggcgugaaccugggaggcagagcuugcagugagucgagaucacgccacugcgcuccagcuugggcagcagagugagacuccgucucaaaaaaaaaaaaaaaaaugauggcaaaggcacaggagagcagcaaaugcaagugacgacucuuuugccaugacacugccaugaugcugucacuucucccacauaccauuggccaaagcaagucaugugaccaaggccaaagucaaaaggugggaaauacauccugcccacaaugagcccaaagcaaugguacagcaucucagccugccaucugaccaugccucuugccaagucccuccugccaccuacuccucaccaugauuuccuuccugguauaguggagagcauagcuuugguuuccaaguggguucaaauccugcccauugcauagcucucagaugauuugcuguuuucucaucuguaaaacagauaguccacagucuaccuuuggauucguuucaguuugcuggggcugccauuacagaguaagacagggugacuuaagcagcagaaaauacuuuuuuucucacaguucuucaugccugaaguccaagaucaaggugucagcagguugauuucuucggaagccuuucuuuuuggcuuguggaugaucaucucccugggucuucauacagccaucccucugugcaugucugugguccuaaucuccucuccuuauaaggacaccaguuagauuggauuagggcucacacgaggggccucauuuuaccuuauuuuuuuccaaaaacaguuacauccagagguccuggggguuaggauaucaacauaugaauuuggggugaggggacaugauucagcccacaguaaccugcuaggacugcugugaggauuaagcgagaucagggagaugaaagcaccuaguucugggcccaucacauagaagucacucagcucauguugcuuuucugccauaucaaauguaugaaucugaguuuaucuuacuauggucaagaagacuuuguuguccaaacauguuaauuaaucuauuguuaccuaucaaaaucugaccaucugcuaggcuggaagccugccauggucaaguggacccaacccaggaucggucauugauaugguuuggcucuguguccccacccaaauuucaucucaaguuguaauccccacguguugagggagagaccuguaauccccaugugucaagggagggaagugaucggaucaugugggcagucccaugcuguucuugugauagugaaugaauucucucuagagcugaugguuuuaaaguguggcacuuccucguucuugcacucacucuuuucugccaccuugugaagaaguugccugcuucccuuuccaccacgauuguaaguuuucugaggccucuccagccaugugggaacugugaguaaauuuaaccuguuuucuuuaaauuacccugucucggguauuucuuuauagcagugugagaacggauuaagacagucaugaagggaccugagcucaaccccucaucuaccuuuuauuagcugggguacagcaaguaaaccauuauuuugcucucaucaucagcauccuuauuuguaggguaugggugauccuaucuccuuuagcauguuuugaguuauacaaagucuacugugcuuuuaaacuuuuucuuaauuggauuuaaaaacugguaacauguaaaaccucuguaauuuaaacacacacacacacauuaauguuagguauuuggugugauuauuauuaugacuauauauaaugaaugaguacuuaucuuuaagagauaaugaugcauguauaaaugaaauuauuauuaugacuauauauaauaaaugaacacuuaucuuuaagagguaaugaugcauguguaaaugaaaugucugggauuuucuuuaaaauaaccugaaucacauggagaaguggauggggguuuagauaaaacaagauuggccuugaguuguuaauugcugaagcuugaguauucauaucuggggguuaauuauauuuuucucuaccuugguaugugugucuauauauauauguauacauaugaauauauauguauacauauguauacauaugaauauauauguauacauauguauacauaugaauauauauguauacauauguauacauaugaauauauauguauacauauauaugaauauauguauacauauauaugaauauauguguauacauauauaugaauauauguguauacauauauauguauauauguguauauauguauacauauauaugaauauaugaauauauauguguauacauauauaugaauauauauguauacacauauaugaauauauauguauacacauauauauucauauauauguauacacauauauauguauacauauauauauauguaugaaaaucuacauagugaaaacuuaagaaaaaccaaacaaaauguagcauagaaguagaagccuccugucaugguccagccccuuagccccaugucuaagaggugacagcuagcagcagguuguugcauagaagaggaugaaauguuuggcucuguugcaggcucuggcaugcacauguguuuucuuuggcucuuacauucuuugaaaauauuuggaauuaguugucaacauuuauuaaucuuuuaaaagaaccaucucuugguguucuuauaggagguuaucaauuuuauugauuuuuugcuuuuauuguuauuaaacacuuacuuugcauucuuuagguuuauuuauuuuuuuccucccuucaugcacugacaguuacuaggcuuucucuuuuuacaaauaaauucacuaaaggcuauauguuuuccucugugugccccuuuggcugcaucccauaggugucucauuaucauuuguuuguaaauaauuugcaagugaguuuauuuuuuucuuuaauccaaggguuauuugaagcguguguuuuaaaguuauacacaaaacacacaugcauauacacacacuuuugucagcaaaaugauuagguaggagaaugaguuuuggagccagacugcuuguguguuauucugucuuggucauuuacuaauuguaauguaauuacauggacaugcauuucagcuucucugugccuuggcuuuugcaaucuaugaaaugaggaugauaacaacaacaauaaucgaccucaagguuguugagaagauuaaguuaguucuugcauuuugcacauuuaaaauugcuaaugugcauuuuuucauaugucuguuggcugcauaaaugucuucuuucgagaagugucuguucauauccuuugcccacuuuuugauggguuuguuuguuuuuuucuuguaaauuuguuuaaguucuuuguagauucuggauauuagcccuuugucagauggauagauugcaaaaauuuucucccauucuguagguugccuguucgaucugaugauaguuucuuuuacugugcagaagcucuuuaguuuaguuagaugccauuugucuauucuggcuuuuguuuucauugcuuuugguguuuuagucaugaaaucuuugcccaugacuauguccugaaugguauugccuagguuuucuucuaggguuuuuaugguguuaggucuuacauuuaagucuuuaauccaucuugaguuaauuuuuguauaagguguaaggaagggauccaguuucagcuuucuacauauggcuagccaguuuucucaucaauacuggucaucagagaaaugcaaaucaaaaccaugaugagauaccaucucacaccaguuagaauggugaucauuaaaaagucaggaaacaacagaugcuggagaggauguggagaaauaggaacacuuucauacuguuggugggaguguaaauuaguucaaccauuguagaagacaguauggcgaucccucaaggaucuagaacuagaaauaccauuugacccagcaaugccauuacuggguauauacccaaaggguuauaaaucaugcuacuguaaagacauaugcacauguauguuuauuguggcacuauucacaauagcaaagacuuggaaccaacccaaauguccaucaauaauagaauaaauaacgaaaauguagcacauauacaccauggaauacuaugcagccauaaaaaacuaugaguucguguccuuugcagggacauggaugaagauggaaaccaucauucucagcaaacuaucacaaggacagaaaaccaaacaucgcauguucucacucauaggugggaguugaacaaugagaacacauggacacagggaagggaacauuacacacuggggccuguugaggcauugggggcugugggagagauagcguuaggagaaauaccuaauguaaacgacgaguugaugggugcagcaaaccaacauggcacauguauaccuauguaacaaaccugcacguugcgcacauguacccuagaacuuaaaguauaauaauaaaaaauaaaaauaaauaaauaaaaauaaaauagcuaauguguuucaaguguucacuaucuguaaggcauacuuauaaugcauaauuucuguauuuuaaaauuuacaggacuuuuucuuuguagugcaaugauuaauuuuuguugaguuccaugaacauuugaaaagaacauuuauuucuuuuuuuguguauaaaguucuacacaaaccuauuaaaucaaacuuauuuguuauguuacucaaauccuuuucaaagucugaaaacuggugauuccuggcucaaucagcuugcacacauguuggguuuagcacauguaguguuuaaauuaucauuauuuuauuaacuuuuaugccuuaaauggaucaugugcucugucuaguucaccauaguucuuagcaucaucauuucaggucaucucacucauuugcuucagcugccucacucuauaggcauuuugaugugugucucuugcuuuauaaucugacuauaauuauuaucaggucuacuuaauuucugagggagaucccuuagugucucuaccagugcuuggucacuguagcuugucaguuucuccuuguauuucugacaauuuuaguuuuauguuuuuugaagcuaugugguuggaugcauaaagguuuauguuuguuguuauuucuucuuggcagagauaagcuugccuauguaaaacaagcuuuuuaaaauucuguuugauccuuuugccuucuuuuuccccugaucuuauugcuguaccugcuuuuuuaaaauuagcauuuguuauguauauguucauauuuuuagcuuauuuucacccuuuuucuucuaggaaaguuuuugacaugccuuauaacaaaagacauaaaaauaagguauaaaguuagucacaaaauauggguguauacugaccuucauauuggcugugauacagguucacauuuacuuguggcuuccaaggagaaaagacagaaagaaaauaagucaaauguuauaacugcuaucagaaauguauggugcuaaauugcacaaaagaauguacucucaugccuucacugaggguucaccaaguaauguuguguuagugugaggaacaccaaagaggacuacaaugaaauguggcugacuuggaaacaaccagggccauggaguucucagggcaugucugggugggauguccagugagugaugguguggucucuggggacacuguccaggaccaccugggaccugggcuucuuugacuuuuuggcuuugucuuccuuaguguauuggcauuuguacuuggguuuaucacaucucuguuccaggcaggaagaaggagggggcaaaggucagaaggguuaugccaguugagauuguccuucuaacaaacuuuccaggaagccccacucagcaauuuccaccugugccccauaggccaagggugggccacauggccacacuuagacccaucauuggcagaugacugggagaaggagguguggcuccauuucccauaucaugccugccuuaauacuuaggggacauccagucuggucuccuggaaaguaauggaccuucugguggccuguucaguggcccuucacacucugcucacauaccuccugugacagggacagcccucugagcccucagcuguguucagcuaccacguguccuggaugugaccugguaacccguggucaacuccaaccccucgggcagaccuggcuuccccgucugggcuuuagucuccccaugcgugaguaagcccauggacaagguuggcuuugaagucuaguggcuggugauggaaacucucagaccugcugcugaaggcagaggccaccagcugcuucauuuggcaucuggggaugucccaagaguccccuauaaaagaaucagaagaggaggagauggagcugaaauggggaaugcuuuuggcaggagagcaccucagagugagaacagcagaggggaggagggagggagaaggaggaagcugccagcagggguggggcgggugcucuucucucuggcugcuuccuucucugccuggcuuccagggcaccugcucuucacccucgucuggcaggggagaaaucuggagcuggugggucauugcucuuaucuccuugagccuuucguucugggaccagaaucuucccguacaggcagggugucagugcugugacccuuuuccuucuuccuaucagguggacauuugcuguaagcugggaucuugcuuuuuaaaauuuagaagggaauuguagaugcccucuucccuggccccuacugccucugguugaagugccuuaccaccccagucccaggaggccuggacauuggaaaugcucugguuuuuuuccuuugaguuuuguuuuccagcucagucuagauccauucugggcacacagaggagcccucucuaauuuuuggcuuccucuggggaugaccuaagcauuuguuuuuaaagggcgggugugggggggucaccaggcauuaugcaacacugcacuacggcaacgucaccuacucggccuucuccaagcugcaugcauuucugagauggccagggccugugcuuaugugcaucaagcuagccacaggagaucgagucacugcccugcucacaagccauccauggcucccuguggcccacagccugcaauacauugcuuaccauggcccuugaaaucuaagcucuugauuaccccucagcccugucccucucuccaccccgucccucuuuccaccccugucccaugcagacugagucccaggcuagaguggggcaucccuagccacugaagaugucuccucugugcagccuucccaggcaggugagaugucucuccuaugugucccugaaguuccagggcucccgccaguucagcaccugccacccugugucgugcucagcucuuuccaagccagucuuuaucccuugcccccagcaccucucagcagggacucucuucuucaucucccaggggcugaggcccccacccgccugugucuggcacuaagcaggcccuccgagaauguuuguugaaugaacauaggcauggaaaugggacagcuuucacaagagcuauauuuaacuguucuagaauauucucuaggucuuucagaaaagcaaauccuugaaaaacagcagcccacgaaucugaauggcagguguuugugagaagagguggguggucccauucggagggcuucuuucggagccgggcuucucccugcaccccucgugcuccccacucagcccgaggugccugcugaacuugccguucuuccuccaaaucccaggguaccugcagggccuggucugguucccguggugccaccggaagcuuccaugggcugggccacaggaagguaacccuuugugccccaccugggucugggccaucuuuccuggugucucccugagcuccaggcauggcugugacuguccaggccgcauaagaugccgguugguuaaauagcaguguccacgcacugacgucuucuuuccaaguagggugcugaggccagguguccacuauagguugccuggagccccacaccaugaugugagauuggccacugccagccuccccagggagcuggccccagaggccucagagacucuuguuccuuauggcagagggagcagccagcuugcugcccgcugugcugcugugccaccugcagccccucagcacagggugaccuccuaaagccagcgacccuuguuccagcucccaagcacucaggggcaccaggaagucugccgggucaaguucaaaguaaggagauguguggaccucacccaccgggcuccgcccugcucucccagcuucucacuccuuccccuggagcucugggcauggggcucugggcacuggcugcuggugccuugacauggucccugccuccugucucacaccuugacccagguuacuccgucugccggugucuuucacggccacucugcuguuucuucacuuggugaacuucggugggcggugugcucgggagaggagcacagccugaugguucccucccugccucuuucucauugugugaccaugaauggacauagcuuggagccuaguguuuccauauguaaaauggguggaaugaugacugccuucuggagauuuuugugaggcuuacaugggaucacauguggaaggcgcuuggccacauggcacagaaugaaugcacagagggcgauaugauuaguguucucaucugccuguucugugccaugcuagaugcugugcuagaggcuguuggcuccaaggcaaaaagagcagacacgaaagccacaugugugcuugaggagacgguuacaaagcuggagcucuaaguugugggaggagaggggcugauaggaggcuggggugaggcuggagagagccccaggcugcugggcaggaccauggagauugugaggaggaguuuagauuuugcacccuagaccuugggaucagagagagggggcauggcucugcaguuccagaaugcgaccgccuggguuccauccuaguguggccuuuaauaauggguggccccagagaagcuaagcaccuucucugggccccguuuccucuccugccaaguggggauccugagagugucagccucacagggcugagugugcaucagggauuaggagcacgcaggggaagugcccaacgccaugagcacucacucggccaugugggugguggguuugcauggggcaggggcagaucugagaugcugaagccacagaaggccacgucagccuccuccucugaucuccuccauggguaaggauccaucuuccugucccuccuccagcccaggacugugccugagguggcccuccugcuguccaggaucauagccccuccggagguauguaggacccaguuagcccccaagcugcuacuuguaggcccgggauaauggcugugguuccuggggaaggugaaggggcagauccggguggggagguggaaagugagccuccacagcccuggggaaguuuccuuccugaagcugggccccgccugcccccucugccacccccagaagacccagacacgggaacuuguggucccugugccugcugcugcuggccaaggcugaaccugaagcccgcgcuuggcuggcucugggcagaggcgcugccagcuggaagggacgcugccggcccuugcuggccuugggcaucacuccugaguccccguagguaugaggugggagcagguggcgcaagggaagagaccuggucggggugggagccaugguccccagaccaugcacccaggaaggcccaugccugguacacagaguacacucaccucacccaggaugccccaucccuccugagcgacccagcugugacauacuacaaggugcauaugagaaaggcacccaggcugagggaagcaugggcugcaggacagaguggaguuggggguuggggacaccacagccuuggaucacaggaagggcgggugacauaaacacgugcuuauugcugagugaauuggcuuggaccccuguguuuccccagguuucccucucuagcuucuccuuccgugaagguagaaccugggcuucuuugaaaagaccuggguuugaauccugacccucucauacaggcuguguaaccuugggcaagcucuguagccuuucugagcagucuucccauccauccagcaaacaaguugaggacaugcuggcacgugcuaagcucuuggugacuucgacagauuccugcuaagcucccuucagcuuuauccaaggaugugcacacccagaggcccugggcugaaugaucgcuagacuguguugacuucuuguuagaaaaaucugaccagucuggguuucccuuguaacaagaagugggugucagcaggcccggcuggcagggcuccugggggaagucaucgcagaccugggccugugcaguucccacacccccgugcucagggagugccuuucaccugccauuccgcauccugccuucucggcaagaggaggggagagcagaggcaggugccagcugggccugcaccugugcgucagggacacaggcgcucuccgggaacccaccuggcaucacuuccauaggcugucauuggcuggaagugggucacguggccacuccugguauuuuuagcugggcccguuguuguuuuaaauaaaacugggguucucuuagugaggaagaagggaaggggcugaggggacagcccacccugccucugaugcuuacgacuaugaagugggcuguuaaaaaaaacaaagcaaacccuaacuccccaaaacgagacccgcaaaugcaucuuuucagccaguguucuuucagccagggcaggcccaagccucugcacagcugucuggucuugccacuguguagauguaaaagcuggauuuagcugugcccuguggaugaagguugcauuuuucuuacccguuuaaaaccuggggagagaggccauuuacugcuguguugucuguagaccuaggaccuuggucugagaaugggagcccacguggcaucaggggcccagugauggccuucagcccuggccaggugaggucugggggccagaacagcccacccaagcccacaggccuugacccccaaagaggaagguaccuguggaccuuggaacuggcuguggaguuucuaucagcgcuaugaggcugcauccaggacuuucuccagggaugggccugaggcccucggggguguugagagaacauuccagcugcaugaggaucuggcuuccugagccucauccuggaagaacagaagggcccugugaaggccccggagcucagagcaugaguggagacgggccgagcugggugcugaccaagagccagaugcaccuugcccugagcaggaguggggcuuccuaagagccuaggguggacacggggcugugguccuagagggacagugaccucagggcucucacccagaagggagguggguuccugucucagacuggagaagggagcugccugcaagguguacaugucaggaaagacgcuuccacgacauccuggaaucccuucaccucugagagaaggcagccugcaccuugggcagaaucuugauuccagugccuuccaaggaguucguauggcccugagaaaccugagggauuguauggaacacgaguccagucaccuccagggccaagcagggggcagccuuuggcaccagugggugcagaagucugccagcugcaguugagugggccuggaugggcugggucaggcuguggggcugggaugcgagguauuacucugcagccguggggaccuguugggcugggaugugagguauuacucugcagcuguagggacucauugggcugagaugugagguauuacucuguagcuguggggacacauugggcucagaugugaggcauuccucugcagccauggggaccccuugggcugggaugugagguacuacucugcagcuguggggaccuguugggcugggaggugagguauuacucugcagccauggggacacauugggaucagaugugagguauuacucugaagcuguagggacccguugggcugggaugugagguauuacucugcagcugugggaacccacugggcugggacucgagguauuacucugcagcccuggggucuuguugggcugggaugcaugguauuacucugcagcuguggggagucagggaacaccuccuuuauuuuuuuuccuccuuguaagaguguccaauccacuuucucacccucagucaaaugcuuggcauuuagaggaauuguguucucccuuggcccugagcugcugcuugggguuuaaacaaaccagcagcccaggcgagcugggugaugaauacuuuuuggcauuuggggucagacuagccccugggacaaguguuuuggaaagagccccaggcccugggguuggaugagcccaaacagaaguccagcauuguccaguucuccuggcgugacucagugccucugccucaguuuccucaucugugacccaggggugcacacccccacaggugauaggagaagcaucuaacacccagcacaggcacaggugcagccgcuacaccaccugcugugcccagcaucaaccuuuaauugguggccacaggggguaggguccccugcggccaccaacuaaaggcagguccagaaacaugauguggggcugccuuugggggaggugcaugcauucugcagccuacuggccagcccggguuuucauccugucuuugcaaccuaccagcugugagacuguggacaagugauucaccaucuuuuuguuuuguuuugucugucuguuuguuuguuuguuuguuuuuugagacagucucacucugucacccaggcuggaguguaguggcacaaucuuagcccacugcaaccuccaccuccuggguucaaaugauucucgugccucagccucccaaauagcugggauuacaggcaugcaccaccacacucagcuaauuuuuuuguauuuuuaauagagacggguuucacuauguuggccaggcuggucuugagcuccuggccucaugugauccaccugccuugaccuuccaaagugcugggauuacaggugugagccaccgugcucggccaugauucacguauuuugugccuccgugucgugaaggucaaagugagcaaauauuugagaagagcuuagaauggugccuggcaugugacuuacacauagggagugccuccucucagaaucaggggcaggcugggucuagaaggcccuuugaggacaaacuucucauuuuccagguagcccuauucugagacauccugguguguucaucaggcaacauuuaugagugccugcacuguaccagccccagcugggaaacagaaauaaguaacucacaaguuguaguucuguccucaaagagcccacagaccagagcaggagacaacaaguagccagcuaaugauggcccagaagaccaagggcuagaaguggguugggggaauccaccacuggacacuucauuguugggagaagagggaaggauguauagauauguagcaguagucagcacaggcuaacugcuguaacaaacugcccucacuucucaguggcuuaacacaauacaaauuuauuuggcuuucacauuaaugcaggucagaguugaggcucugcuccacuuggucauucagggccccaggcuccuuccaucuuguggcccugcccuucucuagggcuuuggcauucuuucauucaacuagccaauagaaaaggagagcccaugggcagcuaugggacauuucucaugccucaggccuguaaaagcaguguauuauuucugcccacauuccauuggccagcacuuggucacaugauccuaccuaagugcaaaggagucugggaaauguaguuuaucugugugcccaagaggaaauugcaccagguuuaugagguuuggugaacaccaacagguucugucacaggaggcuucuaggagaccuuaagguugacuuggguugugaaaaaugaaugggaagugagggugggggacacauaagcucucuaagcucucuaggcggggggucagcuugggcaaagcaaggacugagagugucuuauuucgggcugcuauaacaagaugucacaggcuggggagcucagaaacaacagcauuugauuucucaugguucuggaggcuggaaagcugagaucaggguggcagcuuggcuggguucuggugggggcccucuuucgguuacagauggcugacuucuccuguguccucaugugguggagaaagagugagcuggcuuucuggggucuguccuuauaagggcacuaaucccuuucuugagggcucuacccccaggaccuaauugccuccuaccagccccaccuaaugcugucacauugggauuaaaauuuuaacauauggauuuuaggggacacacugaguccacugcagagcguggaauacguuuugggaaggacaagaugcccaggcaguggggcagguggaagggugagcaaagaggugcugggaugucuccccuccuccccucccacccuuuucaugcggccccaugucccgaauguugccaggucaggcacugccuggaguagggccugcuguggaccuuauuacgucauuugcuccuccaccgcugcuccuuuugggguugguggauaaccgaggcuugggaagagaaaguaauuuuccuguagcucacucagccaaaaaguagagagccaggauugaauccauuguggcugacucuaaggccagugcuauuucugggggugacagcagacacucggaacugugucucuugucagugaggcuaagagggguagggagaggggauccagaguggggaaggcuucggggggaggaagagccaugucccuggggugccaggccaggggaacuuggccucuagguguggcuuucagggaagugcuugcugggugugggccucgcaggccccaccccgggcugagucccugucuugcugcuaggccccagggucacuggggugcuuggcuuuagugacugacagccugggcccugucacagcaccaguggcucucacaaacguguaggcagcacggaagaggggagagaccgucuggccccgugaggcacugcagaggcaugagggcagaacugggggcugggguccugaggucuuggguuggagucccggcuccucccuuuugcuguguggccuaggcaugagggagccccaggcuccugagcugugaaauuggagaaccgggucccugccccucacagagguugcaggagacacaggcuguaggagacacuggggcccucccaccuggcccuggcccccuauacucaucagcucaggcugcccucggagcggcucagacaacagauguugacuucucacagaguagaggcuggaagccugagagcagagugcuggcagggcccgguucuggggagccagcuuccggcuguacaugcagcccuccugcuguauccucgcauggcagacagcggaaagaggagaggucaucgccuuccucuucuaugagggcccucagcccaucacagggccccaccuucaugaccucaucuaagccugaucacccccaaaggccccaccuccaaguaccauccuguuagggguuagggcuucaacauaagaacucuggggggaugcaaaccuucauuccacaauacaccccacguggguuggcuguuggaaacaagccugggguuccugucgcccuggcacacugcaggggguuagagccaggaggaagggaagggcucaggcagaggggaauagcacaaggccagggcgguggggcaggggcggggcugccguggcuggagccgucagcucugguuccaggaggaggagagguccccgaaucuggccuugggggagccagggagcaggugggaugcuggcucagcaugauccugggaugaaaacuuuccucucugcagggguggggaggggcugguauccaagagcacccugaggggccccaccccacuccugacugcagcagaagagggcccaucaucucuuugguggcauuuuuacaaacugcaaaggggcuuaacccacuaucccaaauguguagagcugacauuuugcucacauuuucuuucucuuugcagucuguuugccggcugugcagcccuggaaagcccuugaagcucuccuaacccugcugucccuaucuguaaaaugggccagugguguuuuaccagccacacugucagggaugcuaagugaggugacaccugucaaggggacgggugggcugcacgcauccccacugcucaccagcucccagccagugccgcuaagcugccccucacaauuccuggcauaggccuggcaaggcuuuugacuuuuucauuuuuguagcggcuuuauugagauuucguucacauagcauacaauccccuaauuuaaacucugcaacucaaugguauugagcauuuucacagauaugcgcagccaucuccacagucgauuuuagaaccuuuuauucaccugaaaaagaaaaccugugcccuguagccaucacccccggcccuccauuccccccaggccuaugccaccacuaaccuacuuucugucucuaucacacaagguuuugagcccaguuccgcugggcacucauuugucaacuaagggggcaauuagcuccccagauccaaggauugaggaccuucuugccucucguucuccuugcccgaaucccguucugcacgugguagguggguugagccucugguuauucauuuauuuguuccucucgccuucuuguccuuccccaccacuggcugcuccccaacaugagccugcccucucccgccuggcgcagugccuucugcacugugaugccagggaagauccgggcaggguggaacccacgcaggugccccggggcuugggaccccuucugccuguggcccuuccccgcccgcacacccuaggauguaagugacccccaaacacuccacuccucaagcuccuucccaugcggcuccugucucuggagaggaaacaggacuggagacccaguucuuggccccaagccugcuguagacagagaggcucccccacgggggcugugucuggacagggugggccgacccugucccacaaccaugucccucugcuacaggcuccccugggggcagccucaggcgaggggccguugccaugggaauuguguauuggagucuauuuugagaccaucuuguagugugauuuuuaauauggccugguguuggcuguugguuuuucuacauuugcccaagugaauggauuuugacugaccagaaggguugagcugauuuugucuucagaugugguguuacccagaacauugucugagcaguuaauuacagguuacaggggccccagagcacccucuuaaagacugggcuuagccugccaccacgaaguguggaugggaggcaacuagacacaguccaaggaaggaaucguugugccagccccgaggcccuccccugguccugcuccugccucugggcagcuggaugaagucaggugggugguguguguccuguccuagagaggaggaacccagaaagccaccuccaagcugcagggaguuaagcgagggauuggagugaggaaccuggucucgagccuuggugagccccugccgugaguggcugcuggggucagucccaccugcccggccugaggaaggaucucacccccgcccuuguucuccuagccucaagccgaugcugcaucauguucaucagggcgggaacugcgaguguguuaacauuuucacaucugccucucccacugcacugcagaccccaugaggacaggugggggccgguggugcuccugccacgcucaggggagccuugaauaaauacuuaugaauagaagaauuggccgggugcgguggcucacaccuguaaucccagcacuuugggaggcugaggcagguggaucacuugaggucaggaguucaagaccagcucggccaacauggugaaacugaaaauacaaaaaaauucuguugaaaauacaaaaaacaauuacauucuacugaaaauacaaaaaaauuagccagcuguggugaacacgugccuauaaccccagcuacuugggaggcugaggcaggauaaucgcuuaucgcuugaacccugaaggcagagguugcagugagcugagauugugcuacugcacucuagccugggcaacggagcaagacuccaucuaaaaaaaaaaaaaaaaaagaaacuaaaaaaagaagaaugaacgccagcaaguggccuugggcacgggcucaaugcuggccacgcagggacucauccucccgccucuugcuggugggaguucauggcuuaggcgucucucaccuccucugggcuggcuuuugguuccuuccacugcgaacacaguacaaagaagugaggauauuggcccaagaguuccagaaggguguccccuaggagggugcaucagugagugaugggggcugagccaggaaagaaagggggaugugcccgcugccacagaagcccucugcccuucaggcugggcagccagaagcccaggccuccucugcacaugagcuucuaggagcagaagggccagugacacuugacagaccugugguugcuauugugguuacgcuuccuucugguuacugauaauugcuaucagaauagagguggucccaggaaggagcgagggaaggaagcccauaggaggaguaggauguagaacagagcgagguucuccgcauggcuuggggguggcaauaguggaggggaugccacugcaggugcgcgucacaggccagcuuggggcccugucccugcccugugaugagaaugucuccgggguggucaucaaauccuagagcugcagaagaugcugcuggggaggcgggccacccacguuugaccuaccacauuguuuuuaacguuaaaaaacaaaaucauuuuaaucacaucaauaauacauaauuauuguaagaaauauaagaaaauacagaugaguuaaaaaagaucugaucuccugcccuccaaaaucaauggcucugagacucaggauguuguugguccauauucuuccuuuucaaauauauuugucuuuugguaccugggggagaauggauccucuccgaaacccaaauugauggauguucaagucccugauauaaaauggugcgguauuugcacauaacccagguacauccuucuguauacuuuaaaucaucuccagauuacuuccaauaccuaacacaaugcacaggcagggcuuguuuuauugcuuuucacuuuauuguacuuuauagauacugcuuuuuuuauuuuuauuuuuuuaacaaauugaggguuuguggcaccccgugucaucaagcccacuggugucauuuguuuccaagagcaugugcucacuuugggucucugcgucucauuuugguaaugcucacacuauuucaaacuuuuucauuauuuauuaaauccguuauggugaucaaugaucuuuggcguuacuauuguaauugucugggggcaccaggaaccacaucuguacaagagggcacacuuaauugauaaauguuguguguucugacugcuccacccaccagccauucccccuaauucuacucugccugugcucuacaagugguacaacaaagccuggauggcagccuguuuacaucauggcuuacugaauauuuuaagcccaauauugagaccuacugcucagaaaaagagauuccuuucaaaauaugacugcucauugacaaugcaccugucacccaagagcacugauggagauguacaaagagauuaaugagguuuucaugccugcuaacacaacauccuuucugcagcccauggauuaaggagucauuuagacuuucaaguauuauuauuuaagaaacacauuuuguaaugccauaguugacauagacagauuucugugauggaucucggcaaaguaaauagaaaaccuuuuagaaggaauauaccauuccauaugacaguaaaaacauuugugauucguagaaggaggucaaaauaucaacaugaacaggaguuugaaagaaguugauuccaacccuuugagggguucaagacuucaguugaggaaguaaccacagaugugguggaaauagcaagagaacuagaauuagaaguggagccugaagaugugacugaauugcugcaaucucaugaucaaacuaauggaugaggaguuccuucuuauggaugagugaagacagugguuucuugagauggaaucuucuccuggugaagaugcuaugcacauuguuuaaaugacaacaagggauuuagaauauuccauacacuuaauugaugaaguagcagcaggguuugagaggacugacuccaguuucugcaguccuaguccguggaaauugcuaucaaacagcaucgcauacuccagagaaaucuuuggugaaaggaagagucaaucugugcagcaaacuucauuguugucucauuuuaagaaacugcaacagccaccccagccuuuagcaaccaccacccuaaucaaucagcagccauucacaugaagacaagacuuuucaccagcaaaagaauuauaacuugcucaaggcucagaugaucauuagcauuuuuuuuuuuagcaguagaguacuuuuaauugagguauguauauuguuucauuuuagacacaauacgauugcauacuuaauagacaacaguauaguguaaauagaacuuuuggaugcacugagaaaucaaaaaauguguguggcuugcuuuauugcuauugcuuuguuguggugucuuagaccgaaacugcauugucuccgagguauggagaauagaugugagcuggaaaagaaagcagcugaacgugacaagguugagccucagauuaaagagaaaugacaugugcagcccuuccucagagauacucaggcucaguucaagaucaccacgagaaagugaagauugcaauaaagggagucacacaaauguguuuguuucccagugcauguaagaguuccauuuacacgacgggcgcgguggcucacgccuguaaucccagcacuuugggaggccaagaugggcagaucaccugaggucgggaguucgacaccagccuggccaacauggugaaacccugucuuuauuaaaaauacaaaaauuagcuggacgugguggcgcacaccuguaaucccagcuacuugggaggcugaggcaggauaaucgcuugaaccugggaggcagagguugcagugagccaagaucgugccauugcacucuaaccugggcaacaagagcgaaacuccaucucaaaaaaaaaaaaaaaaguauuguuuacacuauacuacagucuguuaagugugcaguaccauugugucuaaaaauacaguguacauaccuuaauuuuuuuuaauuuuuauuuuaaguucaaggguacauguccagauuuguuauauagguaaacccaugucauggggguuuguuguacagaucacuucaucauccaaguauuaagccaugaguuaauuuuuuugcuccucucccuccucucucacccuccacccuccaaaacauuccucagcaaaugcaaaagaacugaacucauaaccacauaccuuaauugaaaaauacuuuauugcuaaaaaaugcugacacacagacaugaagugagcacaugauguuggaaaaauggugccaauagacuugcuugcugcaggguugccacaaacucaauugguaagaaacacaguaucugcaaaguguaguaaagcaaggaaugguaaaaggagguguggcuuuggagugaugcggaugugcagcacugugcauggcccaacuaugcaauggaaucuuuuuuuuuuuuuuuauuaagacggagucuugcucugucgcccaggcuggagugcaguggcacgaucucagcucacugcaagcucugccucccgugcaauggaaucuuaaucagccauuaggaauuguucuccuauguuggagguguagguuauuucauuuuuugccguuauaaggaauguugugaggaccauuuuuuuuucugagauggaguaucacccuguugcccagguuggagugcgguggcacgaucuuggcucacugcagccuccgccucccaggaucaggugauucuccugccucagucucccgaguagcugggauuacaggcaugcaccaccaugcccggcuaauuuuuguguuuuuaguagaggugggguuucaccguguuggccaggcuggucuugaacuucugaccucgugaucugcccaccucggccucccaaagugcuaggauugcaagcaugagccacugcgcccggcuguggggaccguuuuuaugcacauucauuugcacacuuguccaauuuucuccuuaggauaaaucccuagaagugcaauggcagggucacaaacaccugcuacaagcccauucaguuccaucuugauggaagaggccuuuagggacugaacugccugggcggcaaggauggagcuaaggccagcaggcgaccuggagugcauccccuguggggacuggucugauaggugggggaaucagggccagaaucccagcccacucgggcgcuucugagauggugugugccuugggccacuuuguguccugggcaugcagaucugcaucauagcaauguuccccuugggcugucuggucugcaccaagcccugugggagcccugugagagcuggacaggguggacgggcaggccucaccugggcauggcuacagaggcagccguggcaaugcugccauaggggacaggcauugcaggaggaauggcaccauugcugaagggugaaacucagcccucugggccagggcaaagccaagggccucagugcccagcuugggucuuaccuugaagggggcaggugccuuaaggcugaaaaaauggaugaggaaaauguuaagcagaaagaaaugacaaaaaucaagccagauguugguaaagagcuggugaugugccaacuagcggauacagcuagacauggaucuagagcuuuccaugcagccaagcaccuucuccguucagccggcagggauuugagcaccugcuguaugcacagugcugggcuccgcagccugggcucagaagccuggccucagcaauguuguggcggcugcaagugcagagcugagccuagguucaaguccugaccaugcugcucaguggccugugagcuuuuggugacugauggauccucuuugccucaguuuccuccuccauaaaaauggggaugaccacaguguucugagcacuuuagagagugccaccggacggccgacucauuuaaacccgagaggcuccugcuagguauuuauauuagcacuuaauagacagaaagcaccucacacagcacugacauagcgccgugcuuaguacaugguaaugggauugcauauugucuuacccacccuacacaauaggaugacuuccauucuacagauggggaaagcaaggcucaggaguguuaggaacuugccucuugucaccuggccagugcacuggaaagccaggcuuugcagcugucucccuagcagguauuuacugugacuccccucucaguucucuccugcuuagaacagggaccuaauugccacagggcccauggcuggugaccagguagcugggaucaaaucccagaugggacccaaguucuucccuuacaagacacagcucccggggugcuuggcuugcuuuaggagcacucacuacuucccaggugcugugugacagaguugugcuguguggcggguguugaugcauuuaacccucuugaggugguucuagggcugagcuucucaggcucggccacacugacgccauuugugggccagcagugccagcuucaccuggcagcgggguggaugguggaggcucagcccugccagaccuaccguguuggaaguugcauucugacaagaccccagggcacuguguacacauucaaguuugagaagggcuggucuggacagcaggcuguggggugaucugauggcagcccuuugugcacggccaccucauuuuacagaguuagcugucaggagcaggguggguggugaaggagcuaagguccacagaacaccugugaagcucuuccggcaggugggcacagagccagggcaagguaggcaccuaacaguuggcagaauagugucuucuccuucagccccacaaagaugucugcaaaucuguggauguuaccuuccauagcaagggggaauuaagguugcagauggaguucagauugcugaucaccugagcuuaagaaagggcgagguuccuggaucaauccaggugggcccaaugugauaucagcgucuuuauaagagggaggcaggaggguagagucaggagaguucugaugauugaagcagaggucggaggggugugaugugaggacuacagcccugcuuugaagacaggggaaggggccaucuaugagccaugcagugcagaagcaucuaaaaccuggaaaaagcagggagugaccucucccggauggcccucagaagguaggcagcccugcgaccccuugauuuuuagcuucaugaggcccauugcaacuucuaaccucuugaacugcaagagaaaauguguuguuuuaagccaccgaguucauggcaauuugugacggcagccucagaaaacuaaaacgugcaguagcaauggcuguguggccgccugggccugguuaccuuguguagaauuauacuggugcuggggccugcugugcuuguuguaggaaggagacaucccccccagaucccucagguuugauuuuuuuuuuuauugcugggggaggguuaucuuucccucccuucugcaaaagccacacgguggccccacccagcccgugcuccaggaaugaagccagagggagccucugcaauggcuggaggagcuggcucuugggaaccagaaguuccagugacugaggacucuggccaaggagaacugggcaagacccuggagggccaugacaccaggcugggauguggucacacgccuuacggcucccagccugaccaggcuggacuugcugguggucaggauaugacuguagaguggagggcggggucugugcccugucugugguuggcaccugacaaaggugacggcaguuucuggcugccagcuccugguggcuaagcgucuucuggauucucaauucggugaaacuagguuuguuggggggcuugaguuugggggagcauauuuagcuaauaagggaagcuggacauagcuugaaaugcagccagcuugcagugauauguuaaggccuagaggcuguguaggggaggggaggcgggcucuggagggcuuugccuggcugggaaggcugggugggcuagggcgggagacagagcagcucccuggaccagcaggauucaugcugaagaguggaaccagcaggguuugcucucaaggagauucaggggagggaaaggacugcagagaagucuuugaacacaacauacccaucuugcaggugaggagacgaaggaccugaaagaggacagacuugaccaaggucacauaaugucagacaucacagcccugguucugccccucccggucagucuguccugucuggguucaaaucuuagcuguggcuggguucaaaucuuaguguauggccuugggcaggcggcuugaucggucccugcucccguuuccuccucuguaggauagccgcaagcccucgcagcguucuccagagcauucagggacuuggcacagagugucaggccccgauguguuauuucgcaauuucuucucguuuccuugacugacuucacgcuuccuguauaagagcuuguuccacuuauccguggcuacauaacaaacaucuccaucucaguggugcaaagcgacagcaaucguuugcuaauguugucucucucauuucuggggacuggcugggcucaggcaggcagugcuuccucgaggucucucaggcgguugcagcgacacugaguuaaggcuggaauuggcacaaaagcaccuucucucucucuaucucucucucuaacacacacacacacacacacacacacacacacacgugcgcacgcgcgucuguuccuggggggaaaacgugaaugccuggguuucccucugucucuguggucucucugcagaguggcuucagaguagcuggacuccugcacagguguguccucagggugaacgagcaggugggaagcaaugcugucaucaccaagugucacucucgccucacugucuuucgcgccagggauugaggcuaaggugguggugugugagggucuagauggggcccagaggaggugcucuguguugaugggggcgccgagagcaugugaccaccuguagucccccaagagcggaugggaggaacacguuugcuguguuggccucgcgcugaccugucuuccuuuugucuucagaccuggaugcucccaggcuuugaugcuggguggccugggaggauucacugggacccugugugugugcacgugugugugcauguguauguggggcgugugcacaugugugcaugaggaagcuucagcccauuucagcagaggcucugggugggucucuuccucuucagaccugcacagucccuccuuuccucccagggaguguguugugucugggagaugccauggacucugaggggcuuagaacagcacuggggcacuuuguggggcuggaggggugcugcccuggugugaagagcugggggugaaggcaggggugcucccuuuuacuaagccccugcacacuaaggcgcaucuacccucugcagcgucaggaagcuccuagccugagaucuguccuccagccccccccccuucccccaccccuccccuuccucccuucuccccuuucccugaccccccuccccugucccccgcaccucacuaggagggccagacugugucuccuugauucucugcuaaauccucugggcuggcacagugucuguucagggugggugcucaugaaauauggaguuggguugaaaauggcuguggcugcccacccuggcuagacccucccucaaggccaggagcagcuggaagagcagggggugggguauggcugacugaggccuuaaccuggcagccuaggccuguccaguccaggccagcagaaggggccaagccuggaccugguaggaccuggugcauggggucaggccagcggcuggugguggcacagaacuugagccuccuuuuuugcaugucccugucuuaugaauacagcugccacuagagagcagggucgaugccauguacagcucagcauaaagaacucacccagucccccuucgccucacacugcccuggccaccugcguguccccucgucccccauccuggccacacccagccccuagcaagccaggccuuuggcccaucugagucccugcuguggcuucacuugcagagcccugggcaggaaggaccccagccucccagcucaccccauagccugcuccugccaucucugccugcaguagagugggauguggggccucaggaggauggggaggcccagaggcccacagggaauggggcggcuacaggauccuccccaaguggugggggagaggugggccccugaccacagucaggcuaggcaggcgcuggggaaguucagugaaggucagccuggccuugagucugccucugucccaccagcaccauccugaccugagccccucucgacacaccuugguccccaagccaccacuugaggauccacuguggacuguggaccagcagccagcagucccuccccacaggaacaggaggcuggcccucacagagaaaggggagugagccucuauucaccuccuggggcuaggccucaccacaucccacccaggugggucaaaugguccccuuugcagcccagaaauggacguccucagaggucugggagcuuggucccaaagugacacagccugcacuuccugugugucaggcuccaaagccaggccuuugcccuggaauuguagacaccagucccuguuggccucuccugggaccuccuuugaaacucaaaguucccuggagcugggccgucagccugggcuggugcugggggcuggaugauggggcgcucaggauaccucgccccaggugauucuuaucacugggaagcugaggccccagaggggagggcauacccuuccugugggcucugcuugcuucccagggcugugacgagggcaagccuggcaggggacacccacgacccuaccuuguguacuuuuggccauuucuauacagcugggaugggaagagcccugagacauggccagcaucggcuaccugaaggugcugggggucugagccugcagccccugcccugaucaccuggaaaauggaaaugucccaaagcgcugaguugggguggggggauccccacacugggauguaagcucuguguggguggagacugggauguggggcauauggugugucacacagcaagaggcacauggcccaacucagcgucuucaguaugucuaagacugggucagcaugggguagaagcucucuaccuugucugcgugaucggaccccacugcagugacuuuggccugggaguggcuggagagcugaugcccugauguccagccccgcuggguuugaggccuggcuuugucacuuucucaagggggccucaggaaaguuauuuugaguugggcauuuucacugcuuuucugucaaagauguacagaggugcuggugccugucacaagcuggggguugaggaugcucccauggccagaggacaggggaaauaagggcuuucaaaguggaagcaacuggguccucuaccagcuagcucuuaggccuccuuaggcaggugaugugaccucucugagcuuuaauuuucccaucuggaaaaugggaaugguugcaagacauaucuucucaaaacaaccuguccaggaggggcugucuccugggcuaaguccuuuaaugacagccaguaugcauuauuguuaaucaauaaaugcuuauugacucaaugaaaaacacaucuaugucaguuuuauccagauuuauuuuuuuuauuuuuauuuuuuuaaagacagggugucccucugucgcccaggcuggauugcaguggugcaaucuuggcucacugcaaccucugccuccuggauucaagugauucuccugccucagccucuugaguagcugggauuauaggcgugcaccaccacugcccggcuaauauauauauauauauauauauuuuuuuuuagcagagacggguuucacgacauuggucaggcuggucucaaacucccaaccucaggugaucugcccgccucagccucccaaagugcugggacuacaggcgugagccaccacacugggccuauccuauuuuuaaugcaucguauggaggagccaggggccugucgccagucuucaucgcgggcuguuauacaggcuuuugcuaccugugaaggggugcucuaagugcuuuuuaggggcucuaccauuuaauauaauaauauuccagagagguugaggcucaacguguaccuucugaaaugugcccgaggucacagaaaaauaagcaaacaaauacaauaguucugaccagcaauuuuacugaauaggcaacacaucuacaucguucuucugugaagacagaauaugaaggugcuccuuaagacucccaccccacucuguucuuuccaucccaucuccaucccucccacuuuuuccuguuaucacaaauaggggauuguuuuaaaaaucaauauauuguuucugguauacacacaaauauauauuaucuuaucuccccuuucuugcacaaaaggcaguauacuugaucauuguucugucucuugcuuuaucucguaagaauaggccgggugcaguggcucacgcccguauucccagcacuuugggaggccaaggcaggcggaucaugaagucagaucgagaccauccugguuaacauggugaaaccccaucucuacuaaaaauaccaaaaaaaaaaaaaaaaaaauuagcugggcaugguggugggcuccuguagucccagcuacucggguggcugaggcaagagaacggcgugaaccugggggguggagcuugcagugagccgagauugugccauugcacuccagccugggugacagagcgagacuccgucucaacaacaacaacaaaaauaaaauccucgagaucuuuccacaccaauacagggguaggguccaagccagagagaggccaggggucuaacaccugcugcuggaggauagggggagaggaguauucucuauuuuuaaucaaugugucugaggcaaaggacaaagacaagaggggaaacucagccugaacccucaguccuaggcaugagcuuuguuucaaauauuugaaggcagcucuuguagugcauagggaaagccuugggucaggucucagggggucaggacuccagccuggagccaccccuagcaagugagggaccuuuagcaagucccugacagcggccaagagucagggucguauccacgcagguguuuaggucccagagcgguuucuugccuaugaauucauuugacucucacaaagccccgaagacucagcggcuugauacaugcuguuucuuccuccuagaaugccuuucuggcuaacuugucuucccccaaaacuugaauuuuugcuucacacucaccucuaaucacagaccuucugggagcuuuccugggcugccccuuccacaacugccucagcaaaccuuaguccuucccguguacccucauccacagcaguggucagcaccucggacagugccugaggcagguggacucuggaguagaggccagguccaagggcaguggcagacucaggacaugggcagggaacagcccagaaggagagccaccucgcuuccuggacacuggcccugcacuuggaggcagugugaccguggggaaguccaggccucucagcugcaaagcuggggcucuggagucugccaguuucacagagcuagucccugaggacacaucugguuugugagaauagcauccaggacccaguucuuguuucuugguggguguggcugaauuccagaaggcagggguugugcucuccccuccgugguaucuuuuguacaguggagguagugaggcuuggauugagggggagcugcggaaaaggaaaaggguaccaguggcuaggggcuugcugggcagcagggaagucaggcgugacccguguagccugaggcccgcaucugguuuccuuguguucagcaacauugugggguguucuggaggaaagagcugggggcuggccuccagguggguccagccauggggcuuugggaugggugugccuucccugcucagcuuuuccagcagugguuguccccccaugacuuacagcauccacuagguggucccugccccuggcugcagugcucacugggcuccucucagcccuucaggccugugggugguaauagcugcccccugcuagccccuugugucuuacugcccuacuuggugcccucaaccucuccuugccucugcaaacucucucuucauugaagacaagggucuuugcccugauuugauccaucugaguggaugccaugaccuguuucaugccaugacccugaccugauacaaccaaggacuugagauuuuauucuaaacccaacaggaaaccauagcccauuguccauauaucugcccacccuaccaugucaucuccucugccuguccugugggggagaccugcuguuggacagggagaauccugggagcaggggccagccauguucucugccuggaugggggugauguggguggggaccgcugggauagaggcgaguccuggagaggccuccccacccgccagggugauaacgucccuccucugugaggagacaggaaguuaauucaugcaaagcuuuuaugaauaaaauggggccuuguuaguagugaccaugcggugcagcuuagcaaugaucuccauucugcauauggggaaagggagugucccagucaacgcccuaugcucagauccauccaucccccacuucugcaguguauggugggaagcucaguuucccaggcgcuauugcucucuggcucugggggguuuuggcucugggggguuuuaguucagggagccagugccggaagcucacagggcaggaugaugagaagcuccacaggcagagaggguucacuguggugucccuggcagcugccacagguccuccccggcuccugcucuggccgggagaccugauccugaccugccuucucccacugccuaaggguggaagcagcuuccugugcucuccucaucaccucugugacuaauguucuggauugaauucccucuguucuaaauucucucaagugguggugguuuucuagccagacccaugagaaguuaagcucagagagguucagcaacccacccaagggcacacagcuaguuaggggcaccagaaugcuugagugcaauccuggcucaagcuagcaccugccuucccaccauucucacuuccccaagagagacaaguggaggcuuccugagggcagcaagcuuggagcugagccucaaaagaagaguuggauucagccagguggaccaggcaggagacagggugguuccuguuggaggacauagcaccugcaaagguguggagggggcaaaugguggguuuggaauggguacugaggccaaggggcugcaggggggugaggcugcacuggggagggcugagccugcaagggagagccccaucuugggagggugagcagggccugggcaggaucugauuuguguuggagaagaugguucugguuguggaugguguggccuauggggccaagaguggcuccagggaggcccugagaggcuguggccucuguccgggugagagaucacgguggccugggcuaggcuucugcauggaaacuaggagaaacugcaggucuaggagacaaccauggucauugaagaagcauuugugguauagauagggcacugugugggguugagcuccuccaaaauuuggcauaaagaagaaaaucaucagucauuuccagggaagcaguuagggaagguuggggugaauggauggcuucccggggcaggugucaucugacaagcuucagcauucccagcugcucacucaucugucugcaccuggcggguccugucugcagauugugagggagaggcaagcgcgcccaggacaguggggaagggcacuccaggccgagggagcggcguggggaagacccagaggugguaagagcuugcugcaucuggacagcaggggcguccgagagcacaggaccucaggugcaugugggcuggaggggccaaagaguuaguggcccaggcugagccccagcuggaugggcucucugcucgggcugcuccuggcuuuuuauauuuuuuucuuccuaguacuccugaagaccaagcugcuugcagggagggccugacagcugccacuuggaucugggcacuaggugggguauauuuaccugcaccugggggcaucagccuguaccccaaccuggcucauacauaccuccuuugcugugcccaugaggaggggugacacagagggaguacugaauuguuugaaugucccggagcuucauggcugaguguagauuagagggccgcccugcuugccucuagccucugucugauuuaaacuuuaccugaucccugcaggggcagagcucuucuucccauuaugcagaggaggaagcugaggcuugggggccuccagggacauucccaaggcuccacagcaucgcucugucucccccucgcuguaggcagaaguucucucuugaauccugucuucucccccaggaaaccuucccugaugaucuagggguguccaccauguccacuuucuuccuccggcucugauuggcagagccccugaguggggagagcccaggggugugggaggagcccaguuuggaguuggccacaucugcuuagagucagacaugugcgaccuuaagggguuacugcccuucucugaaccucaguuuacucagcugagaaauagggauuucucacaggguggcugugggacuugucccccauucagagcuggguaucgcucagcuuccugccucccuccugggauggugcugcugcccuugguguucuuucaccuggaccugaugggggucacagccucccaugccccuuccucccccagccccaccucagcgcuccagaaaaucugccuagucagguuugaaugggagagagccagccagccagcaugucuggguggcgagaaaggcuauuuugggaacaagccggggaaggaguguuuuguuuuguuugcuccucgugauuacaagagguggcagaguccugcuccugcucuugggcaccgagugaggucugggugagggcuggggagggaaggagggaugcacuucucugagauggacugucaggcuucuugacaacccgaggccacaggggucugcagccugaccccauucccucgucacugucagcuuggucccaagcaguaucugagggaggggagugggggcgaggagccuggagaaaccaggccauuuggaucucgacaccagacuuuuaucucuagcucugccaccugccccagcgcccgccccccgccauccaucucuguccacuggaacugucucuuuagcugaccaucuauccauggugcauuuguccguccgucacccaucuuuccauucacugcccccucugcagccauccucucgcccauuuauccgcccacucucucuagccgccugccucugcacccacccagccauccucuggccccagcggcccacugcagcugaugccacaggggcucugugcaucuugagcuaggccccgggguagcauggugaacaagccgcugaucugccuucccccacccagaggcuaugaguaagcaaccaguguggcauguaaugcgugucuucguggaucuuacaguauccucaggugccuggaaggauuagcacagggaacugcauagggacccacgugaaaggcuccuggagaaggugacaguucagcuguggccugagggcuaccgcagaaucugccugucgccuaccugagggaagagccuggcagggggcuuugagguggggagaagucuguugucugguuguggggaucauccaggaagccagagggucuggagcucaggaaggggguggggaugggucagacaacaccagggccugagcgggcagggcaucugcucauuggcugugguccuugggaggccuggcagggucuggccgcgcuccgaggccagcguccuguucagcagcucugcucucugaccaggcagagccauccccagaugaagggggcugaacgcugcaggucaccagggcacccagcgaucuggcagcuuguguuuuccauguaaguauuaaaaaugcuccccagagccuucgcuggauauacaggcagaaaauucagacaaacuucagcuauuccucagugauucuuagucuuauuuacaguuuucuuuuuccuuaaauaacagcaucguccuuuuccuaacuggaaagcucuguuccuggggcaauugacuugacaaggcccuaggcaggggauggggucagaguccaggccgaacacccacuuguguggcccaugagccacggacuugcccauccugggccucuacuuccccuggguggaagaaaugaacacgggccuuagcuccggccccuucugcucugaggcucugggguuuagggacuuggaauuggugaggucccuggcuaccccaagcaaaauuccugggaggguguugcccgagagcugagcuggcuggugggaggagugagcuccgcgugggccucuggacaguguggaagauggauuuuuucuugagcugauaaugccgccucguguuuguagagcgauuuauggguuuugaaagcacuuucccuuguguugucugauuugcguuugaguaucuauuaaacaaguguuugcauauagcaggcagugggaaccagcuccaggcccuuggggugagggaagggguggggcuggaccugcuccccuacagggcucacauucccaugaagcaucucagccacacuccagagcuguuggagagaacaagaggaaaggcggcggggguggugggggaggucucuguugggggaguccugagugcagaccacuggaaugauggacccagaaauugggcagaggcucacuugcagggggcuggggagggacuagaucaggcaggcacuccagguaggggaccucaauuuugcuuaggcuuaagcaaauaugucacaaagaaauuuuagguacuguuuugauuauguuaugauaaagccaaguguguguaaauauauucauaacauuuucuauuccuggccauauaucuguggcaucuuaugauaaaauucauuuaaaaagagggcucucggccauuuggaauuucagucuggaaccagaggcugacagggcugguggcauccgugaugcuucuucagccucacaguaaagccccugagcagcuggacugggcuuggugcugcacccugucaaauccacagccuggcagcauuugaggagugcuggggcgcuggcauggggcagaaggggggccccuacaaggugcaucauuggggacagcagcaaauugucagcacugcacacgaugcuuguacgugcaucagccccugccccgaagauggugaauucugacuucaggacaggagaggacagagcucuuguaggaagcugagaccaugguccugucccugucuggccccugcagguucaggggcugaggggaccccagaaucuaggcccuaggagcacccagagugugccacaugccaaggggugcucccgcagccaguagcugacagcguuuggcugcacagugcucuguguauuuauggacccauaaaauauuaaauaaucaucaugcagcacuuuuucuccugaaaggccuuuaagguccguauuucccccauucggaaggcagaacaaauaaccauugaaucagccuucagcucccggcaggagaauccggcccuuagaggagcgccagggcaggcuggcggcccccgcccccagagcauggguggaaggccccucugcuuacagggaggggaugcaggugcaaggcagagagggaaggaccccacaugcauguccacagcccccuauaugugccucagggugaccagguguugcuccuuagacaccuuagcagagaacaaggacacagaaucccagagccaugaugggcucaggagugagcacugagcuuggagucagcagaccuggaagagaaucugcuuggaacaagaucuugggaaaacuaguuccuagucggcccuugugugggauucagggugguuggggccaccugucugcugggaggggaacucagugucuuguggaagcauuggggguggguguuuuuuacugucucugcuguacuaucucuauaaucucugcaagcuggggaucaugugccccagcucuugggagcauugaaaggaggacauuugagacuuaggcuaguaacacaaggcauucacaagauggggaaguucaggaggagaucagauuucagguccuuauggcuccaggcacacaaagaaugucagacagccaagggugggaggucaggugcuucucauugcagcagggaugaugcuggucucaaaaauggugaugggugagucucccuaggacuuggaccacagcauuugguacccacuccagaucuggagauacugacuccagaucaaagagucccuuagagcaauagcagguaaggacuugggccaaggggcaauacagcaauccuguguaauugugucggcgauauuggcuuuauuuuagcaauagcaugauuccuccuauucuccaacacaugagaauuucaacaaauauuuauuuuaaaccccaaccccaguacucuuccacuaauuagucuucuucuggcagcagcugggaagucagcccaauuuggccuccauccuugacucccauccauccgcuacagaagguccaacaccagucucaccccaccccauucuagcacaauaguuguugcaggggguuccuacuuauccaauuccacccuuuaauagaaaacaaugcuccaaacccucacaguaugucuaggagcuaucaccacucuauucacagcaaucugcacccugggugugaaugaugauuuuguccccuccuguggcuauuggguggggagccacagguggccaggugugguugccgugcccauccguggucaggaggugggauuguggucagcagccuccaccgguaccaagaacaggaggauaugugggggcagggggacccccacagguggaggagcagugcugcaugggacacaugcucguguuucugacugugcagguugaauggaucuucaaggugccuucacuccagccccaccuggcauauuuuggggaacugcuagagggaauuuccuaggccuuaggcuugcagcugggaagaagcagaaggggauggaaaaugcacccugaccugcagcccaguacucuuccacauccacccugauagccuugcagcugggaagaagcagaagggggugggcucccugaccugcagcccaguacucuucugcauccaccucgauauucuggggcuuucagcauuuauaggagcaaauauucucagaguuggaaggggcucugaaggccacccgggcacauucugaaccauggcaacaucacuuccgggggugucaaggggcugguggccucugcuccagaauccccgaaugacgauggccaggcucagcucccugaaggccauggggcugcugcuucccucccacaugcugccuuccccacugggcagagcaccugcagccacaucuugggaagauuucucauuucucaggggugugugguugucgaaguuuacucuggugcaguuguaaacuuuccaucucuauccgauucaguaccagccacugccugcacaugagucagaugcucagggacccuggaguggagaggggauauggucccugugugcaccuuccuuccccauccuuggggucuacuuccucagguaagggagggacagggggaugagggagaggggagaggagcagcagccagacacccaggugcacacaggggacccaguucugcucagcuccugcccccauccugagugggcgcccacccucggguucuuuggugcucuguucauaaucauaguaggugcuuacuaaagcacugugugugccaggucgaugcauguucagggugagaugugauggaggcucacagggaugggaauguugccaguaacuccgagcugugaaguaacgugagugagcuaaggcucugccugguuagcagaaggugcucccaccucaccccuacagucuguucuucaaacagcagccagcaugaucccuugaaaauccacuccagaugcucuucuuuggaucuuacuugggggagaugagaagccccaggagaguuuugagccaaguucuucccacagccacaggcuccacaugaucuuaacuuggcuggcauuccugggaggcucucuugccacagggccuuugcaccugccacuucucuuuccccagguagcugccuggcuugcucccccacugccuucagggagaugacacagaagcgucuucccuuggugucccucccacacccaccucuuuccuuggggagugcagaauuccugcuccuccuuguccaaggagccucugcuccagcauuaauugccuuucggacaguaccacuuuguucuuugccgcauccccagacccaagaacauguuaggugcucaguaaauauuccucaaaugaaugauugaggcagagagguuaagcaauuuuuuuccccccaggguuacacagcugagaauugauagggcugggaugggaagccaggcagugcugcccuggagccagacccuguugucuugcagguacuggggagccauugaaggcuuuugagcaggggaguguaucugucgcacagugcaggaggaagggcccaggagugggaguagaccgggcauggaaagaccgcauccaggcauguggcuaucucaggggugggugguaagguccacaguaggcaaggcagaggcagggacccagugaggggcagcaugugugcaaggcacaucuuggagugacuuuaacccaacccgaugauucugauuuugcuaaguccuuccucauucuacacccucaguguccacuugcagccagcccccaaaucaacggguccaagcucaucucuggagccaaccggugccccaggcuucagggcuuacauaauuaaauacacgcuucugacgcgccacucaggccaauuuuccagaucucaucuacuugaaaauccugucauuuuccaccagcugaguuacagugaaaaaggauaauuuaaccggaguccauccaucuucagugaaagugagcaauucuggcccgucuguaguugaaguuccugagauauggaauaaaaggugugggaggggaggccacggcgucggggauggggagaaagcuccucggaggauaaauauuagcucugcauccuuggguuggguuuaguuugguuuugaaagaguguucauagaaaugaauuaugaaaaucaacagaaguaauuucuuaggcguccaguggcuuucuuccccuuuguaugcuaagaugauuaccugucacagggaaaauguaagcugcagguuaaaauccaggaaaggcaguggggggaugggaaugacaccccauccagcccagaggcuucacuccagcccucaucugcccacggcacgugucauuggcguccggugcuacccagugccagcugacucugcccauaagaguccagaggccugguggugggcucuuugagggcaggggccgcguccuuacccaucugucagcuggggaagaauuugcuacugguuaaucccacuugcaccaggcucuaggccgagacacagcugcucagugacggggcuggcacuguuggguuuuaugaucaauagucagggaccggcgaguuccugaauuuguaugcugggcuaguggcccauucucaguccagagggacaggaggcaggcuggagggccacgucagggugacgcggcagccaucaccaucuugcauggguuguugcaauagucuccccucauuuuaauugagguagaauacgcuuuacaaaauuaacuauuuuaaaguguacaauuugguggcauuuaggacauucagugucuugcaaccaucaccucuguguaguuccaaaacaacaucuuauuuucggcuccaaaguaauaccccguccccaguagcacucacucccauucucuccuccccauccccuagcggccagugauccacuuucugucucuguggauuugccuaggguggacauuuccuaucaauggaauccugugcuaggcaaccuuucauguguggcuuucuucacugagcauuagguuuucgaggcucuuccguguugcaauguguccguaccucuuuccuuuuuaugaucacaugauauugcauuguagggauaaaauuccaggucuuauuugaaggagauggguuuuuuccaccuuucagcuagcgugcugcuaugcacauugguggacaaguguguguuuggcuccuguuuuccauuucuuugggcauauuccuaggaaugggauugcugggucauguggcaauucuagguuugaccuuuugggaaaccaccacaugaccuuccacagcagcugcgccauuuucaguccugggguagccaccugagaggggguaagggcggaacgggagaccugagaccuuuuaagguggaagugaagucccuuagggcucagaacucuggaagcuccuugucuuucugagugaaagccaaagcccuuacgauggcccugagacccuguggcugggucccugugaccucccugccaucaccgccaccuccuuuccagcugcaccuggccauccuggccucuaugcccuccuccaucuggccagcaugcagguaggugucucagggccuuugcauagcugucccuuaaccacaggggucgcugcaggggaacaugccgcgugcacgucuagccaucuguccuuccauaucauuuguuguucaucaugcugggcaugcacugucucccgcccugcccccucccacaugagaaucugagcugcacaaaggcaaagaccuaguuuuguucacuaagaaucccacaugucuacagcugugccuggcaaacagcagguccucaugggcuguuuguugaauggcugaaugaagauauggauggaguagcuucugccauagaccuccaaccaaccacccccaggcuccuggcaauggggagccugggaccuucagagcuucucuacccuggcuccuccaugccuucuucccaguugccauccugggccuguuccacccuguggagugcuccccuaaaagcccaugcucacggagcccagccugagccucucugcuccugccuuccagccucagaccugcagagcccccugccgccaacagagggcgggagaggucccuuguguagggucugggagcccagugcccagauggacccagcccaccuuugugugcacugcacaccccgccuugugcacgaguuugggcuggcggccaguguuaggacagggagccagggggccccauuagagaugauagagcuucacacagucauuccuuuuggggagccacagcuggcugcuuauuguguuaaacugagagguacugguuggugcucucuauguuucugcuauggguauuuugaauccauuuguaggaauucauguuuguuaugacuuauuucaucuugcuagauucaggauuuuaaaagauuucaaaagccuggaaagauggccagaacuuucaucuaagauaggaugcauucauucauucauucagucagucagcaaauagucccuggcaucccuguuuuucccagcaauaaaaacaugguacaguccuuuagggcacuguccauuuacuggcggguuguaccucacugcacuguguaagagacugcuucugggucauuauuccaagucauugaugaaaaguauugcucgggucaaguccaagauagagcccuggggcuugccccuggaggccuccuuccaugcugaccuggccgcuagaaucucuguucugcuuauuuaucaauguucagaagccacggagcugacugucaucugcccgugaucacaugucuucucuacgggauacuggaagagacucagaaaugaaggaauuuggcaauguguccguuguugguguugggcuuugcaaaauggaaccagcgcacagcugguuggagaggaaggugguuccaugagcuccaaagaagggugaugcccacaguguuuccugaggggugugaccuuguggcuccugcucacaggcagggcuuccuggggaggugacaucuaguucagucucugaacacuggauccaguuccaacuugacaaguagaggggcaaggagccuucugggaaagcaagccacuggucauggggugagggagccagagagcacggacccuggggaagcugccaucauccccagggagugucugagcuugcugggaauggguaagaacaggauggguguggggcacugggcuaaggagguggggugccgucucaauaguguuggagagucuucggguuugggcuucuggcacaggcagggcagugucuggucugaggcuugggaagcucccucuugcugcccucuggguggaggccagagagcaggcaggaggaggggccaggcgaugguggauuccuccugugcaccgcuuggggccuugcacggggcaggugcucaggauggauggcuaauuggcuccaggugccuugagagccuucuggcugaagcucucugcaaaacaagcccaugccaggcugcuggggcaggugcagggcucuagaguguggggcaugggcaggagggaggggacugucaccuagcaccugcucugggcccugugucaggcucaggguuuucaagagcaccuugucuuguagaccuuucugcagcccuguggggaggugguaccggccucaauguacagacagggaagccgugggcuggagaaggucccaguucuuccacugccugacuaugccaacuuccucuccucccuaccuggacccugaaggccccucccugggccaugcugagggcaggugggcaugggcaggcaugggugggcagccucugccgucuagaacugaauccuugagucuagugggccuugggcucccugggccggucugagccuuuagaaggugaagggauccugaccccuucuugcagguggggcugcuggggccccgagaugaugaggugcccugggucuuccucgggcccacagcaccuggagaaugccucccagugcuccacucuggacucuggagcacuuggugggugccccugccacaaggggcuguggucuauggcuugcacucucuuuguuaauucugggacaacaaaagccuacacggugcgggagggaagccaccccgugcgugggucugacaccagccuagggcuucugcagccgccucgcaccuggugcuaaccuccugggggcuugguuggcuagcccaugucugucugcacugugggcggggauguggggggaggcacaaauagaucagagauggcagcagccucuggaacaggggguggacagcuccgcgggggaggcagggcucuuggcagaggugcgcuggcagugccggggcccagcggagguggcccugaagcccggucagugccugagugggcacugcugcaaggcaugcugggauuguagcagccagagggcagugggaggcucugggggggggggacagggcaggagcaccccagggagcaggcugucuggucuggucccaugcuccugaguggcccugguugcaaaaccaccugugcuacccagguccaccgcgugggcuccuagaaccucacuuuccucaucucugaauuggaagaagugacacccaccuuagggugugaaucugagccucagaacccacucaguguucccagccuaugcagcgggagcccacccugaaccaccucuggcugaaaaacccuacccuggaauaugguuucagccgugggcugugauccauuaaugggucaugaaaucaaguuagugggucacagcuagaauauuaaaaaaugaaacagaacagaauggaaucagauaauagaagaggaaaaaugggagcccgcuggaaggagaaauguucugaggacguugguugaauauccauggcugccgagacaggaugcuaaggacauuucuugcucugggucagguucagccugucuguguuuggauguccacacugccuccuacaagcugcggacacugguucuuuccacaucaguuggacagggaugauggggacaauaauggcaccuacaucccacagugccuggaaagcccuuccugcaaugggcuugagucuggcccuuccuagcacaguaaucaaaccagaguuauaguuauuucagcaacagcuaccaguuccugacuguggguaucguggcagagguggggaccacaaucaccgccuucauggggcccggaucuaggcagacaccaccccgggaccagagagcuggauuccagggcaggugugggaagagcccccucgacucccuuccauggugcagaggaagggggcugggggcuguggcucagcugaaccugcgggccuaccugaagguggcggcgguugaaccagggcuuguagaugagggaagaggcuuuggccagggguccuggggaggaauuucaggcacagacuggaguaagcagaggccccugagacccccaugcaucucagggguggggugggggcugccagcagcgugguuagacuugagccauaggaugggaagccaugggcuuguccaggugacagccgccaggggacaccugugcccugcugagggccggcaucauggcuguagcuguugacccagugccaagcccuaggcccgccccuuggccugugcacggugaccuuggcccaggagggaaaucuucaggauccggaacgcuccugugucccucagucccugcagccccuuccccagugaguccugggaccccugggguuggucuugcugcagcugaguccugaagggagagggagguuugaugucauuuccuccggggagccaccuggaaccccccaguccgggugaaggacguuggggaauagaaauggcuuggagauccagacaggcgggggucgcggccagcagaggguggagaccaauggugggggcuguucagaggggaccuggcucacuggccuuuuggguuuuaggcugugacugagccuggugcuggugugcagccccugcuuuguggggcagugaugggaauggaacaggggagugagaaucccacuuggcccaugaggaagcccacguccuuugcaggcugguuuauuccuugccuggccaagggggucaggcagggggaccacaggggcucaugggucuuggggcacugccuuaucagaugcagaggcugggccucgguggagggagggguccugagcguggcaggggacaggagcuaucugaccauaggacacgaguucuuuuccuuggccaccuaccccaaucuuguucugccaacagcuaugcuuccugggguuuccugagcagaugcaacaaaaacacccccugcugcucagguuccccaugggggccgccacucucccuggcauccccucuuccagaauuugcuuuagaugaagccacacaaacaguacuguccccuccugcccugaccugagcaggcccugugggggcuggagggcccauccacggcuccuuccccaggacugggugcaggucucaggagaagcugcaguggaaguggcugcuccccacugaaucccugcaucugugcucuuugccugggugugcccggccaggugugggaggaggagccuuccagggcagugcguccuauuuugacucggggguuucaggaugacuuccugcgggcagccuccagggacuguccccuugccaggcagaagcaggaugugugggaaggcuugacauuuuuuguaaagcaugcauuuauugcuuuugagcucauuaaaauuguggauuguuuuuguuugaacaaacgagugaauuuaaguuuuuaauuuuauugcuuuggugccauuuccaaguuuuucuguagggguagaaucgucuucgugcaacgaccucuggucccagccauguucuucaccucucccaagucucagcaguugucuucgaaggagccacuacauucgcacaggcugcucuugguggggaaugaaauuuaguugcuuuauaauuuuaggugggggaagcgcugccccugugucacacauguaacuugggauuauaggaguggcugaaguggcuaacaggaggacacuucaaagucccuucucugaugcagaaaucuguucuagacuaucuuggaugaguaugcaucugucccuagcuugcauacucccagucauggggagcucccuaccucaccgggcuauggcuggcuggcuccucuuccugagcugagguggacaucuguauggcagagccugagaggaggccugugcaucacagaagcugagcucugccagccaggcagcccuuccagugacuacucccugagugcucacucugucuucugcuggacaccaguguggcccaguccucagccacacugcugcagugucagggcaguugcauuggacucaccagggaaagucagcugguccucccccaggagggcagccauguagcgggcacggcagggacaagggcuccuagggagaggaggcucagcgcagucagugaagagguggcagcgagguauccuggaaauuggguguguagcagaaagugcggggggggggcaggccagagcgcuggggcagagcgggaggccaccagcuucuggagaggcccaccgugugccacaccuuugcugggcaugugacagcaggcuccggucaucgacgcuguccacccuguuccaccuccaaaacagcaauggucaugaugcccauuucagggggcucaggacugcuaaggagugccaggacccagggccccaggucccucuagucaucugugcuggcuugauugucugggcugagcccuauguccugccagggugggcucuuggcugcaggcgggagagcgcugggaugacuuuuaggagggcaggaugggagccccacagacagcagccccaugcggugagggcacccugagagugggugcugggugcagcugcaagguaugaaugagcuguuccugcaggguccgggcccaggguucucaccacagcacacaccgcuacccccaaaaguacaggucccugggcgucuggacccacuggaaggcacccuggucagagccucagggauggagaggauagugaaccugccucaccuccucgugccagaccgcuucuugcugccaggcccugggcagggcgauucccuggucaucucauuugguccuaagaaaccaauaaaacugaaacacacauaugaaaauaauucuuaaaaaccugugauucagcgauaaauaugcuuccugacugaugcauucaauaaugagagcuaccggugggccuggcaccuccagugagcuccgagugacggugcacgucugcaaugcucaagacgucugcaaccgcagaacguggcaugaaaauacagcuuguuucuguggaugacgcagcaacaagaaaugcuaaauuucagccagagggcgguagaaaugaagauggugggauuuuccccauccagguucuuggacccuccugaauuucacucagagcugccaagguuucaggagucccguccaggguuguccuuggccagccccacagggcaagagggguugugguuauagguugcacaggcccugguggcuuggggcgcggguaugugacugggacacaucaaagaaaguacagugcuccaugcuagguguucugaugcuaaugagcaggggggcuguggagcccagcgaggaccccaacccaaucuaggguggcuaggggaggaccccagggcuguucucuugaagaaaguaguguggggugucgcaggcugugggaccagcacauccacaucccagcagccuuacucaacuugguucauccuuggaaugggagauguacagugcgucaggggcucaggagguauuuugggguaggaugagaggcagguaagucugguggcagaccaggauucuagucacaagcccugccgcugaugugccagagcugggaugcuuuacagaugggaaggucgcaugcaucacggccucagaaccucacagagcuuagcauggugccugggguagagacagggcauuuuggcuggggauggagagggcccugagccacggaggcccaagaucuauccgagccuggccugggaggucagggaugagccaggguugggugugguaugaagcagguauuggcucgccagggcugcuuggcaggaaguggauggaggcuaguaugggaaccaggcaggcccccacugucacugggcccuggccuucacaguggaugacauggaugacaucuccaugauggggcagagcuaggguccuuagcgcaucuugcagaggcaggcccugagcccagagagguuaagggccagcuguguaguggugcuggucuuccuagggcuggcgcaugccccugcaguuagcacgugggcaggcuggggagguuguucugggggccucagccuggucccugccaugaagucugacacuuuagggaagcuggggucuugucacccagagacugggcuucagaagcagcaggaggcugcaaguccugacacgaaugugcuuuuugagccuuuucuugugucacaugugggucugccccuucgucacaugccaagcccagacuccagacccccagcgcugggcuggggagccauggcuacugcagggcaaauggcuuugcaccccaguccuuguccuucaucaguuccuuggcucaggggacuuucuccagcugugggccugagucuccacgggugcuuugggacagagaagggagagagcuacccuguguuggucacuacuccccgccagacagcgugccaggcacacuugcaaaaugagcagaugcaggcagagcacccggggccacaucuuggcgucacuacuugcuaguggucuccaccuuccaugccuccauuuccacuucugcaaaauggggaugaugcuggaacugucccaggggauucuggugagcaucaaugggcuguuucacagagcgagugcucggugagugguaacagcugaugcuuuauggaugaggaagguggcacagcuggcuccuaggcuccaaagcucagguuuuguccagaaucugucagagguggcagagacugcaggaaggggcggcgcaggagugacuguggcagguagcagugaggggcacagggguuggcuacggccuggcggugugggccugggggagggugggaugagggacauggguaggaaaaaggcacgagaauggggaucaguuggaggcugaugcuggaggcccagcaggaguuggacuggugaaugggagaaaggggcaacucaccagagagagcugguggacucgcuccaggccuccugcguucucagcuaauuaaacaggcagagcggaugaugccucuauguaucauguguuugggccggggaaccuggggacucccagggaagccaucccacagcgggugcugagccagcugauuuguaaggaaaacugcucucccagcugggacuuugcccggccccagagccugaggugggugcaggugcccuagauuagaggcacccagggaggcugguagggacuauccccagacaaagcagcuggcacuuggcucagggaaagucaaagggacccagcgaagcucccugcuucugguccugcaguagcccgugugccccucuccucaccagcccuguuuccugcucugguuugaguugaaugcaaccauggaagguguugaacagugaaggcauggccuaaucauggccagacaaauauucuggaagaauggcucccccaccaagucuuccguagcuccuguucauucauauagucaccuguauuuggcaccugcugggugccagauccuuugcuggucauugggaauucugauugacauaggcuugguaauucaugaccuguguggucucaucaucugcagcuguuuguuuucaugucuguaaauaugaaauaaacggggacguacaggugaggagcaacuuauccaugucaugucuucccacguuccuggagauggggacauuuggguugaguuuugaaggaugaauaaggagcuugaugucuucccucguucugccuugucugcuuguuagagagauuccagcuaacgguauggggauguggucuaacauacuuccuguucucuuauuccacagaugaggacacaaacccauggaggucacagcagugagugcucagugagcucagggaauauguuugaccugcacauguguugguacuagcacagcuuccucacauucucccucugucuggccaaggcugggaugggaagaggggcauggaggaggcaucaguggcccagggaaguguggggagugcccaggggugaggucugcugcuggguucaggccuuagacauauucaucaccuccugaaguuuccucccacuccccuuacuauuauuguguguguguguguguguguguguagaguaggaauacuuaagaucuauccuuuuagcaaacuuuaaguauucaauacaguauugcuagcuguaagcacugugcuauauaacagaucuccagaagguuuuuugcauaacaaacuuuguaucuuuagacugugaccucccuguuucccugcccuuuauuaaccacuauucucugcuuccaugaguuugacuguuuuagaugacgucauuuaguauuugucugucucuggcugauugcacuuagcauaauuucuuccagguuuaucuauuuagucacaaagagcaagauucucuucuuccucuuuuuauuuuuuaaauuucuaucuguuuacacuuacucuuuggugagccauuggucucacacuuuccuuuaauucaucagacaugguucuuuuagugcuuugaacauccuuauggcacuuggucaccuuaguaguuggcugaugacuggacagauguccuuaaaugccuugcggucucugccaaggaagccuauguguguugggguaugcggucagcacuccgacaugcaggucaugauucugucuucaccuucccuuccugcuugggcacagucucaaggucagcuggaggugagauguuggggccaugucaagugcacaugccuuguacaugcacacagccuuuuaggcucccgggaguauguuguagcuuuccaaagccuccuuugaaucuccuauucccauuuuuccuuuuugucuuuuggucagccucuuguuagaccuaaguggucauguacuuuggacagcugcuguguuaaaacauugccuuugauuguuuucaacaaauacugcccucucacugaaugagcucuggggacagagcuuccagacaggagugacccuuccauggccaccaggaugcuguuuucacagcuauugugauugcugugcuauggguguuccaggucaccuuggagcugaggcagggagauaggacaagggcagguucaaaugccauaaaccuuucuuuucuuccugaaauuuagucauuuuucuuacguaaacacuuuuccaguuguuacaagacuucagcuaacuuccagaauucaaaaaaguugauuugaugguuuugccaguguucucauugcuuuucuggaagaguugaguuccuggggguccucgcucugcccuucuggaaguuggcuaaaguuuucuucuggaaguuggcuaaaguuuugugaccucagaaagcacuuuuagcauugggucagcagcaggagcugagucuaccucugcugaaaggaaagggccauagggaagggaaaagagguucugcaucuggacaggcaaauggcuuaaggagugacucuauccuuggcagggggccgggguauggggacuggcaggucccauucaucccagccuggccaugaccaucaacacaccagcgugagaacagcugaggugcugggggucagagaagagggcgggcaucucagugucaccacuugagaacugcgugaacugugacaggguacuuagccucucugagcauuccuucauccaggagaaugacagccaucaucucuagcaguugggcaugacaugagaagaagaauaucauuggugcugggccaauaaaggcuggucuucauuuuugaaacuccugcaaugcccagcccaaauccuggccaccauauugguuucuggucuuuguacauggaaugaacagaauuccaggggccagaaacagugugcuuuuggcuaaaacauaaacgggggucuaacggauucccuauuuagccuguuaaggugaagacaugccacaucuacuugaagcuuaugaggaauuaaaaauguuuaugaagaauuuuuauuggcaauaugauagcacacacauuuucugauaaguagaaaaaaagcaggcucuguuauuacuucuauaccaccuccucucagccauagaggagagguauucaggaaaaggacuagcagggaauguaagaugcuuccaggcugccuccugaguggggggguugugggugauuuuuuuuccccugcuucuuuagcuuucuuuugugauucucuucagugagcaaguauuauuccuaugaucagcaaauuacaaaauagaaaaaucuaaaaaguagaaaauaaagacagguggcugggaguccaggagauaaauuaaucaggcuuauagcagcaggcuuuuuccauuucuuuucugguuuuguguuuaggucucucacucucugcaagguuaggugacuugcccaaggucaaauagcugauacaugaggugggcucaccaggacccgggucuucccuguuauuucagaguaauuaugaccauaaaagugucccuguccuccuuccggcccugguccccuccgcuggcccuuuggggcagggcuaggcucuccucaggggacagugagcaacgcugcuaugucacauguagaaaaucugacucugcccuagcaacgcagacacucgggccuccguuuucuuguugaugauacgggauaguaccugaaccuccuacaguuacucugcuguuuagaacagugccuggcacccuaacauugguugugcucuucuguuugcucauuuauuuguuuaaacaauuuuugauguggagcuacuauguaccaggcagcggagcuaugcauggcaguaaaacaggcucuagaauguucucugacaggacugccugcuccugcucccggcuggcugcucaccuuacccuucagggguccucaugcagcaggggaacgacccagauggugaucugugagaauccacugaugcuggcccuagacgccucgcaccacagcuguggagguggcugcccccgcccgcucaucacccaggcaacacccuucagaugaagucccagaagcucuuuguaaaacacccaaggaggggccuuguccccucacggaggcucucagggcaggccucggcugauggcuguugucuuccuccugcuccccucaagccaaggauuccccuuccccucaguuucaaucaaggguaaaugaccucgggaggaggcacccgugcgagccucccaugucuagcuguuuggggaacgguuaccuacuaagugccaggccuggcccuggggaccuggagacaaauuggggucugagccauccucaaggcucuccugcugcucugggcaggacaguccaucccagcagggcagagcuggcccugcccucauggagaauccaggcagcuuccauaaaaggggcuccugaaaagaggugagcgcuugggggcaucucaggauggugccauccugcagggccagcaccaguggaccugcggauugagggcagugggggcuccaggaaagguggauugggagggcagacaagaggcuagggaggcuguggggcaccauggcccacccacaggugcaucuggaugccugccuuucccaugagggguagguuaggccucccugagccauauucccucaagccaguaacuggagcugcuuguuggcugcccccuuaggugggcacaggaucuccucuucaucagggaaucaccuuccccaugaguggcacuuaccuggucccugaagccauuuaaacuugagacccaacagccuaaggaaaccaaguaguaggggcuccuugacucaggcccaugaguccaccgugcuaagcugucccagcccuggguugagggacaugggagugaaccagcaggcgaggugugguaugccaggaggacugcugguauauauaaggccuguaugcggcaggcacaaaugcccuggggcggagagcagaagaaacaauaaguggaugcuugggacaggcucgaugcgaauaguuacagggcuucuggggaaccaaagggcagauugaaaggcugcaggcuccagggagaggcccccgccuuuagggaggccauuccccuugcuuugugugucgucgucuucacgcucgcagcaggccucgggggaaggcccugugugguguugguugucuaggaugggagaccaggacacaagguacugaggcugcacagaccgagagcagcugggcugagcuggugagccucgcgcagccuggguuuuuccacucugcucugcagacuuggagacaccucagguugcuguuauguaagggagggccugggagagccgggccucugggcugcguauguacaugucugagugugccuguugagcguauacgugugucugagugugugugcaugcgugccugcagcauuuucggaaggaggucagcaccguaguugugcagcaauccaagacugccaccuauuagucguguguccuugggcaagggacuuggcugaaaucauuuguuccucacagcuccaggagguccucaugauugccaucguuuggccaacaaggauacugagugacuaugugccaggcagcauucuaggccuuuuacaagcauucacauuuauugcauguuuacuauaguuagauaaggagugaggagggcuuucaaucuucagguuaaucuugcuucucuuauaccuuagcuacaugccucaggccagaugugugugugagcauaucuguauguauguaagcaugucauguguauauucguguaugugagcguguccauguuucuguauacauguguguguuugagugccuguguguauguaccugugucuaugugcacauggccugucagcgucacacggcaggcugcacccugccagaucgccccacugcuacucgugucccugagcccucguuuucucaccuguuccauggacgugacugcaccaaaccgagggguucuucucgcauguuguugaacaauaagcggggugggccugucuguacgucuuugcucuccagguucaacuucugugcuuguacagaaucaucuuaaguacauguuaugagcuaggugcauagcagcuguacccccaaaugccauuggcuucaugcaucacggguuacuuuuucucuugcaucacagccacuguuucucggcaggggcucugcucuagcuggucacucagaacccaggcuccuaacagcuggaggcaccaucccaccuuagguucugaggcuucuaucuuuagggagggagcggggggaaugggagcagggagagagaaacagaggcagagacagaaacagaaggucagagagagaaaaucauacggcagguuuuagugggccaggccuggaacccugcuggccagcacugagucacauggccaugucuacuugcgagggacucuguggcccagcugugugcccaggagcaggaggaggucacauauguggguagacacugucugucucugcuagaacccaccugcuucuguugcuuccugagaaaaugagcauccuuccacgcgggaggcccugguggaagccaguuugcugccaucagacuccagcgugggcugacuccgucaucagugugcacugaguucaguguuaacagugaaaacaugcugugaacaaggccuggggcaccccacagaucuugccugcuccugcuuuuuugaggcccuuuuuuugcaugauguggggucuguggugacucgugucaaugaggcacuugcuagaaaugcagaggccccagcccccuaccucccaugcagaaugggcguugcggcaaaucccaggugaucccauuauuaggaagcaaugcuuuagaagucacacaugcaacaugucuuaccuucauuuccacugucaaaccucccaagaggcaucggguuuuaugguucucaucuggucugguuugaccggaacuuacagcucccaguaacucggcauucaaggcucuugcucuucugacccauagauccuuccagggugaacucugccuguucccucucagacccugcaaggugaauuagcccuacaugagaauccagcagaaacaaaacaggaauuaaaguuugauuugauuucacuuuuuuuuaaacaaaauauaucaauuauuacuuacagaggguauuaggaccuagcuugauuuucaguucuucuaccauagacuuuucaaaagucagccacauuuuauauauauuuuucccucuguacuuuguuuuuuaaauuuaggcuuguuuccccacauuuucuuguaguauuucuaaaaauuuuuuuggagugggagaggaauuauuuaguggugggaagaaagaguagaacggaagggagugaggagaauuuugcuggaaagggguggaggcggccagcaggaaaaugcagguuucucuccagugccugaccaggugugggcgcccagccugcagccagggccaggcucugagugcagaggcugaagaccacaucaggcuggcuugggggcuuacaaaggcaacgugcuuugcgcagggcuagggggcguuuucucacccgugccacagagagaauaccacugaccccgcaaaggguauccccuuccccagaaccaguggguugaggaagggaaaauaucuuagcgcaguccccggcccagcgccagcccacaguaucugguagucguuauuguuaccauuauuuaucuuuugucaaugcugaaaggccacugauggauggcagcuucugagaaaacauucaucgcaugacaucucaucuaugagaaagaaagauuagcgacuuuucccagaugauuccugcguucuggacgcagucaccggaaaacgugggcggccgaccccgcacccggggccgugucccugcagucgcccgagugcccgccagagggcgccguugccucuccgguggccggcgcugcgcagagccccucuugcagggagcggagccccugaggcacaggcucuccguccuagcggaccauucggcuccuuccuggcaacacuuucuaggagccucuuucaaaagcagacuuacuugggggauggaugaccuccagcgucucgcaagagugugauugcaggcuucuguguuucccagccuuugauauucugggggacugagaagggggugugccuugaccgcagccuucuccacccacccugcugucggccuccugcucaggacacacgaugugcagugcgcuuguguggcccuuucauaggagaaggccuucuacgcaccugucuuccccucugugucucugggcaggcccaaguccccggaccugagagguucaccuacacccucuccgagcugccaccccaaagccacuccgcgggccuuccauuggcagauauggugcaggcucaggccugugucugcagccugugccuggaggcuggaguggguggaaggguguggguggcuaagugggaccagcgagcgucggauguugcugcuguguggcucuaggauuaggggcuggcccaggccugcauccuccgggagagaggccccggggaggugggggcggcggcggcggcagagcccaggacucugcagagcauuuccaggccaguagcaagccccugcgagcagacccguuccuuccagcgcccacaaagccucgccuccaccacuuccuuauccucugaggcucagcuuaagaguuuuaaagcuuagaagcauuaaaaauaaugcuuuuucaaaauugggguaaaaugcgcguugcaaaauucccucuuucaaagaguauaguucaguguacaauuuagugcaauguuguacaaccacugggacugaguuccgagccguuuucuuuauccccaaaagaaaccccuuacccuuucgcgccgccccccacgcccgcuccccccgcaaccccuaggcaaccacuaaccugcuuucuguccccauaggugucccuguucugguguucguggacuccuacaauacuuguucuuucaugacuggcuucugucacucaggguuauggacugaacugugccccccgaaauucacacauugaagcccuaacuuccaaugugaccguauuuggagauggggccuuuaggagagguaauugagguuaaauggggucacaugagugaagcccucauccaucagguuuaggauuccugagaagaguaagggauauggggacacugucucucucugcaccaucuggggacacagcaggaagguggcccccucaaagccccggagagcccccaccagaaacugcaucuucccccccuuucauuguggaguucuaggcuccagaacuguggagaaaucagugucuuuugcugacgcuucccagggcugugguauaauauuuuguuauggcagcccagcuugagcugacuaagguuuaucugcacuguaaugcccgucaggacugcaucucucuuuaaggcugaacacauuccguuguacacauggaccacguuuguuuaggcgucuauccacugauggacguuuggacuguuaagcuaggcugugaauacauggguacaaauacuuguuuagguuucagugacacgccuagaugugaaguugcuaaaaaugcuuuaagaacagauuucuuugguguuuggguaugagccaggaguggagaacaucuuggggcacgcuguguaggccuuucugcccuccccaggggcgcccccgcaugcaucucggccccagccagcagaggguguuuccugaugccaccuggugaggucgcuguggggacuaaaggagaagcacauguaacuaugacagcugauguguaucgaggcucagccuuccaauccauagaaaggggaugaagacgcuucauuuaaucucggcuggguccucauaaugagaagggacuggggcccaugggaggugaagccacagagcuggaaaguggccgacugcagucggagccaggcuggccaaggccacugcaagcggugcugggucagugauaaccaugggucaaccagggacgagauguccacccagugcaacccugggccaggcaacggggcucccugaggcuggccuuccucaggaaggggcccuagggcucuccugagggggccucacucaaggcccuacauggagcagaagaggagaaaggccuucgugaauguuguuggaaauuugugcuuugcaaguucauauguuuuagaaauauauuuuauauauuuaguccauuuccccccuuaaggcaucaaaugaaggguaaucaaaaggcaacugaaguucuuuuuggaaauuaauaauaaaucauaugaggaaauugcuuucauuaaauaaaacaccaaaucugccaagauuuggugccaagccugagaauaagccaguugccagggcucugagggcagcucagggcuggggccuuggaauccuggagcgugggucaauguggaagacgagggggccaugcccugccuggucggcaugaacaagggccucaguguucccaucuguggaaggggccagggccuggggcucaaguucuccauggcgauugugggaaggggccuuagauuacccagaacgaccguguuugccaggguaugggguuccucggcacgcugugcagggcagggcugaacucagcccagugcuggaggugcuucuauguugccuuuguuugugcaucugugaaauggauggagccaacugaugauucuugucccugguggccucaccaugagggaggaaaggcaaaggagauggagagccguguauguugugggucucacugacccccacucgccucacucuccugccgcccuccuccccuacaaccccagcucucuucuguucucgcucuuccuucuucaccauuucuggagcauguguggccuccguuugagacagauggucuguuucaucuuauuuuguuuggccugugccauguuuucaaauguuuaauuggacacuaauuagauaccacauuuuaaaaauccauauuuucggcuucucuuuaaaacucagaauugagucacccuggcccaccguccuggggccaggaugggagcagcugcucuuugagaggcccuggccugccagcuggccauucccugcucacagcccuguuaccuuccagccccucuccccaggacauacauaucagagguagcuucuaagagaaaccacaagagacacaggggagugugaauugcaaagugcuuuguugacaaaacuguuguggguuauuuguagucuggcuaggguauuaggauguauacuccagguuggguguuaaucacuuacagugaaacgcuggcuaaagccaacauauuuacaggggaacagaaugaacugucugugagcugggcucacuccggguaggacaggcuuagaggcagggugaaacaucucuguacagcuucccaucucugagaucggggucgggauguuaucuucuguggcugaguucauccuccugauagugaaaugacugcaggagcuccagaccucacccccuggcacccuccagucuggcaggaaaaagccgaagccuuugagucaccagucaagccccaaacccugaggcuuuugcugaaaccaucagagugccuacaaaguacuguucccuucuuggauugaacaggagaccaagccuguguguggugcccaguagaaauagggguuguguuauauugcaagaggaggacuugacacaccaccacugauaccccuuauccaugagagaaugaguugggaaaagcauugucaaguguaaagugcugugccacuggaggaggcugcuucauuccauauugcccuugccagaagggaagguuaacgcuuagaggaucuaaggugucuugcccaaggucauaguaagcaggagauggaaccagacccagacuuugggacccacugauuccugcccacccuacgcgcgacccaugcaucacuuugcuuuugguguuugcagacgccuggguuuaaaucaugccgaguucauuccggggccugagcggggccgaagcucaugggaggaugagugggaugcuugccgcaggcuuccgugggagccaggugggaagccugaggcccaagggcagcucucuucuccagccugcuccuccuccaagccacccugagucauucuuuaauggaauuuguggcuguuuuaauucuuaccggcacaaacuuugcauguccuuuauaaauauuucauucucuuccagcaggaaauuucucagugccuaaauacuuguauggccaucuccuuccggugcugggcagccugucccagggaacugugggcugggggagacagccauggguaccccucaccugcaugacagccgcuccagcuccuggaauagccaggcucccugggagacugggguugcagugacagaagagaaagaggcccagggagggaggugaccauccacagucccuccgagggcacggucagggcucaaaccuggacuggccugacaccaggggcugagcuccuccacuccaccccacugcagugggaauucaaagcucagcuugauggcuucuggucaagggcucagguaagcgggguaauggccugggcauucccaaguggaaggaauggggguaguaaugcugcagaggcaggagguaaaggcccugcucugucuaccucuccccugaauaagcuccacaguggagggcagagguuuuacccuuuaagucugugaaggucacucauggucagguguggauguaccuagauugccaggggggacauggggagccacagacagcucuugagcgcuggagugcaggagcgaggcuggucugcaguccaccuggcccaggcugcccuauuugccuuuuuccaguggggacagcccacuggauacuuugagugucuuuaauuaaaauauggagcucagaacaggugccucuuauggucuaaccuacguguauauaguaugcaucuugcacuacuaugucccaugugcuuagaguaucuuuaagugaaauaaugcuguucagaacaggagaagcugggaagcuucugguaccugguggcugccaugacuucugggaaaucuugcaggagccacuggggaguggcaggugucuugaagugagugcugccuucuagccacagcugguuuuucggggagcuccagacccaauagaaaugauuaguuuuauuuuccuuguccucugccucucuccccucugggaagauggagccuauucauuuuuuuuuuuuuuuuccuguuuuguuagccagcugcagcagagagaugaaggcugcuucucugcaaagccucucccaggacagaucaaagagacccacuaaguauauuaaagaggccaugaaaaucaggcugggugaugcugugucuugggcaaagcugcccccagccaccuugggcccugggcuuagggauuggcugggauuuccaggcaggccugggaagauggaagucacuugcacagcaaggagauaccaugugcugccuucuccuccaugcugggcucugggaucugcacagcugagucaggagugggcucugcucuccucgggagcucacggucuggcccaaggugacccaggcugugacuacccagcagggccagucagggucuggauaggugaggaguacagccugugggugcuguccugggagcccccagccuuccaccaggguccggggcugggagaggcaccuaguaaccggcuaagaaggcccuguggaagcaggcaggcugucaguucccuugggcccagacguccuuggcuacagauccacaugggcacuugggggcuggaaggucugacccccaagggcugcacgccagccugagguggggcucggcucagaggcugcauggcccagcucucggugaggggacccaugaauuuggccaguucugggaggggccaggugagggggcugauucucauugugcucugaugcacaucaucugccccauuucacagaugaggaaguagagggguccucccagggugcucaggagucauagugcacagcgcagagucugcucaggagucacagugcccaggacagagucagcuuuuccaagugggcuuugacauuuuuacaaugacuguccccuuuccagaucuguagggcaggaaccccgucaccggccugcccugucgaguugggcaucaccggcccccgggugucaguugccucugacuguggaggugggccgggugaacuggagguucucuucuagggcuggcuucacuuagcaggugaccuaggaugcuccagaccccuggguggggcugccacucgagggguugguuccaugugcugggacauggggcugggcugagcuggggguuuuccuggaucuccuucaccacucacaucuacccacccugccugguccugggcacuaccaccuguuggcaaagcugagcaggccaggggagggcaggugggugggcagagcaggacccuggagccuaaagcacugagugaugcaggggccagccgggcugagaaagcugggacagccacucaacuggaaccgacuguaagcucccuccagggucccugaacaugccggcauccuggaaucuugggaaggaugguguuggggaugcugcugcugugugagcagugcuggaaaccaaauuucaggcugucagugcugucugucaccagcaccacuaugguuaaccucacacccagaggccugacuccgugugaccaucuggaccgguaccaggucccaaaggcaggcgugucuaacucagcaucccccuagaugucagcaaaacaggcggugaagcucuggagaugagcagcgugggcuggcugcgucccuugugugcaggggcuuuguacccuguguguggucuuugcauuccucaguugguggggcucuggcuuagggcccugcuguuggcugggugccuguagggggugccaggcaucggguuagguaaggaugauguggccucuugcggggcgguuguggguuggcaacccuccugcagccucaucuuacacgucugugaagugguucgagugacugaggcugcuuggcuagaucucacccgcagucggaggcgccccucugggaguccugguuucauuaucucuaccuuuagugcccugugugucccuccugaauuuugugcagauccauuucagaagucucauugccaaagggauaagugaccccuuuaugaugagggaagcguggccaguggugggugggacuucugagauucugccaccucugugguccucagagauggagaaggucaccacccuguagugccuggaggguagggggagggggcgguaggguauuguaggagccuggaguccuagagggaaaauccaccugggcaugugugguuccugagcucacaggugggguaggagguaaccaggaacagacagccuaggggucaccuguggccuuuccacauccaugccccagccucuauccgcaccugcucguguugggcacugggcagggcuccugguacaggcuggcuggagccccuugggagauuuccaggaaagaaguguuuguggaauccccugugccaagagcaggucccagggcacagucaauggagauaucugaauggguaauguaugaguagaugaaugaauauaucuucugaccccugggcgggugaugcugggauauguucauuugcagaugggaaaaaaaugguuucucaggacuugagcugucacacaggugcugggggaauguauuagauuuguaccucauucuccucuugggaagagcuuagaggccaucuugugucacguguccagcauacaugcauuuucuauguucuuuauuguaucuucuacauacaaucuguagacaugguguguacuacuaaaacgugcagucugcagcauauacauagguguggcacauacacagccugugucauguguguucuacaggcgcacacacugcauagacaauauuugcuggugaauaugggugcgcuguaguuauaugugccucuuggucuaaucuaucuguauauagugugcuacuaugucacaugugccguuauucuacacauuagguuccaaguguacacuguguguacucugaagucuucauagaugccauguauguguguucuguacagguauuugggaacaucugacauguggacuuaauauucgcaggccuguuuguacacaguaccugcaguguucuaucauaagcacauuuguuaagcagaccaggggaaaacagauaguguaacagggucucugcaggaaauagcacucucacacugaaugauuaauaaaugggcuauuuauaaauucuucucgaacacguaggcagguuuggggggaagcaaugagggguauguggagcaccaguggagagcuauuaacaugccaagggugcaguuccuggaacuuguagagaguagcugcuguaagcccgcugacagaugcggcuaguugccgaagucgcccuccucuucccuuccucugaucuacuggggcuguccauuggauggacccaacuggaaaccagagggcaaagggacccuugauguagcucccaggguagagagcaggguguggcugggaacgccuaaauaggacaguggaggauacccuguaccaccuucuuuuuccuagaaggccuugggagucccgaaacuugucucucacuugagagggaaugguccuguuccccagaccacugggaccacaggaaauguguuaauggggaagaccccugaaccucagcgcuguucaucucccauacucucucaugcacgugucuuaccaagggauguccucgaugcaguggaccagugagaaacacuauggugugucaaugaucaaguucuuucaugcuguaguaagacggcaggagaauugacauaagccugagacaggacauaccaguguacugcugucuaagccccgugaaggcaaacugcuuauuuuuacuagcaggaacagaagucagggugggggacccuggcaccugguaugcaguuuuugacccagaaaaugccauggugauuucuuccaguaaauauaucacauguggaacauuaccacuuaauaagaaguuuccaacaaccuccuguuauucuccagcauuccagcuggcuuuuuuuguaucagcucuacaggugagcuauauggagauauaguaggauucccaccccugcaucuuuuauauuuacccuacuuguuugccaagaugugccuucuuuccugaagacuuaaguuuccauaugguguccuucuccccagacagagcagccuucaguaaucuuauuguguagauaugcugguaaugaacucucuuauaguuuuacuucauuugaaaaugucuuuguuuugccuuucuugaaggauaauuucucuggauauggaauuuucagugagcagucuuaguucuuuacagccgugcuuccacugcuuccuggccucuguugcuuauguuuagauguaagcaauauuauauuauuguuccccuguaugugguauauuauuucucucuggcuacuuucauuaucuucucugacuuuaagcagcuugacucuggcgugugguuuucuuuguauuuguccugccugggguucacugaauuucuugaaucuauaaguuugugucuuucaucaaauuuggcuauuuuuuuuuuuuuuuugagauggagucucgcucugucacccagguuggagugcaguggcacaaucauggcucauugcaaccuccaccaccuggguucaagugauucuccugccucagccuccuguguaguuagggcuacaggugugugccaccacaccuggcuaauuuuuguauuuuuacaaaauuaguagagaugggguuucaccauguuggccaggcuggucucaaacuccuggccucaagugauccaucugccuuggccucccaaagugcugggauuacaggugugaagcacugcacccaaccuaaauuuggcuacuuuuggccauuauuucuucuuuuugucugauucucuuuccuucugggacaccuuuugauauugcccuacagcuccccccaggcuuuauuuucaaucuucuuuauuccucucugcucuucagauuggauaauuucaauugauauaucuauuauuucagcuucucuguuuccccacccuguccuuucuggccuaacuuugucauaucaucucuucuuucauaaggacuaagggguuucagaggggugucagagcucagcgcuagcugggauugagggccagagaggauggggggaaggccuucuggaggcaaacaugugaugucauuuuucaagugagaguuuggcccauggggguagguagguuauggcacauauucacaccaccggagacagacagacugagccacaggcaaugaagcccugauggagaagugugagcuagagccgucagaggcagcuucaugcaggaaggagcggcagaggauccuggggucugguaggucccuacuguguaucagacucuuggcucggagcugucugaucucggcggauccauacaacgccaccuaagaacaauuaugccauguaacagauaaagacacauggguuugaaaaaacuuauggaacccaagguaaagcagcaagcuaagugaccaugaacaugugacagggucccaucagggaaaucuaucuugaugggcaggauuuuagauguuggaagaccagguacauccuucaaaauuucuguccaaaaaaacacuguccaugauccagguuuuuauucuggguaguguuagucccacaguuugaaccuacugagucucuuguuccuucugccauauugggaagaucccauccuggcucugacauugucacugaccagcuugggugacccugcagcugacuucaccuauucaacaucauugccuucauuucgaaugugaggaaauacagucuugacuuggauucccugcagcaaccacgcaaugaaguugcaucaagaauuucaaaagugcuuacacacauaaggucuuuaaggguuguuuccucauuucuauccaggcuccauucacagaguggugcaaauuuauucauuccuuuauuaaauaaauauuuuacuuucuagguaugggggaauacagcagcgaacaaaacauuuuuaaaaguaugcauuuguggcauuuacaucucacucuacaauugccucucuugauucaaagucucugcuuuugagccucauucuuggcaguugaaaacucugggcugaaaucccaacucugaagaaaucaagcuacccugcuaacucaguuuucuugucagugggguuggaaucauuaugguuguuuagaggcuagaauuaggugauguauguaagaggauucagcacugugccuggcccauggcagguaucauucuuugaaaauccacucuucaugucaauccauaguggacauagagagguuucucccuugggcuugguacuuuuggaguucucuuaguagugaaucugcuuuuuucuuuuuaaagccuuuauguggcucuaagauggcauucgaauguuccuccauccccucucaguggcauagugcaagugacauugguucuucuuuuucucuucccuuccaucccagcacaucccaacucccucccuacugaaauguuccuaccccccugccauccccuaaccucaugugacuucugagaaaguggcucuccuuuguucuccucccuccaauauauggccacgccccucuacccugcagaggaaauucccccaguaccaggucccucugcauugcacugcacugcaccaagucgacccucccuucccccaaccucuagaccccuccucacuugcucucucuguucuucucauccccuucccacagguuaugggcacgcugcaccuggcaccgaugcgggcaaggccuucugcauguucuacgccgugcugggcaucccgcugacacuggucauguuccagagccugggcgagcgcaugaacaccuucgugcgcuaccugcugaagcgcauuaagaagugcuguggcaugcgcaacacugacgugucuauggagaacauggugacugugggcuucuucuccugcauggggacgcugugcaucggggcggccgccuucucccagugugaggaguggagcuucuuccacgccuacuacuacugcuucaucacguugacuaccauuggguucggggacuacguggcccugcagaccaagggugcccugcagaagaagccgcucuacguggccuuuagcuuuauguauauccugguggggcugacggucaucggggccuuccucaaccuggucguccucagguucuugaccaugaacagugaggaugagcggcgggaugcugaagagagggcaucccucgccggaaaccgcaacagcauggucauucacaucccugaggagccgcggcccagccggcccagguacaaggcggacgucccggaccugcagucugugugcuccugcaccugcuaccgcucgcaggacuauggcggccgcucgguggcaccgcagaacuccuucagcgccaagcuugccccccacuacuuccacuccaucucuuacaagaucgaggagaucucaccaagcacauuaaaaaacagccucuucccaucgccuauuagcuccaucucuccuggguuacacagcuuuaccgaccaccagaggcugaugaaacgccggaaguccguuuagguguggggagggaaaugggacagaaaagucauuugucauaguugguguuaauuuccauugguccaacucgucuuuucuuauuuauuuauuauuauuauugucaucauuauuacuuucucuccuuccuccuuucuuggucucuuggucucauuuucccccaccuuuccagccagacagagcaggccaaagggaaauacaggcccauccuccucugaaacucacaucugagcaugaagcauggaucuccuccuuccuucccagcagacuaugccuuacauuucucaccccacccaccccaucaucucugcagugguuuucccgggacagaugugagaccaagaccacggagacagagcugagaggauacccaccccaaagcugcacaucacgcucagccuucaaucgccuacccuuaguggugucucugaccuaacuccuuucucuuuuccuaaggacugagugacuguguguguguugugugugugcuucugugugcacgugugucgugacaaaacgggaaguauuagguauuccguuuucuuucccaucacacaucauagccugcuuuuggcugcuuccaaacaaaacgggaagacaaaacccacaagguuuuugauuuaucguauuuugccaaaucaagcauguuucauuaagcaguucuuaucccugaugugucauggccauauuuucuaaaugcuagguucuaaauuauauuaauguuuuuuaggggcgggugggcaagacgacccaaaccaucuuagcuugccaguucagacauuuuuuaaaaagcaugcacuuuguuaaacugguaugcgcuaucaacaaaaaaacuagaaauggaauaauccaaagccaauaacauuaacuuauaaaagacauuuuuaauuuugucaccuccaguuccaacaauuuaccaugcaacuggaauugucaggggaaacgggaaaauuguuggaaccccagaguaucuauuucccucuuauugaugauuuugugcagcaccuacccugcauaaauaagaauuauaguguuggaaugcuugggugagaauggguauuaguauguggcugugguuccuuuuccucaugaaaauugacagggcauuccucauuaaaaauacauaucuauuucaagaaauaucgucucuaauugcauuugauuuguaaauaggguaaaguucacauuggucucaggaagaguuuagaggcaaggagcuaugucuuggccuacugggaacuugccaaucucaggggaaaauuuugucugaguaguguagaaauuccucccuacucucaauaggggaugaccccaaagggaagaccugcuauccucuugggggagguggugggguaguucaggcuguagaauauggcacaguggaggcucuuacaguaacaggcuuaaaggacaguuugaccuccagauucacugaggggacuuuaauuucccucauuaccaucccugccauuuucuaaaaaucacccauucauccauccucccauuccucuuuuguaaaugaaguucauggcucuugcauggaaauggaccuuggcuauacucagaaggaacacgguuuacuggccugucucaaggccccaacgagaucucccagaaaggaggcuuugcucccuagaaagaguagaccuacaggauuucuuaaaggagacaacaccugaaugccaccagucccaagcauuugggccaaugggcugaaacacuggagcauucaagacuccucugaaaaggcugugcauguacuuuaaugcuacaucccauguugaaauuuccccuucguccaggacacagggccuucgaaggagucugcgaaccucagauucucuaggccaaaguugacaguucucaaccuucaaggucuuuauugauucacuuguuuuaagauuuuguuuaaugggaggcccuacuuggggcucuaaaaucuguccagagaauagcagcaguucaauuuuuuuuuuccucuuggaugagauuguugacucuagggggucagagguauaaaagcccuaaugcauuugcagaaugcuuuaugcuucagaagagugugccuggaauaaaugugggguucucaugaaaaccuuuguaagaggugccuucaaaugguuggggggugugaucugaucuaugacgacaccaaggcacugagagggugauuugcucagugucacaggcuggcuguugacagaacugagacaggugucucagucuggagcccaggagaguccaaggagcugacuucacaccaccauguccuaacucagcccucggaggagggcgccugccuuuuuccccacugggggcaugcagcaggcccuuggagcaaauuaaagggacgcugagaccacccugcauacagagcugguuucuccacuacacuaucugugucaauuuggucauauaggagccauacuucugcuugaaugccucagguaacagagcuucucuauucccaggaacuauagaaaacauucucucuucuacaggauuaaggauuauaggaugaagucuuuucuccucacaugaccacugacauaaguaucugaggcaacuuguaauuuaucuuggcucuauuucccuccuaugucuucucuuugcuaccagcuuagcccuuugaaggauggucacugagucuuucaaaguuaaacauccuuguuuauggucaguauuuaggggauggaggcaaaucuugguuuugcuuggugauguucauuuuuugcucagaugguccaucucuucccccugcuguggucucuggccaaggagauaucuagguauagcaugaaauggucucagaguggggagggcaggggccaaguuaaggguucaggguucuuucuucucuuaauaaaacagcacuaaacagagaugcccaacuccuaccacucaaucagcauuagaaucagauccucaaagccaggaggaagcuugguccaagucaucucacugagcagccuuuguuuucagacgaggacauugagguucagagaaggcgaacacuuaucuagaggucacagagagaggauucuaggucuucccacugauuucucuaccauguuccuggcuacuucuguugcuauuuacagccuucugaagaucucuuguugcuggacaauuuuaguuucuuagccccaggucucucuuccucccucuugcaccugguaauuucuuucuuucauccaagugauuuucauacccuucucccaguuaaccaugcccauucagcaagguggucgaagucacagcaggcugcuuggauguaggguucaacuucuguuagaaugagcucaggaagagccacgugcuaccagaaucacccaaggugagcccaccagccaguaccuagaaaucaacaugccuuguagguauuuagggaucaucaguaccaccgcccaaccuuccuccuauauuuggaguggauagaugaagauugagcacucuuaguugaaaagaguucaagugagaguaauaucucuaagaccccugggggcaacacuugcuagagaccauccagcuauaauccucauugcacccauccuggguggaaagugcuguguuggccuucagccuguuagacucuuuuacguaggacugaaccaaccccucuggguuuugagauacuugguugucccuacagcuaguaucagaucuguucuuuccaccugcacugcuucaucuugaaauccuggcaacagccccuuaagcacagcgagcugccuggcucuacaugugaacccccuuggaagcaucugcgcgcucccacugugcauggcugauugggaggggaaugccugcauucaggcauggucacagcagcucauuugcagcccaggauucccacugggguccaucauccuuucaggagaguuggcaaauggacuuagaccacuguccacaaaagccuccuugggaggugcucauuaaaaccccacccaucaaagggagggagauugaugaaucucagcucaccuguuccuuaucugugcacagggccuuaagagaacauugggacagcaugagaagcuugcagauaagccuaggcaggucguuuuucucugccucauccauaucuggaagccaauggguccugauucucacugacaaucacuugcagcuggagggaagaacaggguuucucagaggccucccuugucugugcacauuggccaggagagggaggugagcaaggagaaaaugaccaaaaaaccaccaucacugaggcuuauggcuccauuucuuuuuguaauauucuuuuucaaaugacaggccccaagauacccuuugaagcccucugcagaggcgccugccccuguccuaucagugcacuggccccgucaucagugaagcacucuggcaaacuguggcuuuguucuggaaguggagugacuuggggucugucccaugcaggccagcugccugugggucuaaaguggguuuccuccagagucguggccagcacagacccuggaaacaccguagaugaggacaggauggcaggcaggggaccuguuauugugcugugcuccacugagcuccuggaagucauuucacucccugggccucuggggcuuccccaucaacacaacgagacagcuugggugagauuuaugggcacuuagcacaaaaccaauuugacccacaaaagcauuuggccuggauguucugaucccugggcacacuugaagcuugagccacccagaagaaagccaaaaaucacuuuguuuggcaggggauggggagcuggggaagaugaagagggaccggcaauagcagagagaaccaugguggucacaaaccaaggccaggugcauucugggcuccccaaagcgcugagcauaaauccauucuaugugguucuuucuugaccacaccugauagaggcugcugauucaggaaaacagcaaaucuaugaccacggucccccacacugaccuucuauguugaagaucccagaauuacaaagaaugguccaaugagcuucccuagaccucucgcccagacccccagccucaauacuuugccacccugcuccccaacucucacucagauguuuggacaaugugucgucaugucugcaacuuuucagugguucagccaaagaagaaauuguccgccaugaacaagagcacucuccuaccuaacggugccauugucacgccuaagaaacauucauacaaucuuauugucugauacagacuguauguaaauccccaauugucccaaaaauguccaagagcuuauugagucuaaaauacaacccaagaucaccucccauaauugcuugucuuguuguuccagacuucccccaaauaggacguccccaucaccauuucugucuucacaauguuggccuuuuugagaaguccuggccagggucuuauagaauaaugcccugugaucuccucugcuuguuuccucagguuaagacaguuuuggcaaaaaaaacccaacagcguugaugucgagcagccaugauuuaugcauuugauguuuggcucucuggggaccucugugguaacugcuuucauuguggauaaauaagucauauuaaauguuguuuuccucuguuaggggaacuaacugcacauucaagagaggcguccguggaugcugggucucacugccaaagccgaacacggcuucgggauuucugccuucucaaguggaccucugcugugcugggcgaaugcucuacucauuccccuacacaacuguggggaugguccagcuacacauagacaggaagcccagagaaacgcucgaugugaggguccccgcaagcccgucgggcucuuucggcaccuggcccccccaaagcuccucaacgaggaguagagacugccaagcccuuccacucauucaucaucauaaaaauguaacuugcuauggcagccucuuggccauuaagggcuauacuuugugaccucuguccuugagaucuuugcucugacaaguucuauagccuucucagugcugcuaucgugacgcagugucccugcuguggcuaaguaaccuuucguuuugaucaagauuuguccacgcagacuccuaccucugcgccuuugcccgugccguucccacuaccuggaaggucuccccguugcucuccagcuuugagguggagacagagcaucucacacuuccuuuuggugucuccugacccuuuugcucccugcuggacuuggcgauguccucuucugggcuccccuaguccuuguuuugguugugagcgaccgcaccagggagcaaaccuucuauggccccggccacaggagcagcaagcacugggcagugccccagacggaaggaccaucgcgagaauaaaggcacugagaugucuggcaucuugcccaaauggccacuuaucaccgugauugaggcacgucuuaacuugcugaaguggaaacaggguaacucaaugcacgccucugcaccaucccuggaaaccaauccagaucuaugagaagaaaacuggucaucauagcacuggugauucaacggcaccugccuggcaggguggagugugccccauacaacagggcuggaagcugccacgccagguauuucucauaaggccgguacagggauggcaccagacuaugggagcauacuugugaugucacucugaagaaguugggccccgugaugggaaugucaucaggaaacuggguccacacuguuuucuuguggcaacacuucugguggaggcugcgaggggauggggacaugcaccaugagugacucaggaacccccagccucuguggccuggcuccugcccaccccuagcucuggggccuugagagaggcaagcacacgcucuucucgccuccagagagcggcguggggguguggauacugcucaggcccuggcaucucgcacgccuaggaccagccucugccauucacagguggguggugguuuugccucucugagcuucaguuuccccaccuuuaaauuggagauuauacauaacaccuacugcaaagagugccugugaagacuagauaugcugugaugacauuuaauggcaccugcucugugccaagcacccugacaguguucuuauacauguuugcauuucucacaaaagcaaggcccaugucucccagaggaaguuacucugggggcauuggacuugaaaucaaacuauggagaaaaaagugaucaagucugguugaggaacucaggcagggcuucauggaggaaauggguuucggaaaucacugaggcgagccuuagaggagcaaaugggugcuauuuuaggcagagacacagcucaggcaaaggcaugggccaaggcccaggggugcgacagcacagggggcacagauuccaucccaccgucaguggaauccugccacucuugggagacaugacacagcauaaaucucaaggcccuccacaagcuggccacauccuaagucauucaagccacucuucugcucaagaaccuucccugacucccuagugcccacaaaguucguuuauguuaagguccugcacucuaaccacccuagcccgagucucaggcuuucagggaggcacuauccaucuagaugucccuccuggguccuccccccauaauaaaauucuaaaaauagauccuggagucucaccaaacuugaauucuguggcauccccuuguuugggugggguuuugacaggcagaggacauuagcuugaauuugcauauggggaucuuucuggauaagaucuuggucuuucacuuaagcauccuggggucuugucuugaugaaaucuucugcugguuuuaccaaagacuagcaugaaacuaacaaaaggaaaaugcuguauaaaagaaauucuuaagcuuacuuggcaugaggaacuuguuuccugauugauuucaugaaaaacagugaucuugacucccugcaucugugcccucugggacugaagcuggcuaaggccuugugggcacuuguuccccucaccccccaggagaugagaccuaugggucugucacccagcacaggguccucugagggugucagaugauccaggagugccuacugucaaggugagugcuggugacccagagguagcagcuccuggugagaagcucugugugcaaagcuguucccaucaggacuuagaaauaugagcuugauuuugaaaugaggccucugggugguggaggcugagggagggcagaggcuggggugagggugggaugauguacaggaaagaagucaagucuagggaacauggguggaaucaacacucagauuuugucuuugugauuugcugugugaccuagggcaagacaucccacuccucugggccugaguuuucuaacuuacagacuaaagggucuggccaagcuaccaaggcccacuccacccugccccaguguccaccauggacaggacgccaguguggggaggacuggcugagcugacuucagcugcauuggaaaauauccccccuccaccucccccaacacccucuguugcaggugacucucagaugcuuuaguuuuaaugacauauggauccuuaauuaaccaacagcccugugcaaucuuugcuuaauuucuugguaggcucaccucccguccucaccacaugaggugcccugcucuaaaggaagaaagccuuagccaguugagcugugagucaucaguaucugcagagcagcccacaggccuggccccuggagcucacccuuccuggugagagaggggccugccccugcccagcauuuaccuuugggcuuggccugaagcagcuguuccacccugccaugucuuccucuggauuccucacuccaggguucucuuugcuuccugggagaauaugucccccuacccccuucugagggccacuuggcccagcaaagggccuugccucaggucagcuuagcucagcuggggcccaaaccucuuagacuugcauauaguguagcaccgugcaagugaagauguuucuucccgcuggcacacucacucuucacgcuagguagguggggggggggugggggggcagagcacccccauuuggcauaugggguaacagggcucagaaaagcggcagagcuggaacuccaagucagguguccugacugcauauuuccagguaccuauccugaagcucccggagcggggcgggguggggugggaugggucccucagauugccaugaggaagggacauagauaggggcaugccucaggaggaagagggagggggugucaucuccaggucaaucaaauacauacgcggg

SEQ ID NO: 12633 - RNA, 18520 nt, Homo sapiens
acccaauuaaggacguugugccaguuuacuccuacuuccuuccuguucacugagcuuaaaguggguauaggcgagaaugccaaauaauguacauaaaaugccaagggccugauuaauggacaguggauccuuaaauaaaacauauccuccgaauaaaguaaugcagaacuugaaguguccgaacauguuauagcugagguuuuuggauaaggauaaaaaggaauaacaagauagauguuaauauuuacacacacacucgcacugcauaaaacaacccaaaagcagcccaucagauguaaagaacaaugggaccaggcgugguggaucaugccuguaaucccagcacuuugggaagcugaggugguggaucacuugaggcugggaauuugagaccagccuggccaucauggugaaaccuugucucuacaaaaaauacaaaaauuagcugggcgugguggcacaugccuucaaucccagcuacuugggagccugaggcaugagaaucacuuaaacccaggagguggagguugcagugagccaagaaugcacaacugcacucuaguccaggcgacagaacaagacugucuaaaaaaagagaauaaugggaacuucuuaguuucuucagguagguuuuagcgauugauucaucagagacacaagacugccucaaccauuccuacugaccuccaaaaaagaaaagggauacaauauaaaaggaaagaccuucaaacaagguccagggaagguauuuuguacagcaauuuauaauuauguuuuacagugguguuuccuugggaaaugaagugagauauguaagguaccaaagagcuaacuugaguuaaggagggaaaagagggagggggagagggaguaauacugagcaccaacuauacaccaaacaucaugcugggcgauuuacaugaaaucgucgaaguuaggcaucacguuuaccuucacugcaggcucacucuuccuauuuacgguuguagaggcucagagauuuuaaguaacaugccccagauuacagagcuauuaaguagcagagguggaguccaaacaugaaugggucuauuuaacuugaaagcccacguucuaauccaaaauacugccaguaacaugccacuggauuaagauuuuuccaaaucauuguucauuuaaaaagcaaacuaaauacacacacacaccauuuaaaaauuacuuguggccaggcacgguggcucacgccucuaauccuaaucccagcacuuugggaggccaaggggcguggaucaccugaggucaggaguucgagaccugcuugaccaacauggagaaacccugucucuacuaauaguacaaaauuagccgggcgugguggugcaugccuguaauaccggcuacucgggaggcugaggcaggagaaucgcuugaaccugggaggcggagguugcagugagccgagaucacaccauugcacuccagccugggcaacaagagcgaaacuccaucacacagacacagacacagacacagacacacacacacacacacaauuacuuauauuuaaauauaacuauuuuuucuauauaaaugaguacucucuuguucuucagauguaugauguuugccuaugugcuuuuccuaacuacaacacuagaaacagccaccacucugugcauuaguuuccucacuauauaaaagggguuuaccucccacgguuauuguaaggauuaaauaaguuaauauacacaaagcuucuagcauauaguaagcaccauaugugcuagcuauaauaacauuaccaacagcaguacuuauguaucauaaacaccugcuuggugcuugacacauucucucaaauacaaccacccaacaucauagaucguacuuccuccacuucauacauuucauaagugaucagagugagacccugagaguucccacacuagucaggcccacagagaguggcagagcucaguguucacaccuggaccugucugaccuccaagcccaccuaagcagccuggagguucccgcugggcagcagcagugccucaggagagcacaggcugcgucaccaggggcauaugguggcuugaucccaugaaggugacuuccugagacacagaggaucuucccaagguuguuggcaauagucauaauguuuuauuuucaauuaugagcuaucuucaugugcacuggcucuaacacuuuaaauuucuuuacuccucagcuucucuuuuaaguauauuuauacgagaaggaagucaaauuuaaagaaacuauuuaugaauccuuuuguaaaagcaacaacaaaagagcagucuacaugugguauuuccaguucugcacuuuacuccaggcaggcugucaccccaaccccaacccacuuuacuccaggcagaauguucuggucaaacccagugcccuccaccucacucagucccucaauggugaccagucuccuugaacuuggccugccagcggcaucugacacagacaccgaccccgccuccuccuccuuccucugguucugugccagucuccuccuuccuuccaccucugacugcuccuucucauccuccaccuaguuucucaucucucugaauuccaaauacuggacucaaacccaacacucagucuuuggacuuauuuucuucuacuugucugcuugguaaucucaacuagucucaucacuuuaaaccacagcuucauacugcucacucccugugaugccuccugcugagacgucaccuuugaacccugacuuguuuauccaaaacugagcaccuggcugggcacgguggcucacaccuguaaucccagcacuuuggaaggcugaggugggaagaaugcuugagcccaacaguuugagguugcagugaaccaugaucgcgccacuucacuccagccugggugacagagcaagacccugucucaaaaacaacaacaacaaaauacuccccgaacugagcaccuuaucuuccuccccagccccaaaccuccuucuggguauccuaucuuaguugauggcaacuccauucuaccaggugcucaggucaaaaaccauguaaaucagccuuguuuucucuuucuccacauccaacucggcagcaaaaccuguuggcucuucuuagaaauauuuccagaauccaaucacuucuuacuauauccacugcuaucauacugguagccacuauuacuucuaaauuagaauaucguagcagucuccugaguuuccugugccucuuucaguccaguaguucucaaccaugggugauucugcuuugugggcaaucuuuggaggcauuuuugguugucacaacugggcaaaggguauguaugcuacuggcaucuggugguagagcccaggccugcugaaaacauccuacaguguacuaaacaggccugcacuaagaaccgucuagcccaaaaagucaacagcccagagguugagaaauccuucuuaagucuauucucaacacaggaguccugagugauucuaugauuuauuuuauuuuaaaaaacuuuuuguagagacagggucuuacuauguugcccagacuggucucgaacuccugggcucaagggauccuccugucuuggccuuccaaaguguuggaaugacaggugugccauugugcccggcccacugagugcuucuauuagaauguauguaaaaucauguuacuucucugcucaaaaugcuaauggcuucccaucuuacucaguuuaauaguccuuacauaaacgcccuacucaauucaguucuguguuacuucucagccuaccacauucccuccuuugcucaaccugcucuaaccacacaggcuuccuugguuuuuuuacggccucgcaccugcuguugccucugccuggaauguucuuuccuccugaucugcauggagcaacugcauuuccuucaggucuuuacucaaaugucgucuucccacugaugccuuccugacuagcccugccuagaacuucaaugcugucuaugacauuucacauucucuuccccgcuuuauuuuuacuccuuggcaguuaacacuauccaacacuguauauaaauauuuaauuguuuucuauuucuagucuuccucaccagaauucaagccugugagagcaaagacuuuugucuaugugguucauuacuguauccccugugccuggcacacaguagauguucaguauauaaauauuuuuauaucaaugacugguuuaguggguauucaauaaauacuuauugaauaaauuaauguuuuaaaucagagcacauauuuggaugccuugauuggguaguaugauguacaaauuuggggacuagacugcauggguucaaaucuggacaucccauuugucagcugugugccuuaagugaguugguuaaccucucugugccucuauuuuuucuauaaacaaaaaugacagacuuuaccucacagagcugcugugagaauuaaauggacuaauacauacaaaauguuucuaacagugucugacacaaaauaaauauuuguuaaguauugguuuucuaaaaaacuuaucguuguuguuuuuuauugauaguuggcaaauauccuacuuguuuacuuccuggggaaauucauuuguugcauuugccuaagggugggggcagagugaaaugugaagagaaacaggaugacaagcagaaugguacaaauggacaguugaauuugaccuuuaacauauaacuucauuucuauuuuuucuuuuuuugguagagauagguucucccuauguugcccaggcuggucucgaacucuugggcucaagcgauccuccugccucggccucccacaguguuggaauuacaggcgugagccauggcacccggccaaugacuucauuucuugacuugaaauaauauugagaaaaacaggcacacccauauccaaauaaguacaaacacauacuccauagccagaugccaguggccugaaauuaucuuuuguuauuuguuaaccauuccucuacuuuguuacuagaaauaccugaaaauuguuugaaaauccaaaccuccaccucacuauucauucaaaaaauauuuaaucucacugucuguaagaaaugguacucugaguuaauuuuuguaagggaaaaggucaccuauuacauaagaaaauucagaaacauucaugacacaaaaagcuaacccacuuccucaguucauauuucuuuuuuuuuuuuuuuaagacagagucuugcucuguugcccaggcuggaguacaguggcacaaucucagcucacuguaaccuccgacuccccaguucaagcaauucuugugccucagccuccugaguagcugggauuacaggcgugcaccaccuuacccagcuaauuuauauauuuuuuguagagacgggguuucaccauguuauccaggcuggucuugaacuccuggccuuaagcgauucacccgccucggccuccugaaguguugggauuacaggugugagccaccacacuugccccuucaguucauauuucuuuaaaauccuuuaguggguaaagauacaguaaaaggcuaaaaauaacucucucuacucaauuuaggccaugcaauaguuagugugagauucaaauaagguaaugaauguaaaaguuuuggaaaauauaaaagacgaugcauuucuaaguuauaugaaaaggauacgugacaggugaaguguucccaaugauccaauaaauugauaaguucaccaugaaagcuauuacuccagauagcagcaccauaagcuacaaauaaaccaaaagaaccauuaaugcaaagcacugcaaucauaaucaucaagcaaagauacauuucauucggcauuuuaaaaaauucaaauaucaaccauuaauaaauaagauuagaaagagagggccgggcgcgguggcucacgccuguaaucccagcacuuugggaggccaaggcgggcggaucacgaggucaggagaucgagaccauggugaaaccccaucucuacuaaaaauauaaaaaauuugcugggcgcaguggcgggcgccuguagucccagcuacuugggaggcugaggcaggagaauggcaugaaccuggaagguggagcuugcagugagccgagaucacgccacugcacuccagccugggcgacagaguaagacuccaucucaaaaaaaaaaaaaaaaaaaaaaaaaaaaaagaaagagaauuugggguugggagacaguaagaauugcaaguaaaaaagcagaaugaaccguguuuagaaaaaacguaauuuuuuccacaagaaucaacgaaaaauacugcaauaacauccuuucugugauugugaauuuccagguucauuuuucuuauuaaucuaaagaaaaaguauacauaugcauuauuauuauuguacaucagacaauaaagaaaagcaaaaagaauauaaggaauucuuauaaucccaaccacccacacauuaacaucucggcauaccuccuucgagaucuuuuucuuuuuuuuuugagacggaguuucacucugucacccaggcuggagugcaguggcacgaucugggcucacugcaaccuccacccuccagauucaaaugauucuccuuccucauucuccugaguagcugggacuacaggcgccugccacugcgcccggcuaauuuuuuguauuuuuaguagagauggguuucaccaucuuggccaggcuggucuugaacuccugaccucaugauccacccaccucggccucccaaagugcugggauuacaggcgugagccacugcacccggccgagaucuuuuucuauuaaauugcucauuuuuauucuuuuuuuuuuuuugagauggagucucauucugucgccuagucuagagugcaguggugcaaucuugacucacugcaacuucugccucccagguucaagugauucuucugccucagccuccccaguagcugggauuacaggcccaugccaccacacccaccuaauuuuuuuugaauuuuuugguagagaugggguuucaccauguuggccaggcuggucucgaacuccugaccucaggugaucugcaccccuuggccucccaaagugcugggauuacaggccugagccacugcaccuggccucauuuuuauucuuauuuaacucaauaagcauucauuggauaucuacaaaguuaggccaggccuucugaggaacgcaguauguacaaaguuccugcccucaaagagcuuagaaacuacuugaggacauaauaaaaaucaugaugaucacugcuuacacuuacauaacacuuauuaugcaccaauaauuguucuguuuuacauguauucacuuauuuaauuuucacauacauccacaaaguaguuguaaaaauauuauuccuuuuuauagauaacuuggcugggcacagggggacaaauggguuggaccacuauauacacauacaaaguucuguucaaaucuaucccauaauuuuauccaaaaaguuauagaaucauuuuguuucugaauuuagauaaaaugauauucaugauauaaacuauuaagaaguuuaaguuccaaagaaaacuuaaacuugauacuuggcacaucauuaaaaacacaauuacucuacuuuguuagggucuuuguuacggacuuugaagaauauaaagaagcuaguuccacguugaagaggagugguaagagugggcauccuugucuuguuccaguucucagagggaaugcuuucaacuuuuccccauucaguauuauguuggcugagggucugucauagacggcuuuuauuaaauuaagguauguccuuuguaugccgauuuugccaaggguuuuaaucauaaagcgaugcugaauuuugucaaaugcucuuucugcaucuauugagaugaucaugccauuauuuauuuauuuauuuauuuggagucucacucugucgcccaggcuggagugcaguggcacgaucucggcucacugcaagcuccgccucgcggguucacgccauucucccgccucagcgucccaaguagcugagacuacaggcaccagccaccacgcccagcuaauuuuguuuuuguauuuuuaguagagacgggguuucaccguguuagccaggauggucucggcuagucucaaucuccugacuucgugauccgcccgcccugaccucccaaauugcugggauuacaggggugagccacugcgccuggccgaucaugugauuuuuguuuuuaauucuguuuacauaguguaucacauuuauugacuuuuguauguuaaaccauccccacaucccugguaugaaacccacuugaucaugguggauuaucuuuuugauacgucauuagauucaguuagcuaguauuuuguuagggauuuuagcaucuauguucaucaaggauauuggucuuuaguuuucuuuuuugguuguguccuuuccugguuuugguauuaggguaaugcuggcuucauauggaaaaaaaaaaaaaaaguugaguugacacaauccucuacuuugagucaaggaugccuccuagggacauuaaggaaugaagaugacuuuccuucacacuaaauggccucagccugcuguggucuugguuucuuugccuuuuuuuuuuuuuuuuuuuaauggcuuuucugcugcuguccucauuuuaaaaccuguuagaaggcuacgaaaaaaauccucucuccuuguaguauaaggucucuaggcugcaaugguuugaaaccagauaaccaggauggcuaggacuuuugcaaaguggaaauauuaucugauagaugguccaaugaccucuacuuuagaaaaaaaguguauaugguaaaauauauaaauuugaaauaacuacuggucuacuuaggggaagcagagcggagcacuggagaacacagacuuuggacccagaaggcauguauccaaauuguguuucugcuuauuagcugugggauugcgagccaguuacuaacucuuuaucucucgguuuccucaucaguaaaaauaauaacaaugguaauauaguuuggauguuuguucccuccaaaucucauguugaaauuugaucaccaauguuggaagugaggccuaguagaagguguuuggguuauggggcuggaucccucaugaauggcuuggugcccuccccaggguaaugagugaguucuugcucuauuaguucucaugagagcuagcuguuuaaaagagacuggcauuuccuccccucucucucuugcucccucucucgccaugugacaugccugcucccccuucaccuuccaccaugacuguaagcuuccugaggcccucacuagaaguagaugccagcacuaaugcuucuuguacugucugcagaaccauaagccaaaauaaaccucuuuucuuuauaaauuagucucagguaugcuuuuauaacaucauaaaauggacuaauacaaauaguauuaguauagcaucaaccuaauaaaguuaugaagauuaaauaaguuaauauuuacauagugcuuugaauagugcugggaacagacuaagggcuauauaggugcuugauaaauugaugcgaccaacaaaaaagauauucccacugacuguguuccaagaguugugggaacucuugugggaagcaggaauuccugauaaguaagguauuauggacugaauguuuguguccccccaaaauuccuauguugaaauccucacccgcaaggugaugguauugggagguggggccuuugggaggugacuauggcauaagggcagagccuucaugaaugggauuagucccuaugauaagaagagauacaagagagcuugcuucuccucuuccuuguugucagaugaggauauggcaagaagacugccaucuauaaagcaggaaaagagccuucaccaagaacccaaccauacuggcagccuguucucagacuuccagacuucagaacugugagaaaugaguauuuguuguuuaagccacccaguccauuguaguuuuguuauagcagccugaacugacuaagacauaggaggauuauacauucuaacuuaaaauguccccaacgcauuaguccuagcugcuugggaggcugagguuggggggaucacuugagcucaggagcuugaggccagccugggcaacauagccagacacugucucuaaaaaauaaaaguccccaaaauacauaugcccuugauuugccaauuccacuccugggacucauuuccauaggaaaaaaguuaucaguacaugagaacacaugauguacaaggauguuuaucacaauauuguucauagugguaaagaacugggaaaaaagugaauaugcagaggggcuauuacacagacaccggcugggcgcggcggcucacgccuguaaucccagcacuuugggaggccgagguggguggaucacuugaggucaggaggucaagaccagccuggccaacauggugaaacccugucucuaucaaaaauacaaaaaaauuagccaggcaugguggcgcacaccucuaauuccagcuacucgggaggcugaggcacaagaaucacuugaacccaggagguggagguugcagugaacagagaucacgccacugcacuauagccugggugacagagugagacucugacucaaaacaaaacaaaacaaaacaaaaacaacaacaacaacaaaauagacccuggaaagaaugcuuuggagagauuuuuaggagauauuauuaagucagaaaagcaagauacagaaaagcauauguaauaggauuccacuuuugucaaagaaacagauguggccggacacgguggcucaugacuguaaucccagcacuuugggaggccgaggcgggugggucacgaggucaagagauugagaccauccuggccaagauggugaaaccccaucucuacugaaaauacaaaaauuagcugggcgugguggugugcgccuauagucccagcuagggucugaggcaggagaaccgcuugaacccgggaggcggaguuugcagugagccaagaauugcaccacugcacuccagccugggcgacagagugagacuccaucucaaaaaaaagaaaagaaauagauguuuaauugggguguguguguguguguguguguguguauggauauauacggcauggagaaaaauauggaagaacaagcacuuagaaaguuaacaugacuucaaggggcacggauuaggggguaauggaauguggaagauuaggggguaauggaauguggaagaguguguggcuaggaaggcuggggaaaaggaaucugcaauaaaaacagcaucuaugauaucauuccauaucuaaaauuauacacacaugcauguguaccuauguguuuauacaaaagagauccaugaaaugauccucaccaaaaugguaaagguaauuaccuuagugugauaggguuccagaggcccuucacuuucuuuuguuguuguuguuuugguuugguuuuuuuuuuugagacagggucucacucuguugcccaggcugaaaugcaguggugcuaucuuggcucacugcagccucgaccuccugggcucaagugauccucccaccccagccucccaaguagcugggacugcaggcaugugccaccaugccuggcuuuuuuauuuauuuauuuuuuuucugagacagagucuugcucuguggcccaggcuggagugcaguggcacaaucuuggcucauugcaaccuccaccucccagguucaagcaaaucucaugccucagcuuccugaguagcugggauuacaggaagcaugccaucacacuuagcuaauucuuuuuuuuuuuuuuuuugagacaggugugaucccagcucacugcaccuccaccucacggguucaagugauuuuugugccucagccuccuugaguagcugggauuauaggugugugccaccacgccuggcuuauuuuuguauuuuuaguagagacgggguuuugccauguuggccaggcuggucuugaacuccugaccucaggugauuugccugccuuggucucccaaagugcugggauuacaggcaugagccaccgcacccagccucagcuaauuuuuuuguauuuuuaguagagaauggguuucgccauguuggccaggcuggucuugaacuccugacaagugauccacccgccucagccucccaaauucccaggauuacaggcaugagccaccacacccugcccauuucuuaauuuuuuguagagaugaggucuuccuauguugcccaggcuggucuaaaacuccugggcucaaacgaucugcccagcucauccucccaaagugcugggauuacaggagugagccacugugccuggccccuucacuuucuuuauauuuuuacguauguucaaaaucgaaauagugauuauaaagcuauguuuucauuguaaaaaaauuuaacuuaaucuaaauguccaaauuauuugugggcucuagcuugacauggucagaacaguaaccaggcaucggaagacauuaauuguaguucugcuuuugccacugaguagcugccucacucuaggcaagucccuucaccuuuguguaccucaauuucuucaucugaaaaagaauccuuaccuuaccuccuuuuauggugauuaugacgauaaaugugagaauggaucggacauagugcucugaaaacuaaaaauuacauuaauaauggaggaguuauuauuauacuguuucuuagauaucaaaacaauuagaacuuaccaaagcagaaacugaccagggaccaaauauuccuccuucuccaaacacuggcucaaagaagggcacagcaaccagcaacauggcagaugacaucggagccugguaguacagcagcugcauugaguucacuuguaauucaugcuguuuggcuccuacccacugaaaauuaggagauaaaacaugucuggcacaaaagaaauaguaucacauaaucaaagaugcgacaacuagagucacaaagaugggaaugugggguauagacuaggggaagauaaaaugucuaauuauucuacaagauuucaaagaccaguaagcuauaugaaugcccuuuaagcaccauggaugaaaauagcucuauaaauuuaauuucugauaaucuagcuucuucucaauucuuagaaggaggagaaaaguccucuauuuccuucuaccugauccuaguaaauagggaaaaauaaaugcauauaagggccuacaaggauaaaagaucuugggaaaauaagggagaaauagaaauucaggugauuaggaauacagaugcaguguuggacuucauuucuuucuaaaaauggcaaaauuuaaaaaauggaagaccggggccaggagcaguggcugacaccuguaaucccaguacuuugggaggccaaggcaggcagauaaccugaggucaggaguccgagaccagccuggccaacauggugaaacccuaucucuacuaaaaauacaauuagcugggcgugguggcgggcgccuguggucccagcuacucgggacgcugagcaggagaaucgcuugaaccaaggaggcggagguugcagugagcugagaucgcgccacugcacuccagccucagugauagagugagacucugucuaaaaaaaaaaaaaaacaaagacagagguuggggggacacgaugacaauggggcaugggggcagguuagagaugguugccaauguguguggcuugaaaagguauguggucucgucaguugcuuuggaaaacccaaucaaugguagaagagauuuuccucucucuggaugacuuuucuguggauacuauuccucaucccccaccaauacaccuagauacacuggauaaucacuaacccuaaaauaccauaccauucaguagaaacaacaucucaagaccucaaaucccauucguccacaaaauacuucacaaauauaacugaaaaaaaggcuuugaagaagauuuaacaggacuguuuggaucagaucuggcaagaacagcuaggcuuuugaaugacuucuacauacuucuuguuccuguaggucuggguaucuuguuacauaaacucuaagucuauagaaauccaucaagacaaaaauagaagagcagggaauuugaaccauacuccugccagcuuuaacuaagaguccucugugaauaugaaggacaaagaacugauucuucugcugccugcuccuuggggcacagcagcaagcaaaaacggauacagagggugugugcucaccugccuuuccuuuugcagccucuucaggcagccgcgugucuucgccacaggacugccuggaacagcaggggcucucaggccuccacugucccucaaugcagcacagccuggcuccugccaccaccccucuaaugcucuccuaagggcacuaugaucuccauggacauguccagacucccuguggcccuuccugcgagcccucuuugcagaaccugcaaguuuugcuuggaagaacuacccucugguuuguacuccucccucacugccuccugcacuuaacaguuuuuaaggcagaugccugccuuccucuuucaucgcccugacugaugucuuuuacuauuugcugagaucuacugcucuucccucaucgcuugagcauccuuaaccuuauauuggccagucuccuggccaucucuacuuauauaaucugcaggaacuuguuuaaaaucaacuggugccuuuuuucuacaaaugggcuccucuuguguguuuccaauaauugaugauauaaucucccucagggaucagagccuuacuuuccucucucucacauucagucagguucuccuauguuccccaaaacgccccuggagugccuuuuaaccuuucccuguccauucccaccgcccuagcccaggcccuuccugccuguccugugaaguacagguagguuccugacugcucugccuuuuacccuuccuucccucuuacccacccuucauugccaucaguuacuuuucuaaagacaggggaaugaucaagucagucccugucugaacuccucuccuggugcgugcucaauaaagauauacuuccuuagcauggcuucacgacccugacaucugguaucacccacuccucagccuugucuucucacaaugcaccuacugccuagccucaccaaacaaaucaaguucuccaaaaaugcuccagacuuucacacacacugcaaggaaaagaccagcuguccuucccugcugagcucauuucugugugcccuucaauuuaaauuguuaacuuuuccguaaagucuuaccucaccgccccucuuuaagagcugccacuuccuccuugguguuccucagaauuuuccuccuaccuugggguacauaugcuacugugaccagcugucucuuuguguuucuacacugcuggacuguagcugcuuuucaucuuuguauccucaagggugaacauaaugcagaaaagaugucugcugaacgaaugaaugagucaaccaucuuucuacaacucaagcuaauagcuggucacuugucuuuuaacuccuuuuaaugucuccagcaguauaagagaaacaacauagaaauuaucccaagauacugugggcagauacaacuuucuuuaagaggaauguuuugggaauauaccuauuuuguaaugguaccuuuaccacuuacugauaagaaacuguccauuaaucuacaaucauuccuuggucaaucucaugucaaauaucuaccuuagggauauagaauccuuugauucuaaucuauagcaauuuugagacuugugugaacaaaaauggucauagugacagagauggugaguacucugaaucuauuacguauaaggaguacaauuacuugcucuguuuaauaaauugccuauacuaggcaaaaacaagugcauuuaacaagaaagaugaauaggaauguucacuagccucuucuuuuauuuaaacugcuucucugccacuagaaaauguauuucacugcagaauauuuucaaauacugucucugacaugaucacuacuagaauguuuaagaugccagggcucuauuacugaacuccuaaaauuucaaacaagaaugccuuaguuuaauaaccaguggauguuugugaaaaaaauaaaauugguuacacauuuuggcuuugauuccccaugcaggcacacccagaauuuccagaccaagguuuucaguauagagagaauaccguuucacuguccccuacagcaaguuauuuuuucuccacuaaauaagaaucaaaaaccauacuuguuaggauuuuaugguaaugaaguaagugaauccaugaacauauuuuuaaugaauaucugcuauaggcaaggcacugcgcuugcacaaauggaaaaauauucauuaauauaaauuacucuauauuuauuaauauagaguauaauauuguaauaaucuauauuagacacauuauuaaaagccaauaaacaaguuguaacagcaguauaauuuuugaggcaaaaacaucuaaaaaucugaaauuuuucauuacuguucagauuucuggaaguauacucacuccuucacaacaauguuaaaaguaaagaguaaacagaaaacauaacaaacuuaggaaguaaaaagucuuacuagguauuuuguaaagauuucccagaaaauaacuucaccccaagcugagacuguuaagcauggauauuauacacuuacaaacagguagguauuuggugagcaucacacacccaaguuucucugucuccuuucuucucuucaccuugagucagacaacuuaugcaauuaugcuuucuucccaacagucuauugucucuauacuguauuuucuaaaccuuggaauacagcuucaaaauuuaugaaaucugcuaaaaaggcacauaaagaaaaaaaaauuaccaaccacuugauaaagggauguaacuaaaacaccaagagcagcaaacaccauuccaaggaaauuaaacuucacaucguaauaagaauuuaggauuacaccuaaaguuauaggaaucuguaacgaaaaagagguaaauguuguucagauuaaauucaagagacaaaaauuuaguauuccuuucacaaugucuuacaaggcuaaugauaaacacauaacugggaaacaaugaaccuguauaaauguuuucuguuuugacuugggaaaacuaguuguuaauccuauuuccuaaacgugaaauaugacaaaucuauauugauauucacauuuaauuccauucuaaauuugugguaaauauauugcacuuugcaagaaaauaccacaugaauacaaaggugaguaaauggauccccaaacuagugucuaaacagcauaagcauaaauauaaaacaauaaaagcauaaagaccuuaaauauaaggccaggcacgguggcucaccacuguaaccccagcgcuuucggaggccaaggcgggcagaucaccugaggucagaguucgagaccagccugauuaacauggagaaaccccgucuuuacuaaaaauacaaaauuagccgggcgugguggcgcaugccuguaaucccagcuacucgggaggcugaggcaggagaaucgcuuaaacccgggaggcggagguugcggugagccgagaucgugccauugcacuccagccugggcaacaagagugaaauuccgucucaaaaagaaaaaaaaaaaaaagaaaaagaccuuaaauaaguuacuaagugcuaaaauugaguccaccuccuuuuauuuaaagaugcagacagcucuaaaguauggugcugcagacguuuugagaccuacuuuaugcuacaucuuuucacguuuuaucauacacgauuugauuccccugggggagaaaggcuguuuuuguuugagcuuuugcagauauucugauaacacuggacuguaccacccaauacagcuuuuuuucuuaucgaucacagcauuuaacgauuuccaucaaauggcagcuacuaaaauucacacaugcccacucuucugggcugacaagauggccuuuucccccucccuaaaauaagccuaaaaguucacaugcccacagaugacucauuuguggauuucaagaugaagggaaagaccagugugcguucgaauuucccggggccagugcaggaggugggucgggagagcggcgccuugggaagcugaagcuacucaccagcgugagcuggauucugguggagaagguuuucugguagcagaaggucuggauggcuaugaucaccggcguggucauggccuuggccagcugauaggugccuaugguguuguucugcagagaaagguuagugaagaccacaaagccacagaagcugagggccaggaggaggagccuggagggcggcagacuuuugggggcaaagauguccagcuucuggcagauauacaagcccagccaggugaccacgaagugcaccagggucaggcucauguuggggaagccgugguacacauaaauccauuuguugaggaacacaaugcagauggacaccagcagguugaacaggagcccggcggcgauucgccaguggccccgcacucgguccaccagcaaugccaug

SEQ ID NO: 12634 - RNA, 11577 nt, Homo sapiens
uucagagcucauuccuccacucuggcuccacuugcagagacaggcccccuucacccucccgcuccugggggagguagucauggcuguggggcccuggaaagagagaaaguacacugugucuuccuuaccaccuccucuggcacuguccccacccuggcccagccauaccugagguagaggggcugagcuugcucagaccuugcaguaaauucugucccuguugcagguccaguuuggcagggaagggacacccgguauacccuccguuuucuuuacagaacuccaggaaucugugggguacagaggagugccagcagagacuggaggcuaagccacgguccugucccaucugagcuguacuugcucaaccucuggaugucauuuaacuuauaaauacaauagugaugcugugaaaauggacacaucugaggauuaacugagcgauaagcaagcgcuuaaaaaagauccaccugcccuaggcaggggcuguggccacuaagagggagaauggggugggaaugcucacacuuuccagucagggucauggcccaggagaaggggguuccccacgaugaugagcagggccuuggcccgggucacagcuacauugaaccucuggaaggaagaagugguguggucaugggagggaagagccccgagaauggaagaauuccugccaccccgaccagcccucaaaccuugggguucuuaaggaaacccagauuaaaguccagauccagcugcacaaagcucuggcugcuucgcacgguggagaugaggaugacgcuucguucuuggccuuggaauucuucuacugaacccaccuaguggggaaagaggcagggccugagaccagccaggggugucaaaggggugcccuaccccagggagcuugccuuccaaggaggguacagagaggucacugggcaauuguagaucagugagugaaccagugcugcgacacggcccagggaaaggggaugggagguaggcuguggaagcugaaacaugaagguugaauccugcugagggcuggggccugcaaaguguucuaaggaaagaaaacagcauugcaaagaacacgggaacucagagcagugacuuucaaacuuuccugaaaacaaucacuaaguaucuguuaagaauauacaacccugggcccuaacccggacccccgaucagaauuuccaagagagaggccuguaagucuuagagcaguguuuucaacccuggcugcauauuagaaucaccugagaagcuguaaaaacuaccagugcccuggcucugccccgauagcuguaugagcugguggguggggcccuggcaugggggcgggguauuaaaagcucuccaggugauuguuaucugcagccaguguugagaccagaaccuuaagagagaggcuacuggggguggggguggcagcaucacaugacaggccacggaauuuggacuuuauccuuagggcagaggccucaaaccugccucagucuaagaaugacaggagguguuuguuaaacaugcaggcuuccugaucccaucccagacccuuaaguuggaaucuccaggagugagaggcucagggagagcucgagcucuauucaaggcagcaggggugggacggggacgugggcuggaguggaagcuugaggaagucucuggaagugggcaagugggggcacacggaaggcagggagugacuguggaacagcaugucaccuucaaguccuugaugucauccaguccucgaagcucccugucaaguuuggugaugcaguaacggauuuucuccaccuggaaggaggggacaggugccuuucucucgugccauuaaccuaaugcaagagggagccuggcaggaggccagggagcuggggaacaaagggaggcggcagcugaccuuggugcucuucugagauacggagccagcagaggccuaagcuccuggagccucugccuaguggucuggauauuaaggagguaccaucugggggaggggccccacccuugcugguaacugaggaccugaccuguuuccgguacggggagaugacgcccacacuucgagggcucaggcgagcuuugcccuucuuggaggagggggccaggagcagcuucagguaggaagucacuguggcagccucuucaggguugaagaaggaugggcuguugccuucacgcucaucuuugcccauuacgccgugaaagaugaugggaaagcccuggacauggggucgggggaaaccgucagccagaccacccucccucuauucccucccuucccaaacccuuccagagaguaagagauccuaggccaaggugacaaagggaggggcugcaccuucagugggagggaagucaggguacagggguggggccugcccugcucagccucaccugucgagguaggcccgcccagcggcagaagcguucucgauccacgacaucagcacaggccugcagcuccccuucauaauagagcugguuaggaauguccaggauggugggaugagaccugggaggccggaggaggaaaagcaagaccaagggucagauucccucugcccuacaggggcuccgcucuacccacucugggcccacacacaauagccugcuaccccgcuggcucccuggauagcaggacacuccuccauaauaucugcugccaggcacuguaaaccacagaaagcagaaccaaauauaguuccagagagcaucuaguccagggacuccacagacccaugacauuuaaaacuaaauaauuaggggcccauuuucagguuucaaauuuaccaaggacaguacgaaaccaaauucuccuugacuaucacguuauuugaugagaccauguguuaaaucaaaaaauauaagcagugaugacacaauaacuaacauuuauugagcucuuagugacagcauaaaacuuaucuaagcauuuuagauggcugaacucauucacuaaaaguauacagcucuuuaauuugaauaacaauagguuuaugaaaaaacuguaucuucccuauuuuucuuucuuuuuuugagauggagucucgcucugucacccaggcuagacugcaguagcgcgaucucagcucacugcaaccucugccucccggguacaagcgauuauccugccucagccucccaaguaacuggaauuacaggugccugucacuaugccuggcuaauuuuuguauuuuuaguagagaugggguuucaccauguuggacaggcuggucucaaacuccugaccucaagugaucgggggugggagccugaccuaccuuggccucccaaagugcugggauuacagccaugagccacugugcccgaccuccucccuauuuuucuuaucucuccuuggauugccugaaaacuucaucugggacugguaccagacacacccuagccucuaggaaccacugaccacccccuaagaugcagauaagcugacugguguagugugaaaccacuggcuaagucacgcagacaacaagcagcagugcuggggcuagaaaaaccuccugccuuccaguuuagucuuucugcaucacacaaccucugagcaacaggacugacagcaagccagacucuccaguggggucugcaugcaggaugugaaagcauaggauauggcaggggaggcaagggcaugggaauaccuguaguugcggagcagcuugguuaugaacugggggucauagccaucagggcccuucuuguacagggaguuguaggugagcagccgcuccagcagugaguaucccaguccaugcuucugggucaguggggaacgcagcacaggccccagcugccgagggucuccugccagcaccagcugcccuccuggaucaccuguuuccuuuacuuccaucagcccugggaagcagaagaggugugggaagaaagguaaguggugcaaccucucugacccacacaggguguauaccugcagccccaccugagucccucaccugcuauagcuaccagacucucaggcuccaugcaguggccagccucaucgaugaagaugugugugaagugaucaaugggaaacugggccgagaccaaccugggaggugucaggccaggcaggggucauauccaggcacccaacuaccaaaccugaaugcuuucccaggcuggcuucucagcacccaccaccccacuccggaaaccauucuuccccauuuccccagcccgguaccccuuuaauuacacuuacgauucagagacacacccacacacacuccccaccugccggcagugaugagggugguaauuaagacccgguauuccugcagcuucuucuuggcgggaaauacauacucccccuucuuugcgucccaguugcagcagggcuguggauugugaagggaccagaggaaucagcuuggcuccacucauucccaccgugauucuggcuguggguacccccccucaaacaauuauuuuuauuuuuuuuaauugagacggagucucgcugucccccaggcuggagugccauggugugaucuuggcccacugcaaccuccgccgccuggguucaagcaauucucgugccucagccucccgaguagcuggggcuacaggcacgcgccaccauacucagcugauuuuuuuguauuuuuaguagagacgggauuuugccauguuggccaggcuggucucaaacuccagaccucagguaauccaucugccucgccccucaaaguguugggauuacaaguguaagccacugcacccagccccccaaauguuuuauccaccccccucacuuacagacaaacugaggcccagggagggguccuguccaacccaaggucacauagcaaguaucagaauccaggucuccuagcuuccucgccucagugucugcccugagagccuccccggcauuugccauucuuuggcccucugcacuucccuaguaccuugauguccucagguaccaugcggaugucccugcugggggccaggaggcgguagauggagcuaggaagguggacccggagccuuugacagaguaggucagccccugaguuggauggagcgcaggccaagaugugggcuuugggcaagugcuucaccaccugagaugcagauaagcgcagugugggaggcagguuccugagacucagccguacccaggcuggggcagggcaagucuaugaugacugaaaugugaauggugacuccaagauucaugcagugcccuacccguacaacagugcuccacagccacauuuacccuaacuucccacuuccccaauccccacccuuuuuuuugagacagagucucacucugucacccaggauggagugcaguggcacaaucgcacugcagccucaagugcccagcuauuuuucauauuuuucauagagauagggucuugcaauauuguccaggcuggucuugaacuccuugggcuagucuuccccaagugcugagauuacaggcaugagccacugcacccggccccuaccucucuuucugauggcugcuuagaagcaggagcauuucgggagugggaaggaacuagaaucuggggacaacugcuuggugcugggggaaucagagugcaggccccagguuugugcucagaccccaccugcuuaauugccuccacuaacgugacagucuugccggugccuggaggcccaaagaugauguagggggcuggacggguggugcccguaacaaugugccucauggccugcagcugcucuggguuugacuccagacuccggucguacagccuggcagagggaccaggaaugugaacuugaagucauccagugacccagaggccucccugacuccacccccugugcccacacuccaaguggcuccagaagcucccugcccacagucucacuugaguuucacaucugagggcagcagcgggacgucccgaggugccacaggaaagagcaugggccacagcagccagcgcccugucagcuccagggcacggugcuggacucgcagcggcuggcgguugaagguaaaguucaccuugaaggucagcccauccacaaagcggcucaggaggcuuugggcagagagaggugguaagaguuuguuggggcaggggaggugggcaauaaagggccagaacuuucuccaccaaccagugucccaaccccucuuuccaagaccucuaugcaaguucucuagaagaggaagcugccguagcaucucaggguaccccugaggaaaagucuccugcucugccccggggucucauuuaucucagggagaaacacuccuccuccccuggggucagaagucuguagacccuuccagcagcucaggguucccccaacacccaccucauggaaaagcucagcuugacacgguccaauuccaccuugugcacaaagcccuuauaugugaugggguccuccuggugugucuccgaggacaaaagggcaaacagguggucgccccguagcacugaggggcggcucucagucacuccaggaaccuauggggugugaacacaagcaagcuucugucccagggauggacgcuggagggcccagcccccagguuccccagaccuuuaagggacaaggacugagacuggccuucuaaccuaagacucagggaguuaugcuaucccugcaccccucuuuccuuucauaccagcaggagucaggggaagaggaagaagacaaauccuccgaagcugcccagagaugccgagcccaggaacccggagccuccagugcagcugcccucuuggccagcucaguuccugcucugccuauaaaaauccuguucaucaguuaaucggguugcuaaaaaaauaauuaaaaaaaaaaaaaaaaaaaaacggaccaggcaugguggcucacgccuguaaucccagcacuuugggagacugaggcaggcggaucacuugaguccagguguugcgagaccagccuggccaauguggcaaaaccccaucucuacaaaaaauacaaaaauuagccaggcguaguggggcaugucuguggucccagcuacuugggaggaucacuugagcccgggcggcggggauuaaagcgagccaagaucaugccauugcacuccagccugagcaccagggugagacccugucucaaaacaaaaacaacaacaacaaaaaacuuguucaaaacucacuuccugcaguaaucuuuccuugaacaaacucacccucuaauucccaccugcaauuguguguagaaauccauucucguguguaauuuugggcuuauaugcacacauugaaaauccaagagccagaaagagcucuaagaauuauccaguccagcucugugcuuuucagauaagggaacuaaggcuuagagaaagccagggacuuacccaaggugguagcaaagccuggacuagaacccagaucuuccccauuucccugcuccaacacaucuuugggcacaggaugcccacccugcuucuugcggagcccugggaaccacuucaacuuuccucuuguucugcccugcugucaggaauaguucugcccacagccucuagcuuggcuggcuugagcccacccuccucacacucaaucugagcccugaccuccagcgugagcagccugggguucugguccacagggucccaggucaugggcaccgacuccaggucauagugccggauaucaugcuccaucugcaguuccuccaggugcagcagcagccgcagcuucaccucauaguuccuccacuucagggcugucuccagcugggcccuggaaaugaugguugggaggggugagugggggcaggaacaggaugggccagacaaccccuaugcccaggaguauccaccuucucccaccugaagcucuggaacuagcgucaaaaagcagagaagacuagagggauacagaaguggaugagagucagaggcccugaagaaggaagccuuggcuccugcuuccuuggaugccccugcccccaccucacccgacuugcauuugcaugguggcucuuauggccagaacauucuccuccaauccucucaugacucccacccucaccucauucaaauguccuucucuguucaaacaucacuaccucaaacaggccaggacuaacuggccuucugcaaagcagcaccaacccauucccuaacccugcuuuaguuucaguauaguucuguucaucuuuuuuagagacaagaucuugcucugucacccaugcuggagugcaguggcaugaucugggcucacucacuguguccucaaccuccugggcucaagaaauucucccaccucugccucacaaguagcugggacuacagacaugugccaccacacuuggcuaauuaaaauuuuuuuuuguagagacagaaucucacuauguugccccaggcuggucuugaacucuugggcuuaaaugauccaccugccucggccucccaaagugcugagauuacaggcaugagccacuuacaccugaccuguuuaguucuucacagcacucaucacuccaugaaauuguaacaaaaaugcucauugucccccauuaaaaugagccaggccuucauuugacugguucaccuugaauggugcuugguguauggugcgugcucaguaagggaaugaaugaauacagccugggaggcugaggacggaggugccagggcaaugcaaagaagccaguagguaaaagacgggagagugcggggugcagagggaugguacuuacuugaucucugcgaucuccuuaggggcagugaagauacuuguucccugaagaagcauggggagcagcugccugaggcggggagguggguaguauguccccagcgccauacuuaacuccaggucauagcccuuagcgcugcagaaucgagggaagaaaacacagaaaaccccucacccuccaacacucugagaacgccccucugggguggaugcacaaagcccuccugcaauccuacugcugaagggaagucagcagccucgcuccaaggguggacuacucucauuuuuggaacaugcgauacuuggaaaccuuuaaaacuauuaucuaaguaauaaaugaucacuagagaaaaaaaucagguaauagguaauaaguaaauaucauucuuaccauccaggaauaaccaauguuaacuaccagacuuuuuucccuguaaguuucuguuauacauauauagucaacaaaaagagcacaauggucugugaagguccuauuauguaguuugcuuuuuuuucuuuuuugagucccacucuguugcccaggcugaagugcaauggcgcaaucucggcucacugcaaccaccgccucccagguucaagcaauucuccugccucagcuccugaguagaguagcugggacuacaggcaugcgccaccacacccggcuaauuuuuuuguauuuuuaguagaaaugggauuucaccauguuggccaggcugaucucaaacucuugaccucaagugaucugcccgccucagccucccaaaaugcugggauuacaggugugagccaccacacccggcuaguuugcuuuuauaacucaguauuuugugaacaucuagcaaaaacaaaaagagaugucuacacauauccuacgcuuccauccauaugaaguauccagcacagagaaaucuacagagacaggaaguagaugagcaguuucuuagggcugaacaaaguggguggaggauaaaagggugauagcuuuuugggauaaugaaauguucuaaaaccgaugguggugauagugucacauauuugugaauauacuaaaaaaauuacugaauuguguaauuuaaaugggugaaucauaugguaugugaauuaucucaauacagcuguuuaaaaaaacagagauguuggcugggcacgguggcucgccccuguaaucccagcauuuugggaggccgaggcuggcggaucacuugaggucaggaguucgagaccagccuggccaacauggugaaaccccaugucuacuaaaaauacaaaaauuagccggguguuguagugggcgccuguaaucccagcuacucaggaggcugaggcaggagaauugcuugagcccaggaggcggagguugcagugagcugagaucacaccaccgcacuccagccugggcgacagagcaagacuccaucucaaaacaaaaacaaaaaacaaaacaaaacagagaugucuacaaugaucugccugauaaugcaucacacagggacaaugccuaaaacuguuuucacucuguccucagaucugcaguucaucugcaacuuucuuccuugacagaaaaauucucugagacccagaagagugaagagccuguaggaaaagggcucuggcucccagcucugugcucuucccaaagcccuggcccaugugguugagauacgagcccagccagggcugaguuggagggaggaguuaccggucaggucucucuccuuccucuauccgauuggucaccacaggguuuccggugauccggguccgcuugaagggagucaugggcuucagcugugcagccagggggcugugggcgacggcagccaagaagcgggcaauguagaaugugccggcuccuucugaacccgacuccccaggucccagcagcucccagagcacuguggcugggaaguagcccacaaagcuggucuuacaauggacauggaguucauagcauucaccuggaggagaauggaugagugaauggggguagggacccucccacccauauccuuaucccggacacucccccaggaagccccaucccaaggcaagagucccauggacagugacaguguguuucccaaagcauaagcacugccugggacaagccccuguccaccagcucuuuccuuuggaaacucacucaccggggcccaguggacagggcaacuccuggucuucauuguagaaagcaaacugggguguccggcagagugggaagaggugagugaggguaacagacuggguuccgccauuccgaagccucagggucagcaccucuuugcgguucaaauccaggcggauaaggagcugcccaucucgggcuucauggggccccuggacuuccacauccacaccauguuucccaugaagauacucagcccuggggagaaggggagucaaggggggguuggggugggagcggucugacuggggaguuacccuggggaaagcuuuaggcuugggaggcaggcaaagugccagcugugcuuaggaaacucacccccucccagcagaccaguucccugcccuucccccauucccugaaggagggggacuuauucccacuuguguaacccacucuuuccucacacagauagcccccuucccucacacccugcagaccuccccguacacacaacauacaacacacacacaccugucauaaaagaucuuggcuagcagugacuugugguguuugcugauaucugaccccagcuucauucuccucuuuucugggaaccgcacgucggcccagcggucgagucugaagaaccugacccgagucuuggugacguaggccagauuugcaaucuucauuccauacagcauggaggagaagccaggggcgggggucccaaagcug

SEQ ID NO: 12635 - RNA, 32880 nt, Homo sapiens
cuuacacaagacaauccaaacugaugcaaaauauuuauuccaaguuaguuauuuuaugcaguaguuucccccucgagacuugugauaaccacaucuuuuaaaucuguaaauaauguuaucaaaauaaucuuaaucuuugaaaucucacaaaaauuuauauuuuacaauccacccugaauaucaaggcugcaagaauaacacaacauuuccuauauccaaauauuuuacagcuguacccaaaaaggaaaaagaaaaaaaaaacaaaaaaaaacaaccaaaaaaacccacauaugcuugguuaagggcuaaaguuacccgagcagccaaaaauaaaauaaaauauccaaauuauuagcauuaauuuaauacaauuauaacuucaauagucacuuugucauugacaaugauugcuugaucacaggggugagugccccaagggcugguaguagaagcuguugcugcagaccagugucuccucuucccugcacugccagcuccuaccugugcaucgccccauauauacuggguguguaugugugugugugugugaguguguuuaaaaaaucugucccaccacacaaacuucucucuauaaagcagauaacagggaagaacaauaacaaaagcaaaacaagccaauugcucucucuuugggauaugauuauuucccuugugaaugaaguauucaacaacauaagaaaaggaaaagaacgauuucuuuuguauacucccuaaacacacagaguuuacugggucagauuuaacugugagcauuuauaugccuacuuccaggcaucgucaucugauguuucacugcuacugguuucggugucugaguccucaaacucugcuuugcaagugcuucuccaaggggagaacagacuggaacugcggcucugcaagaagccauucuuuccaaagccauuucuucucagcuaugguuagcaugggagagaaagaaaaaagaaaaaaauaucaaugacuguacugacccauaagcccugggaaaggccaggccucaauucaauucuagguagaauguggggcggggggugcuucuaagagacccucugagaucucuuauaccaguacuuuucaaauuuuaauuuacgagucaucuacgcaucuuucaaaaaugcagauucagauucagaaugucugggauggggcuugaaaguccuuauuucuuuuuauuuauuuauuuuuuugagacggaaucucgcucugucacccaggcuagagugcaauggcacaaucuuggcucacugcauccuccgccuccuggguucaagcgauucuccugccucagccucccaaguagcuuggauuacaggcgcacaccaccacgccuaguuaauuuuuguauuuuuaguagagauggggcuucaccauauuggccaguaugcucuugagcuccugaccucgucaucugccugccucggccucccaaaguguugggauuacaggcgugagccacugugcccagccauaaguccuuauuucuaacagaguucuaaguggcaaggucucacaucagcuugugccaugccccuuuuaaggacuuggccaauugugcuguaaauacaggccaccagaaguucaaggauuuuuauagaaaccccauuugucuuguucacccuaagaucuagcaguguuuuauucagagaaagaauccaagcaacugcuggauaaacugacacaagcuauuuagcuucuuagcucuggccagaggaccaggaaacuacagugcagaucaggaagcagaggaaggugaaccugcuuccuuaaagaccaagagcucagaccauagcucuggaacacagccuugugguucugauaaggaguuagagcuguuaggaugaaagagcauacuauuuuuuggaaucugcuaaucacugacacuugguuuuuguauauaacacuggggauccuuauuucccaggcagauuuaggggccccacuacauuucuacuaagguaaucccccccccccccacccgaucuuucucucacauuaaacuugcucccucagggcaagaacugucuugacuccuuauucuccugguuacuaacuggucucuaggaagaagguuuacaacauaccugcucugucuucauguggaacucuuugagcucauccucugugaggggaaggcaauucucaucauuuucaggauauuccugccaacccauagcuuucaauaaccugguggacgcagaaggacagguaaagagaauacaacaucacuaagccuaagugaacagcccaccacuuuucacagaaaaguuuucugcccaggggcaauggauguuaaagaaggaauuuuguuuuccucccugugggacaagcuuuaauuguggcuaccugggugcuguaaauaaauggaggcucuucacaguugagagaggaagagcuaaagaagagacaguagaagcaaaaccaagacaguguaaggaagaaagagagcacuugcagucuggcuuuuuuuuuuuuuugggauggagucucacucugucacccaggcugaagugcagugguacaaucucagcucacugcaaccuccgccucccggguucaagccauucucccgucccagccucccuaguagcuggaauuacaggcgcacacuaccaugcccagcuacuuuuuguauuuuugguagagacaggguuucgccauguuggccaagcuggucucaaacucuugaccuugacugauccacccaccucagccucccaaagugcugggauuacaggcaugagccacugcgcccggccugaaguuaaaaguauuaaaguauuggagaguagauuguggaaaagauggcugaguuugagagagaaugcuugaugagcaacaggccaaccuggggcauacacagagaacaaguuaugacugggccacuucucucugcaugugggaccuaucuaucugagauaucuucuccaguauguucaagguccuuaaaggucagacacugcaugcccugugauguccuccucacuuaccugugcucugcuucuagagagugugagagaaccuccccuucuuccacuacagggagggcaagaccauuuugaugacagccuuccuccccauuuuccuuugguucaggugugcuguuguccuccaacugcaauaaggaaaaggaaggacacaguugguuuaagguuccuuuguaguaauauaagcaaccuaugaaaucaaggacucacgacccaggaaguguuuuccaaaagacagccucagcccacagauuuuuuuccccauuuacaaaugaggaccugcugcaucaacaaaacugauucuaaaguuuuaaugaaaaggcaaaagauccagaacagccaacacaauacugaagaauaaaaccagaguacugauauuaccugacaucaagacuuaccacaaaagcuggaguaauuaaaacaguaugguaacagugcucauaagagguguggggggaaaaagugugguacuggcagaagaugacacaaauaguccaaugggacagaacagagagcccacaaauagacaacugaucuuugacaaaggaaauacaauggagaaaagauagucuuuucaacaaauggugagggaacaauuggacagccacacuaaaaaaaaaaaaaucaaucuaaacaaagaccuuacagccgucacaaaaauaaagucaaaaugggucacagaccuaaauguaaaacacaaaacuauaaaacuccuauaaggauaacauaaaagaaaacuuagauuaccuuggguaugacauuuauuuauuuauuuauuuguuuauuuacuuacuuauuuuuggagaucaagucucacucuguugcucaggcuggagugcaguggcgcgaucucggcucacugcaacccccgccucccauguucaagugauucucaugccucagccucccauguagcugugacuaugggugcaugcuaccaugcccggcuaauuuuucuguuuuuaguaggaacgggguuucgccagguuggccaggcuggucucaaacuccugaccucaggugauccgcccaccucagccaaccaaaguguugggauuauagguuugagccaccgugacuggccuacaauuaauuaggcuggauuucauuaaaauaaaaaaaauuucugcuuugcaaaacacucugucaagagaauuaaaagacaguguaguugcucacaccuguaauccuagcacuuucggaggccaaaggugggaggacugcuugagucuaggaguuuaacaccagccugagcaacauagcaagaagcuaucucuguaccaaacaaaauauuagccaggcaugguggcacaagccuauagucccagcuacucgggaggcugaggcugaggcauagcuugaggaggggaggucgaggcugcagugaacugugaucauuaaugccacugcauucagccugggcgacagagugagacacugucucaaaaacaaauauggccggcugggcauggcagcucaugccuguaaucccagcauuuugggaggcugagguggguggauuaccugaggucuggaauccgagaccagccugaccaacauggugaaaccuugucucuacuacauacaaaaaaaauuccagaaaauaguauacucuuucauccucacaggucuaauuccuuaucagaaccacaaggcuguguuccagaguuauggucugagcucuuggucuucaaggaagcagguuggccuuccucugccucuuguucugcacuguaguuuccugguccucuggccagagcuaagaagcuaaauaacgugugucaugugguggcacaugccuguaaucccagcuacuugggaggcugaggcaggagaacugcuugaaccuggaaggcggugguugcaguaagcugagauugcuccauugcacuccagccugggcaacagagugaaacuccaucucaaaaaauaaaguaauacaaauaaauaaauauggccacaugugguggcuuaugccuuuaauccuagcacuuugggaggcugagacaggcagaacacuugaggccaggaguucaagaccagccuggccaacaugacgaaacuccaucucuacuaagaauacaaaaauuagcugggcgugguggcgggugccuguaaucccagcuacucaggaagcugaggcaggagaaucgcuugaacccgggaagcggagguugcaaugagcccagaucgugccacugcacuccagucugggugauaagagccagacucugucucaaaauaaauaaauaagaaagaaugaagagucaaaucacagacuuggagaaacuguagucaaagacacaucuaauaaaggacuauuaacuaagauauacaaagaacucuaagaacucuuaaaacuuagcaauaagaaaacagacaaccucauuaaaaaauggguaagggaccugaacaaacacaucaacaaagaagauacauagauggaugcuccacaugauaugucaucauggaagugcaaauuaaaacuacacaccuaucaggagggccaaaauccagaacacugauaauaucgaauacuggugaggagguguagcaacagaaauucucauuuauugcuggugggaaugcaaaauggcacaaccacuuuggaagacaguuuggugguuuccugacaagcuaaacaugcucuuaccauaugauccagcaauugcgcuccuugguauuuacccaaaggaguugaacuuaugccagcacaaaaaccugcacauggauguuuacugcaguuuuauucauaguugccaacacuuggaagcaaccaagauguacuucaauaggugagugauuacuaaaauaaacccgaauuuaacauuuuugcugaaaaaaggauuaaacucacuuuacuauguggucuagaaggcaguuacaccuacagacaguaucucuguacauuuaaaaaucuugccacaucuuuauccuuuaagaagaagaaaucacguauguaucaaaggaaaauuccuaggcuacccccagaaaaggcggaugcucuuacaucuuccagcuugucacagucucuauucucugagaagucuccauuccggucauccuucagaguuuucaggaacucacucuuccugucggugguucggcgggucaacuuggucagacgagaggagcugaucucaauuggagggguggugcuggagggacucugggcaaauaccacaaacagguugcuccugacagcaaagagcaagaacugggguucucuucuacuaagugcugacuucaagaaucugguagccuauuuaucacucugucuuaaaccaaacaauccuuuuauuuaagcaguucaaacuucaguuuugcaggguuuauauaguuaagagcagcuggcuuacauggcaccucuuugaucuuucuacagacaucagcagaaugccagucuaacauaggaugaccuugguccaccacagagcaucuaucccauuuagccacugcccacuuuuggaugcuaacagaaaacaucaauaaagaaacuauucucagcuaaauauagcuacaaaacaagugucacagcuauacauauuacacuuguuaucuaagugaacgggaaauggcaauuucagaaaagacuguccugcuucauccucacucaccucuuugggagaacucagagcugcaccacuagccaguaccacugguuugguaacagagauuggacugguaaaagcagacucccggcuagaggaaagggauccugacuugugcuccauccuguuagcuuuccaugcauuaggcuacacagggugaaagaacaaaucagucagaacaagcacacaaacagaagcucagcuuauaaaaucauaaagcaaagagugaaauguuacaugagaacauaaguuuccagggcuuaccugucuuaacauguuugggaaguaugcaaccucuuucggagguuaggcacuucaaggaaaaugguagaugggauacagaagagccauuggacauuaauagugacuucccaaaaacagggcucuaguucaauaguucaaugaguuugggaggugccggggugaaaaaaguucaacaagguucuucacugugcaauuucucaaagcacuuaacugcacauaagaauuugagaggcaguuaugcagcauuuuccuaauuuauugaaucccaaaacuuuuuuuaguaguguuuguuaacuuuggauguaauccugauagcccacaaagugcaucacaaaauugcugcuuuccaggaacucugauggcaaaaggcuaguuccaggccaggguggcuauuguaaaugguugaacaauccugauuuauuuagucuggaggcccgucuacucaacucugcagggucugggcccauucugucacucuggccauaaccccaaguaugauagaaagcuggaauacugaguuaccacacuguccaaggagaccaaggaagauguggcaagccaguggaguggugcugaagcaaaugaaaaacuuccaacuuauuuuuccagaaugaaacacuuagaacagaggaccuccaggacaaaggggccugagugaaauggauucccuuccugguugcuuucuugauugauggguauuaaaagaagacacaauaauagcuuuaggaaaggaauuaacuuuacuaucuaccauguaccaggugauggucagucuguuuuauuuaauucuuaaaccaaucaggaauaauaauuguuacgcugacuuuuaauagaggaugacacugacaauaaggaaguuccacaauuuguucaagguuauucagcuaguaaaugaaaccaccuuuccacuaucccaaaaugccuccacaaagaacaagcaagcagauaagagaaacgaugacccaaccagaaugaagauuaauuuuuuucuugcauugauaaaaaucuaaagaugguugcuugugucagguuaacucucaaagaugauuuguggcuuccccugaguuguagucaccagauguccugucuuuaaaacaaugucacuccagagcacagaaacacuuggguuucugccacaguaguacaaaagauuuacucuguuacauaaaacagaauaucuaugucugugccaauuuuauuucaacuuaauuuucaguaacuuaaacccuaugagauagcuagacuacccccuggaaaaaucauuaugccccacaccuguuuuuauuagaugauuauacauguaaaaguccauuaaagugaauuguauaaccaguuuuuuuuguuguuguuuuuuaaauguucucuccuuuuccucuaaauucugaaucaacccuagcuugcuccacuucagaaucuucuucuacuggacuaaaaauucuaaaaucacugggcucaaacuuucucccaccuccucugccguuugccccucaaguucaaaggaauguccuccucccuuucuagcacuuucuucucuuuccuuuuggguuuaucaaauaugcuaauccaccuuauugaaauuaggagaaaaaggccagacuucuuauuuucccucaaucuuauauaccaccuucuuauugccaaacuucugaguaagucaguauacauuaucuuucacucguucauuaacuauuuacugcuuaguucccugcaauacucaccucuauccccaauuuuaguaaaacucuuucauaaauaaccaaaacuuucauccuuauauuacaaaggccagcucuaaaaaaccugucuucuuugggaaaugcgauauugcucauuaugaauauuuucugaaccugucccuuuuucccuucuugauuuccugaugcuucacucucucaguucucucuuuaccucuugaauucccuucuuuucaauggauguaaguauacuagcauuccagacucaguacucuucuucuucuguagucuguugaacuaggugaauuucauuagaaaaagcaauuacuuauaacuguuucaguuuaaaauguuaaaauuguguagauaauauguaaaauugcaucucuaccuacuuuaacuucucuccuguucuuuuuauacaggccuccaucaagucugacuuccccauucacuuucacauaccagccauaccgaaccaauaugguuccuuuacuccaaacauaccauauucugcauccauuuucugguuaacaacagguucccucugccgagaaugcccuaccuacuugcuuucuaaugaacuacuguacuacuguuuuuaaacguccacuuacuggguaauuaggauguuucaaaaacuauauuccaaguacuugcuccaauuuacugucaagaagaguuuagcaaaaucuaauaacuugcuuaagaucacaacccuagaaagugucacaaagauuucaacuuaguuaaguuugagucaaaagauuaauuucucaacuuccucuucuauucuucauccuucaagacaggaggcauucuggaacaguagaaagagcccugguuuugaagucagaccugaguuaaaagccugacucuaucacuuauuagcuauguaaccccacaguguguauucucuauaucccaggauuaaaagaguaaaugcuuuaauauguguaaaagcccuaaccaagcaacauaguaagaugucaacaaauggcaguucucuuuccuuuaucauguauuugaaucccaguuauccguaaagacuuugaugacccuccccaggcagagaagcacaauuuuuuucaaauaacucuuucuucacuagacaguaaacucuuugcgauuacaggccaaguauuauuuugugucucuagugacacaguguuuacuacucagauacucaauaauuauugcuaauguuuagauaaaaugaauggauaaaucaacaucugcuuauuaguuaucuuaccucuuccucccucuaacaucucauauccuacguacccagaaccacaaucacauuuccugaaaccugaccuuccauauuuaccccaauuuucccaggaagaaugucuucuguuuucuuuugcugccuaauuugccucccacuaucugccauuaccaccucugccaacuguuaccaucucugccauucucugccaacuguuaccauccucuucaagcuucaagagcagcagccuuuauauuaguuuuccaaucuucauucuaccccugacucacaacagggcuaaagugaucuuaaguuuuguaucauaauuuuuauccuuguaaaaauuuuuuuaccuuuugauuuaugagauccuugaggacacaaugacauuuucuuacucauuuuuauauuuucuguaguccugcagaaugcuugcagacaucuuaaaguaacacuuaagaaagucuuuauaaacucucaagaaaugggacaaacauaaguugugcuggcagguugguaacaauagcuaccauuuauuggcacuuauuauaugccaguuuuagguauuucauaaaauuuucucauuuacuccucacaaaaaaaaggggggcauuguuaugucuauuuuauagaagaagaaacugagacugggaagugaagaaacuugcucaaggacguaagaugaagaagguguaaggugaaaucugucuauuccauagcccggcaguuaacuuccaugcucagcuguuucuuuguaauaguugcucucuucacuugaauucacauucuuucccuucuacaucagaggaaaauaaacccuaaguauccuaaacccuuuucaaagauaacuguacuugucaauuaguuuuauucccacauauuucuucuuggcccauaauccuuuaaugaucucuuccaaguacaguucaaguugcuuccaguggcuucuuccaacagacuuccucauccauucacuuaucuuuuccacugccuauauucuaucuaguuccuuuuacugucaagguuaaaaggugccacuaccuccacauauuuccaaaagcccuugaaauacuguuucagcccuacuuuauucccuaaaaacaucaacucaaaagucuccuaagauaaucacuaagguuuuuucucaguuauuuuccucaacuuguuaccccuguugcuauugcaaacucacccacuuguauuucugugagaguuuaccauuuuuuucugaacuaguuucucaguacuaucccauucuuuacuccucuucuauccucuucucuucuuccauccucuucucuuguauaucuaaucuaccuugaaaacuccaaucauuaucacuaggauaguaacucccagugaauuuauucagagggugagcacgguggcucacgucuguaauccuagcacuuugugaggucaaggugggaggauggcuugagcccagaaguucgagaccagccugggcaauauagugagaccccaaucacuauuuuaaauaaauagaugaaagaaaagaaagaaaauuauucacagagaggauggcaugcgccagaagaauaauuucuucccggguaagagaaaaaaggggcaauaagaugcaaaagauggauuagaguuuggcuaugagaaacuucacagaccucugcuuacucugcacacugacuauaggacuagcacacuaugacccaugggccaaaucuugaccaaggcauuucuguaugauucaugagcucauacuuauuuuuacauuuuuaaagagcuggaaaaaaaaaaggcaauguguaacaaaaaucauauauaucaagcaaagccuaaaauauuuauuaucuggcccuucauagaaaaaaauuaccaaucccugccauacauuguuuggagccacugaaggaauucaggaaggcaugugauauauucaauuguuuuuggaaugaucauucuggcaguucuguaggacacagagacaugagaaaauagaaagguauacuagaacaguaaaugugagaagacaaaguccugaacaaggacagcauagagagaauaacagggacuuuguaauuccuuggcugaggagaaugacuaaggaggaagagaagagaaguagccaagauagucaagcugagugauuaggauguuguugcuauuacagaaaaccagaggggccaggugugguggcucacgcccauaaucucagcgcucugggaggcugaggcaggaggauuccuugaggccaggagauagagaccagccugggcaacaaaaugagauucugucucuacaaaaaauaauuaaaaaaaaaaaaaaaaaaauggcugggcguggcggcucacgccuguaaucccagcaccuugggaggccgaggcgggcggaucacgaggucaggagauugagaccauccuggcuaacaacggugaaaccccgucucuacuaaaaauacaaaaaaacaccgagccgggugugguggcgggcgccuguagucccagcuacucgggaggcugaggaagaauggugugaacccaggagguggagcuugcagugagcugagaucgugccacugcacuccagccugggugacagagcgaggcuccaucucaaaaaaacaaaacaaaacaaaaaauaaaauaaauaaaaaaaauagccgggcauaauggcgugccccuguaguuucagcuacuugggaggcugaggucacacugagccaugauugugccacugcauuccagccugggugacagagugagaccuugucucaaaaaaauaaagaaaaagaaaaaaaaaaaagcaaagaaagcuguauacauauaacagguacugaaagaauaucuggugacugaugcggcaagaaaaaacaaauuuauuaauuuuuuccugauuuauucccaaaccucucuuguauaagguucuugcccugauucuaaaucauaccuuggaaggaggugguacaggcuuaggaaccagguucuuauagacacuuggaaccacggaugacaauuuguucccauuugcauggugagauccuggugaggugaaugcagcagagaaggcagcagcaggauccucuuuggaaacuuuuuugauaacuagcaucuuggaggguugcuuggcacuaggcggguuuucugugaaguacaagaguggagagacaacagaaugucaaaccuguuguguaacaugaagcauaguuuauacaaaggccuuagucaacaaaacagcugacaguugagacagagggauuaaacauucccugguaugcacuuaauagauacucucaaaagugagacuacucaggaacuguacaaaaaaaugcagcauaugaggaacuggauacuaaauuuauaaaucagccaggaaguccaaagauguuagcaguccuucaggggcacaauaugucugauggacagugugaucaguuaagcaugaacccaacaagaauaaauccaagcgccaggcacuguggcucaugccuguaaucucagcacuuggaggugcugaggugggcagaucacuugagucccaagaguucgagaccagccugggcuggcaaacccuguggcaaauccccaucuuuacaaaaaauacaaacauuagccaggcaugguggugcacaccuguggucccagcuacuuaggaggcugaggcgggagaaucacuugagcccaggucgaggcugcagcgagccaugacugugccacugcacuccagcauggaugacaaagucagacccuaacucaaaaaaacaaaaacaaaacaaaaaaaaacaccuaaaaguagcagcuccugucagcaugagaauagagagaugagguaaucagggauuggagucugccaugaaacccucugaugaggcaaacuggagcaaagguauacaccauuagcaaagaggagaagguacaucgaucaaucuuaauccuacaauacuggauucuaaacccaucauuuagauauguuaaagacuucccauguucuuggcuaucaacaugucuaaugaagaaaccaggagaguccaauuuguaaaugccaaagaucccaaugccacagaugagguuugguuugaaauacagauuccuaucgcaccacugcacucuagccugggcgacagagugagauucugucucaaaaaacaaaacaaaacaaaacaaaaaaccacaaacauauauauacacacacauacacauaaacacacacacacacacacacacacacgaauauuuaaacauacauauauaugaauguuuaagaauauauuguuaugggcuggguaugguggcucacgccuguaaucucagcacuuugagaggccgaggcaggcggaugaugaggucaagagaucgagaccaucguggccaacauggugaaaccccaucucuacuaaauaacaaaaauuagccgggcgugguggcauaggccuguauucccagcuacuuaggaggcugaggcaggagaaaagcuugaauccgggaggcugagguugcagugagcugagaucucgccaccgcacuccagccuggcaacagagugagacuccaucucaaaaaaaaaaaaaaaaaaaaguaagugaaguagcaauguuaauuaaguuacuuuucaugaacuuuuucuacuuaaaaucugcuuccauguuggcuacgguggcucaugccuguaaucccagcacuuugggaggccaagauggguggaucacuugaggccaagaauucaagacaagccugaucaacaugguaaaacccugucuggacuaaaaauacaaacauuagccaggcaugguguagucccagcuagggagguggaggcugcagugagcugagauugcgccacugcacuacagccugggcaacagaaugagacugucucaaacaaacagacuaacaaacaccaccaaaacaacugcuuccaaauucacgguucuauaaguucucaguugucuguauuuugacucuacuaccaugguaacauuucagugguguuuggggguugggcggugggguagggggcagaauaacccgcuacagucagauguuaguuaccaugggcaaaugcaugagaugagaaacaagagauaaaaagagauaaggaaucuuugcuccccucccugcuaagaaaaaauuuuaaaguugugccuuuaaaauggcaaaaucuaccuaccccauacuccagaaggugucccaauaggucugcauggcugaugcuguuugccagcuucuggauucaaggaaggcuaggaaaaaagggauaugaaugguugauacagaaagcugaucauuuuggcacuuuucacaaaguagccaucaccauggaaccuaucaaauaauuacauauuuuacauauuagcaacacuuacuaauuugacacuguauucagaaacguaacaaacagaaaauaucaaaacacaaaaucaauagguauuauguuaauauuagguucuccugaguuucauuuccuuugauauaagggauuucauuuauuuuaaauaaacagacuaaaugugcgaauucccacuuuccuauaggauauguaugccaaauaaggaggcacugaaaguuagaugaacaagaauguggaucauuuuccucagauuaaaggaggacaauguggucagugaaauguauaguauucacugcauuucuaagauggguguagggcaggggcagaccauaugccaaggacugugcuagaaauacaauaaagagccccugucuucacacgggucacaguuuugcuauaaaaacuucuagacaaguuaaguacaauaaaagguuacaaggacgaugaaaaaaauucauauuagggaagaaggaguacucaguaagaaacaucaauucuacuugaaagagaagugcuaucagaaaaggcuuuacuaacaggugauuuaagaauccuuaaagaugaauuccaaagcuggaaaaacgguaauuccaggaacagaaagcauuaaaaagaacagaauauucaggucugcaaauaguucagcaugaguagugcuagggaaggaggggacccuucuguggggaaagagguaucuggcaaagcaggcaagagccagcuuguggaggauuucuuaggggagauuaaguuuuauucuacagguaaugaggauccaucuuucaugcaguuaacauuaucuaauuaucaacuuacaaccgucacucuaguagcagcuuaaaggauggaucugagguauuuaaacaucaacuaagagaccauuaggagaucaauuccauaguccgggaggguaauaaagguaacagaaguagagaacgagauaagggaaagggcagggaagaguuaagagcaauagacuagacuuaauaacuaaucguaugacacugcuguccuagcccaaacuuuacgaucugguaacaggguaggagaauggcuuuuuuuuuuuuuuuuuuuuuuuuuuuuugugacagagugucacucuguugcccagguuggaguacaguggcacaauccuggcucauugcaaccuccacuuuccagguucaagcaauucuccugucucagcuuccugaguaacugggauuacaggugcgcaccaccacacccagcuaauuuuuguauuuuuaguacagacaggguuucaccaugcuggccaggcuggucucgaacugaccucaagugauccacucaccuuggccucccaaagugcugagauuacaggcaugagccacugugcccagcaggaaaauggcuuuucagcacaauugccugugaacauuauacaaacaacaaaaagacacccaggcuccacuacagagcuucagaaucagaaucuccaggggcagggccucuagcagguauguauuuuccaagcaaucaaggugagaaccacuacaauaggagaacaagcacaaaugcaaaugaaacuaccaacucucuauauaaguggacaaaucagugacagauuuucaaggacagguaaauacauuccucuagauggagugguagaggcagaaggagugcccagccauaaaagcugugguuguuuccuuguuucauuuuaauaggcauguuguacccaggguucucagagacaaugcuccuauuuauacaguaucuuugaucucuuucuacuguuuuaaaaaauacaguuuuaaaacuuguaaaauauaaacaggaaaaauauaaaacaaaugaauaaguuaauggguaaaaguucuuuuaaacacuacaugguuuaagcaacauaacauuaccagacaaaccagaaagacauuacaaaucucauuagaaaaaaaccccaaaacuacucauacuuauggugaucacugcauuuuuuuuuuuuacuaacccauugugucucccuugacacuauaguuuugucuccaaaaacaaucucagcuuuuaaucuacuaguuuuuagaaaaucuuaagccucuuucuauaaauugguaguugguucuagagguuacagaauccuuagugguuuuguauucuuccauuaggagacacacacaaauaacaugugguugugcuucuuuuagugaugcuggcagacacuggugcucauagccuaaaacugucagcucaauacaagaugcaaaaacaaugaucuaauuuuacaauucuuuauaaaguaguauacuuccauaaauaggaacuuccccuauuuggcaauucaacaguacaguucauauagaaaaaauaugauacaugcuuguuccuaaggugagguagguaucauugugaauucacagauuuaaauccaauuugaugugauucaacccucgucguuauuauuauuaauugaugcauaaaacugucccauguuuggccuauggaacccucuucaauuuggcuucuaaauccuuuugcuacaacccuaaguaguucuuuacuucuuuguuaucuaguuugaaaaaauauuccaagcucuucuuuuaaguaugcugucuggauaaacuauuucaagaucacaauccaggcaguagagccacucauugcuaugggguuguucacuguuuuuaugucuuuucaguggacagaaccgccuagaaguauguauuuuucacuccaaagcuaaaacaccucauaacuuauuacugauauucccaauucaaacugaguacccuuguggauuuuacggaacaucuauuuuacguuuuuauuuccuccuacaagaauccugauucucaagcauacaaaguauagaauaucauauuuaauugcuuuauuccauauuaugcacaaguuucagaauagcaaugucaguauuucaccagugaccaaaauguuuuguuuuuuuuggacauguucuccccaucuucccacuuuaaaaaaguuauacuauguccagauugugagaucauauaacuaucacaugcuaacucucuuuuaacccucauuucuucuuagcucuacaauuaaccauacauuuaguauuuaccaccauuccuuuuguaaucuuucugguuaguuugucagaagcuuguucuucaguaguucucaggaaaagucuugggaacgauauuccgaaguuuuuuguuuuuuuuuuuuuugaggcauuuuauuuguaaauauguauugcaucccuagaaacaaaauccaaggauuuucccuccuguguguuuucgucuugcuucuucaugguccaugauaccagcuaaggcugucaauaugacgaagucaaaugguugggauagaagcagauuguucugccguuuuucuagaucuuugaguugcaaaucaaagcuggggcucuacacuuguuuagccugccugugagguucacaauuuucccagcucuguuaucaucaaugauuucaaauuugccaauguaacgaugcuucaucaucacagcuagaaguuggacaaugacuuuggagcauggccuaguaagaaccggcguuucccucucuuuucggcauuggugauacucuugagagcaacagguaggauguucacacacaccauuguggcagcgcgaaacaaugccggaaagagcaauauuccaaguacuuacacauugauguuugucugugaucuuuauaacugaacauuagcuugacaaagcacaaaaucuuuggcucacauuuucuuuauuguaauuguuacuccauuuacuuguuauaaagcuuugcugucacagucuaucugguuuucuuucucuuaacaacucagucuuuaugccugaauggccaaaggauaucuuucuuuuuuuguucaagucuaguauuuuguaagaguaugucuuagucauccuggcuauccuuucaauuuguagauucaaaucuaaauguauuucagaaaaauguuccugaauuauacuuuucaguauuuuuuuuuuuuuugagacggagucucacucuguccccaggcuggagugcaguggcgcgaucucagcucacugcaagcuccaccucccggguucacgccauucuccugccucacagccucccgaguagcuaggacuacaggcgcccgccaccaugccuggcuaauuuuuuguauuuuuaguagagacaggguuucaacauguuagucaggauggucucgaucuccugaccucgugaucugccccccucggccucccaaacugcugggauuacaggugugagccaccguacccggccacuugucaguauuuaagcuauuccuuuauuuugguuuucuuucugggggcggggugggaagauccuauuauauaucuauauuagaucuuuucugccaaacuuuuuuuucccaguuuuaauuuuuuaccuauguauuucuccuucauuuaaaaaauuuuccuucgcugucuaauucuugaaaaauauuauuuauucucuuuauucuucaguauuuuucugaaauuuuuuauuauuacuucuuuucaagaguucuagccccuuauuuugaguuuucccagaugauuuuuuuuuuuaaaccaacuucuuaggauuuuuuuuuuuuuuuuucugagaccaaguuucauacucuuguugcccaggccggagugcaauggugcgaucuuggcucacugcaaccucugccucccggguuuacguucuuuaauguccugguuaucuucucccuaccgcuuuuaucugaaccuuuccuuucgucucuacuaacuugucucucugcagcucaaucuggauuauauuuccaacaguuuguccucagugacgggcuuuguucuggaaggguauaguggccagcuagcaugaacaacgauagaacccugugcugguuaccgcuucuuagucacaaagucaucccuucugccuguugagcaaaaaugugccuggacacuuuaaaacuuuuccuuugacagcuggcauguuaacuucugccagcggagaacaauggagagauuuuuacuuccuguuccuguguguuuuucagcaggcucccacagcacccaguuccucaaagccagguucugacauauaagugagcucagagaccagcagcuucccucagcaccucaucugaguaguuuuguagcagagugacaccucucaugaaaagccuuucagcacgcuuccccagagaagcacaucagcaauuacucugccauucagugagccacaacugagcccuuucuaaccagguaugaaucucagcccugggguggugguagggaaaugggggacucauucuuggacacacugucuuagcccuaaggguaguggcugcuccuuguauguaugcauauaugucuguguguauguuuuuuucuuuuuuuuugagacagggucucacucuguuacccaggguggaaugaaguggugccaucugggcucacugcagcuacgaccugccagacucaagcaauccucccaccucagcccccugaguagcugggacuaccagguacccaccacguccagcuaauuuuuaaauuuuuuguagagacaaaaguuucaccacguugcccaggcuggucucaaacuccuggacucaagcaaucgcccugccucgaccucccaaagugcugcaaucacaggcgugagccacugaacugugacuacgugcuauuucuauuuucuuuaaagaucuuuuuacuuuguacuagucaauccuucauuacuccaaucuugcuauaguuaaauuccuuauauuaacuuucucuauucaaacuacugugugguuugaacucuugacugguccagucagauccuucauaccuuaucccagagccccuguauuuacuuguuauuccauuacggaaaacuacucccgauuaacugcugcucuucucaaauaugcccuacgagcuuuccagaaaaacgguuggcucuguuagcauucuuuaugcugucaggugcucugcugcuucccuucaguucccccugcacaaaugcuaguauuaaccaagccucuuauauagauuuuggugguuugucccuaucccuuuacggguauguggggaaauaucauuuugcuuugacguagauggcaucuguagauuuuguugguuccucaacucuacuugcuuugucuuauuuuuaacuuuacuuuaaaauaauuucagggcugagcacaguggcucacgccuguaaucccagcacuuugggaggcugaggcaggcggaucacuugaggucaggaguuugagaccagccugaccaacauggcgaaaucccgccucuacuaaaaauacaaaaauuagcugggcguaggggugcgcaugccuguaaucccagcuacuugggaggcugaggcaggagaauggcuugaacccacgaggcgcagguugcagugagccaagaucgcgccauugcacuccagccugagacacaagagugaaucucugucucaaauaauuuugugcaggaaacaaaaguuuucacugcgaccugcugcaugagaucagguauggaauuuucuacuuguggcaugacauccacacucaaaaaguuuuagacugcagaugcucaaccuguauuaauauuucacauuugcuuccccauucuuucuccugaaccaugugcaaguugcaggacuugaugccacuuacccuuaaauauguauuuccuuaaaaggauaucuuuuacauaaucagaguaauuauuaacacuuauacauacuauuaucuaaucuacaacacuuauucaaauugucccacugauguuuuagcaaaagaaaauuuuugcaaaaugguuuugccucacccaguaguuauuuaaucuagguuuacauguuguuuuuaguugucauaucucuaguucuuuaaucuggagcuuuuuuuuuuuucauggccuuaacauuuuugaagacuacaggccaguuauuuugcaauucuuuuguagaauccucaauuugggcuugucugaggucuccuaugauuagauccaggcaaugcauuucuggaaggaauguuacagaggugauggugcauauuucucagugccaucauaucaggagguuuaaaucuguuucacuacugguaauuuuaauauuuuuuaauacuaaaauuuucauacaguaaaauguacacauauaaaauauacucaauucuaugaguuuuuaaaaugcuaauaccucccuaacuucuuugaagauuauuaacacuuccaucaaccagaaaguucccuucauacccuuucccaguuaauccccacugugcacaggcaaccauaaaaccauucugauuuucuuucccaucauagauuauuuggcuguucuggaauuucauauauaguuuuucuacagaguccuuaggauuuucauuucaccugcaaacacaaaguuuuauuuccucuuguuaaacuguauacauuucuuuuucuugccuuauuguacuuguuaggaccucuaauacaaugauaaauacaagugauaagaguaaacauauuaauauugcucccaauauuaaagggagcucugcuuuuacuggauaauuggggaagaugaaaaagcuguagccaauacugcuggcauccucucagagucccuucucuccaccaauuucuuacuccucagguuucaaacacauccaagucuccuaauccuagaacacucuacccucacaccuggcucuuuauucuccaaagaguaguguaucauucaucaccaacuuacucucuaacccuuacaaccacacuugucaauuuugaaaggccaucccaaacugccagagucaaagcucucucccacacuuaguaacagcuaccauuuaaaaaucuguguuccugucuauaucauguacuucaaaaaagcaaaaaacaaaaaccuaucugucaaggucugugcugagugguucacaaacauucucuaacaacucagggacaauuaggacuauuuaacuugcccagguaacaauauaggacuguuaauuacacgaaaccaauacgauuuuaaaauaauuuucuaauuauacauacauaugguauagaaaaaaauaauacagaaaaucuacugcaaacaaucaggucccaaaacaucuucaauuugugauuuuuaucuaccuacuuuuucuugguauacuuguuccuucuucagcuaaccacuucucagucucccuuacugcuaauccacagguucugcucuacaccucccuucuuuccaauguauuacucuccuugagcgauuuuauuuauccacaaaccucaacuauuaucucuauuuucaagugcacuucucuagaccuaacccaucucuuuggcaucaagaauuuguuuucuccaaccaauucugcuccuucugcuuucucucuucaaguuaauuacauauuauucaucaagucacuuuggauagaaaucuuuaggaaaauuugcauuaccuuuuuauguaaagaaagcucaacaguguacauuuaauccaauugguggcaaguucuuuagccuuugccuuuuugagcuuggcaaugcgagucacagacuugggacccaggacauugccuccccagugauggcagaucucaucguaucugucauuguaauugauccugauagcuuccaccagcuuagacaaaccuccuuugucuuccaaguuaaccugugugaaggcaaccaguggugcaggucuuucuguggaguagacaucccacucuugacuuccccuugauaaugcaguaagggacccccauuuuacgacacagggcagguaggaagacaaccagcuugaugggauccaugucauaugcaaucaccacuagcugagucuucguguucuccaccaagguggugaagugcugacuccugcuugaaagacagguggucucuuacuggggacauccccuuugcuggcagcuuucuucucagccugggccaauagccucugcuucuuucucuugcuuugccucugaucuguacuugugggccagcuuaaguagcugaguagcuguuuggcagcgcaaggccuggaugaacugguuaaucgcaggaggcauuuucagcugcauauagaggauggcucucugcugcugcaaccugauauagcagggccauuucacaaagcaggugaggucucuuuugggcuggguguccuguccaaugccaaaauucuuaggccuuuucuuaaauagcggauucaccacuuucuuggcucugcuucuugacgacagcaggggccagagccaacuucuuccccuugcccuucuuuccuuucggcaucuuggguggcgggaggagaagaaaucuuauuuuugacucuuccuucucuaauuaacaauaccucaguuccaauccuuuaaguuuagucuccaaaacaaggucuuuuacaaacugaauuuccauuaacagaaaaauggauaaauaaaucaaguguauucacacaauauaauauuugcuauagaguaguaaaaaagaucuagagcaagguuugucagccaugacacuacuaacauuuuagccugguuaauucuguuaugaggcuguccagugcguuuuaaguguuuagcaacaucccugaucucuacauguuaggugauauuaacacuaaccccaguugugacaacaaagaugucuccauauaaugccaaauaucccccagcgggcaaacuugccccuaguugagaaccacuaagcuagagccucaugauucaacacauguaaacuucaaacaauuuuacauaaauaagagaauuacaguaugaauuauucauaugaagguaaaaaaaugcacaaauugauaaaauagaauguuuguaucauucccacugggaaugucacaggacugauaaugaaguuucuaaucaaacuaugcuaaucaguagcauacuacccaguuuaaaagguacaauuacuucuacuuuacuccacacuauuucuuguuugcuacaaucuucucuuuuucuuaaugaaguacguaagaaaucaaaacuauuggggauucaaauaaauuagucuucuauaugcacaguuggcuaugguuauaauauuagauauacucuaaauauuucauuucagauacaaauuauguuaaaaucauuauggguuuauuuaaucauagaauaaaaguauuaaaggaaaguuguuuuuuaauaagaauauacugugauugcugcauuuuuuuuuuuuuaagagauagagucuugcuuccaccuccgccucccaaguagcuggggcuauaggugcacgccacccauguccaccagcucuguugcuaaugcuuucauugcuaguuugauaugaauuucaucaaguuccuuaaguguaaugagcaacauacauuguuuucaaaucauucccacuggucuuucuuggauuugcuuguaauacaaguuugcuguauaaauaauaaagauuacauuugaaauuguaguaauuucuggacuauuuguuaucuagaacauucuggacaaauauucaauauguaagggcaguauagaccuuccugaggauaaaguuuugaagaacacucaccugggaauaggaauucacauuaauauauaauuuacagcaaggaccccaggucacuuccuagacuugaggguagaggagcuaaugccuaaauuucacuccucuuuaggugacucuacuaacugaugaaauggcuauaacagaagcgacugaucgaugugcuacuuaaaaacagcuagaggcugggugugguggcugucuguaauccuagcacuuugggaggccgaggugggaagaucacuugaggucaggcauuugagacuggccugggcaacauagugauagcuagucuguauaagaaacaaaaaaauuagcugggcgugguggcaugaaugcaguggggcaaucauagcucacugcagccucaaacuccugggcucaaguaauccuccugccucagucucccuaguggcugggaccgcagacaugugccaucaugcccagcuaauuuuucaaaaauuuuuuauagagacaaggaucuugcugugcugcccaggcuggucucaaacuccuggcaucaagcaauccuccugccuuggucucugaaagugcugggauuacaggcaugagccacuaugccuggccaacuuaaagauacugauuuguuaaaaugauaaucuuuuuuuucuuuuuuuuuuuuuugagacagagucucacucuauugcccagacuggaguguaauggcgcaaucucagcccacugcaaccucugccaccuggguucacgugauucuccugccucagccuccugaguagcuggaauuauaggcacuugccaccaagcccagcuaauuuuuguguuuuuaguagauaugggguuucaccauguuggucaggcugaucuugaacuccugcccucaggugauccacccgccucggcuucccaaagugcucagauuacaagcaugagccaccgagcccagccugauaaucuuuucuuaaauaaaauauauuuaaaacauuuuaaagauacucugaaaaugcuaccuuugauuuaagaggccaaaaggcauguaauuuaacacacaauaacaucaaguguuacugaacgcauaggcaacagcugaaauacucccaauuacauguucaugucacaguaauuuuaugugauagagaacaaaaucaagagaaaaaauguuuuaucauaguuggaaaaaagacaauuuaacaugcaagaguacauuuuaacauaauuauauuugaguaaacuuuauaagacuuaagagaaauuaaauauuuuucuaaauuccaaagacacaaagaugaaaaauuugcuacaaguuacauaggaguuuuggucaccauuuucaaauauuaucaacuuaacuucuuuccucuaaaacaauaaaaaccucaacuuacaaauuccuuuuucuguaauuucugaaauguucucauuacuaacagggucucauauuucagacauuauuuguuggcuucuaaccacacaucuaaagauucauacuuacaaaguccuccucuucaaacugcaacuuuuccaccuugucuucuuucuuuucuucccuaaucuccauagguggcuuuuccugaaaagcacacccuuuccgggaguggaagcugccauuccaauggcgaugguucccugugccaccuccacuacguuggcucaugccaucaugaccucgggaagagcuaugccaaccagauggguucccugugauuccagcauaugcucccuuagagacaccagaguccacagaaucauggcggaacagggagggcuggugccaagaaucuagaauaguaaagaaaaggacuaauuagauuguuugcuuccugauuugguuuacgguauuggccaaaggccuucaggagaccucguuaauaaaaaguccacacaaaaaaaauaaaaaaauguaucuuuucuuugugagguaauuucugaaaucaguucaacugaacagaugauucaugagaaucauaaucauaguuagaccuagaaagccaauguaguugcguaaugacuacuagagaaucuaaaugaaaacuauguucagaaaagauccuauuucaagauuacagacauguacccacagccugggcuuguccuaaaugaguagcuuaaauauagucaugaaaguuggacauggcucaccuccugcaguucguaggggaccauuguuaaaaaaaccaucagaggaauuaugucgacggcggcuuacuccaaaucuaccuucuccucuggguaggugcucuccguguuuuucgaagguggcaguaggugacuaagaugaugaaguauggagaggcaaauggauaaauagcuauuaguccuuuucaauaucuuaauaggcuuugcaucaggccuucaaaaaacaaguaauaauggugauagaaacucauauuguaagcauauggacccuaaggguacccacaggugccuaauuuagagaaguccuagguuauauauucaauugcuaauucacuuccuuuauuccaggagaggagaaaagcuagccacuucaauuguuugcaugaaaggaggcggaggggaaaaaagccuugcaaauauucauaaauauaagcuccaaaacuuuacacuuaaaaauauuuaccuuguaggagaggaaaaucaagaugauugccucaaaaauaauucuaaaguuuuaguauuucuggaauaagggugaaggcaacgguugaaauaucaccuugggaggucaguaguaauuacagaacuuuuaaaaaaaaaaaagagaugaagucucacggucgcccaggcuggagugcaguggcacaaucaaagcucacuacagcugcuuacccuugagcuuaaaggauccuccugccucggccuauggaguagcuagaacuauuggcccaugccacuaagacuggcuaauuuucuaaauuuuuuguagagaugggggucucacuauguugcccaggcugaucucucaguccuggccucaagcaauccuccugccuuggccucucaaagcucugggauuacagguauaagccacagcucccaacuacuagaguuuuuacaguuuuauaaaacauuuauuuccagauauaauaccuguaacaauacuaaacuuuuggcaucauacccauuuuacucauuuacacauaaugaaagaggucagagagaaaaaauaagucuuugagguaacaaaacuggaaggaagcaguuugagaaacauuauuauagaugaacucuaauaucccuuccuauuucaaagaauuuuauucuaugacauucuuaaaugauagagaccaaaguccacaaagccaugaaaauauggguauguuugacaaggaaaaccguaaaucggggcauguuuacauuuauuuuucuuacuaucaacauccuugccaauauuuuacccauucgaguggguaaaaagauuuucuccuguuuucucuuaaaaguuuuaugguuuuagcuuuuuaacuuauguuccauuucagguuaaucuuuuuguguaugaagcaaaggcugagguucuuuacuccgcccccauguagauagaagcuaguucuucuagcucaaaaacacaacacuaucacuuccccauugaauuaccuuuguacuuuagucaaaaaucaacaaaauacauacauaagccuuuuuuuuuuuuuuuuaagagccagggucucagucacccaggcuggaguacaguagcccgaucacagcucacuguagccucaaacuccuuggcucaagcaauccuccugccuuagccucccaaguagcugagaugacagguauucaccaccacaccugccuaguuuuuguuguuguuuuuuuuuuaaauuuuucuuguagagacaaggucucacuuugcugcccaagcuggucucaaacuccuggcuuucaagcaauccuucugccucagccucucaaagugcugggauuacaggcaugagccacugagcccagccucuacaggccuauuuuugaacucucuauucuauuccuuuuaugucuaucauuaugccaaaaccacagggcuuugcuuauuauaguuucgaaaaugaaagaaugucuucuaauucuuuuuacuuaaguucacggugcuaaaacaauuauucuucucugauagaucuauauacuuuucagguagcccacuagcuccaagcuuugggucagauuaggccaauuaugagguccugcaaauuuuguuaagacaauuugaaaugauguuuagagccggguguggugguucauugcuguaaucccagcacuuugggagacugaggcagguacaucgcuugagcccaggauuucaagaccagccggguaacauggcaaaacccugucuucuacagaaaacuacaaaaaauuagcugggagugguacugugcgccuguaaucccagcuaccugggaggaugagguaggaggaucgccugagccagggaagucaaggcugcaguaagccaugaucgcaccacugcacuccagccugggcaacagaguaagaccccgucucaauaaaaaaacaaacaaaaauccccaaaugaaguuuagccugguacaguggcucaugccuguaaucucagcacuuuuggaggcugaggugacaggaucguuugaggccaguucuagaccaccuugggcaacauggugagacccuaucucuacaaaaaacccaaaaaaguuagcugggcaugguggugcucaccuguaguaccagcuacucuagagacuagggcgagaggauugcuugagcccgggaguucaaggcuguaaugaauuaugaccaugccacuguacuccagccucggugacagagacccugucucaaaaauaaaugaguaaaauaaaauugaaacaaaaugaaguuuagagcaaaagaucaugggucuagaugagaccagaagcaccuucccaaaaguccacauuuuaaaauaggaaagguaggccuuuauuuuugggaaugccuaccaauuucauccuuccucuauucgcuggcaaaaugggaagcacuuuuaaguuuacuagcuucccaaacguuuuaucaauaacucaggcugauucuuuuguguacugugacuaggucugcuuuaaucuauauaaacugguaauuccauuuguguuuacccuuaauacaacacacauccccccugaaacuauuaaguagguuaaugccucuaaaacaguuucuaggauuuaaucugagauccauguaguaguugaacaaucacugccucuaccuuuuccuccucuucaucuaucgccauaaacaaauguguguucacuccaaaggucuguuuacccaagugccauuccccuuuuacuucugccccuuugaccuccacaauagguuagcaaguacguuuaaucuccaaagugugcugcagcuaauacaacacuuaacugugucauguaaugagaaaagccuuaggauauaaugaaaaaagugagauacuuaaaaaaagaaaaaaagaaacauaaaaaagugagauacuuggcaguaauaagguagacauucauguggacugccuaauuacuuacauccuucuaacagaaagcuauuaagucuaugaaaauguuuuugaaauccucacacgagguugaauauauuaaaaaacaucaagacugggcugagugcaguggcucacgccuguaaucccagcacuuugggaaguccagguaggcggaucacuugagcuuaggaguugaaaaccagccugggcaacauggugaaauuccaucucuauaaaacaacaacaacaaaaacaaaaauuagcagggcguggugguacacagccuguaggcccagcuacucugggagcugagucaggaggacugccugagcccaggaggccaaagcugcaguaagcugugaucacacuaccgcacuucauccugggugacagagggagacccugucucaaaacaaaaugaaaccaaaaaacaaccaaaaccacccccaaacccucucauauuugagaaguuacuacaggaauggagaacaguaccuuagcugacugugguguugagaaauuuagccaagcaggaacaaaaucaugcugcgccauuuagguccagugucuccuuucaguaaggugaggcauccaaccucauggccaggaucugaaaacaaaacaauucaaaucacuuauguuuacaagaaucugauaccaauguguaaaggaaucuguaauuauucuaagauuccucuuuacagaaagaccugcccucugagccugucuacagauuacuuaccaagccuuauaacucagagaaguucuaaauaaaagcaauuuuuguuaaaacaaaaguucuaaacaaaagaaaacuguaacaugagccuggaagauuuauuuuuuggagaggaagggucuugcuauguugcccaggcugaucuugaacuccuggccucaaaagaucauccugcuucagccucgcaaaguguugggauuacaggugugagucacugcgcccagugaaucuggaagguuuuaugaaggaagcuaaugaauucuugauuguuacaucaaagaacaugaagaauuaaacaucuauuuaaaaccacagacacuuaugaaaagagauuaaucugcuucaaguacucagguaacuucuagcaaaagcaguagaaaagaucuucuuggcugggcacgguggcucacaccuguaaucccagcaccuugggaggccgagguggaucgcuugagcccagcaguucgagaccagucugggcaacauggcaaaaccucaucuguacaaaaauaauaauaaaggagccaggugugguggcacacgucuguggucccagcuacucuggaggcuaaggugggagaaucaccugagcugggaagguugaggcugcagugagcugagauugcaccacugcacuccagccugggugacagagugagacccugccucaagaugggggaaaaaaagaucuuccuagagaaggacgauacaaccucucaagagcuuuuauauuuaguucacauuaauuucuucaaauaccaacuagcaucaguuuuccugagaucuguuggugucuucaaaccaccccacugauauucuccaaaauuaauuacaucagaaagcagucgguauuuuucaugaugcauauacauagagucuucuuuccaaguuagacauauggagaauauuuaccccagaguguaaccucugugguccuguuucugaacucgagucggccagcuggaucucccacaagguuuccuuguuaaaagggugcuuaaguaaccuggccggcagcacgacuuaugaugaagcacgaagaagccagguucugugucgaucacucucucaguccccucaac

SEQ ID NO: 12636 - RNA, 823 nt, Homo sapiens
guuauucaauccuggugcagacaaugccaauacaaagaugucaugugacccagaaauccgugugcagcaagaaaccuugguagccauagaguuuuuguuguuuuacuccagggauuuaaaaauccacuuagugauuaaugcccauuccaggcuuauguacagcaaaacaaucucuugcaguugaaguuggccuuuauauucccuuuagaaugaaaguaucaaaccauccacugauauacuuaaaagccuuaagagcaucuuccauguguauagaguguccuuguaguuccaaagguggcuuugcagggaggcaguagcucuggcuuggcaguuccaaagauaguuuuuccugggccuucucucuugaaauaggagccauagguuuuauauauacuuaauaaaaaucagagaaaagacaagagauuuccaguguccccaaaucagauggaggagccuguaaaccauccuuacuuacauggccagcgugguggcagcccagguggugagaggaaccaucuucagggggacagaccuggagacugaaaaugaagggaaaauguggaaaacugggauuuaaccaacucgcccuugcaucugccacaaugggacauuguuaggccugggcuucaugaaacaauagacuucgauaggacauaauacccauucagaggucagcuuuacauccuagcucuugggccacugagcucccuuugaauuugcaacugcugcacacaauguguguguuacagauuauuuggccuaagucucuuccuguucucccucccccaugacuuaacuucugcucuacucuuccaguaagucc

SEQ ID NO: 12637 - RNA, 6202 nt, Homo sapiens
ggcagcggauagaggacacgaccaagauggcggcggugucuggcuuggugcggagaccccuucgggagguaggcagcagcgcgcggccuguauucccacgcgaccccugcccacccugcgucccgccgucaucuuccucucucccugccaggucuccgggcugcugaagaggcgcuuucacuggaccgcgccggcugcgcugcagguaacaggcgcgggugcucgucggacgagggcggggaggguccccccuucucucgggaaggaggccggagucgcgccugcgcuguggccuuccggcgccgugggccuuggguuugcggagccagcauccuccguggagcuccugcugccucugucgccgccuggcaauuagcacaccggcgagucaccaccucacagcuggcugggcaaugggggaaaacuaagacuaggcguuuccucccucacuccauguuuuuuucuuuaaauugcagcaaaauagaccuaacuuaaaauguacuuuuuagaaguguauaauucaguggcauuaaguacauucaccauguuguacaaccauuaaccaccauccauuuccagaacuuuuuaaucaucccaagcagaaacuguccauuacucgguaacuccucauuucccuuccccaaaccccugguaaccccuguuguacuuuucugucuuuaugagguugccuauucuagaacuucuuauaaguggcaucauuuguccuuuugugucuggcuuaucucagcguaauguccucaagguucauccauguuguagcaugcgucagaguuugauucuuuccuaaggcugaauaauauauauauguauauuuuuuugagauagucucccucugucacccagguuggagugcaguggcgcgaucucagcucacugcaaccuccaccuccugggcucaagggauucucgcgccucacacuccugaguagcugugauuagaugccggugccaccacaccgggcuaauuuuuguauuuuuaguacagacagggucucaccauauugcccaggcuggucuugaacuccuggccucaagugaucugccugccuuggccucccaaagugcuaggauuacaggcaugagccaccucgcucagcccgacauuuucuuuuuuuuuuuugagacggaguuuugcucuugcugcccaggcuagagugcaguggcacuaucucagcucacugcaaucucugccuccuggguucaagcaauucugccucagccucccgaguagcugggauuacaggcacccgccaccacacccggccaauuuuuguauuuuuaguagagaauggguuucaccauguuggccaggguggucucgaacuccugaccucaagugauccaccugccuuggccucccagagugcuggaauuacaggugugagccaccgugccuggccuuguuuugucuauugugaguaaugcugcugugaacauugaugugcaaguauaugcuugaaucccugcuuucaauuauuuggggcauauacauagaaguggaauugauggauuguauguuaauucuccucuccuuccuuuuuuuaacuagauuuuaccauucauuauauuaaaagagcaacuccuacauucuggaugcaaaguauuuggcaguacuuggcaccuagugagcacucaguacauuaacacaugcaaagaccaacuauguguaauagaaauguuacuuuuagaauucuuugaguuuuuagagagaagcuuguucuaguguuuuuauauuguaugcugugggcagccuagguaaauauaaaggaagaaaaucuuaguugaaucccaaacaauucuguauugacuguuuuugcauaccugugacaggugacaguucgugaugcuauaaaucaggguauggaugaggagcuggaaagagaugagaagguauuucugcuuggagaagaaguugcccaguaugauggggcauacaagguaacuaaaauauaugaaaguuauacaaaauugaggucacuguuacccccagauacacuuaagggaucaacucuuaauuguagguuagucgagggcuguggaagaaauauggagacaagaggauuauugacacucccauaucagagguaagccuuccagugggaagcagacccuggagggcaugucuguuaguguccauuauccucauuuuuauggauuuucacuuauguuuauauuuuacuuuauagaugggcuuugcuggaauugcuguaggugcagcuaugguauguaauacucuuuaugaaacuuauccaaagacauuucuuguuuucuuuuuuuuucuuuugagacagagucucacucuguuguccagccuggagugcacuggcaccaucucagcuuccagguucaagcaauucuccugccucagccuccauaguggcugggguuacaggucgcgccacugugccuagccaauuuuuguguuuuuaguagagaugggguuuuaccauguuggccaggcuggucuugaacuccuggccucaagugauccgaccgccuuggccucccaaagugcugggauuacaggcgugagccacugugcccauccccaaagagauuuaacaucaccuuuuaaaaacaucauuugggaaaaaaaaaaaauaccaaguagguagaugugguggugcuugccugcagucccagcuacucgggaugcugaggaaggauuacuugagccuaggaguuagaggcugcagugagcuaugaugugugccacugcacuccagcaugggugacagugagacccuguccauaaaaaauaaaaauaaaaaauaaaaacauuauuugaauguuggaagacuuggagugauuuguuugcuacuguuuguugcuguuucuagucuuuuuaacauccacguuuuugauuuuacaggcuggguugcggcccauuugugaauuuaugaccuucaauuucuccaugcaagccauugaccagguuauaaacucagcugccaagaccuacuacaugucugguggccuucagccugugccuauagucuucagagggcccaauggugccucagcagguguagcugcccagcacucacagugcuuugcugccugguaugggcacugcccaggcuuaaagguggucagucccuggaauucagaggaugcuaaaggacuuauuaaaucagccauucgggauaacaauccaggucagcacagggacccuuugguuuuuuuugaagauugaaaaacuaaaaugauauauuugcacagaggaaaccauuaaagucuuuuaguuaggcuuagauauaucguauagaauguuaauacuuuauauaguaaagauaguaaagaaugugcuugcuuuuccuauuuccgaauauaagggggccagcuagguaaaggggacauuuacugcacacccacaauacugguuugauagauaaaauuauauugaccacuacaaauuuaaguaccuaaacugcucucaaggcugcuggucaugguagagauaaggcuaaucagcacaaugaaacuucucacaagaugaaugauauugcuuucuaugcaguuuuagucauucuggaugugauuaauuacuuuuguuuaaauauuuauguuuuucagugguggugcuagagaaugaauugauguaugggguuccuuuugaauuuccuccggaagcucagucaaaagauuuucugauuccuauuggaaaagccaaaauagaaaggcaagguaagaaaacuaagauauauaaacaguauuuuuaauccagccccucaauuuugguaaaauuuaaucuagaaguuacugucauuuacuuugacugaaaaauuauaggaugagcucaagaugccccaauuucucauucaguugugcuuuucuagaucucagucugguagguuuguguuucauuucuaggaaggcugccacauuccucagcucacuggaaugaaguugaauugaagacuuuaugaaugaacaagagccacagcuggcggcacagugguguagcaucuucaguuucaaccugaucucugaucugugaccacucuguuuucaggaacacauauaacugugguuucccauucaagaccugugggccacugcuuagaagcugcagcagugcuaucuaaagaaggaguugaaugugaggugaguggacauuuacuuguucuuaaagaauuagaagggcuccuuuuagauuuaagacccagaagaguucuguaacagguuaauuagauguaaaaccuugcuuugucacucauuucugucucugcuuaaagcugggaaccugccugcaguucacauacuuagcuuuuuaccacucaggucacuuagguucuggaucuuuuuuuuugagagacagugggagcucucugaaccucuucugguucucagugauaccccccgagagagaaaaaaacaggcuuuuguucuguugcccaggcugaagugcaguggcuggaucauggcucacuguaaccgugaacuccugggcccaagugaugcucccaccucacccuucugagguucuggaucuuuuagaaacucaccaugugcuaguuauacuugggcaaguuauauacucuaaaucuguuucaucagcuauaaaacagggauaauauaaauacugucccgucauagggcuguugugagaauuacacuuaguguagugcuugguacaugaugggcacucagcuguuaacuguuaacucauuuugaugagggaauuuaaagugaaggaggauuggcugggcgugguggaucaccugaggucaggaguucaagaccagucuggccaacauguugaaaccccaucucuacuaaaaauacaaaaauuagcuaggcgugguggucuaugccuguaaucccagcuacuccagaggcugaggcaggaaaauggcuugaacugggaaggcggggguggcagugagccgagaucacgccacugcacuccagccuggacaacaagagcaaaacuccaucccaaaagaaauaaaaaagugaaggaagauaaaugaauccuauaacugcacagagcugcuugugguagacauacagaucuuuguuuuaauuaaaauuuuuccuuuuacaguuuguacauucaugaauagguauucauaggcagauuagauuuuccuagauacaaagauuaacaggaaacaaaaaaggaaaugguauuauggggauaaggcucuauuugugcugcaauagcucuguaaacuugauuauauuaccuguuuaggugauaaauaugcguaccauuagaccaauggacauggaaaccauagaagccagugucaugaagacaaaucaucuuguaacuguggaaggaggcuggccacaguuuggaguaggagcugaaaucugugccaggaucauggaagguauuucaaagaaacugguucuagaauacagucaagcuauaguaaacaucauguaccugaauacguacaggauaaagagauugaaagcuaggaguggccaaacgacuucaacuuuaaacuuguaaguuuggcauuucucuucaggcagauauuuuuaaaagcaaauccagaaagcgguuccccauaauuagcauuccuuacauuuucucuuccuggucagccacaccucugugccaaggugguagugcccagcuggcauuugcacucucucaguugagccuuccuucuccuagguccugcguucaauuuccuggaugcuccugcuguucgugucacuggugcugaugucccuaugccuuaugcaaagauucuagaggacaacucuauaccucaggucaaagacaucauauuugcaauaaagaaaacauuaaauauuuaguuuggacuugaauaucaagucguugaaauuuauuugaaauacuugcuggcacugcaccuggauuuguacugcaagaccugacuauucauaacggaaaacgauuucuaaagcaacagcagguauuuuuguacagggaaguuuaaauguguuuguguauggaaaacucuccacucuccuccccuagaugccaugcuuccuuuugucuguuacgguugccauguucuuugaauaacaaauuauauaacauuuuauccucucucaccacaaggacaaaguauggauguggcagaguccucaugaaagauguauccaaacaagauaacuuauauguauaaaauuaaagcauauaauauacauuuacuguuaguuuguuuugauaaggaauaaaggaauuucuaac

SEQ ID NO: 12638 - RNA, 6202 nt, Homo sapiens
guuagaaauuccuuuauuccuuaucaaaacaaacuaacaguaaauguauauuauaugcuuuaauuuuauacauauaaguuaucuuguuuggauacaucuuucaugaggacucugccacauccauacuuuguccuuguggugagagaggauaaaauguuauauaauuuguuauucaaagaacauggcaaccguaacagacaaaaggaagcauggcaucuaggggaggagaguggagaguuuuccauacacaaacacauuuaaacuucccuguacaaaaauaccugcuguugcuuuagaaaucguuuuccguuaugaauagucaggucuugcaguacaaauccaggugcagugccagcaaguauuucaaauaaauuucaacgacuugauauucaaguccaaacuaaauauuuaauguuuucuuuauugcaaauaugaugucuuugaccugagguauagaguuguccucuagaaucuuugcauaaggcauagggacaucagcaccagugacacgaacagcaggagcauccaggaaauugaacgcaggaccuaggagaaggaaggcucaacugagagagugcaaaugccagcugggcacuaccaccuuggcacagagguguggcugaccaggaagagaaaauguaaggaaugcuaauuauggggaaccgcuuucuggauuugcuuuuaaaaauaucugccugaagagaaaugccaaacuuacaaguuuaaaguugaagucguuuggccacuccuagcuuucaaucucuuuauccuguacguauucagguacaugauguuuacuauagcuugacuguauucuagaaccaguuucuuugaaauaccuuccaugauccuggcacagauuucagcuccuacuccaaacuguggccagccuccuuccacaguuacaagaugauuugucuucaugacacuggcuucuaugguuuccauguccauuggucuaaugguacgcauauuuaucaccuaaacagguaauauaaucaaguuuacagagcuauugcagcacaaauagagccuuauccccauaauaccauuuccuuuuuuguuuccuguuaaucuuuguaucuaggaaaaucuaaucugccuaugaauaccuauucaugaauguacaaacuguaaaaggaaaaauuuuaauuaaaacaaagaucuguaugucuaccacaagcagcucugugcaguuauaggauucauuuaucuuccuucacuuuuuuauuucuuuugggauggaguuuugcucuuguuguccaggcuggagugcaguggcgugaucucggcucacugccacccccgccuucccaguucaagccauuuuccugccucagccucuggaguagcugggauuacaggcauagaccaccacgccuagcuaauuuuuguauuuuuaguagagaugggguuucaacauguuggccagacuggucuugaacuccugaccucaggugauccaccacgcccagccaauccuccuucacuuuaaauucccucaucaaaaugaguuaacaguuaacagcugagugcccaucauguaccaagcacuacacuaaguguaauucucacaacagcccuaugacgggacaguauuuauauuaucccuguuuuauagcugaugaaacagauuuagaguauauaacuugcccaaguauaacuagcacauggugaguuucuaaaagauccagaaccucagaagggugaggugggagcaucacuugggcccaggaguucacgguuacagugagccaugauccagccacugcacuucagccugggcaacagaacaaaagccuguuuuuuucucucucgggggguaucacugagaaccagaagagguucagagagcucccacugucucucaaaaaaaaagauccagaaccuaagugaccugagugguaaaaagcuaaguaugugaacugcaggcagguucccagcuuuaagcagagacagaaaugagugacaaagcaagguuuuacaucuaauuaaccuguuacagaacucuucugggucuuaaaucuaaaaggagcccuucuaauucuuuaagaacaaguaaauguccacucaccucacauucaacuccuucuuuagauagcacugcugcagcuucuaagcaguggcccacaggucuugaaugggaaaccacaguuauauguguuccugaaaacagaguggucacagaucagagaucagguugaaacugaagaugcuacaccacugugccgccagcuguggcucuuguucauucauaaagucuucaauucaacuucauuccagugagcugaggaauguggcagccuuccuagaaaugaaacacaaaccuaccagacugagaucuagaaaagcacaacugaaugagaaauuggggcaucuugagcucauccuauaauuuuucagucaaaguaaaugacaguaacuucuagauuaaauuuuaccaaaauugaggggcuggauuaaaaauacuguuuauauaucuuaguuuucuuaccuugccuuucuauuuuggcuuuuccaauaggaaucagaaaaucuuuugacugagcuuccggaggaaauucaaaaggaaccccauacaucaauucauucucuagcaccaccacugaaaaacauaaauauuuaaacaaaaguaauuaaucacauccagaaugacuaaaacugcauagaaagcaauaucauucaucuugugagaaguuucauugugcugauuagccuuaucucuaccaugaccagcagccuugagagcaguuuagguacuuaaauuuguaguggucaauauaauuuuaucuaucaaaccaguauugugggugugcaguaaauguccccuuuaccuagcuggcccccuuauauucggaaauaggaaaagcaagcacauucuuuacuaucuuuacuauauaaaguauuaacauucuauacgauauaucuaagccuaacuaaaagacuuuaaugguuuccucugugcaaauauaucauuuuaguuuuucaaucuucaaaaaaaaccaaagggucccugugcugaccuggauuguuaucccgaauggcugauuuaauaaguccuuuagcauccucugaauuccagggacugaccaccuuuaagccugggcagugcccauaccaggcagcaaagcacugugagugcugggcagcuacaccugcugaggcaccauugggcccucugaagacuauaggcacaggcugaaggccaccagacauguaguaggucuuggcagcugaguuuauaaccuggucaauggcuugcauggagaaauugaaggucauaaauucacaaaugggccgcaacccagccuguaaaaucaaaaacguggauguuaaaaagacuagaaacagcaacaaacaguagcaaacaaaucacuccaagucuuccaacauucaaauaauguuuuuauuuuuuauuuuuauuuuuuauggacagggucucacugucacccaugcuggagugcaguggcacacaucauagcucacugcagccucuaacuccuaggcucaaguaauccuuccucagcaucccgaguagcugggacugcaggcaagcaccaccacaucuaccuacuugguauuuuuuuuuuuucccaaaugauguuuuuaaaaggugauguuaaaucucuuuggggaugggcacaguggcucacgccuguaaucccagcacuuugggaggccaaggcggucggaucacuugaggccaggaguucaagaccagccuggccaacaugguaaaaccccaucucuacuaaaaacacaaaaauuggcuaggcacaguggcgcgaccuguaaccccagccacuauggaggcugaggcaggagaauugcuugaaccuggaagcugagauggugccagugcacuccaggcuggacaacagagugagacucugucucaaaagaaaaaaaaagaaaacaagaaaugucuuuggauaaguuucauaaagaguauuacauaccauagcugcaccuacagcaauuccagcaaagcccaucuauaaaguaaaauauaaacauaagugaaaauccauaaaaaugaggauaauggacacuaacagacaugcccuccagggucugcuucccacuggaaggcuuaccucugauaugggagugucaauaauccucuugucuccauauuucuuccacagcccucgacuaaccuacaauuaagaguugaucccuuaaguguaucuggggguaacagugaccucaauuuuguauaacuuucauauauuuuaguuaccuuguaugccccaucauacugggcaacuucuucuccaagcagaaauaccuucucaucucuuuccagcuccucauccauacccugauuuauagcaucacgaacugucaccugucacagguaugcaaaaacagucaauacagaauuguuugggauucaacuaagauuuucuuccuuuauauuuaccuaggcugcccacagcauacaauauaaaaacacuagaacaagcuucucucuaaaaacucaaagaauucuaaaaguaacauuucuauuacacauaguuggucuuugcauguguuaauguacugagugcucacuaggugccaaguacugccaaauacuuugcauccagaauguaggaguugcucuuuuaauauaaugaaugguaaaaucuaguuaaaaaaaggaaggagaggagaauuaacauacaauccaucaauuccacuucuauguauaugccccaaauaauugaaagcagggauucaagcauauacuugcacaucaauguucacagcagcauuacucacaauagacaaaacaaggccaggcacgguggcucacaccuguaauuccagcacucugggaggccaaggcagguggaucacuugaggucaggaguucgagaccacccuggccaacauggugaaacccauucucuacuaaaaauacaaaaauuggccgggugugguggcgggugccuguaaucccagcuacucgggaggcugaggcagaauugcuugaacccaggaggcagagauugcagugagcugagauagugccacugcacucuagccugggcagcaagagcaaaacuccgucucaaaaaaaaaaaagaaaaugucgggcugagcgagguggcucaugccuguaauccuagcacuuugggaggccaaggcaggcagaucacuugaggccaggaguucaagaccagccugggcaauauggugagacccugucuguacuaaaaauacaaaaauuagcccggugugguggcaccggcaucuaaucacagcuacucaggagugugaggcgcgagaaucccuugagcccaggagguggagguugcagugagcugagaucgcgccacugcacuccaaccugggugacagagggagacuaucucaaaaaaauauacauauauauauuauucagccuuaggaaagaaucaaacucugacgcaugcuacaacauggaugaaccuugaggacauuacgcugagauaagccagacacaaaaggacaaaugaugccacuuauaagaaguucuagaauaggcaaccucauaaagacagaaaaguacaacagggguuaccagggguuuggggaagggaaaugaggaguuaccgaguaauggacaguuucugcuugggaugauuaaaaaguucuggaaauggauggugguuaaugguuguacaacauggugaauguacuuaaugccacugaauuauacacuucuaaaaaguacauuuuaaguuaggucuauuuugcugcaauuuaaagaaaaaaacauggagugagggaggaaacgccuagucuuaguuuucccccauugcccagccagcugugagguggugacucgccggugugcuaauugccaggcggcgacagaggcagcaggagcuccacggaggaugcuggcuccgcaaacccaaggcccacggcgccggaaggccacagcgcaggcgcgacuccggccuccuucccgagagaaggggggacccuccccgcccucguccgacgagcacccgcgccuguuaccugcagcgcagccggcgcgguccagugaaagcgccucuucagcagcccggagaccuggcagggagagaggaagaugacggcgggacgcagggugggcaggggucgcgugggaauacaggccgcgcgcugcugccuaccucccgaaggggucuccgcaccaagccagacaccgccgccaucuuggucguguccucuauccgcugcc

SEQ ID NO: 12639 - RNA, 9699 nt, Homo sapiens
ucagagaauugggaaaaaagcauucauuuuauaugauaaacaacagaacucguuuuaaguuacaaaagacuaaugguacauuuuucaaaaauauguagucuggaaaaugaagaaaaauauacacauaggaaaaaucacuuagaauuuaauuuuguacuuacuuagaaagcuuucuuagacuucauuagacacauuuuuauuauauugcccauacauaaaaaugaaaauacaagcaaauuacauugguaaagguauuucuaaaauuucaucacuuuugaacuauuacuuccgacucagagauugucuggguuuuuccacagaauuuauccuuugcagcacugaaagcacuggcaacaagcauuuccuuacagaauccauaaaagaacuaaagcuguggugcuagguaccuagcugucuuugggaauguuguacaacacaucuuauucaucaauucucucaccauuauaguuuggauuuuuuuccaaucugguguuuuugaugucuuauaguaagcacaggaaauggauggcauugguugacaagcuuggaggaccacuauccauccacuguuaaauggacccagauuucagagauguuaaaauacgaaacauaguaaaacagaguagcuugcuacuuuguuuuccuuugucuuuaaauauuuuuugguugggcagagugguucacgccuguaaucccaacacuuugggaggcuaaggugaaaggagagccugaacccaggaguuugagaccagccugggcaacauggugaaacccugucucuacaaaaaauacaaaaauuugccaggcaugguggugggcaucuguaguuacagcuauuagggacagugagguggaaggauugcuugagccugggagguugaggcugcaacaagccgugggugugccaaugcauuacagccugggugagagagugagacccuaucucaaaacaaaaaaaaaauuaauauacauauuuuuacaauuuuuuuagaauagggucucacuuuguugcccaggauggaguacagugguguggucaugguucacuguagcuuuaaacuccuuggcucgagcaauccucccaccucagccucccaaguagcugagacuagaggagugcaccaccacacagagcuauauuuuuauuuuauuuuuauuuuuauuuuuuuuauucucucugucgcccaggcuggagugcaguggugcgaucucggcucacugcaagcuccgccuccuagguucacgccauccuccugccucagccucccgagcacgcccggcuaacuuauuuuuguacuuuuaguagagacaggguuucaccauguuagccaggauggucucgaucuccugaccucgugauccacccgccucggccucccaaagugcugggauuacaggcgugagccaccgcgccuggucuauauuuuuacuuuuauuuuuguagagacaggguuucgcuauguuguccaagcuggucucaaacuccuggccucaagugauucuccuaccucagccuaccagagugcugagauuacaggugugagccaccaugccaggccuguuuuaaauauucuucuaaaauauaauauuaauggcugcauaguauuucauuauauagauguaccacguuuucccugaauucugagaaagggguugauuuugucccucugggaacauuacaaaauguccagaggcauuuuugauugucauaacuggggugcuacuggcaucuagugggcagaagccaaggagguucaacauccuaaaauguacaggacagccccuuauaacaaagaauuaacugguagguaugagauugagaaacucuguaaccuauugcuagacauuuuuucuuuuuuuguuuuugagacagggucucacccuguugcccaggcuggaaugcagcagugcaaucuuagcucacugcaaccucugccucccaggcucaagcaaucuucccaccucagcuucccaaguggcuggaacuacaggcguaugccaccacaugccuggcuaauuuuuuuuuuuuuuuguauucuugguagagaugggguuuugccacauuguccaggcaggucuagaacuucugaacucagggcuauccaccugccuuggccuccccaagugcugggauuacugguguaagcugggagccaccuugcugagccaauuuuuuuuaaccccugcaggaccagcaccaaauuaagggggagcauaggcuaugcauaggauauauaggauauagcccguacaauuggauuaccuggguucaaauccuggccuugacaguuacuaauuuaagaacacuaacuagaaggaaguacauugaauuagcaacuuaaccacuccaugccuuauugccccaucuguaaaaucaaagaaaauuuacagaaacugcauagggcugcuaagacaacuaaacagguugauaaauuuaaaacccaugucuggcaucuaagauacacccauaaguguuucaugagcuccguuaggucaugcuuuuuaaaaaauacauuuauugaccagccgcgguggcucacgccuguaaucccagcacuuugggaggccaaggagggcagaucaccugaggucaggaguucgagaccagccugaccaacauggagaaaccccgucucuacuaaaaauacaaaauuagccaggugugguggugcaugccuguaaucccagcuacucgggaggcugaggcaggaaaaucacuugaacccgggaggcagagguugcagugagcugagauugcgccauugcacuccagccuccgcaacgagagugaaacucccaucucaaaaaaaaaaaaaaagaagcauuuauuuauaaacacuacugaggcacugacagaaauaggaaggcacugacagaaaaaucaggaacaaagaaucucaagguuuggggccuaagucauugaaucuaauaucucugaaaccauuggaugauaguaaaaucgauguaauguguaagacuagcaagaggaaaaaaaaacaauagaagguaucagaguauaucacaagcagcaaguacuuuuuccuguguauguauaccaggucacaaugugaaacuguauuucuuaauguggaucacaguaaaaguuagaaagucaccaccugaaguccaacuaccacuugacauuugaaucaguucuguaucugugucuacaugacugauuaacuucugccuuaaggcauuuuauaaacagugccagcucuauuuuuggacacuuugcuaggcagcucuucaaaauaaugaaagacaagaaccuaauaaaacaugaugcaaaaagauaucucuuucaaucugaaaaaugacuacaaauguuuugucuuaaucuauugguuuaaaucuuucaggaaauuaagcauucuagaaguguuuucuugacuauguugcugcagcauuggaaacaguguugcuuaugagcucaucaagucaucacuagcuuugaagauggucauuccuaaguuagccaucaucauuauuaguauguuugaguacccacaaaccagcugagaagggcagcuuucaggucuauaagcaguacugaaaacauuaacuuaaucaucauagugccagcagccucuaaauaguacauaaucauauacaccaaauuaguuaugguuuuaaaaacaaaguccaaaacguacaucuuuuuaacccuuuuaaaaaugaacaauaauugugccucauacuuugaauaaagccaaauuaugugaauugugguugcugguuguuugaacauugccuaaaagaaaauuaggguaaugacacuaaguuguuugagaaauauuuaauacaugugcugaaugccucaggcagaguugacaaaauuaagauguuuaccaugaucuucccaauaaacugaauguacuuugguaaagaauuaauaucauauaaauuuguuacugcaauuauauuuauuuuuuuuuucuuuuuuugagacggaguuucgcucuuguugcccaggcuggaaugcaauggugcgaucucggcucacugcgaccuccgccuccuggguucaagugauucuccugucucagccuacugaguaucugggauuacaggcaugcgccacuggcuaauguuguauuuuuaguagagacgggguuucuccauguuggucaggcuggucucgaacuccugaccucaggugauccacccgccucagccucccaaaguguugggauuacaggcaugaggcgugagccacugcacccagccugcaauuauuauuauucuucuuuuuugagauggagucucauucugucucccaggcuggagugcaguggcaugaucuuggcucauggcaaccuccguccccagguucaauugauucucccacauuagucuccugaguaucugggacuacaguugggcgccaccaugccuggcuaauuuuuguauuuuuacuagagacaggguuucaccauguuguccaggcuggucucaaauuccugagcucaagcaaucugcccaccucagcugguauuacaggcgugagccacugcacccugccuuuguuacugcaauuguuuugaaugguccccuuuacaagccuaugagauauuugauggcaggaauuuuccacaguaacuuucuagucaaccaucaauauaaauauaaaaauuugcagaauguauuacauacagcaaaucuuguauuaauugcugacugccaagcucuccauaaaguuccaggaauuuaaaaauuaauaaugcauaguucuuaaucuuaagaguuucacagacuaagaggggagagaaaaauuuacaguugugagauacagagcaaagcuuaauagaagaguggaaacucuagaaguuagaagcugcuaacauccaagcuguguuuuaagggaugacuuuaaaggugaacaaguggggaagaacauuccuggaugaggaaacucauauagagcacauauaaaggggagaaaagugcugggagauacacuggagagauggguugauaccuuaucauggagagacuuucaugcuagguuaagaaguuuacccaugcccagggccgggcacaguggcucaugccuguaaucccagcacuuugggaggccaagacgggcggaucacgaggucaggagaucgagaccauccugccuaacauggugaaaccccgucucuacaaaaaauacaaaaaauuagccgggcguggugguaggcgccuguagucccagcuacuugggaggcugaggcaggugaauggugugaacccaggcgguggagcuugcagugagccaagaucgcgccacugaacuccagccugggugacagagagagacuccaucucaaaaaaaaaaaaguuuaaauuguaucuaguauacaaaacaaaaccaaugaaaguuguuaggcagggaagagauuugauuagacuggucuuggauggaguaaauaauggagauggauaggaggucaauucagguauaaauugagggccugaacaaguugugggguacugucaaauguuuguugagugcauaccauuauauaccagguacaguacaucuuuuaaaaaggagcuuauagucagcauguuagaugacacugaaagauacaaugugagaaucuaaagaaauuacaagcauguggccaggugcuguggcucacuccuguaaucccagcacugugggggaggcugaagcggguggaucacuugagaucaggaguucgagaccagccuggccaacacggugaaaccccaucuaauaaaaguaugaaaaguagccgggagugguggcaagugccuguaaucccaguuacuagggaggcugagacaagagaaucguuugaaccugggagguagaggcugcggugagcagagauggugucacugcacuccagcuugggcaacagagugagacucugucucaaaacaaacaaacaaacaaacaaacaaacaaacaagcaugguagggaaugacucccagaguaggugauauugaaguugagaacugaaggaaaaauaggauuuuaaagaucugaacugauuugaaguacuuaggguauuuauuguacauccuauauaaucccuccauacuccuaaagaaaacuguuuucuuuugcccucacuguaaaucuacugaagcaucuaaaauaguuauuaaauuuaaaaaaacaauaaugugaugaggccagaauuagguuucucucuucuguucucucccacggcacauuaccuuugcaucauucgcacacuauuauaauuaucugaaaauuuggaagagguccaaagaauggacagauauuuaggagcgccaggaaggaaacagcacaaaagggaaggaggaguauaaaaguuaaauaauuuaaaauggcgaaugcuuuagaaaguucaaguaaaaucuuaguacuguaauuuacuguaauuuggagguccuuguuaaugaucuguuugcaaguuaaguaagaaaugcacaguaggccaaaaaugagauuggacugaggacuuccuaucagaaagcuugguugagaagugaugcuacagaauuuuguuuguucuuuuuuuuguuuuauuaaggaagggagaauagaggguguccaauaggcaacaaaaguaacuuuucaagaccuacuaccauggauacauguauuaguaacuuauaaacaguauuuccucuagauauuugcauauauauaauagaauuaauguuaguacauuuucacuuaucccuaggaaagaauuacugauguuuguuaagagucuguuaagaauauacaaacucuuaacauuuacacuggagguguauaagguaugaaccagucguuucugguaauuuauugcaaccugugauuaagagagaagguuaggacugaauuaauucauuuuccaaagaaaaaagucagacaacauuuauaauuuaccagauuaucacuggcauaguucagaaauuuuuuuuuauuuuucagacagggcaacaaucuguuguccaggcuaggagugcaguggugccaugaugguucacugcagccucgaccuccugggcucaacugauucucccaccucagccuucugaguaacugggaccacaggugugcaucaccacgcccagcuaauuuuuguauuuuuuguagagaagggguuucacuacguugcccaggcuggucuccaacuccugggcucaagcaauccuccugccucggccucccauaagugcugggauuccaggugugagccacugcaccgagcuccagcaagauuuuuacauucuaaauuggguuauauuuguaauaaugaaugucacuaauaagaggaagugcaaguaccaauacguucuuuacaggccucauacugcaguuuuucuuuucuuucuuuuucuuuucauucuuggucauacugccauuuuucuuagccaauuuucuggccaaacuccuccucaccacuuauuuucugugugcugaugacuaugcuuuacuacuaaauuuggcucuuuugucuugccaguucacaccuucccuuaaggcauaauaaccauuuacuacuuaauuuucgcuuuucuccucuaucuugcuggggugguguaauaaaauuccagcuuaaccaauaaguaaaauggcuugccagugaugauaaagaccacauuuguuugggauauguagcagcacaaauuuaaaaguaaauaaauaaaacaagcccaucucaauccuaacuuacagauacuggucagugugacugaaaacugaaauuguucaugcuaaccaacguuuuucaguuuccaccuaacauuuuguucaguuuggugcccucuugugccuccuauuuuuacaaacacaacucagaauuccugaugacuuuagagaaggcaccuccaaguuuucacucauaccagauauuccuggauauaacaggaauuugagaacuauuauguaauuauucuacguguaacaucugcucaucagauuuuaauauucaagccucguggcuucaagucauugccugugacugaucaucuucacaaaugcaagaguccccugaaacugucucccaaccauuagggugcucaugcuaaccccuaacccacuagacccacuacaagauucaguauuuguaaagcugaaaacgugguuguggcguuuacauuuucauuccgauuggccuaggcuucccucucuucucucuugcauguuuucuugccuuaccuggucugagaaauggugccgccccacccuugcagaguuaacagggggacgcuugccagcugcgugcagucccggcgguccggauaugcggggagguggcggcaggaacgccugggccaggcgcugguacguuauccuguuacagaccuuggccuaguccgcagguugccccuggagaggcgacggggacaccagacccucgauuggcuccgcuccuccgcgacaggcugaggggaacaagcucucuuucgccuggggacgauccaguguuuggugggucgaccuuagucagggccuagcugucgcaaagaaggucaaauucaccuugggaaaguacgcaccgggacggcagcuagcaccauaacaggcggccccagcggagucucccagggucaggccaggacagccaaccugccggccggagagccggaggcggggccgcccccuucccggcaggcugccgacuuccggaccugcguagacgccucucugcgccuccaggcgcgccccucccccggcaggccguuucccggcaugcgccgcggaggaagagacggagucgacaauaacaaaccaagccgcggcgguguccgcggcccugccgagcccucggcguugccucagaaucccccagucgccugggccccucggcucugacaggccgcggccuucugucccccggccccagacccagagccgaggggccugcucgcguccuuguccgcccggaccccucccugccuccuagaguucggggccgcggcgggcgggcgcccgggacgccggcgguugugucggcuuagcggugccgaaugggcgguugguaaccgcugccgaggacuaggcggcggcggaagauggugccgggggucgcuggcucugcugcugccgccggcgaaggaggaggcguugccggguaagugucgccgccgcccgcguccccuucccccaucuggcacagcggucgcgcggcgggcccuggcacggugggccggggucgcaugguccaggguuccggucggccugagcccggcccacgcgcaggugugugcacgggagggccccggcgccucccgccccggcagguguugcccacuggccgcuuucccggcgcgacagccccuguggagacaaaagcgguucgagucgaugcuccacuaggcugccggaggugugggucggacucgugcugcggggcugccugcggcuuccucggccggagccuugggaucccucccucugcgcugccgcuuaguacccggccuaguugccggaguggccgagggcgagggacguccgaaccucccaagacgcaucuugacuugugcucaucgcugccagggaucagcccuuaauucuguguuggacucgagaaacgggagaguggaguuuggccgaggccgaacgaagcucaccgaaugggaggaacggagagaugaugucuuugucccgaccccagagugcgaggaucgguauaaaguuacuccuaggaaugacucagccugcgcccgccccacggauagauuugggaugggugugc

SEQ ID NO: 12640 - RNA, 9699 nt, Homo sapiens
gcacacccaucccaaaucuauccguggggcgggcgcaggcugagucauuccuaggaguaacuuuauaccgauccucgcacucuggggucgggacaaagacaucaucucuccguuccucccauucggugagcuucguucggccucggccaaacuccacucucccguuucucgaguccaacacagaauuaagggcugaucccuggcagcgaugagcacaagucaagaugcgucuugggagguucggacgucccucgcccucggccacuccggcaacuaggccggguacuaagcggcagcgcagagggagggaucccaaggcuccggccgaggaagccgcaggcagccccgcagcacgaguccgacccacaccuccggcagccuaguggagcaucgacucgaaccgcuuuugucuccacaggggcugucgcgccgggaaagcggccagugggcaacaccugccggggcgggaggcgccggggcccucccgugcacacaccugcgcgugggccgggcucaggccgaccggaacccuggaccaugcgaccccggcccaccgugccagggcccgccgcgcgaccgcugugccagaugggggaaggggacgcgggcggcggcgacacuuacccggcaacgccuccuccuucgccggcggcagcagcagagccagcgacccccggcaccaucuuccgccgccgccuaguccucggcagcgguuaccaaccgcccauucggcaccgcuaagccgacacaaccgccggcgucccgggcgcccgcccgccgcggccccgaacucuaggaggcagggagggguccgggcggacaaggacgcgagcaggccccucggcucugggucuggggccgggggacagaaggccgcggccugucagagccgaggggcccaggcgacugggggauucugaggcaacgccgagggcucggcagggccgcggacaccgccgcggcuugguuuguuauugucgacuccgucucuuccuccgcggcgcaugccgggaaacggccugccgggggaggggcgcgccuggaggcgcagagaggcgucuacgcagguccggaagucggcagccugccgggaagggggcggccccgccuccggcucuccggccggcagguuggcuguccuggccugacccugggagacuccgcuggggccgccuguuauggugcuagcugccgucccggugcguacuuucccaaggugaauuugaccuucuuugcgacagcuaggcccugacuaaggucgacccaccaaacacuggaucguccccaggcgaaagagagcuuguuccccucagccugucgcggaggagcggagccaaucgagggucugguguccccgucgccucuccaggggcaaccugcggacuaggccaaggucuguaacaggauaacguaccagcgccuggcccaggcguuccugccgccaccuccccgcauauccggaccgccgggacugcacgcagcuggcaagcgucccccuguuaacucugcaaggguggggcggcaccauuucucagaccagguaaggcaagaaaacaugcaagagagaagagagggaagccuaggccaaucggaaugaaaauguaaacgccacaaccacguuuucagcuuuacaaauacugaaucuuguagugggucuaguggguuagggguuagcaugagcacccuaaugguugggagacaguuucaggggacucuugcauuugugaagaugaucagucacaggcaaugacuugaagccacgaggcuugaauauuaaaaucugaugagcagauguuacacguagaauaauuacauaauaguucucaaauuccuguuauauccaggaauaucugguaugagugaaaacuuggaggugccuucucuaaagucaucaggaauucugaguuguguuuguaaaaauaggaggcacaagagggcaccaaacugaacaaaauguuagguggaaacugaaaaacguugguuagcaugaacaauuucaguuuucagucacacugaccaguaucuguaaguuaggauugagaugggcuuguuuuauuuauuuacuuuuaaauuugugcugcuacauaucccaaacaaauguggucuuuaucaucacuggcaagccauuuuacuuauugguuaagcuggaauuuuauuacaccaccccagcaagauagaggagaaaagcgaaaauuaaguaguaaaugguuauuaugccuuaagggaaggugugaacuggcaagacaaaagagccaaauuuaguaguaaagcauagucaucagcacacagaaaauaaguggugaggaggaguuuggccagaaaauuggcuaagaaaaauggcaguaugaccaagaaugaaaagaaaaagaaagaaaagaaaaacugcaguaugaggccuguaaagaacguauugguacuugcacuuccucuuauuagugacauucauuauuacaaauauaacccaauuuagaauguaaaaaucuugcuggagcucggugcaguggcucacaccuggaaucccagcacuuaugggaggccgaggcaggaggauugcuugagcccaggaguuggagaccagccugggcaacguagugaaaccccuucucuacaaaaaauacaaaaauuagcugggcguggugaugcacaccuguggucccaguuacucagaaggcugaggugggagaaucaguugagcccaggaggucgaggcugcagugaaccaucauggcaccacugcacuccuagccuggacaacagauuguugcccugucugaaaaauaaaaaaaaauuucugaacuaugccagugauaaucugguaaauuauaaauguugucugacuuuuuucuuuggaaaaugaauuaauucaguccuaaccuucucucuuaaucacagguugcaauaaauuaccagaaacgacugguucauaccuuauacaccuccaguguaaauguuaagaguuuguauauucuuaacagacucuuaacaaacaucaguaauucuuuccuagggauaagugaaaauguacuaacauuaauucuauuauauauaugcaaauaucuagaggaaauacuguuuauaaguuacuaauacauguauccaugguaguaggucuugaaaaguuacuuuuguugccuauuggacacccucuauucucccuuccuuaauaaaacaaaaaaaagaacaaacaaaauucuguagcaucacuucucaaccaagcuuucugauaggaaguccucaguccaaucucauuuuuggccuacugugcauuucuuacuuaacuugcaaacagaucauuaacaaggaccuccaaauuacaguaaauuacaguacuaagauuuuacuugaacuuucuaaagcauucgccauuuuaaauuauuuaacuuuuauacuccuccuucccuuuugugcuguuuccuuccuggcgcuccuaaauaucuguccauucuuuggaccucuuccaaauuuucagauaauuauaauagugugcgaaugaugcaaagguaaugugccgugggagagaacagaagagagaaaccuaauucuggccucaucacauuauuguuuuuuuaaauuuaauaacuauuuuagaugcuucaguagauuuacagugagggcaaaagaaaacaguuuucuuuaggaguauggagggauuauauaggauguacaauaaauacccuaaguacuucaaaucaguucagaucuuuaaaauccuauuuuuccuucaguucucaacuucaauaucaccuacucugggagucauucccuaccaugcuuguuuguuuguuuguuuguuuguuuguuuguuuugagacagagucucacucuguugcccaagcuggagugcagugacaccaucucugcucaccgcagccucuaccucccagguucaaacgauucucuugucucagccucccuaguaacugggauuacaggcacuugccaccacucccggcuacuuuucauacuuuuauuagaugggguuucaccguguuggccaggcuggucucgaacuccugaucucaagugauccacccgcuucagccucccccacagugcugggauuacaggagugagccacagcaccuggccacaugcuuguaauuucuuuagauucucacauuguaucuuucagugucaucuaacaugcugacuauaagcuccuuuuuaaaagauguacuguaccugguauauaaugguaugcacucaacaaacauuugacaguaccccacaacuuguucaggcccucaauuuauaccugaauugaccuccuauccaucuccauuauuuacuccauccaagaccagucuaaucaaaucucuucccugccuaacaacuuucauugguuuuguuuuguauacuagauacaauuuaaacuuuuuuuuuuuugagauggagucucucucugucacccaggcuggaguucaguggcgcgaucuuggcucacugcaagcuccaccgccuggguucacaccauucaccugccucagccucccaaguagcugggacuacaggcgccuaccaccacgcccggcuaauuuuuuguauuuuuuguagagacgggguuucaccauguuaggcaggauggucucgaucuccugaccucgugauccgcccgucuuggccucccaaagugcugggauuacaggcaugagccacugugcccggcccugggcauggguaaacuucuuaaccuagcaugaaagucucuccaugauaagguaucaacccaucucuccaguguaucucccagcacuuuucuccccuuuauaugugcucuauaugaguuuccucauccaggaauguucuuccccacuuguucaccuuuaaagucaucccuuaaaacacagcuuggauguuagcagcuucuaacuucuagaguuuccacucuucuauuaagcuuugcucuguaucucacaacuguaaauuuuucucuccccucuuagucugugaaacucuuaagauuaagaacuaugcauuauuaauuuuuaaauuccuggaacuuuauggagagcuuggcagucagcaauuaauacaagauuugcuguauguaauacauucugcaaauuuuuauauuuauauugaugguugacuagaaaguuacuguggaaaauuccugccaucaaauaucucauaggcuuguaaaggggaccauucaaaacaauugcaguaacaaaggcagggugcaguggcucacgccuguaauaccagcugaggugggcagauugcuugagcucaggaauuugagaccagccuggacaacauggugaaacccugucucuaguaaaaauacaaaaauuagccaggcaugguggcgcccaacuguagucccagauacucaggagacuaaugugggagaaucaauugaaccuggggacggagguugccaugagccaagaucaugccacugcacuccagccugggagacagaaugagacuccaucucaaaaaagaagaauaauaauaauugcaggcugggugcaguggcucacgccucaugccuguaaucccaacacuuugggaggcugaggcggguggaucaccugaggucaggaguucgagaccagccugaccaacauggagaaaccccgucucuacuaaaaauacaacauuagccaguggcgcaugccuguaaucccagauacucaguaggcugagacaggagaaucacuugaacccaggaggcggaggucgcagugagccgagaucgcaccauugcauuccagccugggcaacaagagcgaaacuccgucucaaaaaaagaaaaaaaaaauaaauauaauugcaguaacaaauuuauaugauauuaauucuuuaccaaaguacauucaguuuauugggaagaucaugguaaacaucuuaauuuugucaacucugccugaggcauucagcacauguauuaaauauuucucaaacaacuuagugucauuacccuaauuuucuuuuaggcaauguucaaacaaccagcaaccacaauucacauaauuuggcuuuauucaaaguaugaggcacaauuauuguucauuuuuaaaaggguuaaaaagauguacguuuuggacuuuguuuuuaaaaccauaacuaauuugguguauaugauuauguacuauuuagaggcugcuggcacuaugaugauuaaguuaauguuuucaguacugcuuauagaccugaaagcugcccuucucagcugguuuguggguacucaaacauacuaauaaugaugauggcuaacuuaggaaugaccaucuucaaagcuagugaugacuugaugagcucauaagcaacacuguuuccaaugcugcagcaacauagucaagaaaacacuucuagaaugcuuaauuuccugaaagauuuaaaccaauagauuaagacaaaacauuuguagucauuuuucagauugaaagagauaucuuuuugcaucauguuuuauuagguucuugucuuucauuauuuugaagagcugccuagcaaaguguccaaaaauagagcuggcacuguuuauaaaaugccuuaaggcagaaguuaaucagucauguagacacagauacagaacugauucaaaugucaagugguaguuggacuucagguggugacuuucuaacuuuuacugugauccacauuaagaaauacaguuucacauugugaccugguauacauacacaggaaaaaguacuugcugcuugugauauacucugauaccuucuauuguuuuuuuuuccucuugcuagucuuacacauuacaucgauuuuacuaucauccaaugguuucagagauauuagauucaaugacuuaggccccaaaccuugagauucuuuguuccugauuuuucugucagugccuuccuauuucugucagugccucaguaguguuuauaaauaaaugcuucuuuuuuuuuuuuuuugagaugggaguuucacucucguugcggaggcuggagugcaauggcgcaaucucagcucacugcaaccucugccucccggguucaagugauuuuccugccucagccucccgaguagcugggauuacaggcaugcaccaccacaccuggcuaauuuuguauuuuuaguagagacgggguuucuccauguuggucaggcuggucucgaacuccugaccucaggugaucugcccuccuuggccucccaaagugcugggauuacaggcgugagccaccgcggcuggucaauaaauguauuuuuuaaaaagcaugaccuaacggagcucaugaaacacuuauggguguaucuuagaugccagacauggguuuuaaauuuaucaaccuguuuaguugucuuagcagcccuaugcaguuucuguaaauuuucuuugauuuuacagauggggcaauaaggcauggagugguuaaguugcuaauucaauguacuuccuucuaguuaguguucuuaaauuaguaacugucaaggccaggauuugaacccagguaauccaauuguacgggcuauauccuauauauccuaugcauagccuaugcucccccuuaauuuggugcugguccugcagggguuaaaaaaaauuggcucagcaagguggcucccagcuuacaccaguaaucccagcacuuggggaggccaaggcagguggauagcccugaguucagaaguucuagaccugccuggacaauguggcaaaaccccaucucuaccaagaauacaaaaaaaaaaaaaaauuagccaggcaugugguggcauacgccuguaguuccagccacuugggaagcugaggugggaagauugcuugagccugggaggcagagguugcagugagcuaagauugcacugcugcauuccagccugggcaacagggugagacccugucucaaaaacaaaaaaagaaaaaaugucuagcaauagguuacagaguuucucaaucucauaccuaccaguuaauucuuuguuauaaggggcuguccuguacauuuuaggauguugaaccuccuuggcuucugcccacuagaugccaguagcaccccaguuaugacaaucaaaaaugccucuggacauuuuguaauguucccagagggacaaaaucaaccccuuucucagaauucagggaaaacgugguacaucuauauaaugaaauacuaugcagccauuaauauuauauuuuagaagaauauuuaaaacaggccuggcaugguggcucacaccuguaaucucagcacucugguaggcugagguaggagaaucacuugaggccaggaguuugagaccagcuuggacaacauagcgaaacccugucucuacaaaaauaaaaguaaaaauauagaccaggcgcgguggcucacgccuguaaucccagcacuuugggaggccgaggcggguggaucacgaggucaggagaucgagaccauccuggcuaacauggugaaacccugucucuacuaaaaguacaaaaauaaguuagccgggcgugcucgggaggcugaggcaggaggauggcgugaaccuaggaggcggagcuugcagugagccgagaucgcaccacugcacuccagccugggcgacagagagaauaaaaaaaauaaaaauaaaaauaaaauaaaaauauagcucugugugguggugcacuccucuagucucagcuacuugggaggcugaggugggaggauugcucgagccaaggaguuuaaagcuacagugaaccaugaccacaccacuguacuccauccugggcaacaaagugagacccuauucuaaaaaaauuguaaaaauauguauauuaauuuuuuuuuuguuuugagauagggucucacucucucacccaggcuguaaugcauuggcacacccacggcuuguugcagccucaaccucccaggcucaagcaauccuuccaccucacugucccuaauagcuguaacuacagaugcccaccaccaugccuggcaaauuuuuguauuuuuuguagagacaggguuucaccauguugcccaggcuggucucaaacuccuggguucaggcucuccuuucaccuuagccucccaaaguguugggauuacaggcgugaaccacucugcccaaccaaaaaauauuuaaagacaaaggaaaacaaaguagcaagcuacucuguuuuacuauguuucguauuuuaacaucucugaaaucuggguccauuuaacaguggauggauagugguccuccaagcuugucaaccaaugccauccauuuccugugcuuacuauaagacaucaaaaacaccagauuggaaaaaaauccaaacuauaauggugagagaauugaugaauaagauguguuguacaacauucccaaagacagcuagguaccuagcaccacagcuuuaguucuuuuauggauucuguaaggaaaugcuuguugccagugcuuucagugcugcaaaggauaaauucuguggaaaaacccagacaaucucugagucggaaguaauaguucaaaagugaugaaauuuuagaaauaccuuuaccaauguaauuugcuuguauuuucauuuuuauguaugggcaauauaauaaaaaugugucuaaugaagucuaagaaagcuuucuaaguaaguacaaaauuaaauucuaagugauuuuuccuauguguauauuuuucuucauuuuccagacuacauauuuuugaaaaauguaccauuagucuuuuguaacuuaaaacgaguucuguuguuuaucauauaaaaugaaugcuuuuuucccaauucucuga

SEQ ID NO: 12641 - RNA, 1413 nt, Homo sapiens
uuugcucuuagggagaagaggcggggccugagcaaggacagcagcuggaaagugaagggcaggccugacucucagcagcaguagugauccggcuugaaggggccaucacgggacgugcucagcuacugggcuugcuucucaguuagcuuggucaauuucacguucaucuugcccaggggggcgccucagccacugccucauccagcuucuugggcaggaagugaaccccaaugggguacuugucuggguggguccacagcgcaaucugcaccaucaccugguugaaggaguuacuccccacaaagcuggggcggcccauagcacagcccagguugaccagccaacccucagccagcacgaugauguggcacccauucuucagccaguaccaguccgccugggcuugauguuugccuucuccacagcauuguuguugaggcaccugacaucgaucuccacgucaaauuguucaguauuacauaagauggcaucauccuucaucugcucaaagugccggccaaggaugauauugacacagguugugguggugacaaagauguugcccuccugacaggccucguccaugguggucaccucauagccuuccauggcagccugcagugcacugauggggucagucucggugaugauuaugcaggccccaaaacccugcaaggccugggcacagcccuugcccacaccaccauagccugcuaccacugcuaccuugcuggcaaucaucacgucuugguccacuuggugccaucuauaagggacuccuggcagccauagagguugucaaauuuugcucuuggugacggagucauugacguugaugguaggcaccuucaggauugcacuggccaucaucuuguguagguuguggaccccgguuuuggucuccucagagaugccucagaugcccgacaugagcuguggguacguacuugguguggaugagguugguaaggucacccccaucauccagaaucauguugaggggcccguccuugaaguacagugucuguucaaugcaccacggguaccccucuuucauuuugcccuuccaggugaacacuggcaugccagccucggcaaagacagccacugcauguuccuggguggagaagaugcugcagcuagaccacugcuccugaacacccagggagaaaagggucucaaugaggauggccgucuccacaguuauuugcaggcagucagcaaugcaggcacccuucaguggccuggaggccgaguaaagcuccugcaugcccaucaaacccggcauccauucuccacaaugucuagggccuuguguccccagguggccaggccgaugucagcaacuuuguagggcaguuugucagacaugcuggcggcaccuuugauggacaagggcaaagggggcugggc

SEQ ID NO: 12642 - RNA, 412 nt, Homo sapiens
ucuccugaucauuauaaagggagccggaggaaaggcuuucugugaugggagugauauuagagucaucucggaggcugaaaaggcaaaacggaagauagcgccaguuuucuucagagaagaauauaugcugaacaaugcuuuugguucuugccagaaaccuuauguugcacuuauucauggaauuacaaugggugggagaguuggucgucaguccaugggcagcuucaaguggcuacagaaaagugucuuuuugccaugccagaaaccgcaguagggcuguucccugauguggguggagguuauuucuugccaugacuucaaggaaaacuugguuacauccuugcauuaacaggauucagacuaaaaugaaaugauauguacagagcaggaauugcuacacacuuuguagauu

SEQ ID NO: 12643 - RNA, 2193 nt, Homo sapiens
uacuuugaauauuauauuugauaccaaaagaaguauaaguuuagaagugguaucacugaaaccauuauaauugaacugcuuuuuuuuuuugagauggccccuuccucuguugcccaggcuggaguggagugcaguggcgugaucugggcucacugcaaccuccgccucccagguucaaacgauacuccugccucagccucccaaguagcugggacuacagguaccagccaccgugucuggcuaauuuuuuuauuuuuaguagagaugggguuucacuguguuggccaggcuggucgcgaacuccugaccucaggugauccgcccgccccggccucccaaaguacugggacucuacaggagugagccacugcgcacggccugcuuuguguuuuucagaaaguaaacaaaaauaaucuguaccagguauccagguaaccggcuucaaguacaauuucuacccaguagucagaaaguuaaaagucacacuagauaagacaucuuuauuacuuaaucuuuaaaacagucacuugccuauucaauucugaaacuguuuguuuucuuucccucccccgcacucccgcucugauacacaaacuuguuguaaaaauaaugcagaaacauauacgucaaucuaagucucugaaauauggccaacucuaccucgccguauauccaacauuaaaaagaaaaaaaaaggcuguuuaagaauagaacucauucccgguuuccaccaaauuauuucccuaauucuuaaauccucaaauaaguucuuaaucuccaaagucucgguugugggaaaaacauuaauuugugcaguccaacacuuacauacuuucuugacggaagggcaauccugucccuuuaaacucaaugaaggcagcggccagguccuucugaguccccguauaauugccuagaacuuaacauuuaguauucauaguccuugguuuacagacggguccgacaguuagaaacuauuacuuccuccucuuuccuccugggcgcuguccuccuuuucucuugccacccaagccaggcggcccagaauucaucuugccucccaagcccccuuuccucuucccucccuggcugggcgggcccccuuuccucuugcccccaggccccugccggccucccuuucucuugcccuucuggcucauuuuccuccucuuggcggccuccuccugguccuccucccucaucugcuuauugguggcccuagucacauccagcugaggcuucuugcuguucaugacacgaagcagcuccaacugguucuuuuucucggcugcaaaguccccgaaaagggguugaaacuuccuuuucuugccggagccccggggcaccuucuccuuggggaggcgcuccugaaagcgccccacagaggcgguggagaccuuggccacuugcauggcgcggcccagcuccuccuuacucugguguccgguagggugcaagccggccgcgcugggcagcugcaucuugugcgcgcgggccagguuacgcagccgguucagcucguucuuggccacccuuuccuucuuggccugaauccgcuuggcgaacugguccuccaaggggucggcauugccgggcaccucaaucagccauucuuuggugucgucccgggcgcgcugguagccccagcgccgccgccacuggccacucaccucgucccacaccagguuggucuucuucuugggacggaugcccuugaggcgcgcgaacugcugccagcguguaaguggccgcggucggggcagaggcuucucucgcggcaggcguguggugggcuccggcagccgcgccacuaucgccucuuccacgcgcuccgugggcagcugccacagcugguugaugagcaguugcguguugucccgcgccagggccuguagcucggccuccggcguggguccggcgcaccgcagcccggucgggggguuccgguccgacgccagcagguugcccaggucaaacugcagcuccagcuccuugugcaccgugaugcguugcaacuucucugccucguccugcucugccuuugcgagcagcuccuccacgcucuggcccuccauggcuccggcucggcucacucgcuuuggggcugcagcugaaguuacuuuuccuacaguggcggcccaaacuccggcagcauaaccacgugcagaugccgggaugcccaauccggaaaag

SEQ ID NO: 12644 - RNA, 1284 nt, Homo sapiens
ccuguuuuagguguuugcacuuauuuuauuucuucuugaaagaauuuuuauuugcuuuugugguagagauuauauguaauuuuuuuucagucauauaauggugugcugucaacuuaaacacugacagguaaauagaauuguacacuguaguuugaauuauuuauaauugacacacucucucccucuccacuccugaaguaugcugcuauagaaaauagcagaaucggcuugcugcuacgagagaaggaaagagcgaccaccacuugcacugugugaaaagauaaaaaacaaaugauggcaaguucucaaguuaacuaaauggaaucaaccauuaccaggcaaauucuugcaaauaccaaaauacuacuaugccuuauaaaacaaaaugaaagcagguuaagauuuucugcucuguuuguauguuaauagaaauggaaauacuaaguauuuuaaugcuuagcucuugaacaguagaccuaaaaggguuuuaagcuauuuaaaucuacuugcuaguuuuugcauauuuuauauauauauauauuuauauauauauauagugagaagugaagaaaauguaugguacuaagauuaugccuuauugauaaauagauaaaccaauuugaauccucuuagcauguuuaaguauguugauugcuuucuaauuaaugaacuucucacagaaauuucacuuagugaaaccaaugauuguagcaaacucauacuggaucauuucaguuaccuugaacuaauagcacauaaugguuuuuuguuguuguuguuuuuaauguagcccuuaccuggauauacauagucugcaaucaccaaaguauaauaucuuguaaggcuauauuuuuuaaagcauauuuuuucuugagcauuaaauuauccuaaaugguaauauauuguggauaagucugggcuuauuggacauaauacauauuuggguugguacugguugaauccuucaguuaacugcuuuguugcuuuuugcaagauuuuuuaucuuaaacaugucaggcaucuuaagucaccuuuauacuguuuuguuccucugaguuucuuucaguauguuauacaaaugccagacauaacauguagcagccauacuugcauggaaacugacuacacauacauaauacugcauuuuauuguaagguuuucacauuaauacagcaauuacccugacuaaauugaguuuugugauauauggaaaacuucauuguaagagaaucuugcauacaauguugacauauuaacauccaaaauaaagcaucuguguacaag

SEQ ID NO: 12645 - RNA, 49583 nt, Homo sapiens
gaucgcgccuccugacauguuggggguaucccuggccgggccgggccggggcuaagagcggcgcugcgggccggggucggggucgggucgcgguccgcccccgcugucccuccguccugcccugucgaggacgugcguuccgcacucggccgccuccagagggagcgagggaagcggcuagaggaucggggagaaggagcauucgccggaggcuggaggaggcugacccgcguccccgcccagccugcuccuaugcgguacuugaaggauggcgaagaggucgcgcagguggguggcaccccuuucgcccaggccugucggcgccgucucggcucagauucucuuuccuaucccgcugcccccucccgccauaaggcccucccuggcgagggcagagguuuuucuucccgcguccccgcggccgcuuggccucgaugaccggagggcagcugcgacguguggagaguuggggaccaggguguuugaggcgcgggacguaagagaugcccagguuucucggugacucuccccguaaugcgcguccagauuucugaccucaugcugccacuucuucgaggcagguuucuugccagguaagucgagcgcuuuuagggaguccgcuacgcagagaaaacugacuguguccugccgggaggacuugaaaaugguguucgggcgacucuuuucugaaugacgguacagucaaaauaggaacuccgcggugaaccugggcggccaccccucugccaacuuggcuaucuugaaacguuguggaaaauccucuggggaauagcugagaggacuuuuuugauguuuucuguaauuccuauacccauaugcucagcuuuauguauauauguauauuuuaauauccucucuugggaccaugucacauaguaacaacuaguaguaacaacuaguagcuugaucuugaaauaaaacaauguguuugauucacuuaauauuuugagugucuguguuuggcucugaccguaccuaaguguuccacagagguaaggcacuuuuuuccaccuuugccuggaaaaugugcuaggaugaauuuaugcaucuaauuuucguuuacaugccauuacagcagcuacucauaaauuauguggaguaauugcuuagauaacaaaaauauaggaugucuuccgauuuucagcauuaucaaauaaaccugaaaagauguuuggcaggauuuccaaauauuuauuuaucuagauccacagccccaaaaucuuaacuagagauguauuuccuaaguugaaauuuaguaaugggggucauucauugcagaguucugcuaaaaauuggcaguaacuauacauaauuguuuuuuccuuaguuuucuguuaagcaucugcugugugcaggaugcuucugcagaaauccuuaagucucuguaagcuuauuaguuuugaaguaaguuauaggacaaacucuugagaugaaauaaauguguacacagaccccucuaaaacuguuuucagccuuugcacuauugacaucuuggaccagauaauucuuuguaauggggagauguuuagcagcaucgcuggcuucuacccaguagagauaguaacacuccacuucccucagucaugacaguaaaaaugucuccagacauugccaaauaucuuuugggggacaaaaucacccaggaaagaaccacccuucuagaacuucaaggacccaauuaacaucaaucuucagaaaagauagauauuuaaagcucuuguaauuaugauugccgaaguacugguuuaggcuuuuugaauuuuuaaauauaaaaaaauuuaaaaauaagaugacaauugaauauguuaacucaauaacaaguuuauuaaugugugauauuaucuacuuaucaguauugauguuaaucuuauuugaaacaguuucuuggcuaauucugucaucagcauuuaguuaaauuaaaauuauggcuagacacgaauguuuaaaugucagaaccuuccccuccccauggguuuucuguccauuucauaugugugaaguguauguuucauaauaauggacaaagaaaggagaaacaacuuaauguuaguuugcauauauaaguuguuuuauugagaauacugugagcuugaaaucuaaauauuguacuuuugacauuuaucccuugacaguuguguaaguuaauuuaaacaugauagaaugauuuaaagggucguaaaucuggaguaauuaaaugugguggggugaagcuauacucucccugggaguauacagauagaggauguggggagaaauuaucaucucugaaugauguaucucuuaagucuucauacuuaaauguguuucauacucugaauuacauuucuugcccacguaaauaugauuuacauaucuuagaagauaguagaugcucugcuuuugugcuucaacaaaaaacaaaagaggauagagugugaauuguuuugaagcaaaaauaaugucauugggaaaaaucucucuugccuuuuaccuaaguaucuuaauauauuugaacucaauuuauaguugaaagggaaaagaaauaauucaguuacuucaaguuguaauuugagaucuccaguauacaaccacuuaagcguucaagugaaaacuauacuuugcuguauaaaaguuuugccuaagagcauaggcguaaauccuguaauauauguuuccuaugugaacugaaaaaaaaaaacccaaaaaaaccuaagaguagaaaacuaaguguuaccucaagugugaacaacugcaggauguuagcuguuuugaucuuuaagauagccguaguaucuguccucuagauuuacauaaaggaagacucauuuguauugugacuuuaaauaauuuuacaucccacugggaauugcgaugacaauuuacaggcaauacuaaaauuaauauaucuguuacuaacauauauuuaacuuuuaagcauauuuauauauacguaauuaauuuuagauucgaaagucaguuuuacccuuuaaaguaagcuuuaaaaaaugucauuuagaaaccuguuuacuaguaacagauuauuuacacuugagaugaccuaugacuacacuaaccugaaaagauaaaagccagcucuugaaauagaagauguuuuuugcaguguuauguauauguguguguauaggaaccaauuuuacuguguuguuuccagcaaaaugggugggagugaaauuauacugaaauaugagaacugaucuuuuaaucgguuuugucauuaacuggcaauauuguuuggggaagcagguaaacucugccucaguuuuucaucugguuaauauauagaguuuggauuuuauggucuguaagguaguuucuagcuuuaauguauauauuugaagacauuuuguaaucuuauuuaaaaguauauacauacuaaugaaauagaaauuuucucacaauguuuuuguuuauggaauuacuagguagaacucuccucaauauugcuguuaauaaugaucaaagguuuuguaaaguuugucuuacuauaauacugcuaguuugcacaguccagauuuggaaauaaaauauucauguaugcaguacauauauuaaccacuggguggccuaauuucacuuuauuaaaucaaccugguaaauuuucauaccuugaauaugauuggacuuguccucaagauuguauaauaaagauuuuuuuuuugucugugauaaagauuucggacuugaguuaauuugugauuaaaaauauuaucaacuugaugcgauuuuacuagagcaaauuuauagaaccgguauuucucuuucuuuuagaauaaaaaauuuaaaaaaauuucaguuuccuccuuggaauaccucauuuacugguuuaagugauauaauuguuauccucuaaaauugaacuucuaaauguuuuaucuuaacaucacaugugaauuauuucaucaagugcguguuauuucacggacaaagucaugacuaucauguccuguuagcuuguacaccaauguaaaguuacucuuaaacuauuuuccuggccuaaugaguucuacaauuuuuuugugugcuuccuuugacuguuuuauaaucacccuaaucacuuuaauucacagucuaugaaacuguuuccauuugaauauaguaguuugguuauguauuagacauuuaucacauaaauauuuucuuugacuuagguaaacuggcagaaucauucuggaaaccgaguccugggcuggagagccaaagaccaaauuaaucuauuauugcuuugugacuagagaaauaaugucacuuuauuuugcugucuucuagauaauuacacuaggcuaggaaugguuuauuuaacuacauaguaggaagccaauuuuauuaaauuauuacauauuaccagcauugauuguuauaauacagaaaugucaaaagauuauguaaaaguagacaaauagagcagauccauuuugaugauaucuaaccauuuuucagugaugggacuuuuucacuguuaaauggugaaagugggauauuggugcagugauuugugggguuuuauccuuucccuguuuucuuugcaaauuauacacauucucaggcaucuuucuuuguagcuagugauguugauagauaucuaggaucuuuuuuuuggucucauguauuggaaaguuaacauugucuuuucaauacucauauauauguagagauaacuugaugcuauaacuaagaaguagguagacucuaggaaagucagagugguagauaauucuaagaauucuacuugcuucuucacacuuacccauucaaaaagcccagcuuacugaacauugaaugggcuauauaacucagugucugaaacugaugaccaugcugaaaugcaaaauagagaaugaaaccucauguagaaauagaaauuucucacaauaaaguauguggguaaaaaguaaggggcaaaauuuuacaguuaaaaugaacuaguuuuuaggaaaauuacucuuugaaaacucagcuuuuugaccaaaauaauguuuuuguacucauauccuuaaaauauuuuguaagaaccuuaaaguggguuucguaugauuaaaugugauguagauuugugaauacucaagauuuauaugggcaaauucccaagguaaaaauuauuuugacuuagaaauaaccuguauuuuaaagcagucucaaauauacuguuauggaaacuuugaggaucugaagagagggaggaaaagaaagagacccugugaaaagcaugccugagggcuauuuggggugucaggaagugguaauguugcugguggcauuucuaagaaagguuaaacaguacaguagauaccuucaaauaaccuuuucuguauugaauauuuaaaauguuuguuucagcagguucugcuucuuaaaauucuaccacuuggagguguuuuuuuuuuuuuuuggguuuugaaagucuucuuuaacaaauaagaaugcuuuuaccucuuccuagagguauuuucauuuguuaaaaaguuuucuuucucagauccacuuugagaucacauguauugaagaagguggaaguuuugguuggguuggaaaggagugagauaauuuuggaauauagagcucuuggugaagcuggaagauuagggaagauuguucauuaguuuuacaaauauuugaguggcagguacugugcuuaguuaguccugagaggugaacgugguagacauggucugcacucaugagcuuacuuuuuggauguggagguuggcaaaugugauaaacauuaaaaagaagaaagguaggugcucuuaguacauacaaauaggacagaaagcugcagugugguguuuuaucugauucgguagcuuucuuagaaauuuaugaagucauuggacccugaagcaugucgaacuuaacaauuuaauauuggccuaucaggugauauuucugauagcugaaaauggcugcauguaucagauauuuaaucaagccuguagaguuuuuuuuuuuuuuuuuuuuuguuguuuuaacacaguuuaauaaaacaaccauauaugggccaggcgugguugcucaaaccuguaaucccagcauuuugggaggccaagguuggcggaucaccugaggucaggaguucgagaccagccuggcuaacaugcugaaaccccgucucuacgaaaaaaauucaaaaauuagccaggcaugauggcagacgccuguaauuccuucuaccugggaggcugaggaaggagaauugcuugaaccagggagguggagguugcagugagccgagauugcgccacugcacuccagccugggcaacagagcaagacuccaucucaaaaaagaaaaaaaaaaaacagccauguauggaaggagaacugguggauuauuguuacaaauagacaauggcuucagggagagcgaacacuggacuauugaaguguguugaacuguagaagcagaucauaggggaaugggagaaucuugguguuuugccuggucaaauaugaagaauuuuguuccaauggaauugacaagucaauggaaguuagacguuccuacaaaggaucuauagacaguauauauuaaaucugggccuucauuuuucaauuuuguaagauuaaaauuacauaacuuacauagauauuagaaacuacuugcaugcgcuuaacuauauuagaguaagguuaaacaaaucuucaaauuuugcucugugaaaucagaaugaauuuuugagaaagaguugaaucuaguaaggcaaaaauaauuuugaauacuauuaggugaucagccuaugcacguaauacuaauauugaggcaccuuucugugccaugugcuguaugagguguuauauauguuuucucauuuaauuuuauccuuaaagcagcacuauaagguaggugguauuauuaucauuuuacaaacaaguaaacuaaaccccugagagguuaacauguucaagguuacagagugaguaauuaaguuagaaccagaaccuuguucugauuccaaaaugaacuugagguuugucuuuaguaucuuccagcuuccuagcacuuucccccuauuuuuccaguaugucguaguauagcgguuaaguagugacugugggcaagagguuacauuucugagucaaaguuuccuauuccgugaaaugggaauaaugauaauauuccccucuuccaguugugaggcuuuaagagaaaaauuuaauagacuacuuagaaaguuuuaaauaaaugguagacuguguuauuuucagaugccaugacuuuauucaguccacugccuacucagaauccucuaauucaguuuacuuauuuauuuauugagacggagucuugcucugucaccugggcuggagugcaauggugcaaucucggcucacuguaaccucuaccucccggguucaagugauucuccugccucagccucccgaguagcuggcauuacaggcacccaccaucaugcuccgcuaauuuuuguauuuuuaguagggguuucaccauguuggccaggcuggucuugaacuccugacuucaggugauccgccugccucagccucccaaagugcugggauuacaggugggagccacugcgccuggccuuguauuucaguuuaucauuaaggcuugcccuuuuuuauggggcuuuauucuuuaaaauugcuuuuucuuuuuuuacuccaucaaaacucagguucugacuuuggccccuuccucacuuuauuaauuuuccuugggucauccugugcccucagcuauucuuuguaugcuggccaaaacugcaucucuacccuagaccuuguauuugagcagguccacaugcucauuugccuucuagauuugcucugcccuguaggauagccauuagccacauguggcuauugagcucuugaacuguggcuagucugaauuguaaugaacucuaacuacaaaacacacaccagauuuugaagacuuuaguaagaaaaaaauauguaaaacauuucauuuauacuuuuuuauguugauuacauguugaaaugauuauauuuuugauauauuaagcuaaggaauauugacuauugaaguacauuucacuuauuucucuuuuuuuaaaaaauguggcuacuagaaaauuacauauguggcuuguauuaugucucuguugggaagugcuguuccagacauccaccuguguauuuuucaaguaccuugaaaacagcuagucccaaacuauacauacucuccccauuuucuucucucucccaaaguucuguuucuccuucuaucauuuuccauaguaaauagcucuacuuauguuuucaaagccagaaacuuuggagucauccuuaauuccuccuucuuccaugucccucaucuaucaguugcaaaauccuuucuuuucuacuuuuuaaauaucucucaguuuaauauauuucuuucaauuccuaauaucauuaccuugguugaucuauuuuaucacuuccagauuuuugucacauuuaccugucuuuuacucaaggauaugaaaaguagacuucuuuucuguuuucuuauaguacuauuaugguuucauguaaaaaauguaaauaauugcuucacuccaguuuauuuuauuguaaaguaggacaccaucuuuuuuuuuuuuuaauuuugaaauggagguucucuugguugcccaggcuggagugcaguggugcagucuuggcucacuggguacaagcgauucuccugcuucagccucccaaguagcugggauuacaggcacauaccaccacacccagauaauuuuugcaauuuuaguagagacaggguuuugccauguuggucaggcuggucucgaacuccugaccucaaaugaucugcucgacucagccucccaaagugcugggauuacagguguccacgcccagcccaucuuaauuuuaaaaaauggcuacccagugucuuaacaccauuuauugaaaagucuaccuuuacuccacugauuugaaauguuacuguuauaauuuaccaaauuccaugugggucuuuuuucuuuucuaaauguucuguuccauuuaucuauguguguguucgugugguaguaccauucuguuuuauuucucuacaguguauuuugauauuggguagugguaauucucugauuauucuuuuuuaaaacuuuucuugccauucuucuugauuuuuuuuuuucauaugaauuguagauucagcuugucuaguugccucccaaagucuauugguauuuuuauucauuuaauuuaauuuaugaauuagggagaauggacaucucccuaaauuagagaauggacauaucuauaauauuguuuucuuauccaauaauauggucaggaggcugggcauggugaugcaugccuguaaucucaagcgugggauuugggaggcugaggcaggaggaucacuugagcucaggaguucaagaccagcauugcggguggagcaacauagcaaaaccccaucucuacaaaaaauagaaaaaauuagcugggcaugauggugcaugccuguagucccagcuacucgggagacugaggugggaggauugccugagccugggaguuugaggcuacagugagcugugauugugccacugcacuccagccugggugacagagcaagcugagacccugucuggaaaaaaaaaaaaaagucagaauguucuuccauuuguucaagacaucugugucucacaacagugucuugucacuuacuguaccuuuaucuuguauguuaaauuuuuuuuauuguugguauuguuaauuggaucacuucuauugugucuuuuaauuggcugcgguuuauauuuuaccauuaccauuugucaggccccaauaauuucuugcuuggguuguugugaagauuacuaauugguuuuucuuuuucaguuucaccacacucuugucacugauuuuucuaaaacacaagauaucugucuuuugucuuuugcuguguuaaaauuauuuaacucuuuagaauaaaggucaaauaaagaauaaaggucaaauuccuuaacaugacguacaagguuaugauuuuucccguaguggcauauccaaccucauguguuuggugucaguaagaaguauaguuccaggccaggugcaguggcucacgccuguaaucccagcacauugggaggccgagucgggcagaucacaaggucaggagaucgagaccauccugguuaacacggugaaacccugccucuacuaaaaauacaaaaaauuagcugggcguaguggugggcgcccguagucccagcuacucgagaggcugaggcaggagaauggcgugaaccugggaggcggagcuugcagugagccgagaucaugccacugcacuccagccugggcgacagagcgagacuccgucucagaaaaaaaaaaaaaaaaaaaaaaaaaaaauauauauauauauauauauauauauauauauauagcuccaccccaccccgcugucugacucuuaauuuuuuguacuuugaauaauuucauugugaauaugacuuguagucuguaugauuucuucagucauaccugcacacacaaguucaguguuugaauuuacaaauuuaaauaaaauucuugauaucacaaauuguguuuuuuuuguagugaggaugaggaugaugaccuucaguaugccgaucaugauuaugaaguaccacaacaaaaaggacugaagaaacucuggaacagaguaaaauggacaagggacgagguaauuaucugacaagguuucauaguuucuuacauguauuuauugguuaauacugcuauaguuauacggccaggugugguggcucacgccuguaaucccagcccuuugggaggccgagaugggcggaucacuugagguuaggaguucaagaccagccuggccaacaugaugaaaccccgucucuacuaaaauacaaaaauuagccugguaugguggcgcaugucuguaauccuaauccuacuugggaggcugaggcaggaggaucacuugaaccugggaggcagaggguugcagugagccgagauugcaccacugcacuccagccugggugacagagcgagacuccaucucaaaaacaaaaaaaaaaugcugcuauaguuaugaaagauauuuaaaaacaaaauaugagaaaagauaugcaucaaauuaacuguacguucuuuuucuucaaccagagacaugaauaacugaugacauuggaacuuagagaaacaguauaauaaauggaagaauuuguauuauaguggguggcuuuaguuauucuaugguuaccagauauuccuuaauagaauuggagaguuaucuauauuuagggguagaggaaaaggacggggggaaagcuuucuaauuuuuguacuguuuuaauaggaugauaaauuaaagaaguugguugaacaacauggaacugaugauuggacucuaauugcuagucaucuucaaguaagugaaauauuaaauuauauuucuaacauggcugguuuaaggcauuggguuaaauuugcuauuuuucaaaaaugugucuacauauuuuaauuuuagguuuccuuccuaaaaacaucccuguugguuuggucugccucuaguugguugcuaauggcuuggagagucugguuuagagucugguuuucuaguaaugcguuuauccaggggccuaaaaagauuauuaacuuaaaacaaaaaugauaauaaauguaugugggaccuuauaaauauuugcuaauacacguuaaaacauucugugagaaauauauugagauauuugauagcuaaccaaaaaauccagaaaagcccuauuaaaaaaagcuuaucaucugaggcuuaccuuuuaaaauguugauuuuaaaaacuauuaugccuauuguuuaccauacuacuauucaccugcuguucguuauauaacuuuauaauuuaugaaguauuuucacauguacucuuuuuuuuuuuuuuuuuuuuuuuuuuugagacggaguuucgcucuuguugcccagucuggagggcaauggcacgaucucggcucacugcaaccuccgccucccagauucaagcgauucuccugccucagccucccgaguagcugggauuacaggcaugaaccaccacauccgucuaacuuuuuguauuuuuuuuuuaguagagacgggguuucuccauguuggucaggcuggucucaaacucccgaccucaggugaucuaacugccucggccucccagagugcugggauuacaggcgugaguuaccgcgccugguccucacauaugcucuuauuuguauccuuaauacacugugaguagugagggaaaauauacauauuugaauuuaaauauugacuacuuuggguuucagaaaccauguuaacuauguuuuuucuauauugucauaugacuuucaacauaacccaaaaauugagaucaaguaauggaaagagcauaaauuuuggagucaguuugaauuauguucaaaugucagcuccaugagcguggaaaaauuacuuagccucuuugauugucaccuuccuuaucuauaaugucuagauaaucauacuuguuucuguaguaugguuguguagaacuagaaauaacauauaggauguuuggcacaauucuuaauauuuagcagguguucaauaaauggaagcuagguuagaaaaguuauuuacauuagcauuaacagaaaugcuacaaggacauacaggagcaaccugauuauuuugaagaaagugucagccuuaaaauggauuagcguugguguacagaagccauaaaugaagcugaguuugaauaaaaauaauuuuaaguacauugggcaaaagagccauugguagacaaaacauuuuuaucugucccuuuauaugucucuagauuuucuguaaucuugcuuaugaacuaacaauuuuguaaacugugaaucacuaauaaaguguuaggugucauuauccuuguaauguauaggaguuaccagguucuggacugacuaaaauaaggcuucauuuauuauuuuuggaguuugagauguuucuacccagauacugcguaggauuucuuauucuggugaauucauuuucuuuuuaagugucaacacuuaaccaauuuagugaauucauuuucuuuuuaagugucaacacuuaaccaauuuaauugaaauguaacauucaucuucuauguagacuauguaauguuuucuuaauaacuuggaaucauaauuuauaacauccuuuugauccuaugcaguaguauagcaaugccuuuacauuucuuuaaaacuguauaguuagguacugcugaacuacgugaauccagacugauaggcuauuugaguucuuuuucuuuuuuuuuuuugagaugagaguuucgcucuuguugccuagguuggaaugcaauggugcaaucucggcucaccgcaaccuccaccuccuggguucaagcaauucuucugccucagccuuaugaguagcugggauuacaggcaugcaccaccacauccggcuaauuuuguauuuuuaguagagacgggguuucuccauguuggucaggcuggucucgaacuccagaccucaggugauccacccaccucggccuccgaaaguguugggauuacaggcaugagccacugcgccuggcacuauuugaguucuuaugucagcuuuguguaguuuucuguccacugcuuuuuauuccucaguguuaaauccauuucuuuauuucaguuaucuguguuuuaucuuugcugcuucuguauuauaagguguaguguaaagauacacacuuuaguuuuaaauaaauuguuuuuauuuguagucuaagcccuguugacuacuauaauuaagaaaaaacauaauuggggcagagauauguaacauaaauguuacauguuuaaagaaugcuauugaauacacuauucuugaagucuuuguucuaaggaugugagacauaaauucgggcugacuugcuuucuggaagacaguuguuuaauaacaaaaucuucuaaauuuuuucagaaucgcucugauuuucagugccagcaucgauggcagaaaguuuuaaauccugaauugauaaaggguccuuggacuaaagaagaagaucagaggguaauguguucauauucuuuauauucacuauguagguagacuagcuuuuuucuuuuuaauguguuguuuugacauaugaaguacauguuuaagucacuuugauuuuguucuccggaggcuacuugcauaagaauugaauguuaagugucuggaaauguuguuggguuuuuagaaaauugagucaaaccaaguauaacauacagcccuuucuuucugagaguuugguuugcagaaggaaaaauacuugcuguaagguuaguuaccuuguuuugagcucaguuucacaacuauuaggguauaguuuuuugucaaaaaucuaauuaacauuuuaaaacagauuuucauuuuauuuuuacaucuaauaacuugauaugcacggaagucauucuuaacuuuuucucuuaaccuauaaugagucccaggauuagacagaugucagagcaucauguuuccaaagguuuugugauuuaaaaaccaaggucauuguuuguacuaugaaguuggagaugaauagaaguguuucugcacucuuuaguuaaugcccuuuaagucauaaagguugcuaaugcaguugaggaauuagagcauccuuacuccugcucaaaacaaacuuuauuuguuguucuuauuuuuuaaauuuuuuaaauaaguagagauggaaucucgcuauguugcccaggcuggucuugaacuccugggcucaagcaaucugcccaucuuggccacucaaaaugcugggauuagaggcugagccaucaugcccagccagaacaaacuuuaaaguuacuucaccuagacugcacugauuuacuugauggcuacuccuaaguuuuaaaaugugugaucuuguuuaaaaaugcauuuaccaaagccugaaauuuuaguuuuaaagauaguaaauagacacauauagugaaaauaucaacauauauuaaacuuagucuaccaauauaaaauguuuaugagaugauauuugacauagggcagugagguaaagugggcuggaauaacuauucuugcaauuuuaggugaaauaaaaacaacuguaaaauguggaaaaaagaauauguaaucuguguccuuucaguuugagaaaggaagaaaugacaaccaauaacuugguagaaucuuucugcuuccuaauuguauuuuuguuuuuugcuuuuggcugaagcguuuuuuuuuuuuuuuuuuuuuuuuuuagauguaggaguagaaaauguacaaguuucagcauguuuacaguuauuucaaauuaauagggugugaaagcaauugaauuucaagagucuuuaauuagccccuuggauuuuuagaugaguuuggcaucaauuuuugaagcuggcaaaugcuaaagggguauuuauugguaauuuuuuuuuaacaaauuguaguuguggcuuggauuuaaugcauuuauuuaaaaugguauucuugaauuauguuuuaaaauucuuugaagguaaugcuuuuuuaaacuuuguuuuucuguuuccuagguuauugaauuaguucagaaauaugggccaaaaagauggucuuuaauugcaaaacauuuaaaaggaagaauaggcaagcaguguagagaaagauggcauaaucaucugaauccugagguaaagaaaucuuccuggacagaagaggaggacaggaucaucuaugaagcacauaagcgguugggaaaucguugggcagaaauugccaaacuacuuccaggaaggugcuuauauaaauguauauauauuuuucuguacuuaaacaugaccuuuauuaccuuacuguuaaauacauuugcaaguccccgaugacuuauuuuuuaaauuuguaauuaaaauguagacuauauaacauaagcaaccuuugggaccauuuguacuaaauucugugguaaaggguaugauuacuuuuuuaaugaauuauuuuauggcaauaauuuguacaauaaaaugauagauuuuagauuauauaaacauuuaauacacuccuaaaaucauguugacauaucagugucaaucaagugagacccccuuuguauaaacucuguuggaaaagaaucuaaaucuaagauuucuuucauauugcguucuauguguaagaccagggaaugauaugcuagcuacaguaaacugcuaugaaaguguguuggggaaaauucaaucuuaauuaauuaugguaugauccaaaccauggaaguaguauauauauucauguggcuaaaauaccaaauuuuccucagaggcagugaugugcuaaguacacucuacauuguacugguucauauguuuucuaauagcguuuaguacagcagaccaacaaccuugugaaaauucauaacuuagaagauacgcauuugucuuuuguugcuguaaucucuaucuguauaguacuuuauagcauuaagugcuuuuucauguauucuuaauuuuuauagacuuggaaaguauacugagcaaacauugcuaucuuuguuuuauagauaagauauuaaggcauaguguuaaauuuuuuauucaaguuauuaaaccaggucuagaugcuuuuaaucucuuauacgucuucuuacuuuucauagaaccuagcuuagugccuuaacauuuacugaaaaccugcuuuauguguguauauuuuaugagggaugaaauuugcaaguaaccauagguugaagauuuucauuuuuauaaagggaaccuuagauaagaagggagccaauuaacucuuucuuaccauaaauauuuuguucuaagaagugaaaaagaauacugggauucuuuaguuugugauuugcuuuucaugaucauguuuguuccuggcuuaagaccuuggcccuugcuauacucuuuaucuggaaugcucuuuuuuucuuucuguucucguauagcugguuuguucuaaccaaaccaaaauuacuccguuacccacuuuucuuauccuacuuuauuugcauuguagugaauuuuuuauucauuuauuuguuuuucuauucuuccuuccuucccacucccacacuuccaaggagaguguaagcuccacgagagcagugaccuacuuugccuuacucacugcaauauuucuggugcuuagaacuaugccugacauaugcacauacaguuuaucuuuugaauuuuuaaaaaauaccuaucuuccugaguagaaacuccaaaagaaaaauuaagaaaaaaguaucuaauuucaucaguguaaaaauuuguuuuaagcacuuuguacaaguuaacacaguguugaaaucuguggaauccuuuuuucuuuuuaaaucauaccuuuccuuucuuaggacugauaauucuaucaaaaaucauuggaauucuacuaugcgaagaaaaguggaacaggagggcuauuuacaagauggaauaaaaucagaacgaucuucaucuaaacuucaacacaaaccuugugcagcuauggaucauaugcaaacccagaaucaguuuuacauaccuguucaggcacauacuuuuaauaccuuuauuauuuaaaaaauuuucuuaaguugcuauaugggaagauguuugguuucuuaauaggacaaauacaaugcguauuaagggguaaauagacaaacugaaaaaaauguguaacuuugauuuauaaauauuuugagaacaaauuuauuaaaauguuuccuuuuauauguaauuuuuacaucaagaaacuauguacauuuccuaauacucugauucuuugaaucuucauuuaugauucaaagcuaauggucaucugugcuuuaacauucuauuguacuuuccauuuaaacaauuuuggcguaauuauaguauugcuuaucucuaagagguagguauauauaaaauggcuuaaaagagaaaguagcaaaaauaaguaauuguuuugggggugugguaauuaauuggauuuugcuggcauucaacuuugcuuuucccccuaauaacuaaucacuuggguaauuuuagucuuuguuuagaugauucauuaaaguagguauuacacgagcucaaaauggggcaagcucuauguugucccuuacagugcauuuuucuacuuggaagaaauuaguguaggagucuucaugagauuuguuuuacauuucccugucuaccuguuaugccauuuuucacaaugagcaauucuugguucuugucacauaaauuguaaagauuaagucaggacuuaguaguuuucuaccaaaagauaaaauugggcaagauauuaaaaaucugugcuuacuaugccucagauuugauuuuugacauuuuguggacauuguuaaguuuuuuaagcaucauuuuaaaagaaccacuuagaguaaugacauuuucauuaacaauaggaaaacaugugaagacaguauaauuaucugcugauacucaauaccuuaagguuuuuauuauguuucuucacauuuuucuuuagagucuagauuucagcagcauaaacugaaacauucugcuucugucuuagaaaguuuaucauuuaaauuuauuuuuuuaacucguagaaagauaauacauggggccaacagaguauuuaacagucuuaaucuaaauauguuggaaagaugaggauauuucuuauacuguaagaauuguuucccuuuuaauuuagauauauucauuauucaauuaauuuaaacuaauaaaauaauuuuauuauaugugugacuugauaaaagaauagauggguuuaaaauacugucacagauuuucaugaaaaguuugggaaagauacguuucuaauucauuagaguuaccaaguugagcaauaagugguacuaaucgaguauucuaaaaguuaagcucuauguuagaaguuauacauaaugauucugcauuauauagugauuuagguagaccauuacggaaagcagacaauuucauauuuaugguuuuugauuuuaaggcuuuuuuuuuuucuuuuugagacagaaucucuuucuguuaccaggcuggaaugcaguggugcgcacacagcucgcugcagccucaaccuucugggcucaugugauccuccugcuucggccuccugaguagcugggacuacaggcgugcuccacuacaccuggcuaauuuuuuuauuuuuuguaaaaacagggucuugccauguugcccaggcuggucuuggacuccugggcucaagcgaccauacccccucagccucccaaagugcuggaauuacaggggugggccacuguacccggccccgauuuuaaggcuuuuaaaaacaccuccucucauauuucuuuccacuacugcuuacuaaauuuauauguaucuugaaaauucuuauuacagauguuuuagaaaagaagcagaaugauacuuagccuaucaucaguauaucuauuaaaaguaugugagugauucugauuguuuuucuaagacaaguaauagaagaagacuuuggcaugggguggugauaaaaguaggagauaugaacauugaaaaacuugcuucaggucucuguccuugugagugcuucauucauauggacacauaggaacacaauuacuuuguuuucuuuaggagauagagcaacccuucuaauaguagauguuuaaauauauuuggugaaugucagauuuaauaaacuggcugauaaaucuaggcuaaguaauucucauauuucaucugaaaaaaagucuuuucuaaguguuacgacuuuuaaucauagauucuaggaguggagcuguaguuauuuaauagauaagaaaguauuauagguauaacauuucaaaauuaauacagguacuuucuaaguuuuuuauauugauacugugucaaaaguuuuugucauuugcuucagauuuucaacauuuauagcauuauauguaugauaauaaugcauuaauuacuuuuuagaucccuggguaucaguaugugucaccugaaggcaauuguauagaacauguucagccuacuucugccuuuauucagguaacuuuuauuuauaacgaaaaccaaaggaaauguguucagucacauuuuuaaaagccuaauaguaucuauuuccucaucuauuaaacuaguauaaaaauaauacgaucuguccuacuuggaguacucuaacuauaaagaagaaaguguguaagugaguuugaagaaauauaaacuguacaaaugugauugaugauaccaguaugguagucauuucauucuuucaagguaaagcauucaaguugggaauggacauauuuuugcuaaauuguauagaauauauuuauuaagauuuaaaaauauaaaauauuucagacauacauuucagcugauagagaugaugcaacauuuuuuaagucauuaaaauuuucccaaaucuuuuaaguugaaaauauuugccagcaccucuuuagauaccagagggauugugauaaugaguaguuaguauuuaguagcauuaagcuuuauuagaaaaaguauauuucauguugcauagaagaaaauaaaaaugagaauacuaauaauaaagcaauuauauaagcauccuguuuucucuuuuauuuaacuuauuuuagcaacccuucauugaugaagauccugauaaggaaaagaaaauaaaggaacuugagaugcuucuuaugucagcugagaaugaaguuagaagaaagcgaauuccaucaguaagaaauaagcuuguuauuuguauuguuagaaucuuucauauaugcuuuuugucauuuuuaucagcuagaaagcauacucaguaugacugcagauuuuaauauggaguaaaaauaguuuuguuuuuuuuuaauuugcaacuuugagguugccuguuuuuuucuuuuucuuuuugagacagggucuugcucugucacccaggcagaaaugcagugguguaaucacugcucacugaagccuugaccuccugggcucaaaugaugccccaccucagccucucaaguagcugggacuacaggugccugccaccaugccugacaauuuuuuuuuauuuuuguagagaugggguuucaccguguugcucaggcuggucucaaacuccugggcucaagugauucuccugccuuggccucccaaagugcugggauuauaggugugagccucugugccuggcccaagguugccugauuuugauaugcauuucuuugagcauaauuuacaauguucuguauuaggauacuucuugagucauaaaugcaaagcagauguaaaguaaaaucuuauauauguguguauauauauauaaauauacacacauauauauuugugaaaauuauguguguuuagauuaggcuuuggcuuuauuuuagacauuccauguaaugauggguuuaauucuuuuuaaaauaaagaauugaauagauguagagggauuuaugagcuccaaaauuauuuuuauucucuuugaaaauuuuuuccuauuuacuagauuuagaauaugaguucaguaaauuuaaaaaaguaauaacacuaaaaauauauggaaaaaggaacauuuagauuuuaugcucucuaaacaauucuucuaaaagaagaaauuuuauauagauguuggguguugguuaccacaugugaaaacuauuguguaagauuuggcugaugagacuaacuaggaguguuaaguuaggaucaaagguaaucauucuaguagaauuaagcagguuaugcuagauugguuaaaagaaagauacaaguuuauauuuaaauaacuuuucuuagguuuuuaaauuaaaaaaaaauuuuuuuuuuuuugagacagaguuuugcucuguugcccaggcuggagugcaguggcgugaucuuggcucacugcaagcuccgccuccuggguucacgucauucuccugccucagccucugaguagcugggacugcaggcgccugccaccacucccagcuaauuuuuuauauuuuuaguagagacuagguuucaccguguuagccaggaugaucucgaucuccugaccucgugauccuccugccucagccucccaaagugcugggauuagggcgugagccaccgcaccuaaccaaauuaaaauuuuuaaauugggaaauaauuguacauauucgugggguacacagugauguuucuguacauguaauguauacugaccagaucaugguaauuagcauaucuaucaucucaaauuaguuauaauuucucugucuugggaacauugaauaucccugcuucuaacuauuugaaacuauuuaauauuguuaacuguagucauccuacagugauauagaacacuagaacuuguuccuucuaucuagcugugauuuuguauucuuuaacauauauuucccugucccucccuucauccuacccuuccuuuaaauaacauuuuuaaaaauuuaaaauaaugccuugagccuuauuauuuuuauuaguauuaguauuauuuuuuuuugagacagagucucacucucucacucaagcgggagugcaguggugcaaucuuggcccuacaaaaaguuuuuuuuuuuuuuuugauuagcuaagugugguggugcacaccugugguccuaacuacccagaaggcuccuggguucaagugauucuccugccucagccuccugaguagcugggauuacaggcauguaccaacaugcccggcuaauuuuuaaaauuguuuuaguagagauggcauuucaccauauuccccaggguagucuugaacaccuaaccucaagugauuugcccaccuuggccucccaaaguacugggauuacagacaugagccaccauuccuugccccuuuuuacauuuagaaaaggguuuguuuguuuauuuuuuguuugggacugaaugagaggacagaauauugagagugacugggaacucaggcaaaauuacuaagaagauaaccugagaucuugaaauaguauuaugaggcaacuggugaugucuuuauacuacuuaagaggauauuaauaaaaaugauauuuauugauuauaauaggcaagauauauaccauaagaaaagcaauuucuguuuuuuguuuuuuugggauuuuuugagucagggucuuggucuguugccuaggcuggagugcagugguacgaucauggcucacugcagccucagccucuuagguuuaagcaguccucccaccucagcuuccuggguagcuaagaccacaggugugugccaccacacuuggcuaauaaaaaaaaauacuuuuuguagagacgagauuucccuauguugcaguuucuguuuugaaacugcaaaaaccaugagcaacuaggaagaccugacauauacuuaccuuaaaguuaauuuguuuuguuaagaagcuacaaauagacugggcuugguggcucaugccuguaaucucaggacuuugagaggcugaggugggagggucacuuaagcccaggaguuugagaccagccuuggcaacauagugagaccccaucucuacaaaaaauuuaaaaagaaauagauaggcaugguggcacaugccuguggcuccagcuacucaggaggcugaggcagaaggaucacuugagccugggaggucgaggcugcagucagcaguuaucacaccccugcacuccaaccugggcaacagagcaagaccccaucuuaaaaauaaauaaauaaauuagccaggcaugguggcacgugccuguagucccagcuacucaaaaggcugaggagggagaggauuguuuaagcucagggguuugaggcugcggugagcuaugaucauaucacugcacuucagccugggugacagagcaagaaccugucucaaaaaaaaaaaagccacaaagaauuaugguuagagaaucagcauuuguagaugauuauaucauguuuaaaccauuuuggauuuuuaauagaaucuuacccuuuuuuaauuuaacaggaaaaauauaacuaaaggaaugaauauuuugcauuaaaaaggaagaaaguuauuuucuuuuuagaacucacuaucuaaaaucuguucucauaaagauuugguugaauaaguguauauucugaaaucuagagggaaguugcugcagccaguagaauagacuccauacccauaugaagcauuuuuuuaauuucuuuuuguguuggagucuuacacugucgcccggcuggagugcaguagcgugaucucggcucacugcaaccuccaacucccugguucaagcgauucuccugcuucagccuccugaguagcugagauuacaggcaugugccaccauacccagcuaauuuuuguguuauuaguagaaacgggguuucaucauguuggccaggauggucuugauuuccugaccucgugauccaccugccuuggccucccaaaguguugggauuacaggcaugagccaccgugcccucccuaaaguuuuuuuuccuaaacaguuaugugacaauauugacugccauuuuacugaguauccauugagcucuacucuugugaauguuuuauauguaugcuugguaauccugauguuaacucuguuaaguggguagaauuucauuagagaguucacauuuagggccgaauguagugacucaacgccuguaaucccaacacuuugggaggcugaggcaggcagauuacuugaggccaggaguucgagaccagccugggcaacauggcgaaacccugucucugcaaaaaauacaaaaacuaaucaggugugauggugcgcuccuguagucccagcuacuugggaaggugaggugggaggaucacuugagccugggagguggaguuugcagugagcugagaucgggcuagugcauuccagccuggacgacagagugagacccugucucaaaaaaaaaaaaaaaaaaaagagauucacauuuaggucugucugauuguaaccuaugguuuuuucacugggcccaguuaucgcccuauuuguguguuggaucuuuuucucaccugcauaccaacugaaagguaugugguuuggagggaaccacguguucccuccagcaugagaggaaaaccaugcugucuccugaaagugauugucaagucagaagguggcuaugcuaaugaaauggaaaauaaugaaaugaaauaagauuacuuuaauuucuuuuauuuauaaaacacaucgaauuugcuuugcaacaguguuuuauuaccuuauuuagguugaaauguaacauuuuauagugaaucccuagaacauucugaaaauuuuuacuuuuaguaguaauaguuaccauuauucagugcuuccuauagacuuccagugugcugucuaccauauggcaguuacuagccacauuuaauuuuaaacaaaacuuaaaauucaguucauuaguugcacuagccacauaucaguugcuuauauggcuaguggcucccauauugagcagcuggaaauauagaacauuuucaucaucucagaaaguuuggaguucccuccaaaccacauaccuuucaguugguaugcgggugagaaaaagauccaacacacaaagagggcgauaacugggccccaugaaaaaugcuacacacuuuacauguuguuucucauucauaacucuucaaggccucuuuucuuauuuuuuaauuauaaaacacuagaaaacuaggcuugcaagauaaguaaauugccuaguguacauuucuaaagagauaaagaaaaaugacauagucucugacuucagguuuuacucugcagugggaaccuacacaagaaacaggauaguauaugauaaaauaaggcacaaggguuuuuuuuuugcuuuuauuauuauuuuuaauugacacaauaauuguacauauuuucuggguguacaguguacuauuuugauacauguaugcaaugugucuuggucaagucuugguaauuagcauauccaucaccucaaacauuuaucauuucuuuguguugggaacauuuaaauccugcuuuuauaguuauuugaaaauauacaacaaguugcuguuaauuauaguuacccuauagugcuauagaacacuggaacuuacuccuccucucuaguuguacuuauauauccauuaaccaaccuuuggcuacucucccuucuccgcuucccuuccuuggcuccccuucuucuccucuaguagccacuauucuucucuauacuucuaugagaucuacuuuuuuagcuuccacauguaagugagaaccuacaguguuuaucuuucucugccuggcuuauuucauuuaacauaauguccuccaacuucauuuguguugccacaaaugauagaauuucauguuauuuuuauggcuaaauaguauuaugugguuaugugucuauguauguguguguguauaaauauacagacacagcacauuuucuugcuuuauucaucuguugauaggcaauuagguugauuccauaucugugaauagugcuauaauaaacauggaaguacauauaugauuuucuuuccuuuggauacauacccaguagugggauuacugcaucauaucauagucuauuuuuaguuuuuugaagagccuccauaguguuuuugauaauggcuguacuaauuuacauuccuuccaacaguagaguuccccuuucuccacaucuuugccagcaucuguuauuuuuugucuuuuugauaauagucauucugacaagggugagaugauaucucaucgugguuuugauuugcauuucccugaugacuagugauauugagcauuuuuuaauauacccauuguccauuuguauguuuucuuuugagaaauauugguucagcucauuugccuauuuuaagucagauuauuggcugggugccuugucucaugcuuguaauuccaacacuuugagaggcuaagguggguagauugcuugagcucaugaguucgagaccagccugggcaacauggugaaaccccaucuuuacaaaaaauacaaaacuuagccaggcgugguggugagcaccuguagucccagcuacucagaaugcugaggugggaggauggcucgagccugggagguggagggugcagugagcugggauggcaccauugcaguguagccugggcaacagagccggaccuuaucucaaaaaaaaaaaaaaaaaaaaacaccaaaaaacaaaacccaaaccagauuauuauuaguauuuuuuguuguugauuuuuuugucuagucuagauauuaauccuuuguugguuaauaguuugcaaauauuuucucccauccuguacaucauuucucucuucauucuguugauugccuccuuugcugugcagaagcuuuuuaguuuaauauaaucccauuugucuauuuuugcuuuuacugccuguguuuuugaggucuuccccauaaaauuuuugcccaaacaauguccuaaaacauuucuccuauguuuucuuucuuuuuuugagacaaagcuucauucuugucacccaggcuggagugcaguggcaguggcgcgaucucgguucacugcaaccuccgccuuuuggagguucuccugccucagccuccugaguagcugggauuacaggugccugccaccacgcccagcuaauuuuuugguauuuuuaggagagacgagguuucaccauguuggccaggcuggucucgaacuccugaccucaagugaucugccugccucggccucccaaagugcugggauuacaggcaugaggccacugugcccagccuuuauguuuucuucuaguaguuuuauauuuuggguguuaaauuuaagucuuucauccauuuugaauugauuuucuucuuucacaaaaaaggagguuuuuuuaauauggugagagauagggagcuaguuucauuuuucugcauauggauauccaguuuucccagcauuauuuauugaagagacucucucuucuuccaucaguguucuuggugccuuuguugagagucuguaaaugcguggauuuauuucuggguuauguauucuguuccaguaccaugcuguuuugguuacuacagcucuauauagaauauuuggaagcguguuagugugaugccuccagcuuuguuuuuguuuguuuguuuguuuguuuuuuugcucaggauuacuuuagcuauuuguaguuuuuuaaaugaauuuuagcauuguuuuugcuacuuuuggggagaaugucguugguauuuugauaaagauugcacugaaccguagauuacuuuugguaauauggucauuuucacaauauuaauucuucuaauucuugaacaugggagaucuuuguauuuuuucauguccucuucaauuuuuuuuaucaguguuuuguaguuuuucuuguagaaaucuuuuaccuucuugguuuaauuuauccuacguauuuuauuuuuuuguagcuauuguaaauggcauugcuuucuugauuucuuuuugugcuaguuuguuguugguguauagaaacacuacugauuuauuuuauuuuauuuuuuaauuuuagagaugggggucucgcuaucuugcccaggcuggucuugaacuccugaccucaagugauccuccugcuuuguccucccaaagugcugauauuacaggcgugagccaccaugcccagccaaaacacgacugauuuuuuguguguugauguuuuguccugcaacauuaccccauuuguuugucaguucuaagaguuuuuuuagaggagcuuuauauaggguuauaggguuuucuauauauaaguucauguugucugcaaauggggacaguuugacuuccuuuuuuccauuuuggaugccuuuucuuuuucucuugccuaauuguuuuggcuaggacuuccaguacuguguugaauagaaguggugaaaauggacauccuugucucauuugagaucuuagagaaaaagcuuucaacuuuuccuuguucaguaugauguuggcugugguuuugucauauauggccuuuauuguguguuuuuucuauaguuaacuuguugagaguuuuuaucgugaagggauguugauuuuaucaaaugauuuuucaugucuauugagauaaucuuuauucuauugauauuugauuuuauuuauugauuuauguauguugaaucauccuuacaucccugggauaaauuccauuugaucuuggugaaugucuuuuugcaucuauguucaucagggauauuggcuuacaguuuucuuuauuugguuuugguaucaggguaauguugaccuuguagaaugaguuuggaaaaauuccuuacucuucaguuuucugagagaauuggaaaagaauugauaguucuucuuuauauguuugguagaauucugcaaugaagccauuggguccugggcuuuaauuuuauaggagacguuuuauugcacauucagucuugcuacuuguaauuggucuguucagguuuucuguuucuucuugguucaaucuugauagguuauaucuauccagaaguuuauccauuucugguaaguuuucuaauuggauacacaguuauucaugauaaccucuaaugauccuuuguauuccugugguauuaguuguaaugucuccuuuuuuguuucugauuuuauuuauuugggucuuuuuuuuuucuugguuagucuggccagcaguuugucaauuucguuuauuucuuuaaaaagucaacuucucauuucauugauuauuuguauuuguuugucucaguuuuguuuauuucugcuuugauuuuuauuauuuauuuuccucugcuagcuuuggguuugguuuguucuuauuuuucuagcuacauuguuuauuugaaauguuucuacuuuuuugguguagguauuuauuucuauaaacuucccuuuugauacugcuuuugcuguaucccauagguguugguauguuuguuucuacuuuucauuuguuuccagaaauguuuugguuuccuucuuaauuucuucauugaccuauugguuguucaggagcauguuguuuaauuuccguuuacgauuucaaaaguuccuuuuguuauugauuucuaguuuuauuucauugugguccaaaaagguauuugauaugucuuuaauucuguuaaauuuguucagacuuauuuuguggccuaauacguggucugucaugaagaaugugcugaugaaaagaauguauauucugcagauauuggaugaaauauucuguagaugucuguuaggcucauucaguauaaaugugcaauuuaaagccaauguuuguuucuuuguugauuuuucugucuagaugaucuuucauugcugagaaugggguguugaagucuccaacuauuuuuuauuggaaucuauuacuccuuuuagaucaaauaguauuugcuugauguagcugggugcucugauauuggugcauauauauuuacaauuauauucuuuugcugaauugaucccuuuaucauuauauauugaccuuuuuugucuuuuuuuauaggguuuuuuuuuuuuuuuugaggcaggguuucacuccguccccccaggcugaaauacagugcugugaucuuggcucucuguaaccucgaccuuccaggcuaaggugaugcuuucaccucagccucccaaguagcggggaccacaggcaugugcugccauguccagcuaauuuuuuuuuuuuuuuuuuuuuuuuuuuguagagauggaguuuugccauguugccgaggcugguuucaaacuccugagcccaccuuggccucccaaagugcugugguugcaggcaugugcuaccaugcccagcuucuuuuuauaguuuuuaguuuaaauuaugcuuuaucugauaugaguauagcuauuccugcuugcuuuuaguuucuguuugcauagaauaucuuuuuccauccuuuuacauucaguccguaugugucuuuacaggugacaugaguuuuuguaggcagcauauaguugggucauguguuuuuaauccauucagcuagucuaugucuuuuaaguguagagcuuaaucuguuuacauucaggguuauuacugauaugugaagacuuacucuuuucauuuuguuaauuauuuucuguuuuuguguauucuuuguuccuuucuuccucucuuaauguuuauuauugcaguuuggugguuuucuguaguacagugguuugauuauuuuaucuuucuccuuuguguaccugcucuacuagugaauuuuauacuuuuacauauuuucauaauagugucuguuaucuuuuugcuuucagguauaggacuuuuuugagcacuucuuguaaggcugaucuaguggugaugaauucccaccauuuaaaaagaaaaagucugggaaagacuuuauuucucccucauuucugaaggauagcuuugcuggguauucuuggcaggcauuuuucuuuuuucagugcuucucaaauauaucauuucauucucuucuggccuguaagauuuuuucaaauaaaucugcuguuaucuaauaaagauuuccauauaugggauguaauacuuuuacuuugcaguuuuuauuuuuaauuuucuuuugauaagggucucacucugucagccaggcuggagugugguggugugaucacaguuugcugcagccuugacuuccuggguucaagugaugcccucaccucagccucucgaguucugggacuacaggcgcaugguaccaugcccagcuaauuuuuguauuuuuuguagagaugggguuucguuauguuggccaaacuguucucaaacuccugggcucaagcaaucugccugccuugacuucccaaagugcugggacuaugugcgugagccaccguaccuguucucucuugcuauuuuuagaauucugucuuugaauuuugacaauuuguaagucacaaaguuuaugguaacauacaggagaggugcuugauuuagauuguugucaucagggaaggguuccuagaaguccuaagugaacucagccuugaaggacaaugauuauauauuagcaagauaaaugaauuaggacauuauuauaaaugaagcagauaaaaguguauaaucagaugaaguacuuuccaguauuugaacugugucuuaagaauagcuucccuuugggaggcugaggugggcggaucaccugaggucaggaguuugagaccagccuggccaacauggugaaacccugucucuacuaaaaauacaaaaaauuaaccggguguggugauggguaccuguaaucccagcuacccgggaggcugaggcaggagaauugcuugaacccaggagguggaaguugcagugagccgagagagcaccgcuguaccccagccugggcaacugagugaaaacuccaaucucagaaaaaaaaaaaaaaaagaagagcuucccuggucaguagguuacagagcauuuuauuaauagauagagggagcagcaauaugugcaaaggcacuccaggucaaaagaguauauaauucacuggggaauugcaagugcuauaguuggguauuucugauaacuaccaggaauaaauagauacacaugauaagguuuaaauauauagcucuugaguagaaguguugagaaaugaaguuuggaaggaagggaguagccagauucuaagaguuuggacuuuauguuguauguaaaugcuuguuuuaucucaucaugauuguauagauuaaaaauuuuaauuagaaaaaagaaacauagucaaagcaugaaguuuaaugaaaaaaguauaccaauuuugaggaaagacaaaauauuugcuacuauguuuuuagccuaauugaaauguguugaaaucugaauuuaugccuacauugagaaugacaaauaauauucaaauuucuuuuguaccuuuagcagccuggaaguuuuucuagcuggucugguaguuuccucauggaugauaacaugucuaauacucuaaauagccuugacgagcacacuagugaguuuuacaguauggaugaaaaucagccugugucugcucagcagaauucacccacaaaguuccuggccguggaggcaaacgcuguguuauccucuuugcagaccaucccagaauuugcagagacucuagaacuuauugaaucuguaaguaaaaaauuguaagauuaucaaaaguucaauuuuaguuauaugauuucaugcucagaaacucaguuuuggacauugaccaguuuuauguuuuguaugccaugcuuaauuuuguucugauauuuugcaguggcuucuaggggaaaaaaguuuaaauuuuucucaaguaugugccuugugaggaauuuuuaaaaauuaaaaacuuaauucauuuuuuauuauauaaguuauacaagugcauuagagaaagcuggaaacuagagaaaacuauaaaaaagaaaauuaaaguccuucauaaacccagaguuaauaauuugauguauuccuuucagucuguguucuauacucagaaaacauuauauuuuuaaacccaaaaauacacuucuguauuauauuuguggauuuuuuuuuguuuuccacccugucaugagcauguuucuguuuccuuuuuuaaacuugauuuuuuuuuuuuuaagauggcaucucacucugucgcccaggcuggaguguaguggugcaaucucaguucacugcaaccugugccuccuggguucaagcgauucuccugccucagccuucugaguagcugggauuacaggugccugccaccacacccagcuaauuuuuauauuuuuaguggagaugggguuucaucauguuggccaggcuggucuugaacuccugaccucaagugauccucccaccucggccucccaaagugcugggauuacaggcaugagccaccaugccuggccuaaauuugaauuuuaggggcuuuguaguauuccaucaaaugaauauaagaaaauauauuuacccaacuauuauuauuggacauuuagguagugucuacuuuuucauuuuuuuaaaaaaaauuuuuuuuuaauuuuuuuauuauuauuauacuuuaaguuuuaggguacaugugcacaauaugcagguuaguuacauauguauacgugugccaugcuggugugcugcacccauuaacucgucauuuagcauuagguauaucuccuaaugcuaucccuccccacuccccccaucccacaacaguccccagagugugauguuccccuuccuguguccauauguucucauuguucaauucccauuuaugagugagaacaugcaguguuugguuuucuguccuugcgauaguuuacugagaaugaugauuuccaauuucauccaugucccuacaaaggacaugaacucauccuuuuuuauggcugcauaguauuccaugguauauaugugccacauuuucuuaauccagucuaucauuguuggacauuuggguugguuccaagucuuugcuauugugaauagugccucaauaaacauaugugugcaugugucuuuauagcagcaugauuuauaguccuuuggguauauacccaguaaugggauggcugggucaaaugguauuucuauucuagaucccugaggaaucgccacacugacuuccgcaauaguugaacuaguuuacagucccaccaacaguguaaaaguguuccuauuucuccacauccucuccagcaccuguuguuuccugacuuuuuaaugauugccauucuaacuggugugagaugguaucucauugugguuuugauuugcauuucucugauggccagugaugaugagcauuuuuucaagugucuuuuggcugcauaaaugucuucuuuugagaagugucuguugauauccuuugcccacuuuuugauaggguuguuuguuuuuuucuuguaaauuuguuugaguucauuguagauucuggauauuagcccuuugucagaugaguagguugcgaaaauuuucucccauuuuguagguugccuguucacucugaugguaguuucuuuugcugugcagaagcucuuuaguuuaauuagaucccauuugucaauuuugucuuuuguugccauugcuuuugguguuuuagacaugaaguccuuguccaugccuauguccugaaugguaaugccuagguuuucuucucggguuuuuaugguuuuaggucuaacguuuaagucuuuaauccaucuugaauuaauuuuuguauaagguguaaggaagggauccaguuucagcuuucugcauauggcuagccaguuuucccagcaccauuuauuaaauagggaauccuuuccccauugcuuguuuuucucauguuugucaaagaucagauaguuguagauaacgcggcauuauuucugagggcucuguucuguuccauugaucuauaucucuguuuugguaccaguaccaugcuguuuugguuacuguagccuuguaguauaguuugaaaucagguagcaugaugccuccagcuuuguucuuuuggcuuaggauugacuuggugaugugggcucuuuuuugguuccauaugaacuuuaaaguaguuuuuuccaauucugugaagaaagucauugguagcuugauggggauggcacugaaucuauaaauuaccuugggcaguauggccauuuucacgauauugauucuuccuacccaugagcauggaauguucuuccauuuguuuguauccucuuuuauuucauugagcaguaguuuguaguucuccuugaagagguccuucacgucccuuguaagcuggauuccuaaguauuuuauucucuuugaagcaauugugaaugggaguucacucaugauuuggcucucuguuugucuguuauugguguauaagaaugcuugugauuuuuguacauugauuuuguauccugagacuuugcugaaguugcuuaucagcuuaaggagauuuugggcugagacaaugggguuuucuagauauacaaucaugucaucugcaaacagggacaauuugacuuccucuuuuccuaauugaauacccuuuauuuccuucuccugccugauugcccuggccagaacuuccaacacuauguugaauaggaguggugagagagggcaucccugucuugugccaguuuucaaagggaaugcuuccaguuuucgcccauucaguaugauauuggcuguggguuugucauagauagcucuuauuauuuugagauacgucccaucaauaccuaauuuauugagaguuuuuagcaugaaggguuguugaauuuugucaaaggccuuuuccgcaucuauugagauaaucaugugguuuuugucuuugguuuuguuuauaugcuggauuacauuuauugauuugcguauauugaaccagccuugcaucccagggaugaagccugcuugaucaugguggauaagcuuagugucuacuuuuucaguacuacagauaacauauaaagcuuugugcaaaaucaugauuaugucuuuagguuaaauugaauuucuggaucaaaguauaucaccauuuuuaacacguuccauacacauuaccaaaugauuaugcagaauuugauggugucuuccugaugugcaguagaaugugaaguuuuaugacgaaauauacuuuuugauaauaacuuaauuuuugauaauaacuuaucauuuguucuuaaaguacuuugacaguaagcuucaacuacugaauuagaugaacuauuauguauuuuggaaucauaggaaagccauaaucuguuccucuuaaauggucuugcuuaaaaaaaauguccaaggaaagcauuuuuacugauaaaaugaguuguuaauuaacucuguggaaaucaucauccuguguucaagagcagauuuaacuagguuacagcauuaacuuuauuaacaguuuaauuuauugcaggauccuguagcauggagugacguuaccaguuuugauauuucugaugcugcugcuucuccuaucaaauccaccccaguuaaauuaaugagaauucagcacaaugaaggagccauggaaugccaauuuaacgucagucuuguacuugaagggaaaaaaaacacuuguaaugguggcaacagugaagcuguuccuuuaacauccccaaauauagccaaguuuagcacuccaccagccauccucagaaagaagagaaaaaugcgagugggucauuccccaggcagcgaacuuagggauggcucauugaacgauggugguaauauggcgcuaaaacauacaccacugaaaacacuaccauuuucuccuucacagguagugguguucauuuuguuuauguuucuaaaugucaaugaguuacauuaaauuagaucuuuaacauccuuacuagcaguugguagcuuugauaacauauaaaaauaauguguuuaaauguauacuugagaauacugaacucugagagaauagaaaguaucucacaaaauguaguagcugcaaauauuuauuuauuuauuuauuuauuuauauuuuggagacagggacucacuuuguugccgagguuggagugcaguggcacaaacacggcucaccgcaaccucaaccaccgaggcucaagugaucuucccgccucagccccccaaguagccuggacuauagaugcgugccaccacaccuagcuaauuuuuguauuuuuuguagagaugggguuuuaccauguugcccaagcuggucuugaacuccugagcucaaguaauccaccugccuuggcucccaaaguguugggauuacaggcgugagccacugcucccgguucuacaugauauuauacuacaguuuuuagagggacauuuucuuuaucuuguagucccauaucuuuauagaacucaucagaaaacaagcccggaaagguaacauugauuugcccaaaguuaucuaaugcaaggcugagacuaagauccgguuuccugacugacuacuguucgauagauauaccugauaaagauuaaaguggccuuaccuauuuagaguaauuuguuuaguuugcccacugagguuuuuccuuuuaauguucuuuggaagaaacuuagauaauugcuuacuguaagaauuuaaugugucaagagguuuccuaaggaugucuagaacuaccuacuuacuuucuccucuuguaauaucccuggacaguagauguuuauguuaggacaguuuccuauugaacacuugcuaugcuccaggcuguuugccaaacgcuuuuuuuuuuuucuuugagauggaguuuugcucuuguugcccaggcuggggugcaauggcaccaucucggcucaccgcaaccuccgccucccggguucaagugauucuccuggcucagccucccgaguagcugggauuacaggcaugugccaccacgcccggcuaauuuuguauuuuuaguaaagacagaguuucuccauguuggucaggcuggucuugaacucccaaccuuaggugaucugcccgccucggccucccaaagugcugggauuacaggcgugagccacugcucccagccuccaaacaaucuucuuauagcaucucaguuaaugcucuuucaaaaggaguuagguggaauaaaauucugaaguugagccacuugucaaaggcaacaguuaguaagagaugaagcugauguuuucugaaaguguuuggcagaggcuacaaaguuuaaggaggaagaagggaguuuaauggucaaacaaacauggagaaugcugggauauuauuggagguauauuuugaggcuggggagauaagcaggaucuggcagaacacagaucucuaaaaauugugcacccaugcuucaggggaugccauuucuguagacuacaaugugaauagucuguucacucccagcccugcucucagaguuaaaaagcacuggagaaagugaaguaggcuugggcauacuagcaguuuucuauucuggaguuuugcaugcuagcaauuuuuguugaagugugaauucuaagguagaaguggcugaaagaugcuuauuucccauggcaaacugcuuggauuuuaucguguaaaagaggguuugauuacuaaucuuaggguaaaauaaauucaaguauucagagccagaagugacagagcuagacuucauucuaguuauaaguagcuuugaagccauuucuauggcuucauaucacuguuucuaaucuuuugacugcaaaaauaaauuaguauuucacaauuguaaauuauauaauuuagaaaauggacucuguuaugccaguuuugacugcuuagagguucuguucuguguucuagauaggcaaauuugccagacagcuguauuucuuaucagcaaagcauuauuauuauauucuaaauuaaaauacucucauagaaaaagccacuuaaggucauuuauuaauaagagcuaaaaaacuuguuuuuucaguuacacacuguuguacaaaacuguuacauuuaacacagcagcuguuuaugguuucuauagaucucuauuugauaauauacuguuuuuuaaauuuuuaguauuuuuuuuguaacuuuugaauauuuguuaaauguuucuugaauuccuauaugugcuaaacacuguucuaagagcuggggagacaaaaaugaacaaaccagacaaaaauuccuacccucauggagcauaauuuccauggaguauaaguguaauauuauucauaagcuuuuuuuaagagguaugaagaaauaauuugaaaaucuuaucaguuuaauauuuguguagggauuuugauguucuagaagucgucuuuaaacucucuucccuuucuaguuuuucaacacauguccugguaaugaacaacuuaauauagaaaauccuucauuuacaucaaccccuauuugugggcagaaagcucucauuacaacuccucuucauaaggaaacaacucccaaagaucaaaaggaaaauguaggguaaguagguauuaaauaauuguguuagagaaaauggggagcacaguguuaaaguagauuagcuuuuugugcauauaaauagcaaguaucauaauuccuauuccuacaggacuuagaauuuuuuuuguuuuguuuuguuuuguuuguuugagauggaauuuugcucucguugcccaggcuggaaugcaauggugagaucucggcucacugcaaccucugccucccggguucaagugauucuccugccucagccacccgaguagcugggauuacaggcaugugccaccaugccugguuaauauuguguauguaguagagaugggguuucacuauguuggccaggcuggucuuggacuucugaccucaggugaucugcccaucucagccucccaaagugcugggauuauaggugugagccacuguggccggccagaauuuuuuuuuuaaaucauaaccuuauguuuucuccuuaggacagugaaaaccaacugaaauauagugucaaacuuugauuucaaucauuucuaguacuuuuucaaacauuucuaguacuuuuuucuauauuaauucuuuuuuucuauuuuaagaugauugauugaaaucagaauuaccauaggugggcauacuuuaaaauagucuuagaauguuuaaaugaagcauauauauauguguaagaaaauuuagcgugugcuuaaauugcuuugcuuucauuaacuuguaugaaaucagaucgugacuauaacauaaauaucuaaaugacuggauagguuuagaacaccuacuauuagaagaucuauacuggguaccacaccaagaacuccuacuccuuuuaagaaugcgcuugcugcucaggagaaaaaauauggaccucuuaaaauugugguauguauauucauuuuauuuuuaauaauuuuccuaauuuuaauaaaacacaaauuaugauuuuuaucacuuugauuuuuaacauuuaaaaaaagauauuuacugaaacagauacaaagcuuuaucuuuugauuuucaagguuuuuuuuuuguuuuuuuuuugagacggagucuuacuuugucgcccaggcuagagugaaguggcgcgaucucagcucacuguaaccuccacccccuggguucaagugauccucaugccucagccuccuuaguagcugguauuacaggugcccgccaccacacccagcuaauuuuuguauuuuuaguagagaugggguuucaccacauuggccagccuggucuugaacuccugaccucaggugauccaccccccucccccccaccucggccucccaaagugcuaggauuacaagcgugagccaccacaccuggccuaauuuucaaguuugaauuuguguucaccuuuuucuuuaacuuguaaauaaacccuugcuuggcuuguuuugaauucuuaacuuuauagcaucuagagaaaacaucaggugucaguggaacucuuuuccuuuuuccuuuuuuuuuuuuuugagacgcagucuugcucugucaccaggauggagugcaguggcucauucuuggcucacugcaaccuccgccuccuggguucaggugauucucccccagccuccugaguagcuuggacuacaggcuugcgccaccacgcccagcuaauuuuuguauuuuuaguagaaaugggguuucaccauguuggccaggauggucucgaucuccugaccucgugauccacccaccuucggccucccaaagugcugggauuacaggagugagccacugcgcccugucggaacacuuuucuuaauacugaaauauacauuuuaguaguuucagucaugguuacauguauuagaauaaaauaauuuuaauauuuugauauacugaagcacuuucaugauaauauuuaggaaacuaaucaggguaccucuuuaggaaacuaauuaggaaaaggcucaguuuccuuuucuaugcaaaggagaucauaaaacacaccccaaauuguuauugugaagcugaaagagaugauguaauuaaaggggcuugucugaguuucaaguacugugugcuugguugcugcuauuauucuaauaauaguauuugugguaguaguucacgaaugaauaggacugggaaguguucuaguuacugugcuuucauauaucuuaccaccuuugaaauaccuuggaacagugaugggcauuuuaggcagauacagauuucugacaaguucuuuagaaauacgauuuuuaaaauauugguaacuuccaggguuuuuuaguuauguucuucuauuuuuagucacuuuuugguuagauucauuaacaaauucuaguuuacuugauuuaauuaauuuucugcccaaaagcauguuacacacgcacaucuucuagucuuuuuuucaaaauacuguguuaaaggguacguaguaggguugaucaagucuuuuugucauuuagcuccauguacugcugugaacaaucauauuuccuuuagagcuuccuagaguuuuuauuuaugcguauacauuaauaaaacaagaguaugaccacacuuuauuauuuuauaacacuuuuuuaauuuaaccaaguaaauguauauauuuaucccauaauuuuuaacguuugcauaauauuccauuguauggaauuaccugauugauuuaggcuguuucaguguuuugcuguuuauuuuaaaaauucaucauuaauucagcaaauauugauugagugccuaauagguuccaggcacuguacuaggcuuuagggauggaaagaauguugaaaaggucaaguaugguuccugccuucauagggucauguagacuaauuggggauuagacaaguaaacaaugauuugaaagcauuuaaaaauucugcagugagucagggucauuuggugaacauauaaguggaauaaaaauuauaauuugauagcugggugugguaguaugcucuuguaguaguccuaggagguuuguuugagccugggaaguggaggcuacagugaguggugaugaagccacugcacuccagccuaaaggacagagugcagcucuguuugaaaaaaaaaaaaaaagacaaaaacaaaaguauauuuguaauagguuucaaauaccuaaaguccuuguccauuuguuuacuagccuucugacauuuuaaauuuaauaccagcagcacucacagcucuuuggauagaauuugaccauugccaaaauagauuauuugcaucagcaauuuaagauaaaaggaaggcaaugauuuauaaauuaaaauuccuagaauaucuauaggcucauacaucucuuugcaguaagcugacuuuucauuucuccugcuccuccuccaguuauuuacugagcaucuacuauaugcuaaccacuuagcuuucuuuuguaucuuacuaugagucaaaugcacuucuuggagauuggcuuuggaauuuuaaucagguauaucuuaaauaucuguugcccuuuuaauaaaccgauucuuuuaauauuuacuauaaauuacucaaaaggcuaaaaacuguagaaauauuaaguuugguaguaucaaaccugaaaaguauuaaaugcaggaguucuuugcuuuugacacauuagaacaauuaagagaauaauucuugcuagugaaugaauuaaucugucuuagcccuauucuaggacauuuguauucuuaaagggagaaaaaccuccagaucuuuuuaagaauacuagacuagaucaagaaaaugugggcuggaugcaguggcucauaccuguaauuccagcacuuugggagaucaagacaggcagaucauuugagcucaggaauucaagaccagccugggcaacauggugaaaccccaucucuacugaaaauacaaaaaaugaacugggcaugguggugugcaccuguggcucuagcuacuugggagacugaagugggaggaucgcuugacccugggagguagagguugcagugagcugauauuauaccacugcacucuagccugggugacagagugagaccccaccucaaaaaaaauuaaggaaaaaaaaaaaaaagaaaaugcgguacguaugcaccauagaauacuaugcagccauaaaaaagaaugaggucauguccuuugcaaggacauggauagagcuggaagccauuauccucagcaaaccaacacagaaacagaaaaccaaauacugcauguucucauuuauaaaugggagcuaaaugaugggaacauguggacguauagagaggaacagcacacacuggggccuuucagagaguggaaggugggaagagagaggaucaggaaaaauaacuaauggguacuaggcuuaauacuugggugaugaaauaaucuuuuuucuuuuuuugagauggaguuucacccuuguugcccaggcuagaguguaguggcgcgaucucggcucacugcaaccucugccuucuaguuucaagcgauucuccugccucagcuucccaaguagcugggauuacaggugcccaccaccacccuggcuaauuuuuguauuuuuaguagagacgggguuucaccauguuagccaggauggucuugaacuccugaccucgugaucugcccgccucggucucccaaagugcugggauuacaggcaugagccacugcgcccggcugggugaugaaauaaccuauacaacaaccccccauguuuacuuauguaacaaacaugcacuuggaccccugaacuuaaaaguuaauuugaaaaaagaauacuuuauguucuuggugaaauaccaucauuaaaaagcucuuugagaccgggggugguggcucacaccugugaucccagcacuuugggaggcugaggugggcaaaucaccuccugaggucaggaguuugagaccagcuuggccaacauggugaaaccccgucucuaguaaaaauacaaaaaauuagccaggcguuguggcagguugugcuagcuacucgguugaucccagcuacucgggaggcugaggcaggagaaucgguugaaccagaggguggggguuguggagguugcagugaacugagauuaugcuacuacacuccagccugggugacagagcaagauuccaucucaauaaauaaauaaguaaauaauaauaauaagcucuuugagaaguauacggaaacacuaacauaauuccuguaugucucagucuagaugagaauacuuuuaacauuuguuuucaucuuaaaaguuuuuguaagugcugugaaaucucauuuauauaugaauaccauucucucuaacuuugcuggcuggggacauaagcugcugguguuuuuuuguuuuuuguuuuguuguuguuguuuuuuuuuuuuuuuugagacggagucuggcucuguugcccaggcuggaguccaguggcgugauuucggcucacugcaacuucugccuccuggguucaagcaauucucaugccucagccucccggggugcacaccaccacccccggcuaauuuuuguguuuuuaguagagaugggguuucaccauguuggccaggaugaucaugaucucuugacuucaugauccacccgccucagccucccaaagugggauuacaggcaugagccaccaugcccagcagcugcugguuauuaagugcugccaguucuuuuauuuaguagagguuuuauuaccuuuucaaguauaucuugguuaugaaagguauaaguuagauauaauuuuuaaauuuuuucuggguuauaaguugugcuuaccuauuugacagaaagcuagaugaauaauauuuugagacuauuucaucacucagcugacacucaagugucuaucucucuguaaccuacccucccacacuacacacacacacacacacacacacacucacucucucugucuucuuggauacugugucagcucuuugcuuaggcuagguauacaaagaugaaaaugaccugaccauugcucucaaguaucucacaaucuuggugguaacaaacguguuaacuaguaauuacauacuauguaauaaguacaauaaaaguagaauaagagcuaguguauucccaauauguucuauauuuccuguuuuuauguaaaaaaaacuugagaaauaacaucuuucuuuucuguuuaauucugaagauccugaccugaagcaggagcuacagugguuuccccaaaaggaagauuuuuguuuaguagccuagaaagaagaaauugcuauucuuuacucaguacuugcaaauguauaauauuguuuugccacaacaugaauuaauuuaauuaauguaucuauaggggcuaggagaaaauuaugacaauaauggacaaguauaaaagauggguuuccuauauauagggagaaaaaggaauugcuauaaaugacuuuuuacaacauuuuaaaaaacaauuuagucccagccacuugcuuucuuggaagaagauauucgggaaguuuuaaaagaagaaacuggaacagaccuauuccucaaagaggaagaugaaccugcuuacaaaagcugcaaacaagagguaaucuucuaguauuauuguuaauaaaagucuuauuguauccaagagacuuugccauaaagcuucuacauaaauuacucauucuagaauaccgcuucugggaagaaagucagaaaaucacuagucuuagauaauugggaaaaagaagaaucaggcacucaacuguugacugaagacauuucagacaugcagguuuguaaaggauuauuauuguuguuauuuuaaaugguugcuuuaaguccuagagguucuuauuucuuacucauuguguagccaguucauuagaaauucauggagaauuuuuaucuuaguaucauuuugccuaauucacagagaaacuauucacuguagagaauauuuuauuuacuuuuuuuuauauuucuuuuguuaugagaggaguuagcugccuuauaucugaugucaaaaaaucguaguucucaagauuuuaaauaucaaaguuuaucuuugguucauuuccaaaauaauauuacuacauuacuagaaauuucaucagagccaaaugcuuucuuggagggaaauaaacagggcuuccauuaccacuuacucaguagucccuccauuugucuccauuuuugaauuaguuauuuuccucuuucuuuuuucucucuuagucagaaaauagauuuacuacauccuuauuaaugauaccauuauuggaaauacaugacaauaggugcaacuugauuccugaaaaacaagauauaaauucaaccaacaaaacauauacacuuacuaaaaagaaaccaaacccuaacacuuccaaaguugucaaauuggaaaagaaucuucagguauggauuuauaaauuucuuuagugauuuuuguuuuuguuuagucaaugaucacuuuggauuuacugaucacaaauuauacuuuuucuuuuaaauucaaaauugauuguaacaguaacuaaacauuuaccauuauuuuaucacucacauuuggguuugagcgacucauucaucagggcacauauaaacuaaacaauugaagcuguaaccaaagacuggucuggugauuuccuaagcacuguaucuuuuuuaaacuaaagauauauaaaucuacuucuggcaccucuucuccuguaacaaauauguauagcccuaauugcuauucugaaaaaggguaagugguuggaagcaguuucagcaugauuuuguugguaccaugguuuccagugaacuuuuuggcucagaaguuguaaaacaaaguccuuuuuuuuuucuguugggauacgaccaguguguaacugcaaaugaagguuggaaaaauuuuuacugcauuaagaguuuaccccagagaauuugagaguucauugaguaggaaauuuucuucuuuaugccacagugacugcagcacuaguauuccugauauugaagcauaccuugaaaacgucuuuggcaauuacauaugaccaccuuacaucuguuuucagccacugcuuucuaagagccauguagcacauucucuuaauccauguaaaaugauuugaguuccuggcguuuaauuaacauagaacuuuuggggaaaguuauuauauagaagaucacaucuauaacauaguaaucuuuaaaauaagggaaggaaaaaaacauaagcuugauuuuuuguuaugaauauauuuccuaauuuguaaauaaagcauucuuggcucauuuuuugacauuacauccucucuuuaaaucuuuugcaaaauuuugaagcaauaaagacuaacauuuauuuccauguuaagacucauuugauuuggggggaauuauuggggacaagacuuuuaaacugccuccauaggccuguaagcaauauagauagcuaaaauaauugacuuuuuaaaaacuugauaaaaaauauuucaguauauauuuuaaaacauuauuauuaaaaaaauacagugccauuguuaaaacauuuuuauaauuauuguuuauaaaauaucuaaucaguuaaaauaacugacuuuaagagucuaauugugauauagauagcuauuuuaauaauuuucaugucacuauuaauauuuccuuucuagucaaauugugaaugggaaacagugguuuaugggaagacagaagaccaacuuauuaugacugaacaagcaagaagauaucugaguacuuacacagcuaccaguaguacuucaagagcucucauacuguaauuguuauuaaaauugaugaaaugccccacucccuuacugcagucucuacuaaauuagguugcagugaaauuuuucucaauuaguuguuuuuaaaguuguaagauagcccuuuuaauacagcaucuuuuuucuauucuauauaguaggcagaaagcuaguaagucacuuaagggguagauaguuucauaguuuauuuuuuaagagaugagauuuuuaaaaauuguuuuuaaagaacaagaugggaaaauaauagaauguucauggauuucuaaaaguaaauucucauauauuuucuucacaagauauauguugcuacucucuugaugcugcaguuuuguuauagauagguguaugaguauauaugauuucugaaauuagucuauguauggaaagcacacaugauuuuaugaaguacuuuugcccaugugcugauuuacuuaggcuaccauuuacaaagaaacacauugaaaaggaauuuaaaggaaggauagaaaguugcacuacuaauuuuuuguuuuuuuuuucagaagcaguaaaauuaacuacaguguuaaauguauuuauuugagcauaguacugaaaacaaaaagcauucaaaaaagaguuuuuucuuuauuaguaaauaguauuuucuuaaucucagaggagcugagaguuuuguugaauguauuguacaguauguaggagcaggagaacuuuguaaauuggaaagaagucuguuuuuauaauuuauuuuuauuuuuaaagcuuaaauguagauauuuauacguauacagggugccuagaagccaauguuguuuccuguuauuacagcuaacacaguaaagaauaauuuugacuuuaaguaugaaacaguaguaaguuauagcugcaaagaauacaauaucuauacuguaugucacaucuaccuaaauguugcacuaugcccuuuaaaucaugcugguuauaaaguaguucuaaaaauguacuaaauaauaauuuaauauuuucuuuuuaaauuauaucggggguggucauauacauuaaucuggugauuuguauauguguuugaaauuuuugcauuuuguuuaaaaaauaauaugguaccuuggucccuaaaaacagucugcacuuagaaguuuauauuuacucaguguuucagaaguggagaacauuaucuuuuauuuauaaaaa

SEQ ID NO: 12646 - RNA, 645 nt, Homo sapiens
caugguggacaugauggaguugcccagguugcgcaucaacgcuggcacgcuagcucaguucaucgauaagccugucugcuucguagggaggcuggaaaagauucaucccacuggaaaaauguuuguucuuuuagauggagaaggaaaaaauggaaccaucaaacugauggaaccccuugaugaagaaaucucuggaauuauggaagugguuggaagaguaaccgcuaaggccaccaucauguguaaacuuauguccaguuuaaagagguaaccauccuuuugaucuuggacuuuacaaugaagcugugaaaauuauccaugaguuuccucaguuuuauccuuuagggauugugcaucauaauugaucuugauggauuuucauaugauugcaaaugagcuauauuaaagacuauuaaaggaagccccucuuguuugagggagagauuucugugcuuucucauauuuaauuugcucuuuuuaagguauuccagccuagaguuuuugauggaacugauauauugacaggucucaccuaaguccuuuuauaaagaauugcuacuccaauuuauggucagauuauaugcaagaacaaagcaguugucugaguuuagguuucuauuuuauuaauaaaaacuaaaaugguaa

SEQ ID NO: 12647 - RNA, 35019 nt, Homo sapiens
uguuuuuuuuuuucccccgggcggcccggcggcugcguacuggcugugggaugggaagugaagccccagcgagcggcugcagcggggccgugaggagcagccagcgggaggcggcggcgagucggugagcagcugggaagagcagaaccggggcggagcaccugcaggcgcgggcggcggccccaccauggcgauucgcaagaaaagcaccaagagccccccagugcugagccacgaauucguccugcagaaucacgcggacaucgucuccuguguggcgauggucuuccugcuggggcucauguuugaggugagcccgccccgagucccaaccgccugccccgccaccuccagcccgggcccgggcuccagaugccagccccggcuucuccgcccaggacgcggggggcucgggcccggggugggugcagacccccagucccugaggugcaggccuucccugcccugccccacgucggcggcagcuccccggcggccggcccggagaugcaaagucccggugggccucaucgcggcccgcaggggguggggaccgccgcgucgcccccuuccugacccgccgccgcccccucccgcaggcugcgcggcgcaguuccugguucccgcgaaggguuacguggcagccggcgaggggccugcgggcgggggcggccccugcgcugccgagcuggcucggggcgggugggcggacuuggggggacugccagccucggccgcggugagcgucagccccgcgagggccggggaaggccgaggcccggcccccgggucugaggagugccggccuggagaccacaggccccgagugacaggggagcccccgguagcuccgagauuggggugagcgagaaaccggagucaggcaucugcuuucgacuugaagggcgguggccgccgggcaccggcgcaguggaggcgcgccagauuguuuucauuuuugucuuuuaaacugauauuauuaccaguuaacgaacuuuuugcccugacgcuuuaaagaaacaaggucugauggauaaaucgagguucugaacagcggugccaaggaaucgaguaauuuuguuucuugaaguaggagaggaugggaaugucaggaguguguaaauucucuucccacguaucuaguauuuugaugacuuauuuaacagcuguugaauguggaugauaaacuuugcaaggugaacgaguaacauccuacguuuuuccccucgcuccccaauacacacgcucauuccuuugcuuuuuucccuuuuuaauuuuucucuggagccuuuaugucucaguaaauauacaaauuauuuugcuccugccuuguuuugucuccucucuccugcauguaacaagugagaguagagauuuuggaguauuuuuacgagucuguauuuccagagucuaggauagugccugggacauaggagugcuuaaaaaaagaugagcgacguuaagaauccuugagaaaaccuaauggaaugauauuaccagugaccaaaaggugaauacauuuucuuuuuaauggagcauauuuguuuuuuuuuuuaauuuuaaaauuaaauaauauuuuaaccuuauuuucgccucucaucaaaugggcuuuucuggaucuagauacagauauuauuuacuccugauugugucaugcauguuugaaaccacugcuaaggagguagcagguauaguuaaaggguagguagaaggaaacuaacauucucaagcuuuaagucugggcugugccaccuaccuacugggugacccaagucugagccucaauuuuucugcucuuuaucaggaaauaauaucaccuguacuguucuccucacagccauuuuuugcaaguaucagaugauauggugugaagguaaauacagugcuaggccuggugcucuggcuuaugccuguaaacaucccaacacuuugggaggccaaggcaggagaaucacuggagcccaggaguucgagaccagccuaggcaacauagggagacccugucucuacaaaugauuuuuuaaaaauuagccaggagugauagauagcacgcaccuguggucucagcugggcggcugaggugggauaauuacuugagcccaggagguggaggcugcggugagccaagguuucaccacugcacuccagccugaaggacagagcaagaagacccugucucaaaaaaaacccaauguuaaacauuuguauucacuuucugaauuugauacuugcauguacuuucugcuuugaccuuaaaguaguacuuuaauauauguaguauauucaauuuucuguaacuugucauaaaccaucuccacaugguaagaauuccugacuuuaaaaacauauuuuagggguacugugaccugcaagguauauuugcagugcuuugaaugaaaugaaauauaaaucagaaauucugacacauaguauaacuuugauuuuauauaaacuauuuuacauucucuuacuauauuucuagggaaguccaccaccuauaccuugccucacauguuagugauuuuuuuaaacaguggauuuucaccuuuauauaaauuuauaaaauuugaaaaucuaaauagacaaaaauacuaaauagagguuuuuaagucaauucaaaagugaguguuaaagugauacacaaaagugaaguuugugcgaguucuuccuuuuucuuaccauauauuaagguguuaggauuucaaagcauguuaucuauauauaggacuuuguagacuagguuaguuuugcuauucgacuuuuaaaacaauugcugcugaaucucaaaguuaacauaauuauagaauuacaguacuugugcuagaauaauagagaaauugauuuuuuuuugcagaacuguuaagccuguugugcagauacauugaggaaaugucagaggauuuauggugacauugacaaagaaauucagaaagaaagaaauacuguauuacuagccaaaaugaagaagcaauggagauacacuguaaaagcauggauucuggagcugaagggauucauguucaaguuagggcucugcagcuugcuaacugggugaccuagggcagcucagaacugaaguuuccucaucuguaaaauggggcuuauuggguuacucugacaaauuaaccaauuuguauuaugccuaguucaauacuugacuuccaaaaggugugcaauaagugguagcuauuauuauucuuuaaaaacucaccaaaauugggaaauagaaagcauuuuuaugugagagaagggccuggaaucucuuuaguuagcaucuaaagagauuauacauacugaaaaggcuaacaaaguagucuguuuggcaguaauguaagaguuuaauuuccagggaacuucacauuaaucaaaaauugcuuguaaauuuuggaaucauaguuuuauuacaguaaauaucuguccacauaauucaaaucauaguauacaaugaauggcuucauauuugaguuaggaaaaauugaauggucaaaaaauguuagggaugcuugggaagcuuucugaaagugaguauguggaggaggggugaagaauuagggguucacaagagaaguauuucuuuuaaggaguguauaaaggaaagauauucaaaaggaaauauauucaaaaggaaagauauucaaaaucugcaaguucuuuaugccauacagauuuuggggacguuuacaauuucaacaaucuugaaacaguuuucaagguuuggguuuuuuuuuucuuuccuuuuuuucuuucuuuuuaugacagguaaggugcucaggucagaacaaaguuugagggagagacacaucucacauauaagcgugaaaccccaaucaucacacuugugaacuacaaaagggucucucuuuuuuuugagacagggucuugcuauguugccuuggcuggaacuugaccuccugggcucaagugauccuccccucucgccaccugaguggcugggacuacaggcacgugccacugagccccacuggaaguggaauuugauauucagaauugucuuuacuuuucaaggauccaguccauguagugacuggucacaucuuccucuaaaacaagugcaaaguaguuaacaucucuauauaacaagaaagauaccaagccccaaccggugacauuuaauuaaagaaauguuguauuuaugacauugcauacagcauagaauuagguaauucauuacaguuucugguaaccuauuuaagaugcaucugaauaagucucuuuuuucauuuuuccauuuuuguaaauggagagcagcucuguaaauguucaaacugucauaaacucagguauuuuuacuuucgagugcauuauauauuucuguagccuauuuauauucuaaacuaacuuaucuuacuacuaauuaauuguggugugaguuuaacugcagcaaugcuagcagggugugaggcuuaggaggccuggaaauggcuaggagcaagacugcuagcuuaaacuugaaacuuuuuggaguguguaguuuacauuuuuccucuucuucuucuauuuaaacucacaugcuaaaccagcuggaggucaaauuuuaauuuuauuuggaagccuggcuaaaaggauaaucuaauuuuugcugcuuuuagaauuugaugcuaaauuuaucuuugaagaaucucauuuguuguuuguaaaggacucuuuuugagauggagccucacucugucacccaggcuagagugcaauggcgugaucucagcucgcugcacccuccgccuccuggguucaagugauucuccugccucagcauccugaguagcugggauuacaggcucccgccacgaugcccagcuaauuuuuguauuuuuaauagagaugagguuucaccauguuggccaggcuggucuugaacuccugaccucaggugagccagccaccuuggccucccaaagugcugggauuacaggugugagccaucacaccuggccuguaaaggacucuuuaacaaaguguucuuaggugugacaguggugacuucauauuacaaacuggaaacagggauguggaguguuuguguguaaaacagauuguguguguguguguguguguguguguguguauaaaacauauauauaguguguauauauagauauauauuguuuagacuauauauauauauaaaaaaucuaaacaaagauagcaaaacuaaaugaaauguagugaccacucaacuuuacuaaaaauaaucacaugaaaguaguguugcccuggagacucaugucaucguucugcucuaaugaguccuuguuaaugacccaaauuuuaauagaguagccuuaguagccuuuucuacucaagagaccuucauaucuaacccaguucggcaacucacuuuacuggccguauccugcaguuugucaugcaagccugacuucuuccacuuccugaauucuaggauaacagaguucagcuacaaccuacguuuuguucaccucccucauucuaguacucauaagucagugcucuaccuaguccaagcuuuugugguaccacggcccccuuucccuuucuccaguauauuagcccccucauuguuuugccuuucuuccugcaaucuuuacuccacuauuggccuuuucggugccucucaauucccagagaaagucauacucaugcuaguagauaauauugcaaaucaaagguuucuaaccucagacauucgcauccgguaucuuuuuacuuucccuggccaucuccuuucccuaugggaacuauauaaauagucaccauucauguccccauuaugcuuaauaugugacauugcuuuuuucucacacagggaaaauaaaaguuuaucaagcacggauuuccucauuuuccugucuuuugaaguuaugugucccauccauuacugccuucuucccaucuaagaggaaaaguuguucaagagugcaauacucaguccuuacaauuuuguucccugucauaugccuccauccguuauucucuuucuauccuguguguuuaacuucucccuuuucccuguugccuucacuguugcccccacacaagcucaaucucuccuauccugaaaacaacauaaaauuugaccuggcaucuacuggauaccaccuugugccucuguguucuucaguccacugcaaugcagcuccugcucucacuacuuaguuggaaucacucaagcugugaccacugaugacuucuuaaauuguccagucuaucguucucuuuccucccacaucucuuuugaaacuuuugacuuuauuaaccacaccuuuuagaaauguuuccccuuuggcuuuugggacuacaagcucuuuuuauuucuuucucugucucucuaaccauuuuuucuuaguuucagugacuugaaguuuugcuuuuuucccuguucucuccaugggucugauguuguccuacuucucuacaaauacugugcacucuccauauaugauuuauguauuuucacagcuucagcuauuaucuguagaaagagacucccaaaucuuuauuuaagcuagguucucccuacugaguucuagacuuagguuuuagcugccuuacugcucaucucccagaaaucucagcuguaggcaucaauaaauaaccuuguacucuuucuucuagcuuaccaaaccuuauuuugccuuaugagugccuccuguaucccacagucacugucuuaguucaggucucauuaucuuucauguggucucuugcagaaguuucauucuuggcugcaugcucacuccgguuuguacuuuuaacugauauuuauucagcgauauugauuaauuaccuaauauguaccaggccccaugcugggcucugaaauauagugaugaguggaaacaggcaugaucccaguucuaauggagcuuacuuucuaaugggcgagacagaaauuauuaauauaaucaaccagaguaugccuuugaaggaaaggaacacaguucucugagauaaucuaacaaaggaaaugaccuacucuaggaagacagggagacuuccuugaaaagguguaaugcaacugagaucugaugggaaauauuuuccgaccguauuuuagauagaacagcaugugcagagacccugugguagaaggugcugcagaggcagagagaggagucagaccauagaguccuauggucacauucuccuagaaagaugggaaucuagugaaggauuuuuagcagguagggagggggaugugguaacaugaugagaaaaucauucuaguugcaauauggagaauggaucugaaggggccugggauaccacuuagcaggucacagagagcaauccuucuaaaaggcauaaaugaacuuucccguccucaacauucuccacuugugcgaaagugaaaucuaaacuacuuagcucaaaaaacagaguccuuucuagcacucaauaauguuucuagucuuuucuaacgcuuccugaugugcauccugugccuggccuuguguucacugcuacuugaucuugccacgcucuguuucuucuaucuguacuguccucuucaucccccuuugugaaccuagggaacaccuauuuuccagcaaaacacagcuccuucauuucauuccaccccagaaaaaaaaccaacaaagcucauuguuuaucccaaguacccacagugcaagcuauuggcacuuauucuacaguauuauaacaguuuauuuaccuguacuuuucacaccacggagcuccuugucauuagggauuauuuuauccaucuucaucucguccuuuuuugucuagcacuuugccuggugccuguaaagauuggguaagcauuccauuuuucugcucugaccaguuuacuuuuaccaguagucaggucaguuaaacaguuauugaccacuuaacucugcugggugugugggauacuaacacacccacaccacagacccuauauuugaucugcuuuucucaugcuaacugugcuucucuuuauuuuauuaauuuacacuugaaauuugucuuaauaggaacuuuuuauucauuguauagggcuagaguagagaaucaucauuugucaaauaacuguuuucuggaacugcagaaaaugucuuuugaaaucuuaaaauuaaggaugaauuacacaauuuuaccuaaaccgcagaagaguacucuagugaauuacauuagcuccuuggcaaucaguaauuuccauugugucugucaggauuccacaggaacgaggaggcccuuggugcuucgauuuagggacagauuuuauaauguuuuugccccgaucuguuauuugggagagggucacaaauugacuugaucuuuguuuuuccuucuuuguagauaacggcaaaagcuucuaucauuuuuguuacucuucaguacaaugucacccucccagcaacagguagguaauuuacgcuaagaauuuucuacguaaauagaaguucaguugaacaaacuuggaaauuuucaugaaugcuagguccugcguuaauuaaucgucagagaucucauccaugaugugacugaauguuauugugaugauuuuauaauacaagaucugauguuuuugauugacuuuacccuguauauguuuucuguuuacuauauauuuuugugaauggacuugaaauuccauaaaauaauuuuguuuugcuuucucugcuuucugauuuuuuccuaagaaaauuauaagaaaagaucuuuuuaaaauuguuuaaaugucauuguucauucaagacuucuaaaagcacaauggcagauuuaguuuuucuguaaguuacauuuuggaccuguaauagcaaucaauccuucuaagauuauuuucacuuuuuccugugcucuacuuuuaacaauuauuuugauuccagaaaauguguuaguaagcucuaggaauuaucugguaauagcauccaaacuauuagguuuuauuucaaaaaucuuauuucuuaaucuauguaaaaauuagguguuucuuggaaguugauuguaauuuaauacagugauauaauuaacuagcaugggugagggaugggguauuuuuugguugaggcaguaaaccugcacaguuuuuuauuuagaauguaagauaauauaguauaccacauuuaguugggguuuuuuguuguuguugcuguuauuuauauguguguuuuuaagagaugacagggucuugccaaauguguuaccuaggcaggagugcuguggcgugaucguagcucacugcagccuccagcuucugggcucaaaugauccucccaggucagccucccaaguaggugggacuacaagggcacaccaccacgcccagcuaauuuuucaauuuacuauagagauggagucucacuauacuaccuaggucagucuugaauuugggccucaagcaauccuugccucccuaaguguugggauuacaggggugagccacugcaucuagccccugaguuggguuuuuguucaguuauguacaguuuuguaaauauuuaauuuagugauuuaguuaucagguuacucaaaacuacaauacuguuuugaaauuugaauaugccagagaagaauaaagcucuuuuauguauauguuccccauaaacauaaaguuugagaauaagugucagcaauucacaaguauuugauaaagauuuguuuugaaaaauuauagcaauugcaaggauuaaaaacaacuuuaguaguugccuuuaucucugcugcuuauagaucaaaacuaaaucaaauacaggucaaaucagcuuuuucaucagaaucauaauuuaguguguaguuagaaaguagaaguagaaaguuucaaaagcccuuugaaaaaaauaggucaguaggcuaaguauaacuuuaucaaccuaauuuauaccccugggauaauaucaguuuauugaguguggccuccucuucccuguuuuuuggucuuugguggcugugacuaacaugugucaagucuuuguaaguaauuucuaaagcuuuagauuucuagauaguuuugauuuucauugccccucuaagacucaagauguccaagaccacguuauuuaugauguuaauauagaacuuuuuuauuagguuauucuucuuuguuuccauaacuauguuguacuuaaugcuguuuuuauaaccuuguguauauuuuuguguauuuguguccuuuuuggucuucagaagaacaagcuacugaaucagugucccuuuauuacuauggcaucaaagauuuggcuacuguuuucuucuacaugcuaguggcgauaauuauucaugccguaauucaagaguauauguuggauguaaguaugcagucuuagaaaucuauacuuuauaaaguacuagcucuccauaaucugcuagucauauauuaaauauaauuuauaauuuauucuuaauuacuaauggcuguuuuuauuuuuagaaaauuaacaggcgaaugcacuucuccaaaacaaaacacagcaaguuuaaugaaucuggucagcuuagugcguucuaccuuuuugccuguguuuggggcacauucauucucaucucuguaaguauguccucuuagguuguuguucuccuuccuuaucuaagauuagaaacucugcuaaugaaauaguauuaaguuaagaguuucagugauaaaucuguuuuagguauuuuuuuauacagcaaaaauucuaaacuauguuuacuguuucagaaaggcuuauucauuuuuagucacucugaauguuacuuuuauaucuuucuuuuuuuuuuuuuuuuuuuuuuuugagacagagucucgcucugucuccaggcuggagugcaguggcaugaucucggcucacugcaaccuccgccucccggguucaagcgauucuccugccucagcuucccaaguagcugggacuacagacgcacgccaccacgcccagcuaauuuuuguauuuuuaguagaaacaagguuucaccauguuggccaggauggucucgaacuccugaccucgugauccacccgccucggccucccaaagugcugggauuacaggcuugagccaccaagcccggccuuacuuuuguaucuuauagugguuuacagauaccucuguaucagcaaaaagcguagguuacaugaguuguaauguucacagucauuuccuccuuuaaaaacagccccaguguuuuccaagcuucuuaaauguuguauaacuuuucaguuauggcaaucaaaaccuuuaguuguaucacucuaacuaaugagaaaaagaaaggcaguauuugcuuuaauauuagugauaacaaucccuuaaauuuauaugguguuccauaguuuacauacuuuugaguuugucagacacauaauucuuucuaaucacuguauuagagaugaauaacagugaguuuuccaggguaaagcacuucauguuggaaguagacuaaaacucagcuuuuuauuccauugcucauuccauuuuacugugcugcuuuaauaauacuuuauagguaauauguaaauuuuaguuuaaaaacuauuauacauuuuuuuaaaaaaacauaaaaguuauacuucugugggaaaauacucuuacaaaaaucacuuuagauuuuauuuauuuuuuaaucuuuuuuuuuuuuuuuuuacauaugcaguaauucucacugaguagaucugauuaucuaagaaaaaaauuggggcaguauuuuauugacguaauuccauaaaacucgguagcacccugauccuuugucuccugucagaugcuacaaacuuuuccugaaaucuucugauuaccuaagacaaaauucuucucuccuggucacuguugugccucuuauuggugguuuuauguuuguuuguguacguguauuuuuauucuaugggauugaaagauuuuuuagggccaggaauuaugucuuaccugauuccauaucucauuucuaucauugauuuucauuuugcucaaguaaccaacucaaauuggcuugaaaauaacuaaaacaacuaaggauuuugacauuaguggguucuuugcaaccugguaugggaccuguaaauguuugagaaaugaaaguaaugccuuauuuuccaagaaguuugcauuaugcucacagguuaauuuuuauaucuucuuucuuaggaaaacuacaucucagacccaacuaucuuauggagggcuuauccccauaaccugaugacguaagucauuuuuagcagcccuuucuuuguuaaggaccauggucaugucacuauuaaucagaauucauucuuguuauucucuuuaggaccuuaggcaaaugcauaaaauagaugaaaauaugucuuugacagucccacugccguaagaaaaaaaaagcuguguaccuuuuuuuaauguuucuauucuaaucuuuucaacaucuuuguaagcuugagacaacugauuuuaacauaacuuaauuugguacucgcuucuuuucccuucuuuucacucauacuuucuccuuuuuaugacuccaucuucucuauauuuuugcuccuuuucuuuguccccacccccugucucuuuucacaucuuccuuucuuucuccuauuauaagcuucuugagguuaggaauuguuucuuuuuuauuucucuagucuguacagugcugcuggguuaaagugcucagugguuaccaagacgucugaauaauucauuauucgagcccagcucuaguacaacuauucuauauuaauuuuccuugcuauuuuagccuguauuggucuuuuguauccccaaauuugucauuuugguagaaauuugauguagugucuauauauuguuuugauuguucuauaauugucucauuuuuguaagucuuguauugugcccauacccacuaagacuauaugugccuugguagcgguaaaaacuauuuuauauccuucauugugccagguacauugcaagugcuugucaccuacacaguauuuaguaaauacauugugaugugagaauuggagaagggagaagauacgaaggaaagaagggaauaaccugacuguggguauuuuaagucuagcaguaauacccacucuacugaaucauacucugauuucuaaaguuuuauuaguucaacgaacuuuguaaauauuauauuuaugugggacuguauucucuccaccccgaccaccaagaaauuagguuggcuuuguguuuucuauuuuagacuucuggaggagaaggagcagggagaauaaagaggaagcagaagggcuagagggauauaaugucaagaggagaguauugguucuagacugauuaugauauagcuccuggagagcccuugugugccuuauucugacugucuuuaauccuagcucugccuccauuuauuuggggcuuucuccauguuccaaccagguacaguuaccauauuugccuaagaaaaaaaaaaaaaacagaggauauuugaaauugggauuauuccaguuucaggugauuauuaaucuaugagccuuugcuuuugugucagucuuuuuccccuucuugucuugaugaaacuguauagacauguggguuauguuuucaguagcuaacaugacauacuagucaguauuaaugaacuaauaggggcucugacuccucccaacuggcuuacaugucaauagcuuucugcagauaguaucuuugccugcuguuuaauccaggggucuuguccaauggugggacugucacagggagauggggaaagagguuguugaagaguuguuuaaaggugcacagauauuguauggaaugaugacacaaagguaguuacuuaguauauccugauuuccaguauuuguuuacuuuuuuuuaaaaaaauuaugcuuuaaaagguacucuucauuuucuuguguuguacagauuucaaaugaaguuuuucuacauaucacagcuggcuuacuggcuucaugcuuuuccugaacucuacuuccagaaaaccaaaaaaguaagcugggauuuuguaguguuaaaaaaugucuugucauuuuuuuuuuugaaaaauuuuucuaaaauuaaguauuuucuuacauguuugcccuuccuccauucuucuuaccucaacucuuaccccaucauucucccaccaacccucuuuccacaaagccuaaaauccuuaagcauuucuugaaaaaaaaaaaaaaaaaaccuucagucaguauuuuagcuuagauuuuuuacauuugauauguuaauggcuugucuuaaaauuauguuagugguaauguaaauuaaaauuuaaacuaauuuuuaaauguaauauuuguuuuaucuuacugauauucuuagcaaauuauuucacaagugagccaaaaaggauuagucacauuacaacuaacaguucuguguguaaguccuaaagcaaaauucaguauuggaaaaaaaaguaaaauauauuuaaauauucaccagcaaagccucucuugaaauggguagagcauucccuuuuuagcauguggaaaggauauuuguuuguuuuauuugaacaaauaaguaaacugcuggagcacugcaaaauccuccuuccuaguuuuacccucagugcuucugaagucggguuccaugcuaucacaaaagucguuuucuuuacccucucccuucugaaaccuguauuggcucccuauuacuuuaaacuagaguaaugcugcucaacugugcccugagaguuucucccaucgccaccaucuuuucucggggaccucuuucucugcuuacuccuuaugcuucaugcacacugauagucucuaguuuuguaaucccagcacaucacuucuuuuuccuggaacaccucuucccucggauaaauuaaucaaguacuuucauuucccuuuuuucugggaguuuuuuuuuuuuuuuuaauucucauauaugaaauccuaugugggauuuuacuucaaaauaauaccaggugaaggaaagugaagagggauauagaugaaacaaguuugaucguuuauuaauaaugauugaguuacggguaugucagaaucuuuucugucuguuguguauauguuuacauuuuuccgcauuuaaaauuucuuuuuuuuuuuuuuaauccccuuugagaaaccuggagugaaagugugacagccagucuggugacuaguuuaucuuugccuacucaaaagccauaaaacacuauuuuuaugugugcuacaaauaguuaauucauggacuaggcacuugauuuccuacuguuucgugucuguguucuguguaucugucguuacucauguugucugcuaggauuagaaaacagcaccaaauuaaaggccauaugcuaugguacuuaaguucuuuuuaugcugauuucuuuuauaaaguagauuguuucuccagcuauauugauaaggaauaggaugaagaccuuuuauuuuuaaacccuugauuuagaacugucuucagauaaaauuguuaggcccagauuccaguagcccuuccauguuuaguaagcuccuaaugugaaucauagauauuguggagcuguacuguccaaaaugcuaacuacuagucacaucuacaugaacuuaaaaaacaaaaacgaaauugacuuuuuuagccccaguagccacauuucaagugcuuauuagcuacuguggcuaguauguaccauuuugaacagaggagauauggaacauuuccaugauugcagaaaguucuauuggacagcgcuacugagaguaucauaguuucuugaugucuuaguagcauggcucagauauuuaaagccuucuuaagguauuuguauacucaugaacaaauaccucuggauuucauuauuaauccaugucuauaucuucuucauugacuaugguaaguaagaagggacauuucaaaguaauuguucauuuuaguuccugaagcucuuuucuuaucaguuccugccagauggcacuucuccagaaaugcagucuaauuuuuauggaauaauuugcauaacucagaacuuaacugaaacuauuuuuaacaccugcauaugacaguugaaaguaacuguuucaaguaauuaacauaauuugaaaguagcagcugcauauguguuaaacaguuucuuaaaauuuacucuaugaaaauuauuuuuggaacucuuuacuggaagaaacuaguacagugauuguuuugaaccaaucauacagacaaauaggaaagaaaggaacgcuguuaguagcaguucaagagguguguuagucacaaauaacuuaguuucuuucaaagauaaaacuuaaauuacauauacuguguauauaaacaguucuccauuuugcccaugagaagauucaaaauauuucguagacagcuugaauauaugagcuuuuagggaagucaugaaauagccaaauguuuuauuucuaauauucaauuuuaguuuaauuauacauacauauaauuauacauaccuauaauugcauaucauauaaaguauuagaaauaguauuuucccccuuccuacuucaugaaaguuucauuacacuuuucauaugcaacuuugauguuaguaucugucauucaucaucacuagaaccacuuuuuuuuaaucugaugacauuuuuuccacaucaugacgucaucuucugucucacugguuccuucauuagaccuuauaaaccuuuaaaaaugacauugauugaaguuuucggguguaugugucuuacgcaaacauuuauuugucaagauaauuaauacagagcucuauaaugcagagcuuuguaaagauuuaauuauaagauguaccaucugggguuuggggggagaucuuugccuuauauuuggggcauauauuugauauucagcuuuguuuauuuuucaguauagaguagucaagaaauguguuuuuuauaaaaauaaauuuuuugaaguauguuauauuuuuuaauaaacagauguuggaauaacaacugaaaauggcacuugaaguuauuuacgauuuuauaauuuguuaugauuucacccagccuucucuguucucucccuucccccacaacccauguaaauguguacguccagagaccauugugcuggugcuaggcaaggcuuuguugucggccucagacaugugaacaccgugccaucggggcuguaaccccagaggaaauggagaacauugagggaggcuggccuaccacaggaauacuaaaaaguagccauuuucuagauaaaauuuaucauuuuaaaaaucaugguaagccaggcaugguggcacacaccuguaguccuggcuacuggggaggcugaggcaaggggauggcuugauuccaggaguuugagaccagccugggcaauguaaugagacucaucucuaaaaauaaaauaaaacucaugguacacuaccccuacuuccauguauuuuuuguaaucauuugggaauaccuuuauguaggguguuuguuaaguuagccacaauuccuaccaccccuugugguauucuacucaucucuuuuuuuuuuuuauuauuauuguuguuguuauccccauuauacagagagauuaauuagcuugccuaaggucccucagcuaguaagugacacaaguauuuacccauucucuuacuaauuuacuuuuucugugguaagcuuugaguguacaaacacugcuuuagagacacuagucaauuugugcaaagcugaauggaccauuacuuagaaaaagguuucuugauaauccuuuuugaaagcaauagauacuauuuuuaaaacuuuugcauaggcauuugaugguugugaagauagaaccuagugauggcauuuuacccucuauuauuauugacucgguugacuauccaaaaggaaaggcuacugggcacaguggugcaugccuguagucccaguuacucaggaggcugagauagcaggaucacuugagcccuggaguuggaggcuacagugcagcauaauugcaccugugaauaaccacugcacuccagccugaguaacauagugagaccauguuucuauuuuuuaaaaaggagguauggggcuaagauacaaaguugaaucugaacuuaggaaagaaacucuauggauuuuuccuuagcuaaugucaagcacaacugcgcuccaccuaauuggguugaaauuuaaagacaaaagaucagaaauggaauggcuuuuugaauuauaguuuguuuguaauuuauaauaguguuuuuagucuugucagagaagaaaagaguaggcagcuuagguucucugcuaauugaccagugugaauuuuaaaaacuuacuuguauuucuuuuaaauuaaaaaaaaaaaaauccuccuaaguaguuacauuacauuauaguuuuuccagcaaauuaguuuuuuuuuuuuuuuacauugccuuacccaaguuuuuaugcaaugaaaugaguucaaucagcaguuaaaaacuaaaacgcuucccucauaaguuuuaaggguuuucuuggucuguuuucuccucugaaauguggagcauugaguaacacauaugaaagaauauggcaauauuuuuuauaccuagucauuuaugugccaccuuccugcuuuaccauauucacauacuacuaauucauacuuuugacauuuuaauuauuaagguauauuaaauaacaaaauauuuuggguuuuuguuuuguuuuguuuuguuuugagacaaggucuugcucuaucacccaugcuggagugcaguggccacaaucacggcucagugcagcugcagccucaaccugccaggcuuaagcaauccuacuacuucagccucccaaguggcuggaaguacaggcaugcaccacuaugcuuggcuaauuuuuuguauuuuuuuagagaugggguuucgccauguugccaaggcugguuucgaacuccugggcucaagcaauccaccugcaucagccucccaaagggcuguuauuacaggcgugauccaccacuuuauuuaaaauuuuaguuacaguuaaauaaaaguauuucauuguguacugucugcaaucauuuuguucaguaccaauguacacaccacacugggaaacacuggcauauauauaguggcacuucuacaugcauuguacaucaaauugcauugauaauacuaagugagcuuuucugagaugauuauaacgggagaagagagguucccuugugguugcauguuaucucaacacccuuucuccuuccuuuuguaagcugaaauauuucauuggaaauuuacaaauuauguagagaggaucuuaagaccgucuauuuucagagauacuucucucuuccauuggaagaaugacuguaaacuugguaucaauuuuccuaagagucccaaaauacaguacuguaaauuguaauauucagacugucuuauguucuaccuaaaacuugaucuuugcgccaugcuuacuagagaagaguuuuccauuucaaaacuagacuucaaaaaaucucuacuccucaaaagauuuggugaaguagcucucaguacugaaacacagagaaauggaggaccaguagaccugcacucaacugugcuaaaugcaagagauaaguuuagugaggcugcagaggaacacaguucagccugccagcagcaacccaccauuuccaucguucuaauuaguagcuguagaacaugaauaguacuaacuagacuaauauaauccuuguaaauauacauacgaagaaaacugcuacaacaaaggaaauuagaaaugagguauagguguuucauuagucaguaggcuggccuguugagcuuaucacugucaguguuuuguaaacauuuuuacugcaaccaaagaugaaaaacuuuuuacaucauaauucauuguguguuuguguguguguaaaauguggaauacaauuuucauaauacaaugugcuauauacucuagcauuuucuuuuucuuuuuuuuucuuuuugagacagcgucuggcucugccgcccaggcuggagugcagucacaauccuagcucacugcauccuugaacuccugggcucaagcaaucuuucugccucagcuucccaaauagcuaggacuacaggcacaugccaccaugccuggcuaauuuuuaaaacauuuuuuuguagagauggggucucucucuguugcccaggcuagacucaaacgccuggcuucaagcaauccuccugucucagccucccaaagugcugggaugacaagugugagucauggugccuggccacauuuucuauuuuauuucauguuuuaaaagaugcuggugugaccccuaaauugauuucaugauccacuaguaggucuuuuuuuuaaaagacagagucuugcucugucacccaagcuggaguacaguggcaugaucauagcuuacuguaaccucgaacucuuguguucaagugaugcuccuccugugucugccuccugaguagcugggacuacaguugcauaccaccacgccuagcuaauuguaguuuuuguagagacagggucuugcuguguugcccagguugaucucgaacuccuggccucaaaugauccucccaccucggccucccagagugcugggauuauaggcaugaaccaucacaccuggccccacuagugggucuugacuuguguuuucuaaaaauacuguuucugagauaaccagcucaacuagauaacugugggagaaaaaaagaaguaaaaauaaaaucuagguacuugggcuugcaaaguaauugaggaaaaagaauauacaauuaaggaauaguauaaaugagaauacaaaauguuaaacuuguuguaaugacugacaagggacuaaagcaugagcugaaaaugugaauccuauuuuagguaaacagaagugucucuacuacuaugaacauaacaauuuuaauauuagaggaacaucaaauugucagcauguaacuaugauuaauauugugucauuuaauacacauuagaaaaaagagccauagaucuuagcucuaaaagggauuuugaguuuaucugauugaagcaaaucuaaguauucacauuuuauggaugaaauaacugaagccagcagagguuaagugacuugcuaaugcuauauaccuaauugaggaugagagauugcgguggggugggagcagaauagcuuucagaucuccuacuucuacauuuuucacuuacucuuaaagaacagaaaugagccaagcacagugggucacgccugaaauccuaacccuuuggaaggccaagguuggggguucucuugaguccaagguuuugagaccaaccugggcaacauagcaagaccacaccucuuaaaaaaagggaaaggaaauguuuuagcauguuuuaaucuauaauguauuuuuuuacaggaagauauuccucgucagcuugucuacauuggucuuuaccucuuccacauugcuggagcuuaccuuuugaagugaguugggauauuucauggguguguaaguaggcugggcagauaguaugcugaccugucuuaauugauaauuaauauucccauuuuuaauuugcucuuuuaacagcuugaaucaucuaggacuuguucuucuggugcuacauuauuuuguugaauuucuuuuccacauuucccgccuguuuuauuuuagcaaugaaaaguaucagaaaggguaaguuguuuagccauucuauuucucguguacuagguauuuaaagucagugccuaacauugccaagauccaugcuuuaggccauuauauuaacuuuuuaagcgaucaguagccgcuuuaaauaaaacgaaauuauuuagcaauucagacuuuguauuuuacucucuaaaauggaggcuuucucagcuagagagauacuguauuguaucuugcaauuuugaaggcuucuuggguuuacuuuucuguuauaacuuuuacuuuguuuguugcaugguuuuucuuuuggaggagugauagagaagugaacucucagaagaaagugaaacaauagauaauuagccuuauagauaacuaaaauauauugauggugaaauugaacugaaaacagaauuggagagguguaacuuguaaagagugcaaaguugucuuaaaaaaaguaaaacugggacucuuuuuuuauuauuuuauuauuauuauacuuuaaguuuuaggguacaugugcacaaugugcagguuuguuacauauguauacaagugccauguuggugugcugcacccauuaacucgucauuuagcauuagguauaucuccuaaugcuaucccuccccccucccccaccccacaacaguccccagagugugauguuccuccuccugugucgauguguucucauuguucaguucccaccuaugagugagaacaugcaguguuugguuuuuugucuuugcgauaguuugcugagaaugaugguuuccaguuucauccaugucccugcaaaggacaugaacucuucauuuuuuauggcugcauaguauuccaugguguauaugugccacauuuucuuaauccagucuaucauuguuggacauuugaguugguuccaagucuuugcuauugugaauagugccgcaauaaacauacgugugcaugugucuuuauagcagcaugauuuauaauccuuuggguauacacccaguaaugggauggcugggucaaaugguauuucuaguucuagaucccugaggaaucaccacacugacuuccacaaugguugaacuaguuuacagucccagcaacaguguaaaaguguuccuauuucuccacauccucuccagcaccuguuguuuccugacuuuuuaaugaucaccauuccuaacuggugugagaugguaucucauugugguuuugauuugcauuucucugauggccagugaugaugagcauuuuuucauguguuuuuuggcugcauaaauaucuucuuuugagaagugucuguucauauccuuugcccacuuguugaugggguuguuuuuuucuuguaaauuuguuugaguucauuguagauucuggauauuagcccuuugucagaugaguagguugugaaaauuuucucccauuuuguagguugccuguucacucugaugguaguuucuuuugcugugcagagcucuuuaguuuaauuagaucccauuugucuauuuuggcuuuuguugccauugcuuuugguguuuuagacaugaaguccuugcccaugccuauguccugaaugguauugccuagguuuucuucuaggguuuuuauguuuuuaggucuaacauguaagucuuuaauccaucuugaauuaauuuuuguauaagguguaaggaagggauccaguuucagcuuucuacauauggcuagccaguuuucccagcaccauuuauuaaauagggaauccuuuccccauugcuuuugucagguuugucaaagaucagaugguuguagauaugcagcauuauuucugagggcucuguucuguuccauugaucuauaucucuguuuugguaccaguaccaugcuguuuugguuacuguggccuuguaguauaguuugaagucagguagcaugaugccuccagcuuuguucuuuuggcuuaggauugacuuggugaugcgagcucuuuuuugguuccauaugaacuuuaaaguaguuuuuuccaauucugugaagaaagucauugguagcuugauggggauggcauugaaucuauaaauuaccuugggcaguaugaccauuuucaugauauugauucuuccuacucaugagcauggaauguucuuccauuuguuuguauccucuuuuauuucauugagcagugguuuguaguucuccuugaagagguccuucacaucccuuguaaguuggauuccuagguauuuuauucucuuugaagcaauuaugaaugggaguucacucaugauuuggcucucugucuguuauugguguauaagaaugcuugugauuuuuguacaucgauuuuguauccugagacuuugcugaaguugcuuaucagcuuaaggagauuuugggcugagacagugggguuuucuaguuauacaaucaugucaucggcaaacagggacaauuagacuuccacuuuuccuaauugaauacccuuuauuuccuucuccugccuaauugcccuggccagaacuuccaacacuguguugaauaggaguggugagagaggccaucccugucuugugccaaaaacugggacucuuaaaugagaauugggcauccuguucuuuauaacacagcuuuuuugguuuguuuuguccagcauuuuccaaaauuauucugaauacuaguaguucugaggaauauuaauaguucuuauacaagaaaagagauaagcuaaacagaaaauuaaacauuuauuuccuggauuguuuuagaaauuuaaauaggcuaauauguguuauaucucucugagugugauauauagccuuucccagauauuugacucaaaauucuuuuuugcagaauaagaaaugcuauuuuaauaggcuuuuacuuaauaggaaucuaguuucuucuuuauuuauuuauuuauuuuuuugagauggaguuucgcucuuguugcccaggcuggagugcaguggcgcaaucucugcucacugugaccuccaccuucugguuucaagcaauucuccugccucagccucccaaguagcugggauuacaggcgucugccaccacgcccaacuuaggaaucuaauuucuaauagaaucuuguuuuugagauuucaggaauuugacuuacggccuuuuucuugcagauuuucucugugggcaguucuuuuuguuuugggaagacuucugacuuuaauucuuucaguacugacuguugguuuuggccuugcaagagcagaaaaucagaagcuggauuucaguacuggaaacuucaauguguuagcuguuagguacgaucaauuuaacauuuuuuucacuuuauacagcuagauaauauauauuaucaguuucucuacauugaaucaucuaaaaaaggaugaauaugagguuggggaaaauacucauuugauuuuauuucauacccguugcuauuuuacaugucuaaagugaaguacuaaagcauuuaacuuuuaggauaaauuauuaaugcaaugauuauuaauacaauuuucucaacugagugggaauuauuacuaaauacuaugaaagaugauagaauguauucaguggcauuguuuuuuauacacuaacuuuuuaugucuuaauauuucuuagaaucgcuguucuggcauccauuugcguuacucaggcauuuaugauguggaaguucauuaauuuucagcuucgaagguggagggaacauucugcuuuucaggcaccagcugugaagaagaaaccaacaguaacuaaaggcagaucuucuaaaaaaggaacagguuuguauucaguaagcaaugaaaaacucauggaaguagaaaacuuuuaaaaaauuuguuguuggaucuuauuuauuaguuuuaaggugucuuauaaagaaaauacuauucugcuuuucaacaaaauuagaggcaaaguaaucuuacugcauuccacaauugggugaucccuugggugaggaaacucaguuacuccccucaaaagcuguccaucacauuucucuuuaacaaguuuuccaugcuugguuaccuugagcuacuuuagaccaaacuuuaugggcagguuuaaacuaaaccugaggaugguaguuuguuuucaagcaucuuauucacauuuuaaaaagcucuucacaaccucuucccaucugcccauuugucccaaguggaauagcuuuuuuuuuauaacuucugauugcuugauucuuugucuuuaaagccuucauuuaaccucuuuuuuccuuaugguuuuugcaaaaauugaaaaugcaucgauauuacaguuaauuuuuucaguguguaugugguauuaggcuuagaacuauaacacaggaaguuuuuagaguauguccacucugguuuacuccuuuguaaguauuaauaccugauaauuuacauccuccagcccugccuuuuuuuuuuuuuuucaaguuugucccagcaagucuuggcccuuugcauuuucuuaauacauuuuaguacaacuugaucuaggugcaguggggggugccuguaguccagcuauucaggaggcugaggcaggaggaucacuugaacccaggaguucaagguuacagugcacaaugaucaugccugugaagcccuacuacacuccagccugggcaacauaugccucuuuagaaaaaaaaaaaaaaaauuauacaaccuggucaauuuccacaaaaguugcugggauauuaaguugaaauaacaucaaaucuguagaucgauuuagggauaauugacuauuucaacccauuaacaugauauauaccucuguuuauuuagguugucuuuaauuucuccaaguaauauuuuuaauagcuuuaaugggauguaauucacauaaaguuuacccuuuaaaguauacauuucagucauuuuuaauguauguucacaaaaucgugcaaaccacuaucuaauuccagaauauuucuaucacugcaaaaagaaaccccaugccccuuagcaucacuucacuuugcccccuucauucugcuccggcacccucuaaucuauuuucugucucuaaggauuggccuuuucuggacauuucauguaaacagaaccaugugauaugugguuuugcaaauggauaaugcuuugagguucauccaugucauagcauauagaaagacuucauuuauuuuuacagccaauuaauauuccauuguauggaaccuuuuggauggauguauaccauauuuuguuuauccauucaucauuugauggauauugagugccuuuuacuuuuuggcuauuaugaaucgugaugcugugaacauuuaggugcaaguuuuuguucaaacauguguuuucauucucuaggguacauacauaggagugggauuuccgagucaugcgguaacuauguuuaacauuuugagggaacugccaaacuguucuuugaagugguuauacuauuuuacacucaguuuagcaucuugauacucaguugucccugugccauuuguuaaaaagacuccuucacuugaacugucuugauacccuuuucaaaaaucauuuuuaagaaaaguuuauuucuggaucaugaauucuauuucauuuauucguaugucgauucuuaugccagaaccacacuaucuugauuacuguagcuuuguaguaaguuuugaaagcagguaaugugaguccccauuguuguuguucuauuuuauguuuugguuauucuggguuucuuacauuuccauaugaguuuuuauuuaagugacgggaucuugcuauguugcccaggcuagacuugaacuuguaggcucaagggauucucccaucagccucccagguagcugggacuacaggcauaugcugccuugcccagccauuuuaauaugaauucuauaaugagcuugucaguuucugcaaaaaagccagcugggguuuugguauggauuaucuucaauuuguagguugcuuugcagaguaugaacaugaaugucuguuuauuuagaucuuuuaaucucuuucaauuauauuuaucaguguauacaucuugcaguucauuaaauuuaauccuauuuuauucuuuuugaugcuguuguaaaauagaaccaucuucuuaauuccauuuucagauucuucauugccauuguauaugaaauacaauucacuuuuguauauugaucuuguauccugcaaccuugcugaauuuauuuauucaaauagguuuuuuuuuuuuuggugggcaaucuggaugcuuucuauugcauuuucuugccaaauugcccugcccagaaccuccacaacagguguugaauagaaauggugagagcagacauccuugucuuguuuuugaucuuagggguaggcauccauccagucuuuuaccauuaaguaugauguuagcuauggguuuuucauaaaugaccuuuaucagguugaggaaguuccccucugauuccuaguuuguuuuuaucauggaagguuguuagauuuugucaauugcuuuuuuuccugcaucuauugagauaaccuugugggguuuugucauuuuuuucuguugguauuauagauuagauugauuuucagauguuaaaccaacguugcauuccugggauaaauuucacuugguuaugguguaugauccuuuuuaucucuugauggauuuugguaugcaaguauuuuguucagguuuuuuugugucuguauucauaaaggauaauuggaguauauuuuucuugcaacaucguugucugguuuuaguaucaagauaauacuggcuucauagaaugaacuggggaguguuuuuuccuuuucuguuuuuuggaagaguucuucacuugaucuuagccaaaaugccaagaagcaauggaagaguuguugaaggagauauuuuauagguuucuguauagggaucucauacauuuuucauuaaauuuauucucagguauuuucuuuuuuaagcuaauguacaugcucuuuuuaaaaaacaguuuuaacuauuuguuacguaguagugccauuuguuuucuuuaagauacuauccagguacugaaaaaagucuuccuaauucacuuauucuaaaguuuacacuaaaauauacaguuacagcgucuauaaauauuauaccuuuucauuuucuuccuguauuacacuagcuaggacuaaaccauaauauucaauauaagaaaugaauacucuuguuccucauauaagagggagaccuuucgguauuucauuauuaagaauggucuguagaugcccuuuauucaguucucuucuguacaucauuuacuaagaguuuuuguccaugacuuguggaauguuaagaaaugcuuuuucugcaagauuuaguuagucauagaguuuuucuuuacucuauuaauguugugaauugcauugacuacauugacuaucaauguuaaaauaauucugcauuucugacaugcauccaaguuggugauaauacaguugucucccugggggaauacauuccaaaacccccaauggaugccugaaaccagggguaguuucaaacuauauaguuacgugcuaaauaaugacauuucagucaacagcuguacaacauauguguauacaugacucauuuaugacacugguccuauaagauaaugcuuuauuucuccaauaccauuucuauguuuagauauguuuagauacauaaauaguuaccacuguauuacaguugccuaaaguauuccauacaguaacaugccaugcagauuuuuagccuaggagcaauaggcuauaccauauagccugggugugugguaggcucuaccaucuagauuuguggaaguacauucugugauguucauacaaugaugaaaucgccuaacacauuucuuaaaacauagccuguuaagugaugcaugacuguauauacuauguuuucuccuaauuagcuaugauaaaguuuuauuuauaaauuggucacauauaacagcauauuguagcaaaaguuaauugaaugugguauuuuucucucucaaaauauuauacaguacucaucuauuuucagaccaugguugacuguggguaacugaaaccguggaaagcaacacugcaaauaaggggagaccauuguacaucacuuucgcugaauucccuuuuucaguauuucauuaggauuuuugcaucuuuguucauguaauaauagaucagccuguauuagcccuuuuuuguaauaugucagauuuugaccucaagguugugcuggcuguaaagaaaguguugggcagauuuguccuuuguguaauaucagcauuauuuauuauuuaaguguuuggaaguguucaccaacuaagcccucugaccuagagucuucuuuuuuuucgaaacagggucuugcucugucgcccaggcuggagugcaguggcacgaucuuggcucacugcagccucaaccuugugggcucaagcaguccucccaccucagccuccugaguagcuggggcuacaagcacaugucaccaugccacuacuuuuuguguuuuuuguagagaugggauuucaccauguuacccaggauagucuugaacuccucuacccaagugaucugcccaccagucucaaccaauuggcugggcacccagcacuuugggaggcugagauggguggaucacuugagcccaggaguucaagaccagccugggcaacaugacgaaacucugucuuuacaaaaaauacaaaaaugaaccaggcaucguggugcaugccuguagucccaguacuugggaggcugaggugggaggaucccuugauccugaugucacccuuggggugucacuucaccagcuggaaaccuuuuuggcugguggcaccuucugccugaguauugcuugcauccgcugggcucauuccacccacuuggccugacaggcugugcuuggcuuaagcuaccggcccagauccuacaccugucaagcaugagccagacguggagcagcagggggugugugggcaagcacacacaaggucuagccacugcgcacagccagacacacaggcugcugccacggggcaggcagcucuaggcaccagcaggugcuggcucugugugaggcugcagcuggaccagauguacugcaugcggcuuccgcugcagggacccaugacuggacaaggggagugugguggcaucuccagagcuuggagauggugggaaccacugaaccccaaagagggugucauagcccuggcucagggagccccuagaucugggcuucccagaggagcacagcucuucucucuuucuugucauccacaacguggugagcagaggggcauguuucagccuuguuugugcuauagcccuuucagucccaccauucagcaggucccaaguucuuguccugcauccaggaagaaugagguaugcagacaacuggagggugagcaaggcagagaggagguucauugagaggcagaacaguucucaggagaccugaagugguuagcuccuauccacagucucaucaucugcccaagucuggcugaguccaggauuuuuaugagcuucaggggggaggaagugcaugcugauugguccaugggugggcccagaaaacacuguaaguucucacuccaguccauggaacugguggccuggcccccagguuucaggcugucccuggcuugaagaggggggcuucaccagggcccaccccuuucugcccaggaaccugucugccuccugcugccaucaaccugccauccguggugccuaggcuggucaugccaaggggugccuacagacccacaccaagcugcccucagccccccucggccucccucucgugcucaucagcacccaaaguccugacagggccaagggagcagggagcugccuugggaacuuuggaccugcugaauggcgggacuaaaagggcuauagcacaaacaaggcugaaauaugucccccugcucgccacguuguggaugacaagaaagagagaaaagcccccagaucuaggggcucccugagcaggcauaucagugcugcucuaaucccagggucagucucaccuucacuccaaaacuagcagacgccaggagcagcagaguggccaggcagugggagcaggcacuuccaagccugcagagguaguagggcuuccugaacaccgaagaacuacagcuggguggcugccacugugcccaggagugcgggacucccaccacuccaacuuugaaagggauggggcuccugcuagcuauguggagcacacagcccuggaugcaccucucacacuacagccaaugucauggcaguagccacuccacaggggcugccgcugccaucacugagaaguggagguugcagugaguggagaucaugucacuggacuccagccgggauaacagagugagacccugucucagaagaaaaaaaagauaauacuauuguucacauuuucuguuucuuagucguuucucuuuugguaaauaauguuuuucaaggaauuugucuaguucauauaaauuugcaaauacaucggcauaaaauuauucauaugacuuucguuauccuguuaacaccucuaaaucaggagugauuccuguuuuucauuucauguuguuaguaacguaagccuuuuaucuuuccuuccaucagucaaaaccaacauuugucuuuuuguguugauuuuccuaguugucucuuuucuggaucauugauuucuauucuuuccuuuucauuggguuuaauuugcgguuuuguuugugauuuaccuucuugagauggaucuuuggagcauugauuuguaucucuugugaauuacauucaguuaaugguaaacuuuuccuuucaacacugcuuuaacuguauuucacaaggauuuuuuguuuuguuuugggguuuuuuuuugugugguuuuuuuuuuuuuuucuuuuuuuuuuagauggagucuagcucuguugcccacgcuggagugcaguggcgcgaucucagcucacugcaaccuuugccucccgggcucaagugauucuccugccucccagguagucaggauuacaggcacccaccaccacaaccagcuaauuuuuguauuuuuaguagagauggcauuucaccacguuggccaggcuggucuugaacuccuggccucaggugauccacccaccucagccucccaaagugcugggauuacaggcgugagccaccaugcuuagucuguauuucacagguuucaauaugucuuuuucauuauuauucaguucaaugauaucugugcugggauuccacuugugcugugauuauaggugcaagccauugcccccgccucaaacauccauuucuguaugcaacuuuuguauuuuuggagagagagucagucacacauacgcuacuccaucauagcuugaagaaggccauuacuauuagccaggugugguggcacaugccuguagucccagcuauuugggaggcugagguccccgggagcaucacugguccccgggaguucaagacugcauugagccaugaucgugccacuacacagccuuggugacagagugagacccugucucaaaaaacaacaguaacauaaauaaauaaaaagaaggccauaauacacgccuccacauagaaauuauccuaaacaccaacuuuacuauauuguaaacaaauauccccaaggacuucgcugucaaaugugaaaaguuucuuuauuucuacagaagguauuucucuugaauacuauuuuuaaauucuugugacuuuauaguuuucugugcugucacuuuuuucugcuuuuaauaguaguuuucuuuuaauuugcuacuuucaguucauuguguuaaaaauguuaccagguuuugugauugguuaaauacugguaaguaaauuucaccugagugaauuggauuuuacauuuucuuuucugaagguaucuuuacauauaaagauuauaacuugcauuuauuuauaaaagagaguaacauggauucuuuucuuuuugcagaaaauggugugaauggaacauuaacuucaaauguagcagacucuccccggaauaaaaaagagaaaucuucauaaugaauuauaaacuaauugauuaauguccccaaagaaaucugcuuucuacuauaucuuucagcauuagagauuuuucuguucuugaaaauacagucugugcucuuugauuuuugcuauuguacgguuucaugcauuuuuuuaaagggcauuugaggggaggauuauugcuaugaaugaaaaaaauauuuuagcuuagacuaagcuaccugccuucaaaauaguuuagggaccaccaccauauuuuauuuuguuuuuauuuuugaacauuuuucuaaugauuuggagagaaaacuauuuacaaaaauuccacauaucagugauacaauuucuugcugucaccaauuuuuuauaauagcagaguggccuguucuaagaaggccauauuuuuuaaguuaucuuucaggguaacauggaaauacuauaaaguuggaugucaaacuuuaauauguuuucaguguucucuaauuuuuuggaauuuuuguagacuuuacaccuggaaaaaaagauuuguaaaaucaccggaacaauugugugcuuuauuuuauagguagugguuauuaguauuacauccccauuuuaaaaacaaaaacauaauaaucguuacaacacguggaguuuuacuaacauacauauuaaaucaaaguauauucuuaaaaguacuugugaaguaaaaucuuucuugugcauuuucaauacuuguaaacuggaaaucagaaaauauuuacuaugaacaggaaaaucugacauauagcccuuuuugauauguuuauuaauaaugauucuuaauggggcucauaauaaguuuaauaugcacagcaucuuagaaaaguuuaaccugcaaacacuuuuaaaacauaaugccuacuugauuuauaucuauaaaaagacugacagguaauuauauuuggaaaacauuuaaugcacuaacuuuaaagaaauugaaaauucagguggauaaauagucuuacaaaagacaaugugcuuuauguuauaccuauagcuuuggucccaucuuuaauugagaaacauuuaucuguauaaaacauauuuuuggauaaauauauauauauauauuuguaucucuacagaaaggcucuaaaaagcauuugaggaaaauauuugguucccuuuucuauaaucauccuuuaagauucuuauagcuacauuugguuuauucaucauauuuacaguauauauauuguucuuuucaguguucacaucuuguuccccauuucucacuugugucaccagcuguuugugccauuuuuaguguaaaaguugcagaccuauuagaucugcaguuuaaguugccaugcugcuaggaaauuguccuuuuucuuucuagcuguuaaccuacuuccuggaaaaaguaguagcucucuguagcauuauggaguuucaguggaaccaaauuuuugccauuaaaaacuggcauuauacugaacuauacauugagaaaucaaucaaaauaaaaauuuuuacuuucacaaguuguauccuggauguuucugucauuguugguguuuaggcuauuuugguauauaaccucauuaaaauguaccau

SEQ ID NO: 12648 - RNA, 1205 nt, Homo sapiens
gcugagcacaggguacuuuauugaugguauaugacaagguggggcucccuaggccccuccccucuucaaggggucuacauggaaacugugaggaggggagauucaguguggugggggacugaguguggcagggacuccccagcagugagggucucucucuuccucuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccaug

SEQ ID NO: 12649 - RNA, 593 nt, Homo sapiens
ggguuggugaaggaucccaagaugguugggcgaaaacuugcucuaaaaaccacugacuguguagcuuuuguggagaucauaccccagaacuaaaaggccauugcuaauucccugaaauccuggaaugagacccucaccuccagguuggcuacuuuaccugagaauccaccagcuauugacuaggcuuacuacaaggcccauguagccaaggcaggcuugguggaugacuuugagaagaagcuuaaugcccugaaguuucugugccagaggauaaauauacugcccagcuggaugcugaagacaaagaagaugugaaaucuugugcugagugggugucucucucaaaggccgggauuguagaauaugagaaacagaaggagaagaugaagaacuuaauuccauuugaucagaugaccauugaggacuugaaaaaaacuuucccagaaaccaaauuagacaagaaaaaguaucccuaaugaccucaccaaccaaucaaggauuuauaaaauugaguccaggaggaagaucuggcccuuauauuacacauucuggacauuaaaaauaaaauaauuauacaguuaaaaaaaaagaaa

SEQ ID NO: 12650 - RNA, 607 nt, Homo sapiens
uuuaauuacauuuauuuuaaugcugaauuuacucccgugccauaaguuuuuguuucuucaguuucuucugggauaucuuuuucuucugggcaaccuccucuucugguuuaggaacaaucuguuccuuuuccguaaggaucaucucaauguggcagggagagcucauguauggguuaauccgaccaugagcucuguagguccggcggcgcaucuuaggugcuuuguucacuuggauaugcucaaugaccagagaaucuacaucuaaacccuuaaguucagcauuacucucuguguuuuuaagcaugugcagcaaaaauucagcacucuuuuugggccaccgaccuuguguccagccccacugcuuggccugcgcacaccugccaacuccaccauuguaacgucggaaugguacacacuguuucuguaaagugacaucuuucagauacuucguggcuuuuuguauaugcauacccuugauggccugagcaguuucacgaguguucuuaaagugaacacgaagauuggaaccucuugauuugcaugauuucgugggguucuccgggucaagugaguagcgaaccauuuucacagauuaccucaggcugcu

SEQ ID NO: 12651 - RNA, 3162 nt, Homo sapiens
aaaucacaaauacaacaauauauuucaauuugagagcagguacuguuuauuaaccaaccagcuuagaaaaauaaucaugguagacaccugaaaggaaaaaagaaaaccauuagaaaacacuuuaggcagcuaacaauuaacauaaacuaggcaguuauaaaguaaugauugaguuuacauuuuuaagaccacccaauuuccaucuuuaaagacuccccaaaacaggcuuuuccuuuccuccagaaagguccucaaaagcaguaaacaaaccaacuguaaucauuaagauaguugacccccacuccccacaaaagcacugauuaaaauucaaacccccaucaauauuuaaugggaaaaguauucaagauuaccaccacuuauacucuaacauuaacucaaccuuucucaggaugaggucucucaccuuaguucauucuucuaauaagccuguugaucugguccucccuguugccagcaucuccaccuucuacaaaauggguggucuuuuucuucauuccaccucguggagaagacaauuugaagggccacaggaaguuauuugccucuuugaagcguuuuccaacaguauagaucucaugaaucaaauccuccaugcagaugaugccguauuuaccuaaauauuuuaagguuauuuaagauuauuaaaguugcaaaaaguuuugaaauaauuauucaaaaucuuuuugaauaggcugugagaugaaaacauaaccaggaauaaacaagguaaaugcauggcuuuacaaagauaagguucaagcuaaugaaaccaugucuuacguuuucuuuuaagcuaaaucaagaaucauagggaacacaugaagauucacaauagugagaaauguacggccacaagaggguaagaaauuaucgcauggucuaauaccaaauuuucccccaaauagaaccuaccaagagaucgagcaaucaaagcguuaucugucaaagcaauucgcuucuuauugauuuugccauaaccacgcuuguagauuaguucauuuacugacuucagauugggguaccugaagugaaaaagcaaacauaaauaaggugaccacuguuaaaacaucuaaaauucauguugcuacauaaccaauuuaucaaauagaaaucaaaggagaaaagagacuuacccccaugcaauauauggcucuacaauccucagcauguuaaucgaagccuuguugagcuucacaaagguuccauugaagauuugacgaaggcgaagaagcugcaacaccuuucgaaccuuugggcucacuccauugauacuguggugaaaacggaccagaaaugcauuugccuuucaucgaaauuuuuauuaauacuaaccauuauaguuuugaauaucgaauccuaccuaaacagauaggaauccucucauguuacacacugaauuucuguauucuauuaagagaagggauaggagcuuggggaacauggcuugcaacuaaaccauuagugaucagcacccuccuuguucuagcuuccccuaaaauauuguuacuccgguguuucagaaucagggcucccagaaguaaugugaagguuuuuuuuuuuuuucccauucaaacccgaaugcaguaaaacugaacuuacccucugauucugaugacaaacgccaauuuggguucugcagguacauagaaguugccagcuuuucuugccauccucgccauucgaauuucaguucuguacaucugccuauauuccuugugauagugcuuugcuuuuucauagauaagcuuccuccuugccuuucgaagcugaaaaccaauaaucaguuauucauaauuuuuagcucaaucacaauuagcaaugccaaucauuaaaaagaaaacuacaacauguuuccuuuaaaucuuuucuugccacaguaugcaauuacaucccccaccaaaaaaccccacuaccuucagauuguaacauuagguagcuaagcaauuacucaguacaguuaggaaguaaaucuugccaagaacauucaccucauccucaaucccaauaaggcgccuccuuaugugcuagugccucaaaaaguuuacuuaccaucuuuugggcaaacuucuuucucaggcgcuugaucuucagcucugcgaaauuccuucgcuuuuucuuaaggguuucuggcacagcaggaaccuccuucuucuucucucuaacguuaauaaacaaaaauguuaucaauagcucaaaaagcucacagcgcuguauuacucccguacugagcaguguuguuuaccagaaaugcugucacugacuuuagucacuaguaacuuuacuugcucuggcaugcuacaguguacgaugcauauuuuagcuccaugucaauaaccuuuaacaccauguugccuaaaacgcaaucacaaauaugacaauagcaauacguuuuucccuauuucaaccaagaggcccggccuccgacgacuaauuaaaaaaaaaaacaaaaaaaacacaccaacacccgaauaacaaaauguacuagcugaaagacuacugcaaggcacugaccccgagacuuuaagcgcaaaaauuaaaaaauaaaaauaaaaaaaaaacaagccaccaccacucugguucaaucaggauccacauguugaaagcaaaggccuggcggcagggaggccuguaccaagcaccagccaaggacgaacacaauucagagguucugcgccucccccgaaagacccucuaccgaggacugggccgucagccaaccgacggguuccacacacauuccaacccgacaucucguucccgggaucuccaaaaccuccguccuaagaccgcccgcaucccaacccuagccucagguccccacuggugucacacagcguucacaaucaagcagggaggugggcaaaggugcaagcuacggccagagagagaaaaagugacacaaaaaguaucuggcucuggagauggagaaggauucucaagaggaccagaagcaacucacucuacacccuccaugguuccagccggaaaaagaggaaguuggcgcaugcguacuguccacuuaaagacuucgcgagagaagccccacgacucauaggugucuuagaauaagccggaaaagaauccagaacuaaaaagccgccuugcagacgcaaagaacucccugauuuagccucuuucaac

SEQ ID NO: 12652 - RNA, 2423 nt, Homo sapiens
aagcagcugggacugcucuaccaucucaagaagaagaacuaguaagugucaaggcugaggugaaagcucagaagcagaugguuuuauuaaaaaugggcagaaccaaaaacugggcucaggguagagaaagaugacgcagggaacagaagcacuuggaggucaagcacaacacaguuuagagacucacaagcucugugaguggucgagaacauucucauggggcagcugccagcuauugcuuuuccugcuggcagcguccgccacagcagcuggaacacacugauguuucguguguuccagccacaacaguguacgguucucgugaaaacuuacccucaaaauaguugaugcuacaauuauuuguuuugcgguuuuacuuaccacaguagguguaugaaauacuugcaucggaugaguugcagacccaauacugcuucugagcuucaguaaauauggaagaaaacaggguggaaaaaaacagaaaugguaacaugauucaauaucuccaaagcuuuacaaaugcaaagaggaucaguaacuaaucaucagacucuuccuuuucaguaagcagaaaagauuuaacuuagucaucagucacaugauuucugaguuccuauccaacuguuuccucuuuuuuugugugugugugcucaacauuugagcacuuccuguaaaggaagagagaaaaaugauuuagaauguacucuucaaacacuuacuguaaaugagagugaucaaagacuuaaaaauaaaacaagacacuuuggccaggcacgguggcucaugccuguaaucucaguauuuugggaggcugaggcagguggaucacuugaggucaggaguucaagaccagccuggcugacaugaugaaacacaucucuacuaaaaauacaaaaauuagccaggugugguagugcaugccuguaaucccagcuauucaggaggcugaggcaggagcuucacuuuaucugggaggcagagguugcagugagccaagauggcaccacugcucuccagccugggcaacagagcaagacuccauuucaaaaaaauuuuuuaaaugaaaaauaaaauaaaauaaacaagacaauucccagucaacuguaacaaaaccagucccuaggucccccugaaagucucaacagacaggcacuccuuuucccucugcauuauucuucucuccuacagcucuguauaacagcaguccccaacauuuuuggccucagggaucaguuucauggaagacaauuuuuccacggacugaggggauggggagggaugguuucagggugaaacuguuccaccucagaacaucaggcauuagauucuuauagggagcacgcaaccuagaucccucgcuuguauacuucauaacaagguuccugcucccaugggaaucuaaugcugcugcuggucugacaggagcuggagcucaggugguaaugcucgcucaccugcuguuaaccuccagcugugcagcccacuuccuaacaagccacaaccagauuccuaacaggccauggacugguacugguccacggcccccagaggauggggccuccugcuuuauaaaacaaauucucagcugggcacgguggcucaugccugucaucccagcauuuugggauaccaagguggguggaucacuugaggucaggaguucaagaccagccuggccaacauggugaaauuccgucucuacuaaaaauauaaaaauuagccaggcaugguggcacacaccuguaaucccagcuacucgggaggcugaggcaggagaaucgcuugaacccaggaggcagagguugcagugagccaagauugggccacuacacuccagccugggcaacagagugagacucggucucaaaaacaaacaaacaggccaggcgcaguggcucaccucuguaaaucccagcacuuugggaggucaaggugggcggaucaccugaggucaggaguuugaaaccagcuugaccgacauagugaaacccugucucuacuaaaaauacaaaaauuagcuaggcaugguggcaagugccuguagucccagcuacucaggaggcugaggcaagagaauugcuugaaccgaggagguggaguuugcagugagccaagauuaugucacugcacuccagccugggagacagagcgagacuccaucucaaaaaacaacaauaacaacaacaaaucaaauuaucauggcccagagagcugcaccuauagaucugaaguaaacagucucauggaaacuauuucuuuucagcagcagguuuaguuacaggacagaacagggccagauaagaccccaaacaggggacacuagcuguaauucugugcugugggcagggacuccaccagucuuaauaauguauucaccuacaacaagcuagagcucaagagaacauuuugaguccuaauaauga

SEQ ID NO: 12653 - RNA, 698 nt, Homo sapiens
uauaccuaaagcaccaaagggaaaaagugcaggaugggaaaaaaagucauucauccauauaguagaaaagcagcucaaauuaugagagaggcccacaaauaagaaaaaaaggaaaaauugaagaaugaaaaggccuuguguuucaaucuuauuggugaaaaacugcaaugguuucaaaaucaucuugaucccccccaaaaaaagauauucaaacaaagaugcuugugaacuaacugaaagguacuuaaauuaaauugauuuagcagugaguuggagcagauugaguuacauaacaguaucagggacaagcaggacaggcagcacuguucccaggacaccaucaucaagcagacgauggagcgggagggacagcaguauaaaggauguggcuuugagauuccagacauucuaaaugcaaguaaucugaaaacauuuagggaaugggacuuugaucugaagaaauugccaaauauuaaaaugagaaaaaucugugcuaaugaugcaauucccaagaagugcaagaggaaaacuauuauaacuacagaccaagauuuaguggaauuggaacuaaacgaugaaucaaaugacucagaagaggaaaugacuggauuagccuaaucaucuucacuugaauucaaaauaaauaauuugagagcuucaaauuauauucauugauuaugguacauaaucaucaagau

SEQ ID NO: 12654 - RNA, 1201 nt, Homo sapiens
gcaguacauugagcuccauagagacagcgccggggcaagugagagccggacgggcacugggcgacucugugccucgcugaggaaaaauaacuaaacaugggcaaaggagauccuaagaagccgagaggcaaaaugucaucauaugcauuuuuugugcaaacuugucgggaggagcauaagaagaagcacccagaugcuucagucaacuucucagaguuuucuaagaagugcucagagagguggaagaccaugucugcuaaagagaaaggaaaauuugaagauauggcaaaggcggacaaggcccguuaugaaagagaaaugaaaaccuauaucccucccaaaggggagacaaaaaagaaguucaaggaucccaaugcacccaagaggcuuccuucggccuucuuccucuucugcucugaguaucgcccaaaaaucaaaggagaacauccuggccuguccauuggugauguugcgaagaaacugggagagauguggaauaacacugcugcagaugacaagcagccuuaugaaaagaaggcugcgaagcugaaggaaaaauacgaaaaggauauugcugcauaucgagcuaaaggaaagccugaugcagcaaaaaagggaguugucaaggcugaaaaaagcaagaaaaagaaggaagaggaggaagaugaggaagaugaagaggaugaggaggaggaggaagaugaagaagaugaagaagaagaugaugaugaugaauaaguugguuguagcgcaguuuuuuuucuugucuauaaagcauuuaaccccccuguacacaauucacucuuuuuaaagaaaaaaauugaaauguaaggcgguguaagauuuguuuuuaaacuguacagugucuuuuuuuguauaguuaacacacuaccgaaugugucuuuagauagcccuguccuggugguauuuucaauagccacuaacuuugccugguacaguauggggguuguaaauuggcauggaaauuuaaagcagguucuuguuggugcacagcacaaauuaguuauauauggggaugguaguuuuuucaucuucaguugucucugaugcagcuuauacgaaauaauuguuguucuguuaacugaauaccacucuguaauugcaaaaaaaaaaaguugcagcuguuuuguugacauucugaaugcuucuaaguaaauacaauuuuuuuauuaaaaaaaaa

SEQ ID NO: 12655 - RNA, 1812 nt, Homo sapiens
gauuauuggaggauuaggucauugucagaugacuggaaaaccuaaauaggaucucucuccagcucaagguugucccagugaggaagacuuuaccaacuucucacucuaccccacuacucacaugaguguuagcuccaccuugcaaaggcugaagaccaguucuccccagugaaagcugccucauucuuuuauggaguucccuggaguggcagagcuauaaagacgagcauugggauuugcagucuccauguagccuuucgugcuuggcaaccccuguagacuuuuugucccaagcagauugcgugcgugcgccugugugugagaauaagugccuuacuuugcugugugguuuucaacuuguacuccguggccagcccccaguugccagggcucgacggcagccaaggacaccauaccucaguauaguuauauauaaaagggacacggauugugacaguuucaccccauuuguuucuaaccccgcugcccaggauuagggucugugguguguucuguuuuguuuuugguuucucccuugugucaguucucuucuggcccagcuggguggcuguggaagucugugagguggcccaaccacaagcauaccuauuaagagaagcccagagcuuccagcccccacuucgaaaacucuccucuggccccacauagcaaacuccuucuccguuauuuuccccacccccagauuuuuuuuaaaaggcccacuugccguaaccucuuuuggucuauuuugcuucccauucagcccaaaguuuauaugauaaagguguuuacuuuuacuucccagucuccaagugcuaacacauaaacacauacaugucugacuguugcagaacuguucgagcuccuaauucaguguuaccuuguuuuagucgcagcaacccucuccccuaccccuugcccgcccacguuuuucucacucuuccggguugugcaauaacucucccagccagugguccuuuccacagccuuucugucccuuaaaacaccugcaacugggggagaaaugggacccaugggagggggagucgucaucccuuacacaagaaauagccacuuuccuuuuguugucauucuugugauccuggguggguuucuguggcacucuuuuagaacauguagcaucaucuuagaggucuauuuuuaaaaaauguguugaagaggaaaaaaccauucucacgauggggcuuaagucauuguccaggaauaagauuggcguggugcccaugacaucaccgucacucugccuaaaagcacucuagagcuacuuguucacguggagaggaaggauauuuugcgaagcaacagccgcagguggagagcccuguucaccugauagggucuagcugugacaguaaauauaauaccgcuguuuccuuggguacagauuugaguguucaugugaugagacuguaaaccucauuuuucgguuccucuguuuaaaaaaacaucugaaggaugaacuaaggcugcuggugcccugagcaacugauaaugcaaauguggacaaagugucuguuuucuacucuagccuguucauauggaccaaauuucaacaaggaacucaaggaaaauuuguaccugccguauuuaugcuuucauguaaaaaaggguuggggggaggggugucuuuuugcuuuuggugaacuuuuuuucaaaaucauuuuuccacuguuucugucugguuuuaaaacaaauuacaguuuuguauggauuuuuuaaauguacauuuuggaacaaaugaucaaauauuuucugaaauaacaauaaaaggcagaaaauuaucagaauugu

SEQ ID NO: 12656 - RNA, 4028 nt, Homo sapiens
uuuugagcacaacuacagcauuuuagacugcaugaaaccaugacugacugagagucacucucuggguagaugauaggcgccuuucuggccccuucccucacagauucuuuccccuccccuccaccugaagagaaggccuccaaguccuuuuggugccuugugaggacuuuuagaaggggcguucagcuuuaaaaagccgguccuaauuacggccggacgcaguagcuuacgccuguuaucccagcacuuugggaggucgaggugggcagaucaccugagguuaggaguucaagaccagccuggccaacauggugaaaccccaucucuacuaaaaauacaaaaaauuagguguaguggcaggcaccuguaaucccagcuacucgggaggcugaggcaggagaaucgcuugaaccuagaaggcggagguugcagugagcggagauuguaccauggcacuccagccuggacaacaagagcgaaauucugucuaaaaaaacaaaagucccaauuaagaaccuccgaacucuguuuugaggcaaaggggaguaguucuugguaggugcaggaauaguagugucauuuggaauacuggucaucuuucugacaucacaguagaaaccaaaccuuggauuuagauucaaaaggggggaaaugggucuuuucaucaaggcaacuccccuucuccaagucacuuacaucauagauaaauuuuagcuucccaguaacugagggauuuguuuccuaacgccauuggaggccuucaucccucucuacgauaagguugcagaaaugggaagagcuacccgugguugcuuuugauuacccuuaggaagugagacaguguuuuugaaaauauguauuucccccauuucucccucuccuucccugacacuucucugggcugcacagcagaaacguugguaaaagggcaguuugguuucaacacagcagaccugauaugggaucccuuagccacuuuagucaaacagcccugacagagucuauaauugaguucaggccccccaccuugccuaauaacugcaaaucgcauguucagccagcagccuccuaagcccaccuuccucccccauuagagaacacccauccuaggugcucuccaggcugugucauuggcagggcuucacaugcaggaggccucucucaggugaguccagguuaaacuguugaguuguggcuucaacagauauguauggcaugcugggaugugccaggugccugcguugugccaguugcuggagagguagugugagcagagcagcugaaaucuugccaucaagcaacccucauucucaugccuguagguuuccauugcucugucccaggacacuugcgugccagagacgccacaacuucaugucccugucucuugcaagcuccccgugcugccaguacuucaugccuuggauguggucccaccagcccaguggccggggucagcuuaggcucugcuucccaguggacgggugugcuaaggguuuauuuuauguaaaaaaaaaaaaaaaaacaaaaaaaaacccugagaccaugaguggggcuggcaucuugccagccugggcuucagggauguuuggggggggugguuagaggguaguuguaggguacuuugucaccccccucccccugccacccucccuggcacguuuauuucacagcagagccaagucuguggcagguugacacagacuguguugccagagcugaaauaauuccacuucauccuaugagcguguugggcuagcuuguucuaauuuuggccacuuuggcuguuuucuucaguuuuaugcauucucuccugccccaaagugccaagccauuugugaaggcucugccagacaccuccaagcuugagagcucagcaccaugcaccaagagcaggagaaaagacguaaaccuaccccagcaacuguggccucucgacagcccuggcuaacuaacuuacauuuguggggaagccaacagacacagcaggaggagagggagguggcgcugguggaccaaggaucugugcuacccgcuccccuccuuggaggugcagugaugaugggaguuauuuuuaccauccgggcgcugauagcugcacuauuaauaaauugcauguguuccuuuugaagguaggggaugguucugggugagaggggagcaggcugagccggcgggggaucugcuguccucccuuuugagucaguucuaaucccaugugugucugggccaccagaccgaaaugguugcugagaaacuugucuguucaugucccaaggcauaacuucccaacauuuaagaaaccccaauagacaccucugcccuggccacguucacagauccuucucuugaccggaaacccugggacccuaagaaccccugaagcuuggggugggugugugcuucuggggucucuuuugggaccuccuuugucaguaccccuucuuuuuucuaagcagcuaauaagagguugggugaaagagugcaucuccucccaggauuccacaacaaaauucuuaucuuccauggaugcuuuaauuggaaguggguugccgacccccuugugccuagaaaaggccuucgcuuggguuuccuuuguaugcuucagccuuccuaguugguuuuucuaggccuggugugagagguagggaagucugcacauaacuaauucuuuugcuuaagggccuauggcacaagugcacaaacuucaauucuugauguucuaagcucucuccucuaacagagggagugcugaaagcuuuugagucaagacaauggagugcucuuccucccucacucugccuuccgagcuuaugguuccuuuucucaggagaggauuuucaggauuauuggaggauuaggucauugucagaugacuggaaaaccuaaauaggaucucucuccagcucaagguugucccagugaggaagacuuuaccaacuucucacucuaccccacuacucacaugaguguuagcuccaccuugcaaaggcugaagaccaguucuccccagugaaagcugccucauucuuuuauggaguucccuggaguggcagagcuauaaagacgagcauugggauuugcagucuccauguagccuuucgugcuuggcaaccccuguagacuuuuugucccaagcagauugcgugcgugcgccugugugugagaauaagugccuuacuuugcugugugguuuucaacuuguacuccguggccagcccccaguugccagggcucgacggcagccaaggacaccauaccucaguauaguuauauauaaaagggacacggauugugacaguuucaccccauuuguuucuaaccccgcugcccaggauuagggucugugguguguucuguuuuguuuuugguuucucccuugugucaguucucuucuggcccagcuggguggcuguggaagucugugagguggcccaaccacaagcauaccuauuaagagaagcccagagcuuccagcccccacuucgaaaacucuccucuggccccacauagcaaacuccuucuccguuauuuuccccacccccagauuuuuuuuaaaaggcccacuugccguaaccucuuuuggucuauuuugcuucccauucagcccaaaguuuauaugauaaagguguuuacuuuuacuucccagucuccaagugcuaacacauaaacacauacaugucugacuguugcagaacuguucgagcuccuaauucaguguuaccuuguuuuagucgcagcaacccucuccccuaccccuugcccgcccacguuuuucucacucuuccggguugugcaauaacucucccagccagugguccuuuccacagccuuucugucccuuaaaacaccugcaacugggggagaaaugggacccaugggagggggagucgucaucccuuacacaagaaauagccacuuuccuuuuguugucauucuugugauccuggguggguuucuguggcacucuuuuagaacauguagcaucaucuuagaggucuauuuuuaaaaaauguguugaagaggaa

SEQ ID NO: 12657 - RNA, 1836 nt, Homo sapiens
ggcaucuaacuaccauacaaguucagaccaauggaagaaaagagcagcaaaaauugaacugaaugaaucccaaaagcaagaaauuaaagacgccuuuaauuuauuugauauugaugggucuggaaccaucgauguaaaagaagguucugaaauuauuucuaauucuaaaucauuuuaaaaaccauauuauuuguggcaaucuuuaaggcuuucuuuaaaaguagucuucugaaagcuuaauauaaagucucuucagugcauaugccugcccugcauuagcaaaacgauaucuuguuaagcauuuuaauuguguuuuauaaaugaguaggcaaaagcccaggguguaacagugauguacaugauggcacaguaggacugaaacacaggccugcugaccuaauuuucuguuuaugcucaguccauaauagaaaagagagaagcucuuaauagggaguuaaaaagcuuagaaagaaaucauggcauauuauaauuccuuuucuuccuauuucagauugcagugugggccuuaggauuugaaccaaagaaagaagaaauuuaaaaaaugguagcugaaguugauaaagaaggaauuggcaccauuaguuuugaagauuuuuuuuugccauuaugaguauaaaaaugauauaguuaugauuuuauuuuucaaagaaauacuagcaauaaccugcuacauuuuagggcuggagcaaucagaaguuuuauagagaagcaauuagaacuagguuuuuaaggaugggagauaggaagagcaagauuaaauauguuuucaggguaguaaugagaagacuaugauguggagaagagguuuuugucaggaaauaaugaggcuauauugcaggauagagagaauggggccagaauuuggaagccuuuaauucagcaacauauauugaaugccuauuuuugccaggcacuauucuaaggagcauugaaagauacaaccuuccauuuugaagcuuacauuuuugguaacggaucugaauuaugagguuuaauaagagaugcauucuggaccacccugugccuucuccaccuuagcaagcucuaccuuuaagcaccuugagggcaggugugaguacauaauuguuaaaagaccaauaaauaaaaucagaacacagcuacuuggcacauugcugcuuuagaccccaaagaucuaauuaaguccagcuugauaaaauaaauaaaugaaagacuggauaguugcuucuuuuuuaaaagaguaaaaaagaugaaaaagaagaaauauugaagacuuucaaauuauuugaugaugaugauacuggaaguauaauacuaaccgguaucaagagguuugcuaagaaaccaggggaaaauuuaacaugaugaacuucagguagauuuugcuuauuuuuauaauuauaauuuauauguaauuauaacuuaugugauaauuuaggauuauaauucuaacuuuaguugcacuuaugcauuuaaaauaaaauuugguuuugaauauguguuugacuucauuuaugucauuuuaaauguauuucauauauuuacauuuuguuuuacaggaaaugcuugaugaagcugaucaugauagagauggagaaauaaacgaggaagauguuuugagagugaugaaaaagacuacucguuauuaauagcguuguuuuaguccuuguggaaaauuaacaaauuuguauuuguuaugcaguuuuauaauuuaauaucugaauguauucauuuucaguuuuuaguuuauauguacacauuggcuucuugaugucuaauccauguaagaaguuacacaucucuaccaauaugauguuaaaucuacagcaucaagaa

SEQ ID NO: 12658 - RNA, 18663 nt, Homo sapiens
gcagcgucgcgcggcccaguucccuuuuccggucggcguggucuugcgaguggaguguccgcugugcccgggccugcaccaugagcgucccggccuucaucgacaucagugaagaagaucaggugugcuucggucuacgggugccgccacgguggggugggggauguccuaguagcgcaagggaccgcugccgagccugggccgggcggccggggcugacacccgcagcuguucuacacgcgagaauggggaggccgguggcuggggcgcgcguuccuggccucgauucgcaccagcucgccggccggcggucccagcgcggggcccgacgcuucaccgccagcucccuggucggcgucgggacucauuucugacgacauaguacuuuuagacugaugaggaaugaugucugcuuccguccgucaaaugcagccacauucggagugggagguggugaaucuguaguuagcauaagcaggguagggaaaaguaauuuugugcuaaagaucaaaaugccgggccgggcgcgguggcucacgccuuuaaucccagcacuuugggacgccgaggcgggcagaucacgaggucaggagaucgagaccauccuggcuaacacggugaaacccugucucuauuaaaaauacaaaaaaauuacccgggcgcgguggcacgcgccuguagucccagcuacugccgaggcugaggcaagagaaucgcuugaacccgcgaggcggaguuugcagugagccaagaucgcgccacugcacuccagccugggcgacagagcgagagucccucucaaaaaaaaaaaaaaaaaaaaagaucaaaacgcccguauuacugugcgaucacaggcgaagacgacccguauuuuacacuugcuuucuauuccuacuuguaugagggugagaguuguucuguaccccggaaguaugguaucaguucagcucuuaaauucugugaggcauacaccugauggaccauccugauauuuuuaaauuucccguuuggcguuugcucuuugguauacagggcugaugguucucauuuuccccauaacaaaaguuuaaccuuauuugguaggaguugaacacgacaucguauucuuuaaguuaauuuuguauugcugaaaauucuucugugaaguccuaacuuugucguuuuauuucuguuacuccacuaacacggaaguaacuuccaaaugauuggauaucauaaacuucgcauggaaguuuacuugucuaagacaacuuacagaauugcgggagugaguucccccucucuccuccccccgccccaugguaggaaugcaguuccgaugcucugaagagcaaaguaagaagggaaaaugcaaaaggcggagaaaaggucaaggauggggagguuaagcacagauaggaagauaugaaagacaaaaagauaccugauuagaaauggaagcauguuaccaacaguuggcuguuagguuaacugagaaaguguuuggaauuuuuuuuuuuuuaacauacaaagugaauggaggaaguucuugucauugaucguaucuuaaagugucuuuucucaggcucugcuucuguucuuguaacaucaguaucgcuguagacaguccuuucagggaaauaugaaauugcucaggauuaguuuaacuuuggugaaauucucagcuugauuagaguuaaauggaauucuuuaucuuuuuuuguuuuccuuugcuuaugcugcuuccacaaccacuuguggcagugaggaugacagaaaaacagcaaacgugguucaauaguucuuagaaaaaguuugcuguguaucuguuuccuccauagagaagcaugaagcaugauuucuggagguauuuuuguuuucucugacauggugacaguuuguuuucuuuuuuuaauuuugcuuauaauaccaacucuucuaugaaguuacuguguucuuguuaccugaaaggauaguaccgucagaucugcagguuuaauacuuuccugaggcaacuaaauauacuuggggguuuaaaaaucuugauggcuuugaauuuuuuuuuuuuggcuuggucuagaaaauguaaugccugugcauuuacuaaugguauccuuucauauuccuguugcacauccucauuuuauuaucuuuaaaaccaggcugagcacgguggcucacgccuauaaucuuagcacuuugggaggccgaggcccguggaucaccggaggucagguguuugagaccagccugacgaacaugaugaaacccugccucuacuaaaaauacaaaauuagcugggcaugguggcgcaugccuguaaucccugcuacuugggaggcugaggcuggagaaucauuugaaccccggaggcagagguugcagugagccgggaucgcuccauugcacucaugcuauugcacuccagccugggcaauaagagugaaacuccaucucaaaacaaaacaaaaaaaaacugcguuuguuuggcugccauaaagagucccagaagaaaaauggaauaaauauauauaauucgguaguaggguaggaaauguccaagugacugaaugugcuauuguaguuguguuuuuauagguccgaagaugcaugcugacucagauaugcauuuuuaauuuuaagagauuaguuacauaacagauccaguucgauguaauuuuaaggcagcauucaccgcauugcccuuuugugaaccaaaaugcuuaucucaaauagcuucucaacugauuaacaaaugauuacccuuuugccaagguaaugucuguaacuuuucuaguagcugugguuauguguguacuugagagcaauacuauuguucauuucuuucaaaaaaaugaaaucugccaagucagauugauuucuucuccccagcaaccacacccccaccaaacccuuuggguuauauuaucaaaaagauuuuugcuguaugcuggaaguccagcagggugcagacuacaugagagaaauucugaaggugauccaugggggcuguagugugucuaaggagccacuggaccucauggaggaaaaccuguggcucuugugggauugccaagauggaugaggugagggaggggucuucaacauuauuugaaauaguuguugaauacaguauuuccguuuuaguuuuucagaaagaggacagaauuugagauugugcuuugucauucguagucaguuuuauaauagagcaauccucaacaggcugcugagcuucgugcuuaucugaaaucuaaaggagcugagauuucagaagagaacucggaagguggacuucauguugauuuagcucaaauuauugaagccugugaugugugucugaaggaggaugauaaagguuuguuuuuaauuuuuuucuaauauuuccuaauaaaaucuuuuaaauuuuucuugugaauuauagagucgucccucauuaucugaggcaaggaggauuuggaacccucagauacagaaggcugacuguauuuauauguuuugaauuucagacuacaggacuuuuaaauagauagguagugguuguauguauuuugggggcacaggugauauuuugauacauguaugcaauguguaauuaucaaaucaggguaauuggaauaucacacaucuuuucuuuauguuggaaacauucaacaguucucuucuagcucuuucaacuauacaauacauuguuaaccagagucuaagcacuguuguuuucaaucuuaccuucacacaugcuuucaguuuguguaaucuauuauaccuauaaaguaaaccuauuuugagaaaaccuuuauuuuauacauagguguauuucuuaaguguuauuacacuaaaugcuuauagucuuagaauaaaaugaaaaaaaugaagcucuuuccuguucauaaguuucagauuaacaucaaaugggauacaguuucaaguaaucuaauagccauuuaauuauuaggccaguuuccuguuuauugagauagaaugggaaauuuucagaauuguugaguucggaaaucucuaguuaagguuuagagaucaaacuuggaugcugauuucggcagcacauauacaaaaaaauuagauuaaauuugggauaugauuaauaucuguaauacuuaaaaauaacuaauucaagcagagagcugacagcuuuaauuucugauuuccuauauguauacacaaaguuuuccuuaauuaagaaaguauccuaguccuaaaucauaccaguaacuuccaaaugauugaauaucaugacagugaaaauugaaacuuuauauacauguaaaucagucucuguuuuacuaguuagaaaccacaucauaggccaggcauaguggcucacgccuguaaucccagcacuuugggaggccgaggcagguggaucacauggucaagaguucaagaccagccuggccaauauggugaaaccccgucucuacuaaaaauacaaaaauuagccgggcgugguggcgggugccuguagucccagcuacuugggaggcugagacgggagaaucgcuugaaccugggaggcggagguugcagugagccgagaucgcaccacugcaccccagccugggcaagagagcaagacuucaucugaaaaaaaaaaaaaaaaaaaaaaagaaaccacaucuuagguaucaauuuccuuccucuuuaauaaaauauacaaguugcuuucugaaugcgaaagugucuuacauuugauggucuucauuguauuaaaacacuggaaaugcauauuuaacuagacgcauugaguauuguaguaucacuguugauuguguuauccauacuuguguagauguugaaagugugaugaacagugugguaucccuacucuugauccuggaaccagacaagcaagaagcuuugauugaaagccuaugugaaaagcuggucaaauuucgcgaaggugaacgcccgucucugagacugcaguuguaaguuaagaucugaaagaaacucaguuuuucuaggugcuuuuuucauguuacuaacuuuuaauggugcagagcaggaauucuggaacuugacucucagcuguggcucauauuagcugugaccuugggcaaguggcuugaccuuucugugcccuaguuuccuccuuuguaauaugaaguuguuaacgguaccugccacagguuuguggugagagcuaaccucaacuuaaaacugguugcugauuucaaacauuguuuauuuguuuguuaaccaaccagguuaagcaaccuuuuccacgggauggauaagaauacuccuguaagauacacaguguauugcagccuuauuaaaguggcagcaucuuguggggccauccaguacaucccaacugagcuggaucaagugaguuacuguguggaauaguuguucugcuuauaagaaauguacuuuuuuuuuuuuugagacggaguuucacuguuguugcccaggcuggagugcaauggcgcaaucucagcucaccgcaaccuccgccuccaggguucaagcaguucuccuuccucugccuccugagcagcugggauuacaggcaugcgccaccacgcccggcuaauguuguauuuuuaguagagacgggguuucucuauguuggucaggcuggucucgaacucccgacuucaguugauccuccugccuuggccucccaaagugcuggggauuauaggcgugagccaccacgcccagccagaaauguacuuuuauauguuauacuuuauauguguuacucaguuuucuccuuuugucaaucucuuguagguuagaaaauggauuucugacuggaaucucaccacugaaaaaaagcacacccuuuuaagacuacuuuaugaggcacuuguggauuguaagaagagguauucaaaaguaaugaacuaacauaucacuuaacagacaguauaaguagguggggauguuuuuuaaagagaaguagggccaguaauuuugcuuuacucuguucuccacagaguugcuauaaaucuauuucuauaaauuugaccuaaaguuaaagauaacuauaaagauuaaaaguaguuuucccucaucuuugaacuuuuuaaaaagugaaauuuggcuuuuuuucuaaaaaaagaaagguggggccuuuccaacaugggcuucaaccuacugcuguagcaugagcuuggugaauguggugaagcaucucaucauuuuuggauggugcaguggcagacuacaaaaaacuuuguguuaauguaaauauuccaucucuccacccauguccuuccucuugcuuaucacacucuagacccagcgagccuaugucagguauaaaagcaccaugcucuuugccagucuggaccaggagcuggcacugguucuucuauagcccguguacuaagaaugguuuuaacauuuuuaaaugauugagaaagaaaaucaaagaaaggguaauauuucaugauauguggacauuauaugaaauucagauuucaggguccauaacauugguauuacauccaugccuauucauuuacauauugucugugccugcuuuugccaagaguuuaguuacaacagauaccauauagcuugcaaagcuuaaaauauuuacucucuggcccuuuauagaacguuugccuaccccuugucuaaguagucuuacuauagucagcuucaugucucugccagaaacaccccucucauauuucgguuagugccucccuuuuacagcacccucuacuuguauccuagcauuuaacacccuuaguugaaaguaagguuguaggcuaagugaaggcaaggaaccucaucuguaaaccauugcauucccaagaagauagcacuuauugggcacugaguggauaaaugcuacccacaguagggaacuggaaggggauacuuguuuaaacacgacauuucugacauucugccaaucuaaauguugagaguugguuuucuucuuuagaacacauaaaauacauauuuuaaucaguaaaauucugagauuuuaccuagcaguuaaguaaaaaugcuucaaguuuaugggugcccccuucaugacuuuauuuauauuggugguugaugcacaugguguuuguugugcuuuuuuuuuuuuauuugagauggagucuugcucugucgcccaggcuggagugcaguggcgcaaucucagcucacugcgagcuccaccucccggguucaugccauucuccugccucagccuccugagcagcugggaccacaguugccgccgccacgcccggcuaauuuuuuguauuuuuaguagagacagaauuucaccguguuagucaggauggucuugaucuccugacccugugauccucccgccuccgccucccaaagugcugggauuacaggcgugagccaccgcaccaggccuguugugcauuuuaaaggguguuacugguaacuaagcccuuacaugucagacaccaugcugugugcuucaaguggauuaaaaagauuucuuuagcugagaagguugaaguauacuguaguugcuaaaacuggaaaaugacuugcaccugugcuuacaguguggcacaagauaacuaaugaguaagaugugguuuuuuaaaaguuuuucuuugaauuuuuauaguuaagucauuauacuuuuuaauuuuaauuuuuauugcaaaguuaaaaauuccuuaguuuuuuauuccugguaccacuacacuaccauaauuuacaggguaacaugccugauguaaugaaaagaaaaaggcaaagguacaacagauaaaagaccucaggaauguacaucuaauugacacuacacugcauuaaucaauagugcacuuuuugcaaccuguagcuaugacaguccugaacaagaaggcuuuccuguuuaagcugcaguaacuuuucugacuguggaucaucauuccucuguggcagauuuuuacaguuccucuaaugcauuuggaugauugccucaaaguaacuugcagcuuuucugacuucuccuugcuugcacuccugccaaaaacuguagcccuuuucugcuguuuuuagaaccuugugcuaccauauuuaccaccauagagacugcccaagcuuuauccaccaaaacugcccccuuucaugcauggguccauaauuugguugucauuguccacuguaauauccaaaaucauuauaguucccaccaccaccguaauuaccacuccccaaauuaccuucuucauuguaaccaucauauccuccacugcugccaccauaucuaccaccaccauacccgccucuacuaucaaaaccaggacaacugcgguaguugccaccaucaccuucaaauccauuauauccagcaaccccuccuccauaacuacuucugcugccaccaccccagcaccauauccuccucuuccaccagaguuucuacccauggccaaaacuaccaucuccaaaguuuccuccacaacccauaaaguugcuagauccacuccacaacugcaucuguuguuuaaaaagggcccuuuucacuucacuaacgccuguuaauagaguguuauuucugaaccacaauuuuaucaugaucaucaaaaguuacaaaagcaaauccucucuuuuuuccacucugccaguccuccuguaacuucugugguuucaaucuugcgauacuuuucaaaguagucucucaaauuauguucuucuguaucuucuuuaacaucaccaacaaaaauuuucuucacuguuggaugggcacugggcuuuacagaacucucucuagaaacagcugucuuugguuccauugcacuccucagccuugugugguugagcacacauugcugcauccaccucuucaacacaagaguaagucacaaaaccagaguuuguggaacauuuuguuugggggucucugauuaccacacaaccugugagugugcuccauuucuuaaaauguucucuaaaacuaccaucucuaguuucaaagcucagaccaccaauaaacaguuuuuuuuagcugcucuggcuccuuuggaucauggccucuuccagguugaguucaguauuaauuuuuuauuuuuagagacagggucugaccauguugcccacacuggaguacaguggguauuuggcuguucacaggugcaauuguagugcauuacagccuugaauuccugggcucaagcaagccuccuuaguaggugggacuauuggcaugcgccacugugccuaggcauuuauaucacuacauuuaagaugcggguuaccacuuagccaugccuacagugguauuucugaaucuuaguaaaccuuaguuuugaaagaaguuuuagauagcauuuaccauuuuaaaauaaaugauacaguuccugcugauuuugcccaggcuaaacucagauguggggaguaaguauuuuuagaaaaugaaaaaaggaaaagaaaaaccucuuccuccuaguuagcaaagcuuucuauaagcugaagauuccacaguuuaaagaagucaugaggaguaaagauaaacauuuucuaaaaguccaguuugaaugacugcauuuauuuauuuugcccuauuuacuccagugaaacugauguauauaacuguaagaauaauuuaauuggaaggguaucuuaaguagaguuauuuaaauauuugguauugucucaacuucagccauacuguccuaacaguuucugggacacaaaacuuuuuuugcgccuagggccuuuauacuugguuuucccucugcuuggaaagucaucuuaccccaccuuucaugaacccagcucuuuucauggccaagaaaaggauauuuuacaucauuuuggucucagcuuacuugccaucucuucugagggagacugcuuucccacuguacauaaagcggccuuuccguuuucugcccuuguugcuuugauuaaaucaccauuuauuuccuucauagcacuuauuaguuacuuuuccuuaguuguccaucuuuccuacuaaaaggaagguuuuaugacuuuucccauagacagggacuuugucucucuuagucaccguuauaaugucaucagcacaguaccugccucuuaaaaauauuuuaaaugaaugaauagcaguaaugcuuucaaguuccuaaagcaauauuucuuuuuagugaugcugcuucaaaagucaugguggaauugcucggaaguuacacagaggacaaugcuucccaggcucgaguugaugcccacagguaauguuaaacguuacucugaugaggguuugacagcgauguagagguaagcuacaauauuaaauuaaguaacugaaaucauguuugcaacuaccagugauccagagccauuugauaguguguauuuccuggugauucuaauguagauacuaaaauucaagguuugauauuggaagaacuguggauugaauaugaaguagcugcauggcguuuaccuggcgggggggguauugcugguauggggaugaugaucccaacccaagaauuagaaccuaaucuugggccaauugacccuaauuuuaagguuauagguggaaaguugauggcuugccaaaaauuaacccauugcuaaugaguauaagggcuuuuaacagucuuagaucuaacugguaacaagaauagaaucaguuuucuaaaucuauguaauaaggauuaugaaacuucuuuuuuuggucauugcuuuguguggaccucuacaugauaggaguugguaaaaagggaaguuggugguaaagauccuugacuuugaggucaggcugccuccauucacauucuuacuccaccucuuaaugagcacuucugaacugcuucauaguugauaaagggggcagaguaauacuguuugucuccuagguuguugugaggaauaaaugagauguaaggcaagugaagcacuuagugucuuggcaugugguucugcugcugcuuacuauuugauuaccuuggugcuuucucuccagcuauguuuuuaucuacaauuaauauauuucauuuuguuaaaacagaugaaccugauaaauguguuggccugucuuaacccaauccuguagcuuuuuuaauguuguuuauauguuuuggacuguuagauauuuugccgaauuaaguauauuuuaugaucugcaaaaacucaaugaaaagccaggauuucaaaacccugagcuuacauuuuuguucucuaauuaagguguauuguacgagcauugaaagauccaaaugcauuucuuuuugaccaccuucuuacuuuaaaaccagucaaguuuuuggaaggcgagcuuauucaugauguaaguaguuuauccuuuaaugugaaaaauguucuccuuuccuaaauuuuacauacugaagcaggacucuuuuucuuugcauuaauaaaagugacuaauggcaagauauggaaagauuaagaacuauguauucuuuuuauaucaggaacagacauauuuaggaccagcuuuucuucauccacugagcagaguccuauucuuccucccuuucuuaauuucuuuuuuuuuuuugagacugagucucacucugucaccaggcuggagugcgguggcaugaucuuggcucacugcaaccucugccucccugauuuaagcaauucuccugccucagcuuccaggagaaguagcugggauuacaggcacaugccaucaggcccagcuaauuuuuguauuuuuaguagauacagaguuuugccauguuggucuggucuccgacuccugaccccccugaccccaaaugaucugcccacuucggccucccagagugcugggauuacaggcgugagccacugugcccggcuaccucccuuucuuucaucuucucacuuacucaucauuauagacuuagauaauacaaguuucuuuuuuauuacauauauauuguuccuagccccacuuaggaauauaagucugauauuuaaaaacacaugaacauuuuucaaaugcaaguauaaauauauuuuggacuguugugcaucuggacuaugccauuagccaucaucuuucaguguggauaauuuagagcucaguguauuuacugauuauuucauuuuaaaagugagccaugugaaagcagaugguuugguaauuugaugaaacagaaugauauuucugccuugaacaaaauguaggagucaguaucuuuaaaauaauauuuacaauaucuuagaauaucuuacaauaaaucugaauucuguauugaugguaucuuuuuugucucuuaucuguauagcuuuuaaccauuuuugugagugcuaaauuggcaucauaugucaaguuuuaucagaauaauaaagacuucauugauucacuugguaaguuuugggguuuauucuuugaggcacagaggugggaacaugauacacuaacaguuauguacuauguguuccagcaaguauggcuguggccuuauuuguagauuauccuaaaaggagucguguaugauagaacagcacaaaaauagguagacaguuuaaaauauuacuuagaaugaauugagaaucagaaaccaagaagguguaggagguggcauuugugauagaaagagaaugaaacugggaguaugaaaacaacucggggcccagcgcgguggcuuagagguauaaucccagcacuuuggaggccgaggcgggcggaucacgaggucaggaggucgagaccaucuuggcugacuaacauggugaaacccugucucuacuaaaaauacaaaaaauuagccgggcgcgguggcgggugcccguagucccagcuacuugagaggcugaggcaggagaauagcuugaacccgggagauggaggcggagguugcagugagccaagacugugccacugcacuccagccucggcaacagagcaagagucugucucaaaaaaaaaaaaaaaaaaaagaaagaaaagaaaacaacuuagcacuuguaaucccagcacuuugggaggaugagguggguggaucacuugaggucaggaguucaagaccagccuggccaacauggcaaaaccccauuucuacuaaaaauacaaaaauuagugggcaugguggcacauaccuguagugccaacuacucaggagccuuaggcaagagaaccacuugaacccgggaggcagagguugcagugaguucagaucacacugcugcacuccagccuggaugacagagugaggcuccaucucaaaaaacaaaaaaaaaagagagagaaaaugacuuggaaccuuuuugucucauuuaagagcuugcugaacuuuaggcccuuccagcucuucuguaccaugauucuuugagguaaaguuauaucaacaaucggguguuuggagaagauugaagaaauaguuccauugguacauuuguuuuuaaaauuuagagauggaggagugagcagaaaagcaacugaaagaauuaccauuacuuugaucauaaugguaacuuucagaaauguuuuaagagcugauaaaauuugaugauuaaagguacuuuauuaagcuaaacauuauucuuaaaauaauauuguuucuuuguagaagacuuuauuccuuagauauauggugauuuguauuuuuggucccuuuuuuuaagccauagccacagaaugguaacaaauaguuuuuuccccccuacuauacuauuuuaugcuuggauacccccgccauuaacaaauuacaaaaguauauaguauugccaguuagaucugaaagauggaauuagaaauggaaauguaauuuuacaugauaguaagacuuuucuaacuacguuuguugaaaacagcauagucuuuauuauuuuuaucuuugaauuuucuugucuagcguaucaguucaguaaauguuugucaaauugaaucaaaucuuauucauccuuauugagcaaacccuacauauguucaauauuuuaauuuccuucuggagcauguuuuuaacauacuaaaauacaaagagaaaacucagaaaaucugcaguugaacagguuuuaaauguuguaaacuaccaguuucuuuacacuggagucaacugugaaacuaaggugcuuuguucuccuacuaggcaauaaucaaaacacauuagagauugauuauauuuuccauauuaagacugaauuuuuuuuuguuuuugagacuagucuuccugguucuugacgauacagaugaauguauggucuauuuugauagucuucaauuugguaaucauuaaugcuugucaccuguaaauugugugccuccauuggaauuggggaagauugacuuauucugaacauaauaaggcauuugaaauacaccaagauaaaguagauguaaguguguuuguguagaaagcuuugccaggugcacuagacccagaaaaccacauucugucccaguuaauuuguuuuguggcaugaagcuaugugauggaauguuaaugucagcaaccucuuuauuuacgcaccaaggaaaaaggaguaguaauuaacacuuugacacucccccauugauguguaauugacuguuucaaaggagcacugguucauaagcuauugcaugcauuaaaacuggguuuucuauauugcagcauuuuaagacaggggucagugacaaugcagaaauugcucaaugaugcacuuuuuuuauuacugcauuaagguuuugacauauuaguaaugaauaaauguuuccauaaaauuagauuuuuuauaacuuuaaaauugaaauaugacacaguacacugugacuuccucuuugaugguaguauuuuaguuuuaugaaacaaagcacagcuuccuacaaagucuuuaacucauacuucacugccuuaguaguuugauuuuucagaacaagaguccuaaggguuuuaaguuugguucuuuguuacuuuaaacaucaauuuaaaguguuuuuagaugcaaguuuucacauguaaaauagauaacgguuuuauggaauucagccuagaaauaaucuucauuccucugauaaguuuuuucauuuaugguaagauuguaacugcagaaaagauaagcaguaaaauagauuuaauuucaggaguauuuaaaauaauagaaauuucagaaguuucuaucacuuuauauugaaagagaguugucuguccaugccaauagaacugagaauguuaaggaauuuuugaaaaaaaucuuuaauacuuauucauugauaagaaaaaauucguuaacauugcuaauuuauugugccagcuagaauucaaauuccuucauuugccuuacguuucuugaacaucuaugcaaaucaguauucuauuagaaauuuguuuauaugcuuuucagaaaacaucuuuauauuaauguguauauuuuuuauuuuaauucuauaauuaaacauuuauuacagcugaaagccuagugacaacuaucuagauuccacaaguugcaaucaguuugucagaacauuuuccuuuauuaacacugacaacuuaggccaacaguagcauuaucuugugucaacugaauugcccuaacauguccacauguaaucugguguuauccaguugcuaccuuuugcuucagaaaguuaaucggcaucuaauuugcauuguuaauuaggguuaaugugcacuaauugauuucuuggcgccuguagauuuccauuaaacccaguuagcaauacuuccuuguauaccucauucauuugaguuauggugaucauguuuuuguugaaucugugccaaauaggaagccuguaucauaauuacagcuaauuaacagaugaucauguccuauguuaaugggcuucccuaaucuuccacuaauauaugaauguuauaaauuuaaaauuuauuuauggaguguuuagagagugaacuuuuuaaacaauacagacuugaagcucugaauuuauuacagggcacuugauugaucauuugcugauuuuacauaguucaaaaguucagagaaaaggaacauguaaaucuagauuaguuuuagaaacuuaguuuuauaauuaauaaguuagcaucaaaacaaguauauaugauauuauguuagaauucugcuccuacuuaggacuagguuauauauuuaggauuccuaauuuuuaaaauuucuagcccuuuauuuuagaaaugaaccuauucuaggccuagcacugcuauuuuuugacuauaaguccccauuuaaucucuuugcuccucaguuuuguuuuuaaagugaaaggaucaggacuggguaauuccuuaaguuuucuucuaggccuaacacauuguuguuauuugaauaauuacaacagcauguuucauuagaaauuauaaugcaaaauuugaauuauuugugcaauuuucuacuuuugucuuauaaagaacaaguaucacuuuuaaugguauucuuuaauuauaucuaguacuaacuguauuggccuauaaauguuaaaugacacacacacuuugacaguuuugguuuguaaguaguuuugauuuuuaaauagugaccugaagcaaaauggaauguuuucauaacugaaaauguuugugaaaguauuuuaaaacuucagguuuaccaguaauaguaacacagaaaaaacuaauaaguagauaagaaauccucuguguuuaaaugaagagcuauuagugugaaaaauaagcuuagguaauuuaacuaaauagaaauuguucuuaugaaauguacuuuguagauuuuaucuccuaaaauguauaacuauuuaaaaauguaaaaugugcaaaacuuuuagggucuaaaaauaaucauuuuauggccgauucuuaacuuugaaucuaucaccuaugguacuauagaaaaauuguuuuuaauacucuguggagucaguuuauaguuugcaaauauaagaagcuuugucaaaauuguucuauauaagugcucaaacaauaauuuccacaauuacaaaaguaaaaauaauuuccacagcuuaacaugagauguaauugugcaggucuuuaauuaguaugaacacucaucaggcuucacuauucuguuuucuaggccuguuacaugaacagaauauggcaaaaaugagacuacuuacuuuuaugggaauggcaguagaaaauaaggaaauuucuuuugacacaaugcagcaagaacuucagauuggagcugaugauguugaagcauuuguuauugacgguaaggcagacagaacauuuucauuuauuucuagaauuucucaucuacuacauggaucauaguaagauuuuuaucuggaaacugagccuuacacaacaaagauuuguuuauagcagauguguauuuaguagauuaguggauauauuuguuguagggugaaaauuuaguagaaauauaaacugcuauauucuaucccuugaaaucacguagaacaaagacguuuaggcaauacaccacugugguuaagagcacagauuuuaguauuagauguggauuuaagaccaggcccuuccuuugugaaacaggaauguagggguucauuugugguuguaagaauuaaaugaauuaauacagguaaagcacagugccuggcacauaguaagugaucuuucaaguguuaaccauuaccaguuuuuuuaugauuagccuagaaacaagaacuucuuccccaacaauuagauuauaaagcaacuuaacugcucaggaauuuuuucugagcuuuuuaaauuugaaaguugggauuaugcaauuaagauuaauaaaagguacagaacuauugaccuuuuuuccccuaaugcucuaaguuuucuaugaagaaguaauaacuuaguaggaaauuaguuuauuccccuauaugagaugguaggggaagaacaccuagcauucuuuaaaaaaaaaaaaaaaaaaaaaacagcaaaaaacuguaugcaguauuuauuuaauauagauugucccagcagccauaggacaaaugcaugaccuuucuuuugguugccccauacuguuuugcuuauuagauuuaaacaguguauaauguuggaaaacaguauaaaguuuuauuauggcuuacuuggucacaguuuucauaccuuagcuauuuuucuuggaaauuuuccauauaacauacgauauaaaacaucuuuuuucagccguaagaacuaaaauggucuacugcaaaauugaucagacccagagaaaaguaguugucagguaagauauuuaaugcuuugcagcauuuuauagaacgauuuaguuuguuccgauuauuucacuuaaauguuuagagaaccaaggugguguuaucacuugacuguaguuaaauaguugcuauuuaucauaauuuuauuaaaguucagacugaaugugauuagcuuauuuaaugaaagaguccuauuuuccagcacauuucauuuaauggcugagcauuggcuagaauacuaaugacuuuuaugucugcuuuauauaguugcucaggagaauuagaaggcuuaggaucaauaugguaaagauuuuuuuuaaauaauuauguaauucuuaaauucucuuacuauucuaaauuagguauauuuaaucuugcuuuuaacuggauucaaaucuguaguauuauaaaagaauaccagaggcuaaaagguugacuaacacuguguuuaauuuuucaauuuuuagucauagcacacaucggacauuuggaaaacagcaguggcaacaacuguaugacacacuuaaugccuggaaacaaaaucugaacaaagugaaaaacagccuuuugagucuuucugauaccugaguuuuuaugcuuauaauuuuuguucuuugaaaaaaaagcccuaaaucauaguaaaacauuauaaacuaaaa

SEQ ID NO: 12659 - RNA, 76715 nt, Homo sapiens
ugccagugacagucuguguuuuggggcaggauagaaacuaaccugcuucaguuaccugacauucuagcaaacuuauuaggaacacaaacgcucgggucucugaaugcaccaaccugagcgccggcugauuaggcauuguaaagcaguguucuaaaaggaaaggccuucacuuaaacagugcuacaacguguuuguucagcuuucuuucauacacaaacuuuugccagaaaaggcguuuuaagccgaggguaaagauuuugugcguccaccguucccaucuucaacucuuuagaauaauagucauuuaagcaccggaccugucuucagauucuuacuuugcgacacagcuuuggccggacuuggcuugaucugggcuccaggaucggucccaccacccgggcucggagcgguuuguuccuaguggaucagggcggguguguugccggagucgccuucuauuggcuacacucccggggacuggcugggcuuuccgacaccugauugggcggaacagcccucuguacgccgacaucauuggagggcgcuggagccagggggcggagcggguuccccaggauucuugaccgggcgcgcuaguccguccgcugagccgggcgcggggcgcaagagcggagcugcgcgagccgcugcggagggaagggcuccuagccaauuggggucuuugaggcgaaugcgaggcuggggccgguugccuaccggccgcuucucgccgaggcaguccagacuuuucccccggcggugcccgcuccaagacagcaucugucaacgcuccucuucuccccuccuccuccugccgggccgggcuccgccggcugcggccgagaggacgcgggacccggcgcggugagcccaucagcugucaggcgagcggcgaagcggcuggagggcggcgagagacacacaaagaacgcggugggcggcggcggcgaaaggggacggcaacuccuccccgcgcccgccggugccaccgccggccgugcuuguuccgaggccgcgcagacaaugcggccgggcucguccccgcgugccccagagugcggagcgcccgcgcucccccgaccccaacuugaccgucucccggcucgcccagcccccucccgggguaggggcgcccccucccuccgguggccggcgaaggaagucgguccgcggccgcagaucccggcaacuugcgaaccgggaaaaguuugcggcgccuccgcggggcggcgcgacgcggcccgccccucgcguccgcggucaucgcgggugacuuucucgacucgucgucagccggggccgcagcgcggccgguggggacugcggggcgggccggaguccguccgagggcucccgcaccucgggcugcgggugagucggcuuuaggcgccgugggcucaagugguuuagggcaccugggcuugggaagaagucguggagagagccuuuaauacuuuauggagcuggcggggagaacaaauaaaauugcgguagcuugaagggcacugacaugccacugacuugggaaccguauccgugggaacucuucgggugccggcgcgaccaagggccugugcgcggcugggugggagauggaaagguuagaaggucgcggacuagcccugccugcgacuggcucagcuugaccuuggaccagugacuuuaccacuuagauuuuucucguggguaauauguggggccacagcaacguggucuaugcugucguccaguuuuuagacuacaucuccguuuuugagauuuuccuagggccucaacacggugcgcgaguuaucaagcgauaggccaggauauguuuacaugcgccuggauucaccuuucagccuacucagaaguaacuuuuaagucugauguuuuaaaacacuaacauuuaaaggcuuuccuucacuauccauugcuuauuuuacgaaccuuaggauugucguauuuugcugcaccauuuggaauccuaggggccaggguggggacagagagccaagucugagggugaaguggcaggugcccccgggcgaucccugccggauccaguugagggggagaacaaagcauuuauuaugcauaagagagagugaacagggcagguguuuguguuuuuguuuucuguauuauacugaaaacuuuuuuugguugggggggugcgggcaguggaggaggggacaaagaagaaaaagaaaugucaaaaaagagaggaaaaugucacuuauacccaaaguaaaucuuaaaacuaauguaagucuuccuuacaggaacagcaacacauaaugcaaguacaucuugaucuaauuuuaaugaaggauugaaaauagcuacuguguucaguauuacugacgccaaggcagcucacuuacauaaucuucuuuguugagauguguuaguggcauguauaauuuugauaaauaauuaauguuaaagguuuaguccggcaaugguauugaaauauugucgucacagauuguauugcaagacaaugguguguaaacuuuugguuaucaugauaaccugcauuuuuuucucuaaacaguaaaaucacacauuuuucauaaccaaaauucucuuaaauaaugcauguguacuuugucaguaguguauacaggagaaauuauuuuguucuguaaaugacaaagucuuucaguuuucucaccauuucaugagagugaauucuagauuucagguacuccacugggcauuuucucuucauggagcuuauagcaacaaaaguguuuuacaaaaguaagugcauaaguauagauacucaaccaauauuugcugaauaaaauacucagaugacaauaauuaaaaguccaucuuguucauccuuaaagagaaugaugaucaugcuuuaguggagagaaugaaaguaucaaagaaagaacuggcagaaaaacagagcuuaguuccaguaucuagccuaaauguuuaugcuuuaaaacagguauacgcauuugaaaagagacaaagacaagugauaggguuucuaggagaaagauagcaguauugauuuaacguaguacauuuuaugaccuaguuuuguuugaagaacacgaacguuuguaaagguauauuucuuaaauaaucaguagcuguuugcauugugauuggaugucuaauuaaauggccuaaucguaaccauaauaucucacuugaaugcuguuuuuaaauucauuuuuaaaauagcuugaaauaaaccaauuuaguuacaugaaggaaaguauaccuuuugaaaucaaaauccacagugaggaaaaauuauugucaguguaucaccaaauguaaauuaagcacuggaaguagcaucuugccaagaaggucuucacucuagacaaucacuuuguguagaagagguauaauguggaauguggacugcagugagagaugcccuuauuccucugagggucuauuuggugacaucaggaaaauacuaacgcccccccaccacuucaccauuuguaaaccuggcaacuucuggaaagccuaguggccuuauuucaaaguaaccacucaaccuagaacuuagcauugauauuugaacaggcuauuuuuguagaauauggguucuccucugugcagauuugcuggcugggcuaucuuguaagagaucacagcaguuuaucucagaguguaguccuuagaucaccugugucagaaucaccuguagugcuuacaaaacuucaaaauccugggcacaucccacauuuacauaaucagaaugucugugaacagaaccuagaauuucuguucauaaaacccauuuaugccuaguguuccauuauuggaaugcugagcuugugggaguuauuuauauccuacggcucgaggucauugccaaggucugauuuuucgcaaaaaaaugugcaaccucuggcauaaauggguuaaugaacuccuucagaagugagaguuaauuacacuaaauuuuaagaauuaguguuagaguuuucuugccacaguuguaaugcucauguugcuuucuuccaggaacauuaaaaucuccccagaugcucacugcucugaucauuuccccuacagcaccagacauguuggcaucaucucuuaguugggccauguggccagggaacccuucaugaaaccaccucugcagguaaaucaacauagaauauaccaccuacaagcagaguuaaggcugcuuugggacacaaggcucaagagaccacaguucacagaccccuccuacuagugggauacucccaccauccuccuuaaccuguuggugauuugugggaguggcagucccagcguucuguucaacuagggauauaccguuucaagcaaaugauuggaaauggacccuaagggacggaugaccugagagagaacagacaagaaugguggauggagggcugucccuucaacauccuucaagccucagauuucaaaaacuuuaguccuaaagcagauaauuuggcaagcaaguguggcuaagcccaggcaccucuguucuugguugucaaaacuuuaaucuacaaacucauauaauggcuccuauaaucucuaucuauaaaugcccaacaugugagaauuuucaagcuuaucaguuaaaaaaaggucggggggcagugauuguuuagaagagagguucaaagcauagguugaggagucaaccaguccugauugcaauccuaguuuugccauuuacugcuuggguggcuucaaccuacauccuugacucuaaguuuguuuccuuacuugaaaaaugaggauaauaguacugccucauaggaguuguuuuguaaauuauguaagauuauaaauuaaaacaucagcuaauaaaucacacgguauauauuuaauauauguagcuuuuaauuuauuauaauaacuuuuucaaauuuccuuuuuaguccuggagaguugcuguagaagaaggaaaagagaggaagacaacacaacacaggaggggauaaguaccucuggacacaauggaaguaguaguuguugagcagagggaaagggauaggagaaggauguggacugcagugcugcagugccagguaauaacuuugaucauguaccuccuuggcucaggugcugucucuucuacucuccuccuuacuuguacuaccuuauuuagcacuuaauuauauacuuucuugacucacuuugagacacacugauuauguggucugccucaaagacagaauccuaguuuuggauuuuagcauuacugaucuauagccuugcaggggcuuaaggauggcagcugucucucucccuugggaucuagcuuuugcaaauauugaagggaagagauuucuuugaucuuauaggaauagauccacaguuccucuccagauuugcuuuuauagagaagugugugucaccaaaacaauggagauacggucagagaggccccuacccccagaauuuuaauauaauuuuacuuucuggggcauuuauucuugacaaauacuuucucuccuaucagcucacuuguuccucacaaaaacccuauaagauauuaauauuauuaaacagaccccuaugaagcaccucaagucuuucucucuucccacuuccauucuugcacaccuuuugcuagacuagucucugcguucaucacaucagguuucuaaaauaaaaguccccuaauaacuuucuauuuguucucucaucauauugaaccuuuuuugccuggcuuauaagguggccuuaaaaccccauuuuccucuaaacauugucucuguaguucaggaauauggcaggcucaacacuaugcuugagcccauauugcuucccucauuagugaugccuccucucagaccacccagauucuacucauucuucaauuuccagcuucuccuuggagccuucccagaucauuagcuucuuaaaaaucccagcuuucucugaauucugaugguagcccccguuauuuggacaauuauguccuggucuuaaaguccuaaugggaaaaaaaaguacaugauggacuucauguagagaagaaagcacuggacugaguuuuaagacagcugcuaaggagcugugugagccaaaccagguuacuuuaccucucuggaucuauauuugcugaucuguuaaguggagacaauugggucagauaaucuugguggucuuugcuuauucugagguucuuggacaacuuggccuaguucacgugggaugggauugaagaucuuacugaguucuuggauggaaaugucaguaaugggcacuuagugccuucaggacuuguucuauacuaucccagaaauuucugaugcuaaacuuggcaauuuuuaaaugucauauuccuuuucuccaaacucuuuaaccacaagaauucagggaagguuauggggggugacuuaguuaucuggauaauacauauuguggacaauauagcauuauccuugggaaugauuucauauuguugaauaaauaggaucaacuucuugauaaaccuuagucccaagcauuucaucuucauuggauaguguuacauaguaauauauuuauguuuucuuuuaaucauuucauaacuuggaaaauacuaacauagucaaaacucuaggguaggugauacaugaguuucuguaguaaucugguuggagacauguuguaauucuguauauauauguacauuuaucccaugcauguuaugccuaaacuaagacggauaccccugaauuaagaggugcuguuauacauugaccaggcuuaagaauaucucuuuaaagugugucgacauuuaauugaccuuuggaaguucauucuguuaaucauacucaaagugcuaaagcuaugguugacugcucugguguuuuuauauucauucgugcuuuagcauauaaauucuucagcauaauugcuacuuauuuagcaagaguuuccuuuauuugaaaaugugaguugugcuuguauuuuugugucuuucuuucuuucuuucuuuuuuuaaacuuugcuucaggcuggguagugguagagguuugaauuaaaauguuuuccugucaguaguuguaugagguguggcuucuuaaucuagaaguaauggaaauuucuugcuuaaaugaagugcacuuuucuuccugcagaaguuagaacucuuuuagacaagcuuaacacuucaaaacuguauaucuuuaacagaaacuuuuggaaauuuuuaaauuccauuuguguagauuaaaaauaucaaugcuaauacuuucuauuaaauaaggauuuaucuauuuucauaaaaccucuaauuauauuccuugaauugcuaugaguagaauuuuguuguaaacacaauauuuuuaaaaagucaaauauauuuuaaaaaucuuaacauuauauuacuauaacuuagagaacagguguuuacauguuuaaaauuuucuaggccuuaaauuugugaaaucagucuuucagaaguuauuuuuaauauaguuaucuguguuacagguuuauaaguugacauuucaauuuaaaauuuuuucaauuuauauuucaaugaccaggaaaaaauaguuaaacuuauuccuaaauuuuaauagaaaaauaaaaaaccacauaguuguuaauuucugguaauuuaucuugagacuccaggcauguuuuuagaacauuuuuaccuuaaaagcaauuuugaaauagggaaauuaaaguuuaaagcagaguuuucacuuuaaugagguaauuuuauacuucccagauagguaggcccauauucaagaacacucugaucucuguuuauaguaaguuuugaugccauuauaucauuuacuuauucacgcauuauaagcauaguagauagccccauugucacgaagcuggcauuauuuucuugucugucauucaauauuguccccuuuuuuuuuucuguuuucaucauagccguccuuuucauuuuauuguagcccugacucgaaaugaaaguaaguuugaacucuuaaaaaagaguuccucaaacucuuuuuuaagaauauacagugaaaugucuuaaauaauauuaucuaaauaauaccuaaagaaugcaaaugacuugcaaugcugaauagucagacacaggauguuccaugcuaaggguagacucauauuuccacuuuauaaaaugugguuucagaaaacaaauagauguguuucuuccuuaauaauuaguguuucaggaccaaaguugacuaaauauggaaguuuaagauaaaacccgguuucuuagggaaucuuucucaguccuuaguaauucuguagaauugaugauagaguggcaacuucaauacacucaguauucuuuucuguuugaagucuguuuugccauuggaaaaaacuuauuguuguuugaauuuggguauauguauucacagaugguuuacuuuauuuuuauuuuguuuaaacaaauacuuucaugucccaaacacugagacauguuucauguccuaaacacuuuauaaauauuagaauauuuaauccccuuaacucuguaguuauaauuaucuucauuuuacaauugagaaaacuaagauacgacguuuuauuuaaugguaacgccuuaaguaaggggagagugauaaguguaagcagaguggaaaacuuaguagugcuaaggagcaacagaaguaugugcaagaguuugggaagaugugucugcuuggaaaggaucagggacucagcugggaucagucuuaaagagcaacauguccucauuccucaauuuuaagccuuugggcucuagaaguaaagggcaaacuuagaggaggcacuccucagguuucagcugccuguuccggccuggugagguggcuguacuggcucauguguuucucauagggcuacaugagccuuuaugucuuaccuccuccucauuucuuggcugacuccugcuuuuuuggaggguuuaacuucucucucagcuagaagguuaggcauugcaaauaccaguggauaauuuuuuucuuagcuuuaaccccagcccauuucaacccccucuuugcccuuuguauauucuuuugaaaauaugauccaguaguguuuaugaauguguguuguguaaaauuuagagauugauguuaaacaacagaauuaaaggacaaagcugucuuuuuuguuggaauuggggaugggagagcagcucaaagugggaaauauggagaaaggagagacauuguggaaaagaagagauaaauugaggggaaaaaaagaggaugaaaaaaugaagagagagaauuacugaugugcuucacacccacaccuccucuccaacuucacaguaacagaggcaaugucacuaucuuuuaccugacaagugcuuuaccagggaguugugccuggcaucgugggaguggaaaauuuuucccuuuugcauuuugagacuugggugugcugcuuuaagaugccacugguaucuaaguaauguuuguuuauacuggauauuuuucucuguagccuuuguggauuggacuuauaauauaaacaauauuguuagcagaacugcagguacucuauugcuauguuuauuuuauuaguuaaaaaacuaccagagcccuaggacuucugagcacauuuagaaaauaccagaggcaauuuuaagacuagcauuagaaagaaagaaaagaauaagaauaaaacuaagacuugcauaccuuagaauccuaaccaauguggugauuuuuaaaaauuaauguuucagagacucuaaauuaggguaguugguuucaucaauuacauuuuuuaaguuaauauaaagugcuuuuguauguaaauucucuuaauagauaauuuagguaaaaugaaaguguggcauuuuuuguuccauagaauguaaaacuaacgucagaauaagaauucuuuugggaauuuaggauuuuuuugaugcuucucaaaucaucuguaaugacuuuuauuuauagaaaagguagauuauucauuaguuuuuaugaaaaacacucaguuuaaauagccggguaugguggcgcauggcuguagucccagcuacucaggaggcugggcacgagaauugcuugaaccugugaggcagagguugcagugagccaagaucgcaccacugcacuccagccugguccagagugagauuccgucucgaacaaaacaaaacaaaaauauugagcuaaucuaaaugguaaaaaucuagauuugaagaaauuuauuuuaaaauaguuguucauuugucaaauagaaaaguaugaucuuagcagguuugguuagaucccuaucugaaacaaaguaaacuaaagauguuuuucuugaucaaugcauagcaauaacugcuguucaaacaugugaggaaucaccaguaaauugggggauagaaagcaggaaaaggagcuuuuuucucuuauuuuuuuucauuuaucaguuuuucccauuuguccauccuuuccuauaaucauggaaauuuuuauuuuuuacacuccucuccccauuuuuuuauccuagauugccaccacaccaagguuuucuagaguuaggcagaaagagaaccugggccuagaugcuaauggaaacuaucccaugcuuucucagacucucuuuccuccccagagacaagaggagcaaaacaggaguugauggcucauugcuguugcuucuguggcugcccuguuugguugaccugagcuuuuuuuaaaaaccuccacucuugacgcuuaacucuaugaauaaaauuagggccagucacacuguauuuucaucaucaguuaucccuagugauucaaauuuagcacaaaccugcugugaguacauauuaauuaggugaauacaguagaaugcaaucauaacaugagucuuuuaauaacuauucuuuguuugauuuuuauuuuagaaguuugaaguuauuuuguugaaaaucuagaaaaucuuuaugugagcaacugagguucggguagcccacaacaguuuaaaucaaacauuaacuugcaguaaaacacuacugaaagugucuuugauuuugaggugcagagagcuguuucaaguuaaguugcuauauuagucuguucucaugcugcuaauaaagacauaccugcaaccgggcaauuuauuaaaaaaaaaaagagguuuaauugacugacaguuccacauggcuggggaggccucaccgucauggugaaagagcaagggaugucuuacaugguggcaggcaagaaguuugugcagaggaacuccuguuuauaaaaccaccagaucucaugagacuuacucacuaccaggagaacaggaugcgggaaaccaccucggugauucaguuaucugcaccuggccccacccuugacacauguugauuauuacaauucaaggugagauuuggguagguacacagccaaaccauaucagcugcccauucuccugugcagugacauaaaggucugauaaccugauuuaaagcuuggacucuaagauuuuuuuuuuucuuuuuuugagucagguuaucucugucgcucaagcuggaguucaguggcaugaacagggcucauugcagccucaaccuuccagguucaagugauucucuugccucaaccuccugaguaucuggggcuacaggcaugugccaccgugccaggcuaauauuuuuauuuuuauuuuuguaaagauggggucucacuucugggcucaagcaaucuuuccucagccucccaaagugcugggauuauaggugcgagccacugcacccugcuguaaagaauuucauaucccuguuuucggugugcugugucacuguuugccauggguaaagguauaugaaucucuuuuauuuugcugcuugcaacccaauucccaugccaaacccaauuuguauccaaacaaacaauauuggagacaaguucuucuauagaaagcuucauaagccaguuacugacuacugugucuguaaauauacucaaacuauuuuguagucuugcuauuuuaaaaaaugugugggugugggaagugauguugaaugaauucaggguaauuggugguucuuuguauuaggaaaacucacuaguuaagggaagucuguuuucaugauucauguauguuuaacuuaaaaaaaaauucuuccauccuucucuccaguuuccacucuaccucauaaauucaaguaaugaaggaauuuaaauaauagaauuuuauaacugaaaggauuuuggagagaaucuauuaacccuccuacuacaguugaggaaauagauguccagugaggucaaaugagaucauguagcuaguuuaaaaacccaaauaacauuuuaguaguuuguuuccauuaguaaacacuguucuguuugauuugcccuaacauguucauaaucagagucauaauaaggaaaaaucacuaauaugugugugguacuuucuugugcauaccucagucacuucucaaaagaggucuguaaggugucgguauccugguuuccauucagggagagaacagucuaugagccuaagagaccugucugugccagucacuaucagaacagucuaaugcuaugugucuuccuaccuuggcaaaagcauuggcuggucucuggacaguucucauagaccacaggauugggcaggggggagccacaucuucauguuagggcucuaaccuguaccaauuauuaacuguugucucuauuucaucauuucuuaaagggaaaaaaaagcacuuuuuaaagagcaugagauuuuaaauuuuucaaaagaaggaugcuggaucauuauaaguaaggcauguuuuaaagaucuucuuaucaacagcuuaaaaauuagccaguauauacugaacauccacuguauaaaaagcacauuauggggugcuccaguagguacagcagugaucgagacagaaucauagccuucagggaagagguauaugcaauguucucuccuuccaaagauuaccuagauagagaacuguucauaagaaauaucuugguacugucuacauuacucuugagauauaaaauauauauuauuucuuacgucugaaaugagucaguuguuucuaaaacaauuuguauuaaaguauucacauuaaaaauuuguaaaauacagaaaaguagagagaaaaaaucaugaauuuuuaacaugguaaugauuauaucaguuucguucuuggcguuucuuuaacuugaugggauagcuaauguuuuuugucauugcauagcuuuguaaacuuguccuaaggauuauauaauuucagcaugaguuaguuucuaaguaugucagaaaucuagcuuuuuugugguaauuguuguuuuacacaaaaugauuaauaaaagacucuaaacuaaccuuggcuuuagaaaugcuuuuuaaauuuuaaaauagugaaugaguagcagauuacuuucuaguauuucuuuaaggucaccaaaaucacuuaacuugcuuaaaauauugauggaaauaucaacuacguacaguugaccuaaauuagaaauggguguuuuuuaaauagugaaauuuauaaauauaauauguauauuuuaaaauacaguuuauauuauagaguuauguuccucuguaauaauuucucuuuacacugaaucauguucaguuuuuauuaugcagauaauuuaaucuuacagcuuugaucuuuuuuaaaaaauaaaacagccauuuggagucuaaauucagccaugugauuauuacaaugaaauucaucuuaaaucuaccuaaugucccuuuagauauaagaccuauuucaauagaagggcguuucuugguuaggguugcucuucccgagaggagucuccuggagcaggagccccuggggaggagugaacugagccagcagguggucuaagggaggugccagggaacugcugacagugacuugccugaaggaagggagggagcaggaugggagugggguggaaagucccuuauuagccuggaggcugggaugcccugacccucuggaaucccccucccuuguaagaaugccagccaaaguaggaaggaggagcuccagccagaugggggucccagugcaggaggaagauaguagggugaccacaaccaaaaaagcugucugacaggcuuugagaucucuugucugaggaacuccggcauagauaguaagucaguauucacuuagaggagaguuuggcaagugaauauauaugaugaaugaaugaguaacugaaugaacugcuuuaucaccaaaggaucuggauauuuguuucuacucucaaacauuuuuugauuuguuaacuuuuuaugcccaauuuuaaaagaaaaugcaauuuucauugaacuaugauugacuacuucauauuuauugaaacccacacccuccaguacuccacaaaugauucagaaaagcuuacaauaaaaaaaaucagaauagaaaagugaguaacggaugugauuucaauucuccaagccuguuguccuuaucugugaugguaaugauuauagaugccuuaucuugcuguggcagggaugaaaugagaucaugugcaggcauuauuugucauacaacaaauacauaguugagguuguauuaaaauuaaggcuuuaaacuugaguacauacacuuuugcuuaauucucaauuuauuuuucauuaccauuuuaucagagaaugauauuuaagcgauacucauuucuagaguagaagagauuuuauuccuuauaacuguaaacucuauacuauccaagauaauacucuucuuccuagaauuugaauucguuaacaaucuuucacauuuucacaauccaugggaaaucacucccaguaaaugcuuacagcauucguccacuuucaugaggcaaggaguagguaggucuguauuuguauuaauuacaaagaaauucaagggaagguucaucauuaucaucguuagcaggaaauauaaugaauuagaagcccuugaauuggacuaaaagaguguggaguauguguaaaagaaugaaucagagaagguaaagauuaauuuuaaagggcagaauuuuguuuguacauuuaggucacuucaauuucagaucaguucuauguaugcuuucuagaaaagauaucaaagaccaccuagauuucuugccuuuagguguguuuuaccaaaggaacaagacagaagaugaaugccaaaacuauuaaugcagcuacccuggacacuaagcccccaaagagauggaggauuggaggauguagagccugggcacuggguccagugcugacauggaacauguucauucuuagaguuucacugcaaacacuccaaggauagagagcgagaagguuauguggacaugagaggagaaggguggaagaggauugaaugguucaggguagcuaaaaaaaauuuuuacacuuuaucucgggcugcuucuaaacccuccaccagaaagaauuaauccugcaagcacuuaaaacaaaacugaugugaggaagauaauaaaaccuguccaggguacagacauccagauuugcaauuuagggugggaagacuuuagagaccuugucuaacagggcuaaagaguauccuuaugguuuuaaaguagguacauuguuuuuuguaagcauuucuaggguuauauaagacaaaucagagucugauguauugaacacaauuggaucuuauucugccauauuuguuuuuaauucacgauuuuuaaauggauuuacuggucauauuucucaggucauggcaagauuuuuuagucuuaaacuuauuuagcucaguccuucuagaucaaugguucucugcccugaagguguagcaaaauuguuugauagcuuuugcaaaauuuacauacccagcagccuccccaucagcugaauaagaauugcaauguggauguggcagaggcaaucagguaugugggguuagaagaagcuguccuggucauucuguugccacccucucacuuggagaauugcugauccaaugaauuccuuaacauaacuuugaaaacacagcguuuugcucagaacuucaugaauaaacaucaaauuuucacuaaacaaaauaauuaaagaccauaagaucuuaguuauaauacuucauaaauggaaaagcacuuuauugccuguauguaugugggcuccucuuuuagcaagauaugagcuaggugaagucuaugugaaagcuaaagcagauuuauuccagucagaugccagacaauuuuaccaguuuaacugagacucauuauuacuuaaacuacaugcuuguuuuuuugguuacugaguaguauaggucccacuuggaucagcaauucucaaagugagaggguggcaauagaauuauuuaaguaauuauuuguuauuugagguuguuugcuuaguauuuacuugucacuguuuuacauguuauuuaauaauuuacaguuauuuaaaagugguaagauuccaaggcaaguaggggaccugucacuuugagaaaaauuuauggugguaaaaauauuuucuuuuuguaaagagucacugauauacaauguccccccaggguguaagccuugguauuuaucuauuuuaauuaaagaguacucugccugucuagucguggcuaacuuaaaagaaguggguaucuuggugagaaguucacaagguugguagccauagcugaguuugguggauugacucaagcucuagucagcagugguauaugaaugccaaguacuaagaauuucuggaauguagaauugcacagcacugauaaaguuugcuuuguuccccugugugacuugacccauugagaaaacugguucccuaggaaguuuuaauaguucaaaguccuuaguuaauaaagaaaaaggccacaacauaauucagcuuguuuucaccugcugacucaaagauuaacuuuuuuaaccuuaaugggauagaguuacccuuugcuuugagaaaguaauuuauggaguucuucauauuuguuaguuucaguaaacaugaugcuuuuuguguggauuuuauuuuuguuucggguuugagaucacaaacuacuaagacuuacacaauuuaagaaccuuacgguaacuucaucuaaaaacaaaucucagggaaaggcacacccacuuuucuguaucaacuuaaucuuucacuagauucagaaugguuuugaauuacuucaggaaaguagugacugauagagcuuaaccuucaguuuuccucauuuauuuucauaagagaaugggaguggaauucaaaacauucaaauuuggaguuaaugugcgucacuguugugagugauagguucuguguuuuuccagugggaaacuuugauccacauacugauauaugccuguguuauaccucguuauucuuuucuguuuuucuccugauuguugcuuacucuuucaaaaaucagcugacuguacaaguccucucugggagcagacuuuagagcaaaagugaucuauaaaagcagcauguaagucuuuuuuuuuuuugucagaguuuauaacuuuccaaguagaccuuuuauauuuucacgguagucuaaguucacucaacugcaguauuugauguuaaauguacgcuuuacgcuguuaagauaauuuaguuucuguguuuggucacuuuugcuuaaaggauuguaauuacauaaugcauguugaaaucauauuaaguaaccuggccacuugccuauuuacuucuuguggcuaacaauaaugaaugaaaccauuuauauauguuguuuuaguauaucacaaaauuuuauagaaacuagaagcucggugaugaauaauagacauccaugagccuucuuauuuguuuugaauuugagacauuuucuagaauauugcuguuugaaugaggcuucaguacuuuacagaaucguugccugcacaucuuggaaacacuugcugggauuacuucuucagguuaacccaacagaaggcuaaagaagguauauugcuguugacagugagcgacuguaaacauccucgacuggaagcugugaagccacagaugggcuuucagucggauguuugcagcugccuacugccucggacuucaaggggcuacuuuaggagcaauuaucuuguuuacuaaaacugaauaccuugcuaucucuuugauacauuuuuacaaagcugaauuaaaaugguauaaauuaaaucacuuuaaaaccaugucuguacauuuuuagagggcuucagcagggcauugaggaggugcucuguguaugcauagaauuugcaauaucaaaaagaaaguauucguaagagaaaugaggaaauguguuacaguauuuuuauuuuuuuuaaaagcguaguagggcaauauuucccagaaaaaucuaugaagugauuuguuuuguccugcccuuucugcaguuucaaaauagguguuuuuuagacccauucacaaaaaaaaaauccauuaaugaaaccacaauuauuugggggaaaaaaguaagaugaaggguuaguuauuuucacauuacuuggauuaaaccccuuuuauuuccuuauaggcuuaguguuuaaguaauaaaguagcagcucucagcuuaauaaagugucuaaaacaaacaaauacugauucaacuaacucuauuauuugaaaaaccuauucuuguuucagaugauuagaauaguauuuuaggaauuuguggauacuguuuccauuugguugaacuuuuaacuuagcuuuaugcaauaacucauaucucuuaaaaauaauaaauacaucaaauucuauccuaaauauaugaagacaauuuuaagauucagaauccuguagaagauuucugugauggacauaauuucuaauuuuccuuuuuuguaaaugcguauuuuucuuauggcggauauuuuuaauauuauacacuuaaauagaaauauuuaaguguauaagagaaauauuuaaguguauaauagaaauauuaaggauacacuuauauagaaacuagacacuuuaaaaagauaugaaagugauaucuuuuguccucuaaaacacaguauuuuauaaauauauaguguuuccauuaauguaaaagaguuucuuuucccuguuuaauacccauugaugaugaugauaaagaagugauacuaaaacaguaugaucauaccacuauuuaaaauaguagcauuucuucuaauaccugggauggagagaaauauguguuagaaaugucuuuaaguuucccucauacauaaagcuaucaaaacucuauuagucaugcugggccaugagagguucaucaacugccacugaaaugcaaggggcuuggagaggccucugccaggcccugggucuggaacugagaauguggucuauuuuaauugguaagcugaaaaccccuggagcaaauaacucggcuguuuuucuggggucacccgaccguauuuccuagguaaaugacuauagguuugaagaaaugguuaaacuuuuccuaaaucuuugaccuucacuuucuuuagguucucuuccuauguuauuuuauauccucuuccuuaccuuacugccccuaaauuuuccauuuuucauuuuuaucuguucauuuuguucauguaaauaauuaguuaugggaacuuuuuaauuuguaaaaauuacagcauuuuuaauuauuuuuaaaucaacaaauacaaaccuccauaagccauuccggguaguuucaaaauuaauaccuaguauuucuuaugucuugugccccacauuuccacaguaauaauguaaacuacuauuuuaaaguaacaucaacaguccaggcacgguggcuuacgccuguaaucccagcacuuuaggaggcugaggcagguggaucacuugaggucaggaguuugagaucaaucugaacaacauggugaaacccugucuccauuaaaaauacaaaaauuagcugggugugguggcacgugccuguaaucccagcuacugagguggcugagaauugcuugaaccugagagggagagguuguggugagccaaaauggugccacugaacuccagccugggcgacagagcgagccuaccaucucaaaaaaaauauaucuauauauauauauagauauacauauaaauaaauaaaauaacaucaacaguguguuauucauaauugaaauaagaucuggaugcaauuuuuuauuuuacaaaaaaaauaacuucuaaaguuuacaguauuauguuucuaccacuacguggacagaguuaccaugcaugugcuuagguaagauaaacuaauauuuaacauaaauuagaaacccuuacuaauugcuuucauguguuuuuuuucuuacuauaauuuuuaaaauuucacauaucagcauaauaaaauaucuauaaacuaaaacauaaaauucuuaaaauggacuguaguaagucaguuacugaaaauaaaacacugucaaaauguguuaguuaaauguaaugugaguguugcuauaaaguuaguaauguuuaaaaaauagcaccacacugaguaaucaucaaaaguauuauacauuuaguuuuuauucaugauuugccaaaauaaaaauuggcacaugcuugaaagggagauuucuaaaggaaguuaagagcuucugaaagugucaguggugaaugauuuaagugauacuuauuuuuccugaccuuaaaacucugauuugaacuugcacuccauuuuacaaugauguugucuauaaauauuacacauguaugaagccuuuccucuacuacagaauaacuaaaaccagaccagaggacuguggaggcaagggaaaugcauuugaaggccgucugcaugggaauuaguuaccuagaccugagaaaccccuuucuauuuagauuccucucagaauugcucuguuuucuuuuacuagaauuuuagcuaaacauuaccauucaaggggaaaacaaucuuuccugagugguaucaauuuuugguagcuuaauaacacuaauucaaaauugcccguuauuuuucuguaucagaagaguaacaggaaguuaauuguuuaucuuaauuuuggaagcaccuuacugaaauuuuaaagguggugcuuagugaacugucuuaacaaucucacuaaaauaauacagaagacuuucuucaugugguucuauaucauaagaaguauucuguauagauauggaagauaaauuuccuagugcguacuguaguuguuuuugugcacugccaaacaaauacauaaugaagcuguuaaaucauuugagauugaggguuuuuaugauuauuauuuuuccuccucauuuuuacaccuccuaauggccaguaaguaaaaugcaaaaaaguauccucugauuauguuuauuauuagaaauaauagucagugaauuaaauauucuuuaauagacuucuguuguaaugugcggagaagugucucgcuaauguacacuucuaaaaucucaauaugaaugugaugggcaaguuaauguugccaagcaagugaugcuaaaucugccuuuccuaauuuguauaccucauuauuauauaaccuuaauaaugcaguacuuucaggguagaggcuuuuugaugcaaauuaaaacaaaguagguuggggauucauuuagcacaaacacuaaaugugaacuuacuguccccacagacuucagugcccugaaugguuagagaaauuaaugaaggagcuccaucgggugccuuuacaacucuuaguaauaugagaaucuuuccacagcucucauuucaaaaaugauaacaugagauuucaggaugugaaguaacauauuagcaaguguguuagaaaauauaaaauauuuuacaguaugauaacauaucaucagcuuguuauucuuaauguguuuccuuguagggccugacuaccauuucugaauuuuggaauuugguauuuuuuaguaaacguuugaaaagaugaaaugcuuauaccaauagccugucagugaaggaaaauuuauguaaaagcuaaagaaaugcaguuaaauauaaaauaaauaucuuaaugccguaaaacaguagcauuugcagucauaauucccacagucaguaacaauauauuuauuuucaagaugugugauguuaaugcaauaaaaacauuguugcccuauuugaaugaagauuuauuugcacugaguauaacccugcagaaaugagucagagaauugguaaaauuugcaaauccaaacauucaacuuugaguguucauguuuugugcauaauagaucuaagcgcauaucaaagaagugauuuugcuaaauuuauuacucuuuaaucauguuagauuaaaauuaucuuuagaauuacaaucuuuaaacuauguaaugcccaccuagaaaauuuaauuuucaaacguuuguucuuuuuuauaugcuuucaaugguuuucuuggccauaucagcuauauaguugucuuucugcaauucucauucuacucuuauaccccagugaaucuauguuuggcuuaaaauaaauuuagauggucagauacugaguaagaaauuaggaaauccacacacuguuaauucauaaaaacaauaauguucauugaaauaauuaaccuuucugcacuuuaguuucuaguuugauuuuauugauuucuuauaauuugaccuaaaaucucuguguaauaaaaaauaaaucaucaugaguuauuagaaauucuaaaauuuuaagacuaauuaaaaaguaaaauucaguuuaugaaaaugcaauuuacugagagguaauuucucuguucuuuuuguauagaauagaaucuauucagguuguugguacacauguaauucuuauugacuaugugugauaugcuaauagcuaauuaaaacuacuuucauucaguuuaccaccugagacaacagaaagacuagugcuggagaaguuaggguuaaguuuagaguuagaaaacaagcucucaaggacuuguaagagcagucccauccccugaaucucaggauauggcagcucacuuugacugaaggaaauuuuaaaguccuagggugacuaacacuuuucuagcacuguugauuuucuagauuagacaagaauaagagaauaccaaugaaggcaggaugauuuuuuuucuuuauucuauuuuauuuauuuauuuauuuauuuauuuuuuugagacagagucucacucuguugcccaggcuggaguauagugacacgaucccggcucacugcaagcucugccucccagguucaagcaauucuccugccucagccuccugaguagcugggacuacaggcgugcggcaccacaccuggcuaauuuuuguauuuuuaguagagacgagguuucacuauuuuggccaggcuggucucgaacuccugacuucgugauccgcccaccuuggccucccaaagugcugguauuacagguaugagccacugcacccggccgauuuuucuuucuuucuuaugaagaaugaguaaucuguaacucaguuuuauauauuacuuuagggcuaauguguguaaguccuauacugccccucuuguagagcuuauucuaaaggggucuuuguaaucugauguaugccccaccuacugcugucccccaacacugaccacugacuuccaauuguucagacaaccuuguucuuuuccuucguaucucaaaaucuuugccucaucucuucccucugcauagauugagugcucuuauuuuauucaccucuacccccaaacacauauacccauacauacgcauacacauacaugcacauuaauacuuuaggucucaauccaauuuucauuuccucaggggaauaauucccucauucccuugucuucauccuaugggcuccuucuuuguccugagacagaagucaugaggaggagccaaccaugugcaauuuuggggaaaaaacauucaggcagaggcaacagcaagugcagaugaccagagguaucagaucaaguaaaaguuaugaaguauucugguacaaaaucagcaaaacagagucagagguaagcaaaggccagguauuguaaagccuuguaggucauagugacguuugaaauuuacuaguaggcauuagacuaguauuuguuauuaugaaauguucuuuaaauuuugaauuuaguuuaguuaaauaauaguaccucuaucauugugacugacccuaccagaauguuaguaacauuuaaaaaauaaaaaggucuccagccugggcaacagagugagacccucucucaaaauaaauaaauaaacaaauaaaagggugaacaacagcuuacuucaauaaauauugaaugccuguuuguauaaagaaugguguuagaugcugaaagaugcaaaguugaaaaaaccuugaucccugugguuacacguaagagugcaaauaugaugguauguggaccagagccccaacacuaccugaaaucagcuaccccucucugaaaaaguuccacaggaaauagaugcuaaggagcggaaaagaaaacagaauaacaucuuauuacuaaguaggacaucugcuccaagcccacuguagaaugcuaaugagccacacuggaauuauuaauuucacacuccaguaaccuagagcccuauauuggacaguucuuuuuaugacauauguugaagaagaaagauuaucugagaagauggaagagaagcaaaaguugggaccuguuccagaacacaccuuccuccuugcuuuugggaggaagaacguccccauggaagucugugcaaauggcguaacgaccaugccuacauguccuugaaccuucagcucagugcacuggccaagaaaaugucuguaaaccuaacccaucauagcaguacuccucaguguguguauuugggauacggguggagagugcagaagggguaggaagagggaggagggcaaggaaggguacuaauaugcaccuuacucccucuggaugccaauacuugucuucaggcaacuuuucuugaggugggguagaagauguaugugugaaaucaguaguaaugguguaugauguccuaaguagugcuaguaauaaugaaacucugaauggcauuuuuugaguguaugcuaucugccaggaacuguucuaggugcuuuacuuguguuagucauaauuuaauccucacaauagcucugugagguaggugccuucguaacuuuacauguacggaaacugaggcauagaaaagccaaaugacuugcucaagguuacucaguaaguggcagagaaucuaaaguaaagaauaaggugcugaagaucacaaaagaaagaacacuaagcuagaaaaguuguggaaggcauuugagcuauacuuuccucagguugaaaacaugaagauauacaaaguauguuuggauagaaauguuugagugcaaggagggugugugccauagagauugccugugcuggcuagauugcugccugauuggccccgcagcagguagcagcaagccuggaagcaauacagucagaaacugcugagagauuguggagguuuugaaaauguaguauaaaaauaucccuguaagcuuauggcaagcuacacuuuuaaauagcguugaauuauagguuaaaguuauuaugcagacauguuuugcuucccuugaaagcuggaaagcaagggacagcucucacugcaucuguaaauaggcugcugucuguuuuucuuucuuuuugugguuguaaagaaucauucaugccagcguaaugagcuucagcagcuguuaaaugaaauuauauauucuguucaacuagggccuucuaaugcugccauugucuccuggccauccuggugucuucucuagugcugagauacuucuaaaucacaauggccugaguuguuguuaguccaggagauucugagguuuggaucagacugggccugcagagugagaagcuauuuuggcaaagauagccauaaagggauguuauuuuucuauaucacagcugcccucgucagcaaggacuaugaggaaugcuagagguaaacuauucacaauuuucuaaaaagguuuuuuaaaacaaaauuauuauuuaucaaguuauauacagcaugauguuuugucuuccaaguagagaacuuaaccaaauucauagacaguuaaggcugaggguguuaaaugagacuuggcacuucucuuccuucgugauguuucuucguuccacaccugucauucuuggagcuuuguggucagcucuuguaguauaaguuugaagauuuuuaaaucucaaucuauuauugcucuaaauucagaccugaacauugagucuuuuaaaacuauuucucugaguugauuguuuuccucuagugcacucuaaaaaaugucagcuccccaugcaccaccaagaaaucacuccgcauucuggugcccccaggccccacucugggucucuggugugcaggaggcugaccucuccugggcuaugcucuguggguucugccccuuucgaugguggugggugggguuauaucaaggcacuuuuugguggaaaggaaguaauccuguuugggacuaacugcacaaguuucauugccuuggaguuaggaaacucugugcuuuuuuauggacagaauuccccucuuuccaaacacuuaauucucucuccuccuccauugaaagaagguuuagauuuuuccacaaacauuucugccauauauuuaugaaaggaaaacaaaauauuugcuaggcauuauuugaauauguaccaguuaaaaaaagaggucuguggcuuuuggguuaccaaacauaacuacuaaaaggcaaauccuggugaaguguuaauuuaaccaauuaaauuauauuuaagagucuaaacauaagggaaccagagaauaagcacaggaaacauauuuguaugaguagauauguacagauauaaauucaguuuuauauauuuucuauuucuuuacaucccugauuucuauauggaccuucuguagauggcuaguuuguuauuuauaaauuugagcuguuugcacaguagauguuacuuuaauuguguuauucuaauuaucuauuuaucuauauaucuaauuauacaucuaucugcuuuuaaaacuauagcaauauaugcaugcuuuuauaaucucuucacuuuuauaucugacuuuugaagaggaaguuaauuuugaugaacagugaugaggaaaauauccuugaagacuaaaacacugcaauaaaaagagaaaaccaugagagguuuccaugucuuggucucuguuuauauuacuaaagagauguuaaaaauaucauuuggggacuaucuuauauucuguaacuagagcauaacuaucugcugacacauaggccacuuccgaaauauugcuuaauaacacauuuucaaauacccuggugccaucucaggcaaauuaaucucugaacuaacaagagucuuuacugugcugcacagaucuucucagagauauguaauaaaugguauguauucaaggacugcugcaguaauaguauuuauguagcuuggcuagaaacauuugcucucuuaacagugggcauuuaagaugaagacugucccuggcauugugcagcacaguaggaacauuggccugcugacuaaacaaauaugauugccaaagugaauuauuaaauuccaacuggccucacuugcuagagaauuucacuccuuuuucucccacacagcuuccuacuuuuuauuaaaggaacaguuuucagcucuugcaaauaauugcaguauuuugcuagucauuacuacagcaguuucccacuguuuauauuuuaaaacuagcacuuggaugaguccuguugaagcagaacaaauaacugugugugcaucuguguaaauauuuaucgaaauuugcuuuauuaaaagucccagugaacuuuuguucuaacugcuauaccuugugucacuucugacacagucacaucaucaagcuacuguuacuuuacaaaacaugggugacuucauuucaguauuuccuucagaggacuuauuugggagacucccuuccaauagaggaaguggguugaugagugcugguguucucauuccagauccuucacaucucuggaaagcugcauccuuuguagaaaauagaucuguaugugugccaaaguauaacccugauguucaucagggcagugggaggaggucauauauuccuugucuguuugaacagugauccucccauuuggcaggacuuugagaggaaguauuuaacaaugggauuuuauaaaauuuaauguaguaaagacuguuuuuauauuugaauggaucuaaggaaguuuucuuuuucucccuccgauaagugggggguguuuaaggguaauggugucuacgaauuuauugggaggauuuggcuguuuuauuggaccuuguggaauaauuugcuuucauuuuaucauuuccaugaaagguaguccucagaagaaaaaaauguggucucuuaacuucauaccaaucuuaaauguuuugcuuaaggggaauuagugaggaaauaacagucucaggaagguugaaaacugugauuuuacucaacaaauauugcucuuuuaaucucuccagccaugccagaaacuaugaaguuauuuucuuucacacaugcacuguaagaccugguauuuuaaaaagcuuuaaauauaaguagcuuuaucuugaaaauaaaaauuguacauaguaggggaaaagauguucuuaucaucaucccuugcuuccagccacaugaugucuccaguggagcugcugacgacacaaauuucccuaagucuagcacacccagauagugucaaaugguuuguuagcaguuacugcagaaaguuagaggacaucugaggaacaaagguaaaucccuuuucuccaagaacuacuagguuuauaggucuagaaugaaagaaagguuuaggucuucauuagccagugacccaggccaucauaacacagagcaaaaguuaccucucuguguuugaaguguuugagugucugcugggaaacauaagaaggaaaaaauaauaccaccaguguacuuuuauuauauacuuuauuuagacuuuauuaauuucuagucuuuaaaacaguaacuuuaaggagauuuacuugguauaggaucaucauaacaucauaaauucuuucucuugguaggagcauuaaguuacuugguccacauccuuaucaaacaguagccccaccaauuggucaugcagaagauguuuggauauuuucugagucauaucauuacugacaucauauuuuacguauauaaaauucauccauucacuugauauuuuuugagcccuuacccacauaaauauauggcaaauaacaaugcagucucuuauuucaaggaguugauaaguuacaagaagauaaaaauggagacagugauugcaugagagaaccuguaguagaggugcuguugagaguuuuagaagggguggacggagaaggucuuuugagcuuagugugaaaaucaguucaaaaagaaaaauuugaacauacugaaacacagcagauccugggcaaauguaucaauggagcagacaacccagaaagcuaaagagcuugugcagaggauggaaguguggagaguggagcccucaggaagagcuaguggaauaugcugcccaagucagugugagaagacaaccauggaaagaaucugugacuaugggggaauaggacaucuaaaggugggcagaggaagaugcugcaaagaggcaucaaggaggguggcucaaaggagccugcagaggaggaggaagaggaaaaugaggcuggaaaugugaagggagaaagaccacagucucaacagcugugaagaccaaggaauuagccuagaacagaagaagaggugucuuuccugugaagaagaaaggaugggugaauguuagaauagauuucaucugggaagcaguaauguagaggacagaauguacuucaugaaguaggaaguaaaguaggucacaccugaaggggaugaaaauaaggaugagguggagguuuggaaaggcugcugcaagcauuuagcaaaaacaaaaacacgucggcuguggaagagacucugugcuucacugaaggccaacugagauuaaaggccacaaauuugggguggcacgcauccacuugguggcaugauuuuuuuucuagcguuacaaguucaaacauagguacaaauaagggaaaauauagugcacuggagaccccaccugaaaaggaaaugugccauuguuggguaucuaguguaccauagcuguaaagaaugacaugaugcugguauuuugguaaaguauacaaauuauacacaugccuuaucuagaagcagcagcagcucuucccucccccgcuguccccacuacauccucccaucagcacuccaaagucuuugguugugccaugaccucagaguaaucaaagcccacaaaucuggcuuggcucuguaguuuguuacaggauaucucaucucucugaccucuuaggcucauuuccuucuuuucuuaggcuuuacagauugaccuguacacuucaaugcuuaacuauauacagcagugccugauuuauuugaccccauucaggaaugagcuuauccccacaauuaaauuuuucagauacaugaauuauauuucauuuauaacuaaaacgacuaaccaaaccaaaaagacaauuucuaaaauguguauuucuauuacuugguuucucuaaagagaguaauggaccuuauuuacagcagauuauuaaugacuuaaggccaugauuccaaacaucaguuaaugggcuacaccuguggaguauaaugaacccccucugguuuuuuuuuuuuuuuuuuuuuuuuuuuuuggugguggggguugggcuuugggaauucugaaggcucauugccuugauaguugagacugucaaauugugucuuuuauuacguuguuuuguaauugcuaaucuuccuaugacuaaauaguaccuuaaaagcaaggauuaugccugauucuucucuauuccccacuuuucuguuggugcuuagaacaaugccaguaaaaguuccguaaauauuugguugauuucuaaagauagcacaauucucuuaacguuggcuaaaaccacauuagcuuuuuuuuguuuuuuguuuguuuguuuuuuuggcagacaucuguguuacucagguugggcuuagugucagaacucuuuucuuuuucacaugaauugcuguuuugccccaauuggugcuuuuuuggacuguuaccugaauugaaguagguauuuacauuuaucccuaagacuucacaaaagcuaccacugucacuuuuccccccauaggaaauuucuuagaaaugcugccuaauuagguuaauuuuagcccauugugcuaaucugucacagguuuuuuggggaucuugauucacuauuccaaaauaugcacugccuucuuuaaugucaaauuuggaaaaccuuauuuuccucuaguuuaagaugguaauacaaauuaaaauauuguauagaaaauguccaaggaaggucagagcuguaaaggcugaaucucaacgcucuccuccagguugauaaucuauagaucaucaguuucuucaguucuuuuuuuuuuuuuuuuuuuuuuuuugagauggcgucuuccucugucacccagucuggagugcaauggcacaaucuuggcucacugcaaccuccaccuccuggguucaagcaauucuccugccucagccucccgaguagcugggguuacagaugcgcgccaccaugccuggcuaauuuuuugugguuuuuuuaguagagacgggguuucaccaugcuggccaggcugaucucgaacuccugaucucaugaucugcccgccuaggccucccaaagugcugggauuacaggcgugagccaccgcgcccagcccaucaguuccuuuagagcauauuugugcagcaguugugaaaucucccuaacgguauucggauucagacuaaauuuccccacguggacaucuugagagacuuagucauauagacuuugccuaauacauuuucucugucugcccaucuagugaucagauaaaaaggggaggaaauaaaaauuaacacucuuguuaaauaaauaucugcgcaccuucucuccaagcuucucagaaaagauaaccgauaauugcugauccaagacagaggauuucagacauuuguuuguucacuuaauaaauacguauuaaguuguuacucugaaccagacccuaugcugagaguuuaggauacagcugugaacuacuuagauguagccccagaaauggccguuacugccuggcucucagagaggcugaaggguguggugagaguguaaagcagcuaauugugaguaagugguagacagacuagagcugggaaauagcauuugcagaaguggaagcuuuucaagucccugagauuguaaaaucaaauucaauguugaagucuagauggauugggaaacuaacuaauugaacuguguaacagauaaccccuaagaaacugaaguuuggaguagcuuguuuccuaaaacauuuaguacuaauagacuuuucaggccaguaauucaagcacauacuagcgagagcuuguuucacguaacugguuaacaugcuauaaaaauggcacugucaucugaaguaaaugucuuugaacuuagaacugccauauaagaauuuggacucuuugccacagagugaagaggaagcccaggagaacaaugagucaguuuuuuuuucuuuuuuucuacauugccuacauuuaauauucuuuuagagaguuuucaaagaauugcuuaugcaacaccuaucccaguauuuauacagagggagaaauugaucauuuucagaaaguccuuuauuuagguauguacuacaccugggcugacucuuauacugauuucuaaguuaauuguauccuaugcacagaucucaaaaggacugugggugaagaaacaagaucaucagcccaagaccccuauucaacccuaacuggguuccuuuuccuauuuuccagugcagcuuauccuuguaccuaaaguugaguagccccacuaggaaagauuggcagaaaggaauaguuaagcaccccuuggagcuugcugccugcaggagccuacuucuagguacucagcuucccuuccacucucuagggauccuguagaccacaguguuugugcucaacugcagaagcuucaugugagaaaaaaguuuccuuuucuccacugacauauucuuccacuuuuucuuuauauaauuuccugcuggucucuuuaauccccaggcuucuuucaaacuccuguuucucuauauaguagcuuccuguacaaauguaugucacauuuauauguggaaacuugccuaaauaaaauuaggcagaugugugaugccagauauacacauaugacucaccccgccccuccccuugcuucauuuaguuucuggucaaauaccacuuuacuaagaaaggccuuaccugaccaccaccuccaccuaaaauagcucuccuucaaauggaucauuuggcuuacugcacuuccccuugcagcaguugucaccaccugugaaauuauauaauaucuuaauuaauuguauuugacuccaugaaugccaggauaucagggacucacugcugagucucuauagccuagaacagugcugguacauagcccuuaaauucuuuuacacaaagaagaaccuauuaaauuuugucaaauaagaaacuugagguuuaucuuaaugacagaguugcuauuaucaccaccaucuguuuuaaaguugaguauacuaaaauucauagccuacucaaggucacacaaguaguaaguggagccaagcuucaaacauagaucuccugacuccauucauaugacccuauaaacugucucaaaacaaaaagauaaauuaauauaaauauuuauugaauaugucuuuguagagaaagcauaauaagcauaaagggcaaugcguuaaccuuuaucacaagcaacccuauuggaaugugucaacuuaucagaaugaaucaggccagaauaucaaguauaaaugaagccuguaguuaacugaaaguugcauaucaaucaggcacuccaguuucucuccucaaacucugaauauucaaugaauaagauaaagaaauggcuaauuugauuuuaccuuucauuuuuuugaccuaauucuaaggugacuacucacuccucaagauuuaacuaauguugcuuuauuuuuaucccucuggggagacagaagagaugauugggaaacacauguuugaaguuuguaaguucugcugcuuucaaccccacagaugucucuuacugcccacuugggcccuggugauuaagcaacuagauuuggagccagucaggcuuuuguuuagacauuuuaacuuuuucuugcuuuccuugcaaacuccucagccuucagacugguuggaaaguaaauguacaaucuuacauaaauuuucagguaauagcauuucagcuuuuuccccaagauuuuuugcuugggaggagacagauuagacuggauucggagucuugauuuugcaaagguaacaaaagacauguuuuuuuauaagacuuuucaucauaaguuuauuuuauucaacagaagcaaaaucuaauauaauggaaaaaauaaagaucugugauaaaucugaucuguguggauaaacacaauuagaaagacuuaaagauuaaguauugaaacaaacuaccaaaauauuuuaauacugauuuguaaaaauuucaguacauuuuucuucuuugcuuaauucuacuggguccuguuuuucaucaaaacauucuaucauguuaguauacaauagccaaaaaaaaaaaaaacugcauaagggaaccacccucagugcugcugaaaagaaaucauugucagaaguuguauuagaauauaaagagucucuuauucagguuucccugaauauaaucagcuaccugagaaacuuuuacauuuuugcuccuguuuuaaaagcaaagucaguuauuguguggcaagccaacaucuuugguuugaucuacuuaaaaagagcauuacaucaauuaucuaagucucaucauugugagacuaggugcuuuccucuccuuugucguaaaaauuguugaaacauugggaaaaccauaauaaaaauucgcccacaaaaaugauucacaaucuuacuauucaaagccaaguauuuugguuuuuaccuguuaccucccaguaccuguccauuuuugugcaaauguaaucauguggguaugcugaaaguaguaguuugugcuuuuuaaaaaaacguauacuauacauagacaucauauuaaucacuuaaaugacuguauuauauccacauaccacguuguaucaaauuacuguuaaaauuguuuucauuuugaugacuaauacuuccauauagcauuuugguuucuaucacuuuauuuccuuaugauaaauuaccuuaagcaaugucaccaaaucaaaagcagugaagcuaauaaaauuccauuuacugcagccgugccuacacugucuauauuauauauuaaauguugcuaauguaguaguugcaaaaugcuaacaaaaaauucaucggcuugaauuuuuaauuacaaaaaaguaguuaccucuauauuuuauuugaauuucuucuucagagauauaucacauagcccuggaagggaagcagagauucuugauuucauuuuugcauauucaaauguugauagacaaggauugauaaagacauugcaugauccccagagaauuaacuugaaauccuauauaauuccccaugaagucauaagaggcuguggaauagucagauacaucugagccuugccuacuuuuaaaauaucaaucaauguuaauaucaagcuuuuagaaccaaaauguacuuccuuucauuuauacuuucucuauguugugcauguuuacauagaugcuggaaaaaguaaaucugaguuuagaucuaacucuugggugaguuugagcaaguuuaagugucagcuuccucuucuguguggaguuauuugcaguguuaggauaauuagcacuuugcacagugcuuggaacauggaaagcacugaaaaauguuagcuauuaauauuaugaaagccugauuaaucauuaauccagaacuguuuuagcaugugguuuauucagguaauucaauggaagaacuauuuuuacauuuuaauuaguacauuuucuuuuucuaacuauuuggagaauuuauaauauucaguuuuaacaguaacugauggaauuacagcuguaaacauguuguaccagcuguguuuucugaagcaaaucuaagugauaaaagcauguuaucaucaccaaguacauauaauccuuacccacauggaggagugugcaguugguaguauaaugugguaaacaugauuuuugcccauuaugaccuuguaaaccuauaaggcaacacaaugaccaagauagagacaguugcuguuucacaagucgacaauggauaauuguaggagacuccacuuuuaaugagaagcaaacuaucauaauggaaaauagccagauagauuaaagcuuaagccauugagguugaaugguguaccucuuauggauagcauauaguugugucuagcuuuuauauacagcuuggccccaacaggacuuuucauuagaguguuuaguccacuuacauuuacuguaauuagugaucuagcugaauuuaguucugccacuuuacuguuuguuuucuauuuuucucauauauugcuuguuccucaguccuucuuuuccugauuucuuuuacguuaaauguuuauuuuaccauuuuaauucuguugucuuuuuaaagcuacauuucuuugcauucuucuuauaaugauuacuauagggacuauaauauguguauuuaauuuaucacaaugaaaacuauuugcgaauuaaccuugguuuuacauauauaaaucuugcaacacuaaaguucugcuuaccucccgucuauccuuuggugcuauaguugccauauacauuacaucuauauuuuuuaaaacacaaaaugcagugcuacaaguuugucuuuaagaaacuaagaacaguaugaaaaggauguuaaaauaucuggguaguuauuaaaauaaauuaucucuaaaaugaauuuuguaaucuauuauuauaauuuuacuaguuagaauuuucaauuguuauuuuuuauaucuuuaagaggugaaccgaguauagaguauagaacaagaaaaaugucaggcagucagcuggacucacuuguucccuggacgaaucuguuucaguuaaaugacagaucaccauaaucauauggaccuucagguuuucccaccaaaaggccaaacugaaaauacgaaauuccugacccauaaauaucuuacugcauuguaaaucauuuagcauucauuaaucacuauuuacaauuuuuuaaaaaaaauaaggcuugugccuuuucucaucuguuuagaauauucaguuuaguaacuguauggcaacguaaguuacugacagggaaagccuuguaagacaguacucauuuacuuaaaauguggaguuuuugcauuucuuuacaauugaauggaaaaauuaccagcagugcuuuggguuauagugacaccuggugguacgguuugagguuuuaaaaaaauucuuuuuaaauuuguuacucuuuuuuuuuucuagaccauuuuuuguaaggaaucauuuuaucaacuaggaugacaagaggccucucccauccugguugcacaucacuuucuauaacagagagacaugggccagaagcccugauggagaaagcagccaaugucccuuacauuuccaccuuuggcuugaaaaaaagaucugugcacuaaauacagggaaaaaaaaaugaaguuaggcuggaagaagaaagacauuguuacaugguaaaauuggaaagauucauaccaacaguacgggauaaagcagggguccccagccccugggccacggaacuggacugguccagggccuguuaggaacuggacugcccagcaggaggugagugguaggaaaugagcaucacagccugagcuccgccuccugucagaucagugguggcauuacauucucauaggagugccaacccuauugugaacugcacaugugagggaucuagguugcccgcuccuuaagagaauguaacuaaugcuugaugaucugagguggaauaguuucauccugaaaccauacccccacuaagcccccgcauccaugaaaaaauuguuuuccaugaaacuggucccugcugccaaaaaggcuggggaccggugguauaaaguacgucugagaauguauacuuacugagaauguaccuuuauacccuguaagauaccauaguguuuuaucauuuuauaaaagcugaggcucagagaggguucuaagaguacucaaggucacaaaguuaaucaacugucuagggaagcuagaauuucaagugaacccuaucucuaauuuggcucaagaaagaauuuaaauuuaaaugaccagauguaauuuucaaauuuguauacauguuacaugaguacauucuccuuuuaaaauauugccaauaagguugaaaucaucuuugauacccaaguucuagucccauccccuccucuuuucuccaguggugacucacacuaucguuuccagauaucccucccugucacacacgcgugcacauauacuguguuaaauacagagauggguggucgcuuaccuguguguuugauacauaauaguauuuggucaaaguaacuuuuauacugguaaaaccucuucauuggaacaauaaugccucaucaaaaucugaacucauaccacuaaguauuauuauaauaauuugguauucuauagcaguaacaguuauuuccaaagacauuccaauaugccuguaguaaauauucuagauuuaauuaaaauauuggcaggacuaccguuuuccagauuaaauuaaaaagcaauuauuagcauugcagauuaaguuuuuaaaugaauauuucaauucagcgacacuggcuagaauaucuucuguuuugucacagugucacagaucccaucaccaucacuguaaacuaaaauuagcuaacuuuuaaacauaagacccacaauuauuuauuauagcccaaaauaucagaauguucuuuagcuuauaaccuugcucauagaauauacuggggaaaggacuccaaaaauugucuauaagaaaaucuugguuuuuuuuuuuuaaaucacuuucauuggaaauccaacuguaaacucauauuguuaaaaaaguucccauaauguuaauuuuuuuggaaauuugcacacuuaaaaggaaacuaauauugauaggcagcugaaaaauauauauauucacauauauauuuugaauauauauucauauauuuucauauauaugaaugucauauauuuucauauauaugaaugucauauauuuucauauauaugaaugucauauauauuuucauauauaugaaugucauauauauuuucauauauaugaaugucauauauauuuucauauauaugaaugucauauauauuuucauauauaugaaugucauauauauuuucauauauaugaaugucauauauauuuucauauauaugaaugucauauauauuuucauauauaugaaugucauauauauuuucauauauaugaaugucauauauauuuucauauauaugaaugucauauauauuuucauauauaugaaugucauauauauuuucauauauaugaaugucauauauauuuucauauauaugaaugucauauauauuuucauauauaugaaugucauauauauuuucauaucuauuucauauauauaugaaauucauaucuauuucauauauauaugaaauucauaucuauuucauaaauauaugaaauucauaucuauuucauauauauaugaaauucauaucuauuucauauauauaugaaauucauaucuauuucauaaauauaugaaauucauaucuauuucauauauauaugaaauucauaucuauuucauauauauaugaaauucauaucuauuucauauauauaugaaauucauaucuauuuucauauauauuucauauauauuuuccauauauauauauauaaauucaucagaacaagguugucuuuuuuucuucugaccacaccaauguaaugaaacaguaagugugaaaaagaaaaaaaaaaauacaggaaucaagagcccaaagaauuuuuaaggaaaccaugauugaauagguuauaucagacugacuggucuccuaacuuugauucugcccacaccauucaauagaaagaggacauggaauuccagcuauucccuccacuauagaauuuacuacauuuuaaauuuaaacagguuaauuuaagcuacaguaauaauuugagacagaaucucaucaagcacagauucaaaguaccacacuuugaggucagaguggagagagcuuuucccuugggaugaacaugagaagguuaauuaaagaggaaguggacuuucucagagcaaaggguauuuucauaaaaccauggaaucuuugaguuggcuaaaucuccauaaauuuuaugaacauauuguguucuuuuaucuacuguaaagucacauuacuguugauuuuccauauauuuuaacuguagugaguuauucuaugcuguaauuuuccuuuaggauccaggguaaauaaaagcaaacuaguauaagaaccuuuauaaguuacuguaagugaaggaggcuuaaaauaggguguguacuguuacauuuucauuaugauuuucucauaguuuuuccuuggaaauuuccauguauuccuuaaggauguguuugucacauaugggagauuuggaucuugcuuucaacuagggaaugauaauuuuccauuaaauauccaucccauauacuaggcaaggugaaagcugaauggaagaugaaauggcaaauguuagacuaggcaagggaagggagcagguggcaaagucgcuuguggagauaugcccaaagaauaugaugcaaagaagcauccucaccagggaauuuuccuuccaucucuaaaauccaccaauguaggagaccuggagccugacuuuaagaauuaguaaagccuuggcagggugcaguggcucacaccuguaaucccagcacuuugggaggccgaggaggguggaucacaaggucaggagaucaagaccauccuggcuaacacggugaaacccugucucuacuaaaaauacaaaaaauuagucgggcguguuggcaggcgucuguagucccagcuacucgggaggcugaggcaggagaauggcgugaacccgggaggcggagcuugcagugagccgagauugccccacugcacuccagccugggcgacagagcgagauuccaucucgaacaaaaaaaaaaaaggaguaaagcccauuacugggcagggcaugagcuguagaacauccuuguauacaagauacauuaagcuuuaaaucugggaacaguguuuuuucuccagugaaucauucauggcuguaaagcugcuacauuuuaauuuuaaaaauguaaguuuuuaaauuaaaaacuuuacauacuguaaaguugcuacauuuuaauuuaaaaaaugaacauugggaguugggaaaagccacuguguauccugaaaguugauguguaauacugcagaauauuuuuaaaucaauggauaagguuuuuugauacagaaugugacagauuugaucaaauauaaucuacauuugaaauaaauguauuuucauucagaacuaaaaaugaccaaaggcuaguuuauuggagauuaguuuuaugugacuaaaaugccuauuacaucagaagcccuacugaagcaaaagagaguggcuuucacguuacaaaaggaacuuuucagacuugacuuuaagaaguuaaaaucauuucauguagcuaaaauuauuuuagugacuauuuaauaaggugugguucuuuccauguagaacauuuuaagcucuuacauaauuauucaguauugauacccacauuuuaugaccauuuucuuucauucuugucuauuuuuaaacuguuuacauagauuucuucucugcauuuacuguguauccugguuuuucuucacuugaaauccaucaugaaaauaaaauuuuaaaauaaggcugccuucauaaaagguuaacuuuccaggaguuaaugccaucauuuaaggagagauugcuuucucuucuuagcuaugaguuccuuagaaaaguaaaacagccuaaccuugaauuuugggggaauaaaaacaaaguuuuagaaacugguaaauauuuuuuauuuagagauuuuuaaaaccugaauaaucaucuuaacauuguuaacccauugucaggugguagauggcaucauucauucauucauucauucauucaucaaaccuucacugagaaccuccuuuaguaccagacaaacccuggauacauguugugaauuucuucugaugaaaugaaguuaaguuaaacgaaacaugguguuucuucccuaguagagagauggauagguaaacaaauaauuguaauaaaguaucaguucugugaucuaggcauaugcaauuaugugaccuaggcacaguauaauggugguaaaaggaaaaaugaacaauuccuccucagguugggggagggguguggguguuagggaugacgcugaccagagaggauucacaagagagaauacuugauuugggauuugaagacuguaugggcacuugccagguagaagaguaagcagaagugcagaaacagaauaaagaacagguuugugugauuuaguucuucaaguguuuucacccuuucaguugugacagaauucaguauucaaugagcauggggucauaacuuugcagcccagcccauucaaguuaucauucuuagggcucuuuccuucuccacuucucuuccuauucuuucccuccugcaugaaaggccuuaugaagcccaagccaggcuugugaauuacccaugacuucuccaucuccacagugccucuccccucagcuacucacucacugaauucugcuguucuucuugucuuuauaauuucucauauucauuuucucuguguucuuacugccucuucccuaauuaaggcucccaugcucucccuuacacuacugcagugauucuuuuccuguuuuccuuaccugccaccuuaaagcuagaguaaauucucuaaaguacugacauggucaucccacuugccugcuuacuaucuuucacucguacccaucguuuggagauaaugcccaaacccuuuaaccuggcacauaaggacucccaucuuucccuugugucucuccccuuacccuucacccacaugcaucuuugacuccaccucugcugaauucuuaaaggccucagcauacauuaccuuugucuuucuuucucuauuggaugacuguucuuucugguacacuuuaagcuacacuaucuucuucacugcccaccccuuccaaauucccauuagcaccaucuucaccuagcuaauuuuauucaggcuucaagacucagccuggcuauuagccaacucagaagugucuuuugacccaucauaacacuuauaguaaugguguaugugucugucuugcaaauuaagcuguguccuucucgaagguagggaugauacccuucauuucucaucaccuagaauuuaaaacauugcugauauauggcaggcagucacaauuguuuguugaaugaaugaaugaaugaaugaaaugaguaagauccuguaacaguuuggaauuauaugccaccuggguuuacaguguagucucuuaucagguagguuuguucugagauguauaguaaugaugacuuucuucuucgcccaaguauuuuguguaccuuagaccaguuuagcaaaugaaguccaagaacuauuugaauaagucauucuuagaaaauaacuuuaggaagcaacugacuccauucauguguaugccucuaauuguagguucacuucuguccgaauaugaauuuuuaaaauaauuuuagcauuauauuagcaauuugcaauauaccauuuuuaugcauguaaaguuguauucuaacauauuuacuuuuugcucauuugauuaaauuuauuacuguguaucccaucauuaagguaacuaauuuucaguaauuaaacuguuggucuucuguuuagccauuauucucaguucugugcaggagugagcugaaacaaaguuguauagcccagagagugagaagcugcauuucaugucucccaacagucagaaagggauuauguacuguuuaaggaaggaguuuggcgaauauuuugaaacccuuuugggaaagcauagaauauugaaaauccaaaauuaaccaaauccgugagugugcaagcucaaagcuagagaccuuaggaauaucuuaggaugugcaaaacaggaagaaaacaagaacugagcaggcagcacuaaguaagugucauauagccuccccacccacccuuccaacccuacuccuaaaagagccauaauuuagucccaaguauacuuuucugaucuuuuccugugacauauuaugguaucuucaaaugguacuggguuuccugaggcuugugcugcugacugccaaccccauccuagagagcacugagcgacagauacuguaaacauccuacacucucagcuguggaaaguaagaaagcugggagaaggcuguuuacucuuucugccuuggaagucaacuaaagagaaauggauuuugaauauuucuaugucuuagaauugauccuaucccguguuuguuucugaggucaacuguaaaaggaaaaaaggugaauugacuaagucauccaaagaaauguaagauaaucuauaauaucaguuauauuugaacuguuucacuuaguuuaaaaagaaaaaaaagauuaccaaauacccaagugacaaaaguucugguuaacuuguaugaggcuacauuuuguggguugcugcagucugaucuguaaaagcaacacauuaccuauacguuaagcuaaacauuucuccuuuaaccugagagcauuccacacugaagucugcuuuucuugaagcaaaaauucuaguguccuuggacuugcuauuuuaucagggaucaaaggcaccuuggagccccaugcuuuaggaauuguaauggcaaacaauaaggucugcucuuuaaagcuagaauauaguuacacauuucaggaaaaaauagaauuguuguuggaggacgggagaggaaggaaaauguagagguaagggaugggaugcaagaaguuaauuuuaagaaaaaucuacagaacgaacucauaaguucagccuuaaccagaaaaacucuuucauguaaaucguuuaaaucaaaggucuauuaaacaucuaaucuagaauguaacuuaccugaaauuugaguccauugcugauuuauuuaaaauuauuaugaaauaagccuucuuguuaaagagaauauuuaaauaaggcauauuuuuauauaacaagcccuuaagaaguuaaauaauuaacuuaaugcuucuauuaaaaauuaaacaaaucugaacaaaauuacucuagucuuggcauaucagcauauaucagucauuuaaacuaaaagacacucuacuacuuuagaaguauuagaggagcuuuuaauuuuaccuccgcacugacuguagagccuaauacaauaggaguaauuguuucauaugaguuuauagaaaaaaaguuuaaauacaaugacuuuagcaugugauuucagggaaguauuugaacaggcuggccuugaagcagugguagacacuguugaagugccagcuugauugagucauuuaccuuuuuagguuugccuacaggcuuaagaaaacccucuuugaaacaaugcucuacagucuucucaaagaaauaauuguuauagauguuugaaauuuugcuuucugcuaggagaggcagauaauauggguaaggggaaaagcaacucuaagcagcagagaaugaugcauaugcuuugccauagcauuuuauuauucugccuaaauuaaaaggggggacauucaaauauuccagaucuaaauuuaugguuaacuuuuagucaugaauguagguguuucaaagcuuauugaaauacaugcugaaauucauucaucauucaagaauuauuuauugagcaucuacuaugugaacuucuaggcacaggggauauagcagagaacagaaacaaaguccuuuuucucauggaacuuacaagaaaauauauaaugugucaaaauauaaacaucuuguguaucuauguaaaauaucuaauuuuauucaaucuuuuuauugccuuguccuccaaaaccaaguguauuuaaauauuccagaauauuucuuucauugacuauggaaaacuuugauauaaagcuauauaauuuugguuuuuguuuaguauuauucuucuagauauguucuaguuguuaacuagccuguuuugugacaugaguaaguaggauuauuaagcaugcuugagaaguuauauauauauauuuauauauuuauauauuuauauauauuuauauauauuuauauauauauuuauauauauuuuuauauauauuuauauauauuuauauauauauuuauauauauuuauauauauuuauauauauauuuauauauauuuacauauauuuauauauuuacauauauuuauauauauuuauauauauuuauauauguuuauauauauuuauauauguauuuauauauauaaauauauauaugagggggcuucaaaauauucauggaaacauugaguuaaaagcuacaaauaaaaaauauaaauuuuauuucucagaguaagcuccaucagggucaagacacuuuuguaagcaaugauaccagacauuuauuccaucccuaaagaacagggucuugggaauuucaccacaucagugccaucuuuuuaacauuauuaacugaagaaaaaugagugcucugacagauuuuuuuaagauuaggaaacaaaaguccaaaugagccaaaucaggacaguaagguggaugccuagugacauuccacugaaacucuggcaaaauugcccuuguuugaugagaagaaugagcagaagcauugucaugguggagagggagucugguauagcuuuccuggacauuuuucugcuaaaccuuuggcuagcuuuccccaaacacucucauaauaaguagauguuaucauucuuuggccuuucagaaaguuaacaagcaaaaagacuuaagcaucccaaaaaacuguugccaugaccuuagcucuugacugcuuggcuuuucuuugacugcaccacauccccuucuugguagccauuacuuugauugugcuuugucuucaggaucauaccaguaaagcuguguuucaucuccuaucacaauccuucaaagaaaagcuuuaagaccuugaucucacuuguguaaaauuuccacugaaagcucugcucuugucugcagcucaucugagugcaaugauuuuggcaccuauagaguggaaaguuugcucaacuuuaauuuugcagucagaauuguguaagcugaaccaguuggaaugucuguggcguuggcuaugguuuguacuguuaaucaucaguacucuucaauuagggcacaaacaagauuuuuuuuuuccuugcaaauugauguaguuugucuucuauagugggcuucaucuucaacaucaucucaucuuuucuuaaaauaaauuauucauuuguaaacugccaauuucuuuggggcauugcccccacuaacauuuuguaaagcagcaaugauuuccugauuuucccacccaaacuuccccauaaauuugauguucuugcuuuaauuuuagcagaauugacauugcucugauaagggcucuuuucaaacugauuucuuauccuuuuuugugccucaaaauagauccuguucagacauguuacaaauuaguacaaguuuauuuugauauaagaaaaaauugaaauccauguauaguuuuuccauaauauguauuuuccaugaacuuuuugaaauucuucguauuugcugagaugauauugcuaaggaguuauauaauauaaaaaguuacauguuuguguguuuauauauguugcauauguuauauauauucaaauuaucauuguaucugauacaaguaaacauauuaauuugaaccuaacucuauucaaguuuguaacucucuaaauacugguaaggaugauuuaucuuuauguuauguuuauauauugguugcuaagcaaacgccauaaagacuuuaaaagaacagauuacuuuuaaauguaaacauccauuuauauuugaaaaaagacauaagcuuuaauugacaagcuuuguaagccuaauugugucauuaaaaacucaguagaaauaaagguaucauauguacuuuauucauuuaugaauuuauagucuccuugucucuauuuguucgaauuaguaauucuuuauaauaccuaguggugauauauuucuauaaacuacucuggcuuagauuucuauaaauguaaauauaauucugcucucucucucuuuuuuuuuuuuuuuuugagacagagucacgcucuugucgcccaggcuggagugcgauggcgugaucucaccucacugcaaccucccccucccggcuucaagcaauucuuccgccucagccucccaaauagcugggacuacaggcgcccgccaccaugcccggcuaauuuugguauuuuuaguagagacgggguuucaccauguuggccaggcuggucucaaacuccugaccucagaugauccaccugccuuggccucccaaacugcugggauuacagccaugagccacugcucccggccugcugucaucauuuuaaaauagcagaaagcagguuauuaauuacaaaauuggguuuuagguguuauuuugguuaacuuuaucauuggaaaacuauaugguuaauauauaaaaaucaguuguauaucuauauaucagcaacaaacaaauaaaaaugaaaauuuuuaaaagauacuucuuauaauaacauuaaaaacuaucaaaugcccaaggggaaaucuaacagacgaugcauaagaccuccgcacuggaaacuaaauauuauugagauaaauuauagaagaccugaauaaauggagagauaaaccauguucauagagaacaggacucaguauuguuaaguggcuaauucuccccaaguugaucuguagauucaguacagucccaaucaaaauguaagcagguguauguuuggaaauuaauaaacugauucuaaaauuuagaauucaaacagcaaaagcuagacaagauaaucuugaaaaaaagauggagaaauuaugcuuccacauaucaagaucuguuacaaagccauaguaaugaugagagugugauauuggcacaauggcagacagauacacaacagauaaaugauaaauagaauagacacacuauuaugauaaagaugauacugaaguacacuggagacaggauggucuauggauccuaauacgaaagguaaaacaaggcuucuaggaaguaauauauagaauauccuuaugaccuuggagugggcaaaauucccuuaaaaaacucccaacacaacaccaaccagaaagagaaaaaacugguaauuuggauuauaauaccaagaacuucuguucaucaaaagacaacauuaagaaaaugaaaaggcaaaauauaccagaggagguauuagcaacacauauaacaaacaacuuauauccaguauauauaaagaauuccuauaaauuaauuagaaaacacaagcaacccaguagaaaaaugagcaaagauuugaacagauaauucaccagagaggauauguagaugaucaauuaacauaaaaaguugcucaaccuuauuagucaucaaauaagugcaaaugaaaucacagcucaauggcaagacacaacuacuagaauggguaaaauuaaaaagacaaaaaaaucugguauuggcaaggagguggaguaacacugcagaugaaagcauaaguugguacagccacuuuagagaacuucuuaguggucucuacuuacgcugaacagauccauauccugugacccaguugcuguuaccuaccucacagaaauuugcacaguguucuucagaagaaaugaauaagaauguucauagcagcacuauuuguaauagccccaaaucaggaauuauccaaaugccaacaguaggauucguaaauugugaaauauucguacaacagaauacuaucuagcacugagaaugaaugauuugcaacuucugauauaagugcaucucacaaacauaaaguuggacaaaauaaaccagacacugaagagaacauaccguauguuucuauuuacauuaauuucaaaaacaggcaaaacuauaguuaucuauggugauacauaucuauggugacucaugcacuuuucugauuguauguuauacuuuaauuaaaaguuucuaaaauuaaaaaaaaaaacgcuguauuaucuggucuuaaauaaggcagguaaaacucuuauuccagcagucacuaagagaaacuuuaucccagaucaucuuucucuaaaaacauagcaacagcacauaucuugaggaacguucucugaaacuggcauaaaagauuacgcuauccauaagcaaagagacguuucagcaaacauucucuuuucuccaaaauacugcaguguauacugucuucuagaacaucacuucccucaaaagcuaccaguccaccucauuuucuggcaaguaacgaaauuacugaaagaugaggagaaaaaaggcugauguuaaagggcauucggcuguugccauguugcugcauugccucacuuacccacguuguaagaaagaggucaaaacacgguuaacuggcuuacccaggguuauauaggcucucgguagagccgcaggaggacugaaggagacacugccagcuucugacucugauucuuuaaucuuuucuauagucagguaacccaggauugggacagaaaaacauaagcccucuacuaucauauuuguugaauguaagauuuccucagaaucaagaauaugaauagauuaugcacuuacuguucauauuuuuaauuucuagaauggcuauuaugauuaguuuuugcuuuuucuuuggacaaaagaauuuuguggugcuaaaagugucuuuuaaaauuuccuuuuauuauggagaaaaaaaaaagcuuuguccggacaccgguggcucaaaccccuaaucccagcacuuugggaggccaaggcgggaggauuucuugagccccggaguucaggaccagccugggcaacauagugagaccuugucucuacaaaaaaugagaaaugaggcagguggaucucuugagccugggagaucgaggcuacaaugagcugugauugugccacugcauucccacuugggugacagugagaucuugccccccccaaaaaaaagaaagaaagaaaaaguuucaaccagccugaacuaagaaacuuuaaaaauauucaacccaaacucaaaaaccgugauuccuucagcaaggcacguaugcuaacaaaguccccuugaagcgucucuucuggagacaguacagucccacaguaguguuuagaaaugugugcagugugcaggcauuuuugcuugucacaguaacugcagaaugccacuccuaugaggcuuggaauagucucauucaacaagaaauaguuuugaacaaaauaacagugcccucaccaggaugaacauucuuaaaguuaucauuuacuucuaggaauauuugaacuauacauacauuuaugucuucaguuuaacacaucucuguaguauacuaguuugcaugucugagauaaauaugauggucuggaugaucuuaaccacaauuaaagaauaaaaaauuaccuuaaaacugacuuuuuaaaugcccugugacuuuaaagugucuagaaacauucuguaauuuugaauucaucaaaagcuuugucaucaaaaagccaaguauggcuuuaaaauacuucuuuuuggcccagggagaaaaauacuuuuuauuuuaaccuccaaguuucaucgaguagauuaguuauuucuguaguuugguaaugcccauuauuugagaaucugauaacauccaggacuucaccauauaauucagucacuugaaagccgugaauuucuggcuguacuaaaaagcuuucaacacuaggguuagguguuccuaugaagacaaauaaaauuccacauuuuuaaaaaccaccuuuggccgggcgugguggcuaacgccuguaaaaucccagcacucugggaggcuaaggugggcagaucacgaggucaggagaucgagaccauccuggcuaacauggugaaacccugucucuacuaaaaaaaaaaaaauacaaaaaauuagccaggcaugauggugggcgccuguagucccagcuauucgggaggcugaggcaggagaauggggugaaccugggaggcggagcuugcagugaguggagauccugccauugcacuccagccugggugacagagcaagacuccgucucaaaaaaauaaaaaaaugaaaauaaauauauaauaaaaaccaccuuugaauuuaaaaauaguuuuaauguuggagcuagcccaguuguaugagugugcugaagaagccagucucugcuugccuuccuauagcuccaauuagacauuuuuaauuacagugcaaucgcugcaacuauucugggccauuucaacccaucccacuccacgaauacucagcucagucuuagcauuggacaucaguagcaagcaacuagaugcucccaccucaggaagcuucuaauuuuguggggacuaccccuguugugcuuauugcuaaacuuauacuucagugaaccuuucaauucuacauaauauauuccaacucauuuuguggaaucugauuuuuuuuuuuuuuugcugacuuuccuuucacagguauuuaguaagucaaugacgggcagcagcaagccaggcuucuauuauaguaauaauaaucagauaaccaauaaucacugaggauucuguacauuccaaagccaugccaggggucaagagcaaauacuuaguguccuuacuauguacagggcacuauucuaaacauuuggcuuauauuaacagauuuaauccucacaguucaauaugcaugaacauuauuuuucagaugaggaaucugagaugaaagagauuaagaaaacugcccaagguuaugcuaacgagccuuaaaacugggauuucagccuaggcaguguggcaccagaggucugaucaugaccaugaagugauaaacacaaguauccucuaaguuagguaucaucgucuuaauuuuccagggcaggaaacugaaguugaaggauuuaagaaaaugugguaguaacuggaguuguuuaugaaucuucccguucuccucuggcacaugagaagauugugauacaggauuuuuugcuccuuaguuuagcuaaauccaguucuugucuuacaaccaggaaaaauuaggcacacagagacaucgaagacugaggaggauggaauuuauuaagugaaaagaaagcucccaacaaagagagggguccuucaugcagguuuccaccucacaaaaauugaauggcaggccaccacacgugaguugaagaggccaggcucuuuccccucauaauucaugaauuccugguggcuccacccauucuccuagugguuguggggcaugcccagacaagcccccugugcuggcucccauaucugcacaaagcaucugguguaaagacuugugggucggguuggagauguggcuguguccugccucuaucaauugcacuucucuacaucuucugagguuagguguggcugugugacuuguuuucaucaaugaaaugugaacagaagagccagggaaguauuaagagcuugugugcccuuccuucuguguuggugagagguuuuucaagacggaggcuuugucaccuugauccuugagugacuagacuggauagugccccucugcugacugcuguuggacacauugguuaauugauaaacuucugagauucaaggcaggguuggaggaaggagacuauuuguaaccacacguaaucuugucuaacuuaauuugccuaaauaucuuucacacacucuuaagcuuguuggugccagguauuuaucuggaaucgagggcucucugacuuaacaauccaugguuuuuucauuuauuuccucucuuuugguaucauaugaccugcaggaacccaaauuucauucuuuugcuugccuuuuaauuuuaugauaguaaugaaagugccuaaaaaauucaaucugaugucuaugguuagucuaagauuaagauuaagaaaauguagaggaaaaaucugucauucucuggccuacauguuuggucuggagcuuuaauaugaugaucugcaggauuaggagaaauuuuccuggcuugcuuaaucccgagauucaaguucuagcaaacaaccgucagcaauaauguuagcuaaagaaugcuaauauguccuaaauguuacucauauuucucacugugcuuauaguuuucauggugugagcugcuacaagaguucacccuuuuuuagguugucacucagacauucuguaaaguaauuccaucauccauauauauauauauauauauauauauauauauauauauauauauauauauguauguauguuacugaaacgccauggguucaucuggguccugccgcuugcugcacagaaagccagugacugagacgaagaguacugccaaggaagaaggcuuuaaucugaugcugcagccaaggagaugggagcucagucccaaauccaucucccugaccaacuaaaacuagggguuuauauagcagggucuucccugcuauguaacaauguguaagaaaacaagaacuagagaggagggguaacgaagcaaucaugaugaaugaagggucuggcaucucauugucuggauguggugaucuggugaguuucaguucuuuaauuuucuuuuucuuuugagaggucugaaugugguuuccugaggaaggaacucugauaaaacaaauguaaguuucaaauuuuaaaaccagaugggcaauuucuauguuuauccaaaaaaaacugucuaggggacuauugggucgguuucauauauauauaaaaucacuuuauguacacaacaccaaauuauccggguucauauguuuaaauuuagaauuguggggauuucccaaucuaccagcugaguaugcucaacagguuagcuggauagcauugacuaucaugacagugaacaacagagaaucacaugcaacucugagucuuuccugaggaguaucuuccugaaacuaaaugaauagaagauucugagaaccuugcuuuuuccauuauuugauuauggaaugaccuauggggcaauacauguucauguaauauggaaaaaacaaaaagaaggcuuuaaccgcuuaauuagcaggccuaauuuuuuagaguugggauucucucuuucuuuuacuugcugaaaauugacuguuugguuacuuucacuuuauaaguuuacuuuauucauuuaaucacaaaauuccuaagcauucagugacucauaaaguagauuauuuguuuauaauccugccucauucuagaaaugacuaaaggcaauaaaguuauguuuaaccuuggcaaauauugguuaaaugauacuaagcuaacuuuuuugggaugaacuauacagugaauagauuauguaggauugggauguuuuuauuuuaauuuagaaauaauuauagauuuauaggaaguugcaaaaauuguuuggagagauccuauguaccuuucacccagguucccccaguggucacauuuuacaacauuugcuacagcacaguagcaagaccaggaaacugacauugguacaauuguguguguguguguguguguguguguguguguguguguaguucuacaccauguuauuacaugcauagauucuuguaaccaccacugcaguuaauauacaaauuaguauacagauuacuuuugcuauaucauuuuuuucuaaaaucuaaagacaugaaacuuuuuugaaucuuaaagggaugaagcccuucuuggugacuugaacagcaucaucauuuucuguugguaauaacaacuagcaaauaaagcuuagaugaaacuuacacuccuguguaaaguguagcucuuccaguagguccuguguuuagucuaauaucuacuuaauuacaguaaguguucaggcuuuuuguuguucuauuuguuuugcgagcagggauuugauauaaaucuaaauacgacaagcuuucguuaaaaaaaauauugaccuuccauuuagaacaauguggucuuucacuguauugagcuuauguggauguauauuacuguagaagaauuuuacaggagauaaauuccuaugaaauauucucauugcuaucuuaauuagaaauaaucuuuuuaugcccccacuguaggugguaagucccccauguucagugaauauacuugcgauuaggucauagucuauuauuaggaacauacaggcagccaacuggcaaauggauuguuauccugccuaaggagaagagaaaaaaauuaagguaaaauuaaaaugccaauacaugcugagaaagagcuaauagaaagcaugugacauuauguacacuggugauacucaaaugaaacaauggaaccuauuaaaagguaccuauguggauuuuauucuuugagaaauggacuaggguaggggguagaaaggcagggaaagaaugaagacaguguauugaaagagaagauuguuugacccauuuaucugaaauaaaaauccuaaguuuuauaagauccucaaauauuuggcuacauuuucagguagaugugcaugcauaaauguuaaauggcuaaaagaaaauggguuauagucuaccaauagugugucacauagcuuuaaaaguacugcuuuaaaaaucaucaauuuagagggaggauuuggguggcaagcaacaggacucugcuuucaauccuguccuacaccacauuuuaauuuuuauuaaaaugaaaacauuguuggaauuaugauuuauuuuuuaaaagaagcaaacaguguuacaguagaugaaucaagguccaagugaaaucucagcagccugaaaggaugggcaggguuggauacaaagaaauugaauugguauaaauauggaaguccagcuccuggagucagacagcuaauugcacaaggacuucaugggggacaugugacuuaccaucacauguggaaaaagacuugugaauuuuccuaaccacuaccuauguggcccacagagugacaugauguuccaaaaaacgaauacaaccuguaugcgaucguagacacauacaccacaccccaaaacaugcuacacaggauauaauuuucaaaguaggacaacaaacugccuacuuuauuuuaaguuggcauuuuccaaguaguucuguguucauuacugcacaauagagguauaaguaaagcagggcaugucuaaaacaauguggccauuugaugaagggcacucgaaaauguaugauugagccaaucacagauacugaggaaacuugaggccaggauuuugaggcugcagugugcuacgauugugccugugaaugaccacugcauuucagcgugggaaacauggcaaaaccucaucucuuaaaaaaaauuaaauuaaaaauguauuauggaaaaccauggugcauugcugucuucaauaauaaaggacuagagcaaggauagaggcuuagauuuaaacuuuguuugcuccaacccuugaagauacauagaagcagaauucaauacaacauaauuuuuagccauauuuagagaauccaaaaaugaagcaggcucauuuggaggcagugagucccuuauuacuggaaauauucgagcaggaauuucaguagccacugagcaauggaaauguuaguuucuucaacccugaaauuuuauuaaauguguaucagcaaaucgcagguguaccacuuaccucauucuugaguagcacuuaacuucuaugggccucaguuuucucucauuuaauggacugaggggugauaauaacuuacaaagcuguuagaaaaauuaaaaugaaguuaaagaacaauacagggccagcgugguggcccacgccuguaaucccagcacuuugggaggucgaggcgggugaaucauaaggucaggaguuuaagaccagccuggccaagaugaugaaaccccaucucuacuaaaacuacaaaaauuagcuggaugcaguggcagacaacuguaaucccagcuacucaggaggcugaggcaggagacucauuugaacccagguggcagauguugcagugacccaagauugugccacugcacuccagccugggugacagagugagagccugucucaaaaaacaaaaaacaaaacaaaaaaaaaacaguaacaguauccugauuccaaaucuccuccucacaucccucaaauaaacauaagauccacaaggagaacaaaugaaacuauacaggaccuaagaauuaaggauuguuaagagauagaaaacacugcaacccugaugacaccuugauuucaacauugugaaaccagagcagaaaaccaagcaagccaacuuaaccucugaccuacaggaacauacaaguauuacaugaagaccaacaugaagaaaacuaccgacucugcugagaccacaaacuccugguacaaacaugaaaugaaugcaugugauacguucuggacaaauaauugauuacacuguguauuagucuguucucaugcugcuaauuaaagacauaccugagacuggauaauuuauaaaggaaaaaaguuuuaaugaacucauaguuccacguagcuggggaggccucacaaucaugguggaaggugaaagacacgucuuacgugguggcaggcaagagggaauaagagccaagugaaaggggaaaccccugcuaaagccaucagaucucaugagacuuacccacuaccacaagaacaacauuaugggggaacugcccccaugauuaaauugucuccuaacggauccuucccacaacacaugggaauuaggggagcuacaauucaagaugagauuuggauggagacacauccaaaccauaucccaccaaaguuaauuuaguuuuaaaaaaauaggugagaaaacaauagguaaaaacagucaagaagguuuugacaaaauuauauugaaggagacaagccauacccagauauugaaaaguucuucaaaguuacaauaauuaaaaugacacaguguugacucagguauagacaaacacauuagugaaauggaaaagagagccuacaaauaaaaucauguauaugauauagauagcuauaaaccaauagauaaagaauaaacuauuugauaaauaguacuaggacaguugauuaacuacugggggaaaauguuagaucuuuauauuauauugcaaaguaaauuguagcuagauuaaagaguuaaauauuuucaaaaggccaaauagguguauguuuaugucaucugaagauggaggagaaccuuccaagcauuagagcaauauuuuaaaauccacaagaaaauggacuaauauaaagauaauuaaaaccuuaccuaucugaauaugccaaacaaaauaugaaaacacauaauuuggggaaagaccugcaaacuuaagacacagagaggauuuauugucauaauaucugaggcauacaucauuaagauagacuuuaguagaaaaaugggaaaauaaaugcuaauucacaaaagaagacauucaaauaacuaauaaaaugcuuaaaaguuuuaacaccagaccugggcaagaugacagaauaggaacagcucucaucugcagcucccagugauaucaacacagaggcgggugauuucugcauuuacaacugagguaccuggcucaucucauugcgacugguuagacaguggguacagcccacggagggcaagcugaagcaagguggggcuuugccucacccagggagugcaaggggucggggaauucccucuccuagccaagggaagcugugagggacugugcugugagaaaugguacauuccggcucagauacuucgcuuuucccauggucuucgcaaccugcagaucaagagauucccucaggugccuacaccaccagggcccuggguuucaagcacaaaacuggguggccaucugggcagacacugagcuagcugcuguuuguuuuguuuuguuucuuuucauaccccaguggugccuggaacgccagcaagacagaaccguuuaccccccuggaaagggggcugaagccagggagccaagugguccagcucagcggaucccacccccacagaucccagcaagcuaagauccacuggcuugaaauucuugcugccagcacagcagucugaagucgaccuggggugcuggagcuugguggggggagggguguccaccauuacugaagcuugaguaggcaguuuuccccucacaguauaaacaaagccuccaggaaguucgaacugaguggagcccccugcagcucaacaaagcugcuguagccagacugccucucuagauuacuccucucugggcaggacaucucugaaacaaaggcugcagccccagucaggggcuuauagauaaaacucacaucucccugggacagagcaccugggggaaggggcggcugugggugcagcuucaacagacuuaaauguuucugccugcuggcucugaagagagcagcagaucucccaacauaggacucaagcucugcuaagggacagacugccuccucacguggauccaugacccccgugccucccgacugggagacaccucccagcaggggucaacagacaccucauacaggagagcucuggcuggcaucuggcggguggcccucugggacaaagcuuccagaggaaggaccaggcagcaaucuuugcuguucugcagccucugcuggugacauccagacaaacagggucuggaguuggcuuccagcaaacuccagcagaccugcagcagaggggccugacuguuugaaggaaaacuaacaaacagaaaggaagagcaucaacaucaacaaaaggauguccacacaaaaacccuaucugaaggucaccaacaucaaagaccaaagguagauaaauccaagaagauggggaaaaaccagugcaaaaaggcugaaaauaccaaaaaccaggacgccuuuucuccuccaaaggaucacaacuccuugccagcaagggaaaaaaacuagacagagaaugaguuugacgaauucacagaaguaggcuucagaagguggguaauaacaaacuccucugagcuaaaggagcauguucuaacccaaugcaaggaagcuaagaaccuugaaaaaagguuagaggaauugcuaacuagaauaaccaguuuagagaagaacauaaaugaccugauggagcugaaaaaaacagcacaagaacuucaugaagcauacacaaguaucaauagccagauuaaucaagcagaagaaaggauaucagagguugaacaugcacuuaaugaaauaaagccugaagacaaguuuacagaaaaaagaaugaaaaagaaugaacaaagcauccaagaaauaugggacuuugugaaaagaccaaaccuacauuugauugauguaccugaaagugacagggagaauggaaccaaguuggaaaacacucuucaagauauuauccaggagaacuuccccaaccuagcaaggcagaccaacauucaaauucaagaaauacagaaaacaccacaaagauacuccucgagaagagcaaccccaagacacauaauugucagauucaccaagguugaaaugaaggaaaaaauguuaagggcagccagagagaaaggucagguuacccagaaagggaagccccugagacuaacagccagucucucugcagaaacccuacaagccagaagagagugggggccaauaaucaacauucuuaaagaaaagaauuuucaacccagaauuucauauccagccaaacuaagcuucauagcaaagaagaaauaaaauccuuuacagacaagcaagugcugagauauuuuguuaccaccaggccugccuuacaagagcugcugaaggaagcacuaaauauggaaaggaaaaaccgguaccagcuacugcaaaaacauacuguaaagaccaucgacacugugaagaaacugcaucaacuaacgggcaaaauaaccagcuagcaucauaaugacaggaucaaauccacacauguaaaugggcuaaaugccccaauuaaaagacacagacuggcaaauuggauagagucaagacccauuggugugcuguauucaggagacccaacucacgugcagaaacacacuuaggcucaaaauaaagagauggaggaauaucuaccaagcaaauggaagggaaaaaaaaaaacggguugcaauccuagucucugguaaaacagacuuuaaaccaacaaagaucaaaaaagacaaugaagggcauuacauaaugguaaagggaucaaugcaacaagaagagcuaacucuucuaaauauauaugcacccaauacaggagcacccagauucauaaagcaaguucuucgagaccuacaaagagacuuagacucccacacaauaauagugggagacuuuaacaccccacugucaauauuagacagaucagcgagacagaaaauuaacaaagauauucaggacuugaacucagcucuggaccaagcggaccuaauagacaucuacagaacucuccaccccaaaucaauggaauauacauucuucucagcaccacauugcacuuauucuaaaauuaaccacauaauuggaaguaaaacacuccucagcaaaugcaaaagaauggaaaucauaacaaacagccucucagaccacagugcaaucaaauuagaacucaggauuaagaaacucacucaaaaccacacaacuacauggaaacuaaacaaagaaugacuacuggguacauaacgaaauuaaggcagaaauaaguaaguucuuugaaaccaaugagaacaaagacgugauguaccagaaucucuaggacacauuuaaagcaguauguagagggaaauuuauagcacuaaaugcccacaggagaaagcaggaaagaucuaaaaucaacacccuaacaucacaauuaaaagaacuagagaagcaagaucaaacaaauucgaaagcuagcagaagacaggaaauaacuaagaucagagcagaacugaaggagauagagacacaaaaagcccuucaaaaaauuaaugaauccaggagcugguuuuuuaaaagauuaacaaaauagauagacugcuagccagacugauuaaagaagaaaagagaagaaucaaauagacgcaauaaaaaaugauaaaggggaugucaccacuaaucccacagaaauacaaacuaccaucagagaauacuauaaacaccucuaugcaaauaaauuagaaaaucuagaagaaaugaauaaauuccccgacacauacauccucccaagacuaaaccaggaagaagucgaaucccugaauagaccaauaacaaguucugaaauugacgcaguaauuaauagccuaccaaacaaaaagagcccagaacaagauggauucacagccgaauuuuaccagggguacaaagaggagcuacuaccauuuaccagggauacaaagaggagcuaguaaaauuccaaauaacagaaaaagagggaugccucccuaacucauuuuaugaggacagcaucauccugauaccaaaaccuggcagagaaaacaaaaaaagaaaauuuuaguucaauaucccugaugaaaauugaugcgaaaauccucaauaaaauacuggcaaagcgaauccagcagcacauuaaaaaacuuauccaccacaaucaagucgucuccauuccugggaugcaagggauguguucaacauacgcaaaugaguaaacguaauucaucacauaaacagaaccaaugacaaaaaccacaugauuaucucaauagaugcagaaaaagccuucgauaaaauucaaaaccccuucaugcuaacaacucucaauaaacuagguguugauguaacguaucucaaaauaauaagagcuauuuaugacagacccacagccgauauacugagugggcaaaagcuggaagcauucccuuugaaaacuggcacaagacaaggaugcccucucucaccacuccuauucaacauaguauuggaaguucuguccguggcagucaggcgagagaaagaaauaaagaguauucaaauaggaagagaggaagucaaauugucucuguuugcagaugacaugauuguuauauuuagaaaaccccaccgucucagcccaguaucuucuuaagcugauaggcaacuucagcaaagugucaggauacaaaaucaaugugcaaaaaucauuagcauuccuauacaccaauaauagacaagcacagagugaaaucaugagugaacucccauucacaauugcuacaaagagaauaaaauaccuaggaauccaacuuacaaaggaugugaaggaccucuucaaggagaucuacaaaccacugcucaaggcaauaagagaggacagaaacgaauggaaaaacauuccaugcucauggauaggaagaaucaauaucgugaaaauggccauacuacccaaaguaauuuauagauucagugcuauccccaucaagcuaccauugacugucuucacagaauuagaaaaagcuacuuuaaaucucauauggaaccaaaaaagaccccauauagccaauagauucguaaggaaaaagaacaaagcuggaggcaucacgcuaccugacuucaaacuauacuacaaggcuacaguaaccaaacagcaugguacugguaccaaaacagauauauagaccaauggaacagaacagaggccucagaaauagagccacacaucuacaaccaucuaaucuuugacaaaccugacacaaacaagcaauggggaaaggauucccuauuuaauaaaugguguugggaaaacuggcuagccauaugcagaaaacugaaacuggaucccuuccuuacaccuuacacaaaaauuaacucaagauggauuaaagacuuaaauguaagacccaaaacuauaaaaacccuagaagaaaaccuaagcaauaucauucaagacauaggcaugggcaaagacuucaugacucaaacaccaaaagcaauggcaacaaaagccaaaauugacaaaugggaucuaauuaaacuaaauagcuucugcacagcaaaagaaacuaucaucagaaugaacaggcaaccuacagaaugggggaaaauuuuugcaaucuaucccccugacaaagggcuaaugucgagaaucuacaaggaacuuaaacaaauuuagaagaaaacaaaaacacugaucaaaaaaugggcaaaggauaugaacagacacuucucaaaaaaagacauuuauguagccaacaaacaugaaaaaaagcucaucgucacuggucauuagagaaaugcaaaucaaaaccacaaugagauaccaucucacgccacuuagaauggugaucauuaaaaagucaggaaacaacagaugcuggagaagauguggagaaauaggaacgcuuuuacacuguuggugagaguguaaauuaguucaaccauuguggaagacaguguggcaauuccucaaggaucuagaaccaaaaauaccauuugacccagcaauuccauuacuggguauauauacccaaaggauuauaaaucauuguacuauaaagacacaugcacacauguguuuauugcagcacuauucacaauaccaaagacuuggaaccaacccaaauucccaucugugauagacuggauaaagaaaauaugucacauggaauacuaugcagccauagaaaggaugaguucauguccuuugcagggacauggaugaagcuggaaaccaucauuuucagcaaacuaacacaggaacagaaaaccaaacacugcaugcucucacucauaagugggagucgaacaaugagaacacauggacacagggaggggaacaucacacaccggggccuguugggggcuggggggcuaggagagggauagcauuaggagaaauaccuaauguagaugacagguugaugggugcagcaaaccaccauggcacguguauaacuauguaacaaaccugcacguucugcacauguagcccagaacuuaaaguauauauauauauauaaaaguuucuacacuaagaauaaucacaaaaguuucuaaaauaaaaguucucuaacauguagagcaaucuuuucugauugaaaaguuaagccuucaugaaacaguccauuggcuucacagccauaucagauugagaaucuaaguugguguaauacaucuuuugagcugcauuuuuuaaagcuuuggacugugucagugaaguaugcaauccuauugaucaacuauuccaacugguuaucccugagauuacaaaaccuuuuuccagaauuaaaggagaaaagcgucaauuuuugaugaaaccuuauagggaagauaaauuuuaauaugcuaauuuuaugccagaaacaaaugaauauguacaacuuauuaugauaaacauaacuucuauagcauuuggaauuuuaaaaccuuauggaccuuccugggccacugggaguuaacagauaagauuuuuugaaucauagauucaaugcaggucaaauuggccuuaguuuugcuugcccuaauuucaacuagcaugauuaccgugauggaaucaggguugggucaauauucucuggccuucuguaggggcacuuuaguguagaaacaaucccaaggcagaagcaguagacuacaauuauguuaaauuauuuuuagguccauaaauggauacauuugcggguucuauuguuacaaagagugauaagauaaaaccuuguuuucaacugcagauuccaugucuaugaagcaggagcuaucagaacaugauaguagcauguuccuuccuuccuuggugcugggugagggaauggugguguuggugaaagaugaagauuaagaauagggaaauauuaggaauaacaauaaaaucaauguuuuuucaagucugcacuaaacugaaauaauuugcuuguauacucaacuuguauggagauuaaauaaauauuuuucacagucaggaauaaaauggcuaucaacccccucuguuuauaaaugugguucucaaaaucuaggcuuaguaugauuuauuaaugaugauauaaugaaagccaucuucauauuaauuaaaaguuaguuuuauuaaauauaaaaaacaaacacaagaauagcaaggaaacuacuaaauaagaagaccucugggaugagguagugggagcaaggcagaacuacucccagguauaaaaauguguuucaaagcucuuucauuaaaugguaaguacuggcacaagaauaaacugucagauaaagggaguaaaauaaaccuccagaaguagauccagcuacauauaaaaauuuaugacaaaagugguaucucaaaaaucacucggacaaaaaugcucuguuuacuauacaguguggggacuaguggauagcuguuuggaaaaagauaaagguagauccauuucuuucaucacacccaagaauaaacuccaaauggaucagagaucuaaauauaaaaaguaaaacuaugcaaguaccaaaaagaaaaaaaacaccccaugagugaauucuucugaaaccaguguauaaggaaaagcuuucuaagugugacuacggucccauacacaauaaaagacugauaaauuugacuacauaauaaaaauuuuacauggccugaaaaauaccacuaagucaaagacagcugacaaacugggagaaaauagucacaacauauaucagauaaaagguuaacuccuuuauuugagaacuuucuaaaaaaaaggaaaaaagaucuacagaaauccuauagaaaaagaccuguagaaauccuauugaaagaaacaaaaagauauaaaaauagcccuugaucacaugaaaauauauguaauuuuaaucacauaaaaauguaaauuaaaacuacauugaaauuccauuuuucaccgaaaaaguuggcaaaaauucaaaagcuugauaacacauucuguugacgagacaguggagaaacagcaaugccauacuugcugauggauaggugcaacuccucuggagaggaauuuagccaucuauaagcaacuaucuaugcccaaaucucaucacagaaaucccucuaugaauuuauuuuaaauguauaucuuuaauaauaugaaacuauaaaaacauagguauuaaguuauucauagaauacuguuuauaauuguugagcauagaagauugguugaauaaacuaugguacauacagaaaauggaguacuauacagcuguaagacagaauaaggaggaacacuauuuacuguuagggaaugauuucugggagacuuaauuaaggggaaaaaagcaaaaugcaaaaauguauauauaguaugcuaacuuuguguauaaaagaagggacauuuuuaaaauuuauauaaaugccuauuuuuacagaaaggaacacuggaagcacaaaucagaaaacaaguuaguugccuuuaggaguuuggggaaauuggauagaaggaauacagaaagaagugacacaucucugauuauaccuuuuuuguacaguuugacuuuugaaagcauguuaauauucuacauauuccaaaaauaaaaucaauaugaauaagaaggaaguuccuucuuuuuuuuuuuuuuuugagacagagucucgcucuguugcccaggcuggagugcaguggcaugaucucggcucacugcaaccuccaccucccagguuuaagcaauucuccugccuuagccucccgaguagcugggacuacaggugcgugccaccaggccuggcuaauuuuuuguauuuuuaguagagacgggguuucaccguguuagccaggauggucuugaucuccugaccuugugauccacccgccucggccugccaaagugcugggauuacagguguaagccaccgugcccugccagaaggaaguucuaaaacugaaagcaaacuaaaauacaugaaccuaacuauauuucaaauaaacgccacagccauacuaaaggaaaguaaaggaaggaggaaagaccaacuaaaguaacuuauaaauacaguaucuaacuauauccccucauucuugggguaggaggggaggaagaacugcaagcaaaucucaaaaucuugguagauuuguuacuguaaugacaugggcaaagcaauuccaaaccuacuucagguauaccaaaggguugcacaaaugaauaaauguguugaugugguuggaaguucucacuguggaagaagggacauauaaauauggaaugauggaaggcaagaauguauacuuugggaguggauuggaacugcaguuuugauaugaacucauaauuucucaaauaugcauacauuuaugugcacagauagaugcacguguauauuuacacaugucuguuuauugaugugcauguguaugcguauguguguauguguuuguuuauacauaugugccuagauugccuagcucuccuuacugagaaagccaagaagcaaagaccagaguagccaugagcaaaccuaacacccagaccaugguccucacuaaaaggaaccaaggcuucuaggagaaaugucugauuccaggguucagacggaguagcuugcuccugaggaaaugggcuaccuguggcauccaacauuuguauuccucuuccuucaaauccuagggagccagccauaguuucuuccaccuacuauugauaugguuaucagccaguuuuccugggcuuccaugaaguuuauagugauccucaggauauuaaagaacuucuaccaaucccaaauugucauuuauuuuuauccuguguuccugugaacacuuuuuuaaaggcaauguaaaacuuggaucuuaauagccaucauaguaagcuucccuuauuuguaauugguuccacauuucuacucccauauguuuuugucagacauuauaaaucugaaagguuuucuagaacacaaaauaaaugucagaaacagaggcaacagcaaauuaaacagcuuacauugcagaauacacucaguauagcauggauaaaaacucauuggucaagaggauuuacagugugaauuugcugaagcuuauuggcccuacaagcucaauagcugacagugcagcugcccucagagcauggggaaaaauacaucagaaacaaauggcacucuaauaaauuggcccucuaacaucuuccagaugugaacauaacauuuuuacuaccaauaggauuugagugaagauuauaguuuaaauuaucagccacaauagugugucccaaucccuggggcaaccuaccugaaggagaguuaccuagucacccagaauugcugccauccaaggccuuuggccuuuacauuuacauggaggcaggucugagcucuguuccagacaggcucaacuuagugaagcaggguccaagcagucaccaagcagacaggcuaugcuucuuuccuuguagaagaguuagggcgaggaaaagcaacugaaaguuauucuucccaggguucagauaaggcguuaacugccuaauuuacaggcccaagaaggaccugcacgucauggcaaauuuugaguucuguaguuuuuuuaagugugagcucccaacuuucuagcaugcaccucuugcuucugcuucacacugcuaagccauuuuucccuuuuuuguaugaacuuuuauggcuccuucuacagauuaauucuggcauaacagaagaggcucaaaugacuguauuauaagacugaggcucacccaacaucaaucuuaguuacaugagcuggauuauuaccaguguuaauguuuauuugcuuaauuugcuugucuuuggaugaaaagaaaaugggauaccgaaagcauuauggagggaaaauagauuuucgucuucucccucucuauccuugaacuaccuaguacuguacuuucaaguggcuuauggaaaggauuaaaagugaagggugaaaagacaaauaggagcuguuucuauugucagccucugaaguuccaugaacaggcugaaaguucaauugaggucuaugaaaaaauuaggagaugccaaaaggccagcagccaagauuugugucuuugugcaagaacugaauagcuaccaacaaacuaggaaauuuuuaaaaccuugccaaugauggaaaaguccuaugaaaaagagagugagaaagggugaaacauuucugaaauaauuagauuuaugaacucguaaaagaguguucucuacagauccuaggccucuacgcauguagauaacugaaauuuuaagacuaagaaaugacauuuuuuuuuuaaugaugcuguuaguaauagugguugaaaugacucagagcuaacuuggauuacuuuagugaagggaagugacgugcauaauuauuagucaaaauugaaguuuacaacaagcaaauauguaaauuuguaagaugauucuauuuuuaaguuaauaacaugacaucuagaggauuuuuuucucaguaauaaauuucauuaauuacauucagaaaauagugauuggcccuucuuaauuuucuuaugcuucugaauauuuaaauuaaaaauauaucuauuuuggucaucuuuuuaaaaaagauacuagucaacauagugaaaaaauucuggcuguguaaaaugaauugaaacaaaugccaaaaaguagaaauguuuuuuauaaaguggaauuugaauuuuuaagauuaaagugacaaaaauaugauuaaggcaaauauguaggauuuuauuuacuggucaauuuauaaaacauguaaaugcuucaaaaugcuuagucaauaauaauuuucuuuuuuauaauuagaaucuuuaucagaaaugaauuuauugcugguuauuucuguaaggacgacuuuucuguuaaaucaaguaucuuaacagaaaguuggcuguaauaacagagaagaaacaguagagggcacuuuaguucucugacaaaauaauagcauuucuauaaccuuauaaaaaucaguaaaaucgacaaugagauuugaacuaccuagugaagguuaaacaaaaauguaaagcaaguuccucugcuucgcauagucuaacaaaagauauuucagguaaauuucaacuucuuuccuuaagcaauucacauaaaucaauuggguaccauaugaaaaacauguucucagaucugcaaauuaguggauccaacauuucaagagaauuucauuuuuaaaaaucacacaauuauuuggaaauugccugacuuguuggaugcaguugacuuaagucaauaaauucucauuauccaggauuuuuaagaggcaaauugaguacucuaaauauguaagaauuagcaguacauaauuguauauuucuuggucuuagacauguuucuuauucauaauuuccucuaaaaucaucuuuaucaucauugccaucaccaucauaaucaucauuucaaggcauaguugccacuuucaaguauguuccacucuauaauaauugaauaaaacaauaaauacaugaaaaagcaaacaauggaaaagacauugcacaguuaaaucuaaauuguguaguuuaguuuguaaaugaacucaggcgaaucauuaaaauucucugggccucaguuuuuacauuuuauaaaugagauuccauacuugacgaugagacucuacaacacugucauccauucuuacuuuguauauuguucugucaaauuuggucaucuguguccuaguucucaacagauuuaugguguuucuuaaccuuuuagaguuuaaagaccuacuggaaaaucuuauaaaauauauggagcuuauaccccuaaaaaaugcuguaauguauaccuuacucaaaaugagcauucauuucaggaaguucgaggaccuucagaaaucaauccaugggcuccacaagcacuguaucaagaggcauucgagaccagucugggcuagagggugagacccugucuuuaugaaaaaagaaaaagagagagaaaaaugaauauuugauagaggcacaaaucaugcaguucccacauauuuggggguuauuccuagaaauuucgugugcuguuguuggguaaagauaggcaaugaggauggagagggagguaggccauauccagcaauuuuggacuuuaugaaacaagaggaaguaaacuggaguguuuaaacauaaagguggccaauaugcauuuuggacagcaaaaucagaaaguagaaugugaaauaacuggagaagaaagacaggaaguggggaaaacaucaguuugucagcacaauaaucuggguuggaaauagugagagccuauuuuaaaaccucuccaacauuaaggauguucccuuuucuaagauaggccuacuuugauucuguauaaaaaauaauaagacaaaguuuucaagcacuaagggacacuuugaaauuagccaaacguuuguucuguaauuccuuuuguuuuuuacucaaggcaacaguuagauguuagcaaccuugcuuuuguacccuuuugucuacauaggguauaucaaaagcuuaagcagccuaggagccacugaggagauguggcaacuccuccugaauaggaagauauggagggcuuugcucaccaugcacauccaaguucagugacagguguucuaacuacuuuuauuaccucccuuggggcaacaaggguggcagaaaugauugaccacucauauugucauuuaaggcuggacccagguggaaaugccucuccauucucuaguagccagauuaaaaugagcaagcaaaauuucuggauagggagguuuaucacaggauuuuagugaaaauuaaaugcaacauauauaacuuuauguauagauugucuucuaggaaauuuguagacagauccuguuacugccuuacauuaccaaguccauuuguuuucuauaagagagggaaaauaucauuaauuugauggcuaggaugagauagagauguccucauucuauuaagggaaauuuaacuaggagccuccaaaaauaaagccagaaauaaggcaaggucaauggaguuggagaaaauagauuagauuugagcauuaguuuguugaguccacucggaccuuggcauuuaguuagaugugggaagugaaacuguugguucuaaacuaucuauagaacaaaacccacaucccucauuggaagcacgucacgaucuggcucaauccaccuucuagccucagguccacccacugcccaccucauggucuguguucaguggucaccaggcuacuaaacacaccaugcuccuuaaugucugugggacgcaauguccucuugaauaagaauguccuuccccacgacugucccccucuggugaaauccuaugcaucccuaaaccuagccucaaagucaccuucucuacuuaagcccuuguugacucccugucuaccuccuguaggcagaauuaaccgccucacucucugggccaccucggacuguguucauauguauaaugcucaucauaguauacagaggugaauauuauucacauccgucuuucccacuacacugugagcucucaaagaaagguggucuaauuccuuucauacuccaagcuccuagcacaaccuuggcacauaauaugaaauagaacaauacuucuuaaagaaaaggagagagaggaauuacagucaaaaggcuguuguaauaauccagacagaacgucucauacauaugagccuauauuauauauagaaggugggacugggaauagaaauucaaaauuauuaaaauagaauaguagauuggauguguaauuaaauguagggacugagagaggagaaaaacuugaagaugauucugaccauguuuucuggccaauaagacugagagauccuagaggauauuguaaacauaggaagaagagggaaagggaaaggaaguuaauuucuguucagacuuuugaacuuaacaugaagggggauuuuagaagauuguuguguauucagaacugaaacuaaguucagggcuuacagcauaaucauagaaacuaugaaguggauaauauugaagggaaaagaaccaauaacuguauuugggguuuugucucuaagaaauggggaaaagaagagaaggaagugaaaggaaucuguugagagagcaggugaagugauccaagaaaaggcagugccaugggaaccaagaaaggagaccaaaagugaagaauguugagucugagccagagaaggacugauggagccauugccacuguagccucagagagggcagcuucacuagaacaauggcagcagaaugcagauggagccagcggggagaggaggugaggagagugagugcagccugcucucaaaaauauuaaucuuaacagggcugagggaucuugcuauacauccuauaaaucauuucuaguugugaccuacauugucuucuaauugaauguuggcuuaaucaaauuucauuaaaguuucaacugcccacagcuacuaagauaauuuuugcuuuuuaaauuuaagacauuaaaaauagaaucucuguauaagccugggguugggauggagaaauagcucgaugauucauuuauccucucuuugaaaguauaucauuuaaaucgcauuaugaaucaacuaauuuaggggguuuuauccuaauaagauaaacccagaagaccuuaaagaguucuuggggugcggggaggaggcacuaccauuaaaucuaguuggaauugcauauguccagcugcuguagggcuggggucaggguuuaauugugagcccuacauacuugaagccaucauuucuuacuuggcuuucuccuccugucacuguagauugcaggcuguauuguuuaauguagcaaagggagaauugaaaugucugccuuccucgcaguuggguacuuuuuauugucucauccccuauuuauuacugaggaguucuggacuuuagaucauaaucagugaagcuuguggcucucuuuauccagugccaugcccagcucugggcagguuuauucuauugaauuucaaauugaagaccuguguguguuagccaauuauauuuuaaauacauuuucugaaccgguuuuaggaaguuuauuaaaauccaguuaaaaagcaggcuuuucagagaucaaagauauuaauuacauaauacaucucacucugucaguggcuuuuuagaaacuauacuagauagauuucugcaaaagaaguguuucucucccaggggaagaaacaggagucccaggugaaagaaguuugaaagagcuaagaaacuugaggaaagagacuucugcuucuaguaaucgcagaugaggcaauuccugcugaaaaccaauuuuaagaaaagcuguaguuuauauguaauauauuuauuuagacauaauuuacguauguauuuuguuuauuacuuguuuacauguuagcaucucccugcuagaauauaagcuacaggaaggcaagaauguuuguuuuguucaaugauauaucccaagcaccuggaacucuaucugguacauaccaacugccccauaauuauuuguugcaugaaucaauaaauuaucuaaaaccucuuaaguccugggagcauuucacuuuacuaccacaggguagcucucuuuagugccccguccugucccugccccuuuacucucucagaccucuuuguucucccacccagugcacuucuacugcaucucacucccccagagaacacaacccaagggagaguagcccaucuccuguuccacuguuuagugaaaagaauccuccauu

SEQ ID NO: 12660 - RNA, 2429 nt, Homo sapiens
uuuuggaaauuuuuaaauuccauuuguguagauuaaaaauaucaaugcuaauacuuucuauuaaauaaggauuuaucuauuuucauaaaaccucuaauuauauuccuugaauugcuaugaguagaauuuuguuguaaacacaauauuuuuaaaaagucaaauauauuuuaaaaaucuuaacauuauauuacuauaacuuagagaacagguguuuacauguuuaaaauuuucuaggccuuaaauuugugaaaucagucuuucagaaguuauuuuuaauauaguuaucuguguuacagguuuauaaguugacauuucaauuuaaaauuuuuucaauuuauauuucaaugaccaggaaaaaauaguuaaacuuauuccuaaauuuuaauagaaaaauaaaaaaccacauaguuguuaauuucugguaauuuaucuugagacuccaggcauguuuuuagaacauuuuuaccuuaaaagcaauuuugaaauagggaaauuaaaguuuaaagcagaguuuucacuuuaaugagguaauuuuauacuucccagauagguaggcccauauucaagaacacucugaucucuguuuauaguaaguuuugaugccauuauaucauuuacuuauucacgcauuauaagcauaguagauagccccauugucacgaagcuggcauuauuuucuugucugucauucaauauuguccccuuuuuuuuuucuguuuucaucauagccguccuuuucauuuuauuguagcccugacucgaaaugaaaguaaguuugaacucuuaaaaaagaguuccucaaacucuuuuuuaagaauauacagugaaaugucuuaaauaauauuaucuaaauaauaccuaaagaaugcaaaugacuugcaaugcugaauagucagacacaggauguuccaugcuaaggguagacucauauuuccacuuuauaaaaugugguuucagaaaacaaauagauguguuucuuccuuaauaauuaguguuucaggaccaaaguugacuaaauauggaaguuuaagauaaaacccgguuucuuagggaaucuuucucaguccuuaguaauucuguagaauugaugauagaguggcaacuucaauacacucaguauucuuuucuguuugaagucuguuuugccauuggaaaaaacuuauuguuguuugaauuuggguauauguauucacagaugguuuacuuuauuuuuauuuuguuuaaacaaauacuuucaugucccaaacacugagacauguuucauguccuaaacacuuuauaaauauuagaauauuuaauccccuuaacucuguaguuauaauuaucuucauuuuacaauugagaaaacuaagauacgacguuuuauuuaaugguaacgccuuaaguaaggggagagugauaaguguaagcagaguggaaaacuuaguagugcuaaggagcaacagaaguaugugcaagaguuugggaagaugugucugcuuggaaaggaucagggacucagcugggaucagucuuaaagagcaacauguccucauuccucaauuuuaagccuuugggcucuagaaguaaagggcaaacuuagaggaggcacuccucagguuucagcugccuguuccggccuggugagguggcuguacuggcucauguguuucucauagggcuacaugagccuuuaugucuuaccuccuccucauuucuuggcugacuccugcuuuuuuggaggguuuaacuucucucucagcuagaagguuaggcauugcaaauaccaguggauaauuuuuuucuuagcuuuaaccccagcccauuucaacccccucuuugcccuuuguauauucuuuugaaaauaugauccaguaguguuuaugaauguguguuguguaaaauuuagagauugauguuaaacaacagaauuaaaggacaaagcugucuuuuuuguuggaauuggggaugggagagcagcucaaagugggaaauauggagaaaggagagacauuguggaaaagaagagauaaauugaggggaaaaaaagaggaugaaaaaaugaagagagagaauuacugaugugcuucacacccacaccuccucuccaacuucacaguaacagaggcaaugucacuaucuuuuaccugacaagugcuuuaccagggaguugugccuggcaucgugggaguggaaaauuuuucccuuuugcauuuugagacuugggugugcugcuuuaagaugccacugguaucuaaguaauguuuguuuauacuggauauuuuucucuguagccuuuguggauuggacuuauaauauaaacaauauuguuagcagaacugcagguacucuauugcuauguuuauuuuauuaguuaaaaaacuaccagagcccuaggacuucugagcacauuuagaaaauaccagaggcaauuuuaagacuagcauuag

SEQ ID NO: 12661 - RNA, 867 nt, Homo sapiens
ucguuccacaccugucauucuuggagcuuuguggucagcucuuguaguauaaguuugaagauuuuuaaaucucaaucuauuauugcucuaaauucagaccugaacauugagucuuuuaaaacuauuucucugaguugauuguuuuccucuagugcacucuaaaaaaugucagcuccccaugcaccaccaagaaaucacuccgcauucuggugcccccaggccccacucugggucucuggugugcaggaggcugaccucuccugggcuaugcucuguggguucugccccuuucgaugguggugggugggguuauaucaaggcacuuuuugguggaaaggaaguaauccuguuugggacuaacugcacaaguuucauugccuuggaguuaggaaacucugugcuuuuuuauggacagaauuccccucuuuccaaacacuuaauucucucuccuccuccauugaaagaagguuuagauuuuuccacaaacauuucugccauauauuuaugaaaggaaaacaaaauauuugcuaggcauuauuugaauauguaccaguuaaaaaaagaggucuguggcuuuuggguuaccaaacauaacuacuaaaaggcaaauccuggugaaguguuaauuuaaccaauuaaauuauauuuaagagucuaaacauaagggaaccagagaauaagcacaggaaacauauuuguaugaguagauauguacagauauaaauucaguuuuauauauuuucuauuucuuuacaucccugauuucuauauggaccuucuguagauggcuaguuuguuauuuauaaauuugagcuguuugcacaguagauguuacuuuaauuguguuauucuaauuaucuauuuauc

SEQ ID NO: 12662 - RNA, 1228 nt, Homo sapiens
gauugaagaguaugcaaugagcgauuuuaggucuguuugucguaggcagauggagcuuguuauaauuaugccucauagggauaguacaaggaagggguaggcuauguguuuugucaggggguugagaaugagugugaggcguauuauaccauagccgccuaguuuuaagaguacugcggcaaguacuauugacccagcgaugggggcuucgacaugggcuuuagggagucauaaguggaguccguaaagagguaucuuuacuauaaaagcuauuguguaagcuagucauauuaaguuguuggcucaggaguuugauaguucuugggcagugagagugaguaguagaauguuuagugagccuaggguguugugaguguaaauuagugcgaugaguaggggaagggagccuacuaggguguagaauaggaaguaugugccugcguucaggcguucuggcugguugccucaucgggugaugauagccaagguggggauaagugugguuucgaagaagauauaaaauaugauuaguucuguggcugugaauguuauaauuaaggagauuuguagggagauuaguauagagagguagaguuuuuuucgugauagugguucgcuggauaaguggcguuggcuugccaugauugugagggguaggagucagguaguuaguauuaggagggggguuguuagggggucggaggaaaagguuggggaacagcuaaauagguuguuguugauuugguuaaaaaauaguagggggaugaugcuaauaauuaggcugugggugguuguguugauucaaauuaugugcuuuuuggaaagucaugucagugguaguaauauaauuguugggacgauuaguuuuagcauuggaguagguuuagguuauguacguagucuaggccauauguguuggagauugagacuaguagggcuaggcccaccgcugcuucgcaggcggcaaagacuaguauggcaauaggcacaauauuggcuaagagggaguggguguugaggguuaugagaguagcuauaaugaacagcgauaguauuauuccuucuaggcauaguagggaggauaugaggugugagcgauauacuaguauuccuagaagugagaugguaaaugcuaguauaauauuuauguaaaugaggggcauuugguaaauaugauuaucauaauuuaaugagucgaaaucauucguuuuguuuaaacuauauacca

SEQ ID NO: 12663 - RNA, 1228 nt, Homo sapiens
ugguauauaguuuaaacaaaacgaaugauuucgacucauuaaauuaugauaaucauauuuaccaaaugccccucauuuacauaaauauuauacuagcauuuaccaucucacuucuaggaauacuaguauaucgcucacaccucauauccucccuacuaugccuagaaggaauaauacuaucgcuguucauuauagcuacucucauaacccucaacacccacucccucuuagccaauauugugccuauugccauacuagucuuugccgccugcgaagcagcggugggccuagcccuacuagucucaaucuccaacacauauggccuagacuacguacauaaccuaaaccuacuccaaugcuaaaacuaaucgucccaacaauuauauuacuaccacugacaugacuuuccaaaaagcacauaauuugaaucaacacaaccacccacagccuaauuauuagcaucaucccccuacuauuuuuuaaccaaaucaacaacaaccuauuuagcuguuccccaaccuuuuccuccgacccccuaacaaccccccuccuaauacuaacuaccugacuccuaccccucacaaucauggcaagccaacgccacuuauccagcgaaccacuaucacgaaaaaaacucuaccucucuauacuaaucucccuacaaaucuccuuaauuauaacauucacagccacagaacuaaucauauuuuauaucuucuucgaaaccacacuuauccccaccuuggcuaucaucacccgaugaggcaaccagccagaacgccugaacgcaggcacauacuuccuauucuacacccuaguaggcucccuuccccuacucaucgcacuaauuuacacucacaacacccuaggcucacuaaacauucuacuacucacucucacugcccaagaacuaucaaacuccugagccaacaacuuaauaugacuagcuuacacaauagcuuuuauaguaaagauaccucuuuacggacuccacuuaugacucccuaaagcccaugucgaagcccccaucgcugggucaauaguacuugccgcaguacucuuaaaacuaggcggcuaugguauaauacgccucacacucauucucaacccccugacaaaacacauagccuaccccuuccuuguacuaucccuaugaggcauaauuauaacaagcuccaucugccuacgacaaacagaccuaaaaucgcucauugcauacucuucaauc

SEQ ID NO: 12664 - RNA, 1429 nt, Homo sapiens
gaaauacauuaauuauuuuauuucucuuaaauuugagucuuccaaaucugggcucagguauucuccucucaaaccuggaaauguuauggugccaacauaagagggauaauccuugauggauaaucuuguucaugucacuuaaccccucugacauggcuuucuugucaaaaauaauuguacaugugaucaucgugauaauauguuguauuuauauagaacuuucaauuuguagagaaauuauuuuugucccuacuaauaaugccuuguccauacaaccacuaaauaaauaauuguccgggauauucauuaucuugacuuuuaucaacacgauauuccuauaaaguggauagagcaugcaacuggcuaauuuuauaaaugagcacacuggaucccagguuaggcuggugauguccugaugacaguacucugguuguguagaagccaaguuucuuauuaucacaucuggaauuuaaaaguaaaauucaacuuaaagauuauaugcaggacaaagauguuuauuucauagaucauauagaucauguaaaaagguagaaaaauggcaagcuuuuugaaacugaucacaaauaaaucuaaaguaauuucaauuagaggaaaaaacauugaaaagaaaauauuaucuaauauuuauugaagccauuauuucaaauuuugauuuggugaauguacuuauuucuauuauugaguagguacaaaacauuuucagcuggcuuuuauugaacgagcuuuuucacuuugaacacugcaaugcugaaauauugauuuuuaaaaaaagaauucaauaguuucaaaugagugauauugggauuguugcaaaauuaauauuaguuuaguauauauaugauuaugaaccacuuaguuuaaggugaacagauuauuuuccuaguuuacauuuuaauugaaugcaguuuuucauauuucuuuauuucauuuaaaagugcuuacauauaguaauauuucgugcagccacuccacccaucucuauuuucucucuacuacuaauauuugaguucccaacuugcacauaguacacuaaggaaguuaaaaaagaaacauugcucuaauacugaggacucccauuuucaaaauuauaagaauaucguuucacucaaauagcuguuuauauaaauguccagugaacccuuauuuuugcauuuuguauguaggcaaugaugaaucauaauuuugaaguaugauuaacucaagaguuaaaauuucuguuuuuugaaacuaaagacucugauaucaaaaucacauauuccuggccccaucccagaacuaaugaagcagaguuuuuagugaauuaagcuuaacccuuaauugauaucucaguuugaugucucaacaguuauuuuuaagcacuauccuuccauuuugggguagccuugcaggaaugugcucagauuuuuaa

SEQ ID NO: 12665 - RNA, 1210 nt, Homo sapiens
cuuucagcgcagaccugucgcagccagagagcugucauuucaguaccgggauucagaauugauccaguccgcagcggagggggcacaucccagcuaccgagcugcugagugucucuggcuggaacaauaguauuuuuuucucugcgaggcugcaauuaacaucuuauuuguucuggcuccauacaggcuuugucaggaucgcggugcggcgaccgacguugggcucuugcauugcuuugugcuuggcaauggaaucaugguuucggggucuaaacuuuuguuucguuuuguagucuuaauguaucugauucuuuuucaaguuucccuaguaacagguuuggggacggggugggaagaagcgagaaaaggggugaagagaaaaaaccagauuauauagaaaggaaaaagggaaaagggauguuuccccaccuuuuaaucuaacuaucuaucugucugucuaucuaucaucauagauagucauuuugccuccuggacaguuggcugacgaagugucugauaaaccagcuucagauacaugcuacaaaaggucauucgccuccugauuauguuucuacuuguaaacgcaguuggugguuugcaaaacaagugcuaaaauagugcagugauguggugggaggaaaccauaauggguaauucauauaaagugcuggaaucuucguaagggugaguuucucgagcggcaggugaaguugaauaaagcaauuuuccaucauuuguuccccucacucuugcauuuuuuuccuccgcuuguuucucuccccuggggcgauuauggauagccaagaacaccauuuuaaaagagauugauagugaaaacaggaaguuuauggucuguuauccacuggaguuguuugaaauauuaaaauugguccuuuacuucuuaaugcauauuaauagagugacccucuucaaggcuuucccgucuuaaacgaaugccugggauaaacacuguaaggggaaacaguuaauaauuccccagcaggcuuuaacuauuuucccaguaacaaaucaccggcaagagagcagccuggguggcauuuugguuuugugucauuuugguucuuuacaauauuuuuuauucauuuaaggaaauguuaaaaggaaauaauuaggguuuauguccagaacaaauuuugaaacaccguuuaagcaacacauuuucuuuuaaaaacaaagaacauugagcaac

SEQ ID NO: 12666 - RNA, 536 nt, Homo sapiens
uuuauauuuuauaauaccuugaugaauuuuuuaaccaaaacacuucuauuuuagucuucgaagaaacucuuuucuucuuuuccaagauaaucaugauuaacuuacaaaaauggguauacaucuucaaaacauuucccuuaauaggaaacuuagcuuuacaggaucuaaacacuaaaaggcaaaaaaaaaaaaaaucuauuuucuuuucauuacaagacaaaacagaauccagcauaagucaaggaaacacauucauaccucagguccuccuccuccaugaaccaacauuauuauauuauuuccguuuagcaaaaucugaucuaauuuaguauucuuucuucuggugggauuucaaacucagugauaucuugcaguaccauauugacaaaguuaucaaauccuagaagaguaucaacaauuuccuuaucaguuuucaucacaaugagaauuuuugauucuuacauuugucuacaagcucuagcaguagcagcuguaaggagcugguacuaguguuagccgccauaacugugauggaa

SEQ ID NO: 12667 - RNA, 536 nt, Homo sapiens
uuccaucacaguuauggcggcuaacacuaguaccagcuccuuacagcugcuacugcuagagcuuguagacaaauguaagaaucaaaaauucucauugugaugaaaacugauaaggaaauuguugauacucuucuaggauuugauaacuuugucaauaugguacugcaagauaucacugaguuugaaaucccaccagaagaaagaauacuaaauuagaucagauuuugcuaaacggaaauaauauaauaauguugguucauggaggaggaggaccugagguaugaauguguuuccuugacuuaugcuggauucuguuuugucuuguaaugaaaagaaaauagauuuuuuuuuuuuuugccuuuuaguguuuagauccuguaaagcuaaguuuccuauuaagggaaauguuuugaagauguauacccauuuuuguaaguuaaucaugauuaucuuggaaaagaagaaaagaguuucuucgaagacuaaaauagaaguguuuugguuaaaaaauucaucaagguauuauaaaauauaaa

SEQ ID NO: 12668 - RNA, 1419 nt, Homo sapiens
uuuuuuuuuucaauguucaguuuccuuuaaugacccccaucucccugaagggcaggugcaggcagcuaggugauggcaagagauguucacuugaagaucuugccgugauugaaggcuuugcccacaugcuggaaggcccccucccaggaaaaguacucucgaaccagcgucugggucuccucucugccaggauccaguuuccgccauguguaugacucguaguccaccugccaaucuggacucagcggaaaggcaagcuccuggccucggaagacccagacuccagaaauggagcugcuauuguugguuccaaaaaggaugacacuggcgaaggcauucuuccucagcuuguccagucgcuggaacauuccagugaugagauugcagcucaugaaggucugagugaguucuucagggaagcgauacucugaguaccacagggaccagccguccuuaucaaagugcucccagaaauauggcagugccacagagaguguguccucauuggaguacuugcgcuuaaauucauccaacacaaagguacucuugggcaggugagcgaagggguccuuggccuugggcucagcagccagcgccugcucacauucauccaucuccuccucaggagcaggggcagccgccuuuuucuccuccuuccgcucagccuggggcuucugcuucucuucccgugaacccuucucuuuccgugguguguccuuuuuaggcugggucucugcaaacuuuuuagcaucaaacugggccaucuucucacacaguuucaguucccccaagacagcccggaacuggggcugguuaaugcaggugaggaaccagcgguugguauugcgaaaggcccggcggaaagaaggcucuagaaccugcuuauagagccacaacagggugcagacaacugugaugucagccaaugucacucguucgcccaccagaaaaguccucgucuucaaguaagcauccagcagccccagaauucgccucacuuccuccuuugcauucucaguggccuguuuguuguggugcaugaugcccaagguggggaacacccagguacuggcugggggcacuauaucggaaucagcaaagcucacccacugcaccaccugggcugcugccucuggaguacuuccccgcagcuccucauugcucacauaguaggcaauggcguugcucucaaacacacagaauccaucaucacccucaaaugcugggaccuugccggcaggaaauuugcgaagaaauucagaggugcgguugguuuggccaaaauggaagugggguggugcggagagcacgcggaucugagccccgcuguacugagcagcgaugagagccuugaaggcccuccaguuuucaggauacguguacagggucccagccgccauggugauuccgcaaagaaag

SEQ ID NO: 12669 - RNA, 1410 nt, Homo sapiens
ucaauguucaguuuccuuuaaugacccccaucucccugaagggcaggugcaggcagcuaggugauggcaagagauguucacuugaagaucuugccgugauugaaggcuuugcccacaugcuggaaggcccccucccaggaaaaguacucucgaaccagcgucugggucuccucucugccaggauccaguuuccgccauguguaugacucguaguccaccugccaaucuggacucagcggaaaggcaagcuccuggccucggaagacccagacuccagaaauggagcugcuauuguugguuccaaaaaggaugacacuggcgaaggcauucuuccucagcuuguccagucgcuggaacauuccagugaugagauugcagcucaugaaggucugagugaguucuucagggaagcgauacucugaguaccacagggaccagccguccuuaucaaagugcucccagaaauauggcagugccacagagaguguguccucauuggaguacuugcgcuuaaauucauccaacacaaagguacucuugggcaggugagcgaagggguccuuggccuugggcucagcagccagcgccugcucacauucauccaucuccuccucaggagcaggggcagccgccuuuuucuccuccuuccgcucagccuggggcuucugcuucucuucccgugaacccuucucuuuccgugguguguccuuuuuaggcugggucucugcaaacuuuuuagcaucaaacugggccaucuucucacacaguuucaguucccccaagacagcccggaacuggggcugguuaaugcaggugaggaaccagcgguugguauugcgaaaggcccggcggaaagaaggcucuagaaccugcuuauagagccacaacagggugcagacaacugugaugucagccaaugucacucguucgcccaccagaaaaguccucgucuucaaguaagcauccagcagccccagaauucgccucacuuccuccuuugcauucucaguggccuguuuguuguggugcaugaugcccaagguggggaacacccagguacuggcugggggcacuauaucggaaucagcaaagcucacccacugcaccaccugggcugcugccucuggaguacuuccccgcagcuccucauugcucacauaguaggcaauggcguugcucucaaacacacagaauccaucaucacccucaaaugcugggaccuugccggcaggaaauuugcgaagaaauucagaggugcgguugguuuggccaaaauggaagugggguggugcggagagcacgcggaucugagccccgcuguacugagcagcgaugagagccuugaaggcccuccaguuuucaggauacguguacagggucccagccgccauggugauuccgcaaagaaag

SEQ ID NO: 12670 - RNA, 3120 nt, Homo sapiens
ggccucauugcuacgauuucagaguacccugguaauagcugagcaugcaaaugauucccuagcacccauuacuuuaaauaccauuacugcagccacacgccuuggaggugaaguguccugcuuaguagcuggaaccaaaugugacaaggugagaaauuuuuaaggucagccauagcaaauauuaucuccaucaagagacaggaaaagauggcaacagagaauuaugcuuaggauuguaacccaaacugggcucuaauccucauuaaauggucagugucacaaccauuaccaugugugaaaaaggaacuaaaagguuucuucccuaagcauuuuaucuuuugaaaugcaguagaauacuugauuuaguuccacuggcaccaucaugugccaucagguaccaaguggaaugauaauauuugaguccccuuagagguuaauagcugaucucuuuuuuguguugaugaauauacuugguaauugcuucuaauuccugaaagugguaaaucuggacaaaguauuauggauguuaauuuuuaauugguagaagaauuugaauguuaaguacuauucuuuccaaacucuagcugguacuaaaagauguucuuggguuuguuuguuguuguuguuguuguuauuguugaaaucagaugauaacagcuuggaacacuaacccucuagaaaggugcuaugauaugauuugcagggucuauaccaccagccugcaauauagaugagugcuucaguuaagcuuacacaccuucagccaccaguucccucucacaugguauaggaguugcugaguguguaguugggggcuuaaacuucacagaggaauaaaucugaagggaguauguuuugaggauuuuauguuuuauuaaauaauugaugcuggcugggcaugguggcucaugccuauaaucccaggacuuugggaagcugagguggguagaucacuugaggucagguguuugagaccagccugggcaacauggugaaauccugucucuacuaaaaauauaaaaauuagccaguguggugaugcaugccuguagucccagcuacuuggaaggcugaggcacgagaaccacuugaaccuugguggcagaguuugcaauaagcagauauuguaccacugcacuccagccugggugacaaagugagacugugucucaaaaaauauauuaaaaauaacaauaauucagagcaugugauaauggagguucauacugcugguguugcuucugucuaauuuuuuacaugaaauugauaaaagaacauauucugguggguuuaugauuaguuauguggauuucuuuacccaauuccugcuaacaacuguaggaucuuacauaguugauacagccacaaugugugaugugugauggcuaagcuaucuauuuguaugucuguauuagccacaguauaugauggcuaagcuaucuuuuugguuucccuguuuuuggauauauaggaauuugugauuuguuguuuguuuugcugugauuuaaaauaauuauuguaauauuacuuuaaaaagacuuugauacuuuauacuacuuugagaaaaaucaaaauagaaaucgucuucuguacucaguuacaauccuaaccugucauguucuaauuuuaaagaaaacaaccaguaccuguaugaagagaucguuuaauagaguucgguuuuauaccauuuuauucagcuacuugucauaaacagcaaguuauucuucuguauaaugccagccguuuugccaguaaaaacaagauaguuucaaugggaaaauucugccccauuuucuaucccaugcugcuaugcagcuacauugcaauuaacugaguuucuuaauuggaaauucucuuaaaguuugagaagcuaaaugcagcugcauccauaauaaagggccucuguaguacaaaugguaugccggugaacacuugguuuagcagagaauguauucuugcacugcauccuuucuucagugaauauuguugcaagcuaacaguucauaugaggguggcacaaggcacagccuuuuaauccuacucaucagugaaucaaugaaucaguuuggagguaaacaaggagacagaagacgauaguaugacugauaugacuuagcuaaaguggaaaccagccaugagguaauaaagauacuuaaaaaggggaaaucuaauugccuucugaauauagaaaaucugaaucaucaaaaagcuuucucagaaccccauucuaauuccaaacaggaaaaaugaagaauuaaaauaggaaauauuuugcuuugucauagauaaauauguguaugugggcaggaacucagugguugacaaugggauguuacuagagaacuucauuuucaccauuuccaggacauugaacuuacacuuggauugaaccaaaaguaaaaagcacaauuuauaacaaaauuugaauaaagagccauguugauuuugguuugucaauuagcacuuuucuuuuucaaggcaggaauuuuuguugaaaugcuugguaguuggacaguguaaggucagucaguaguaagaucuauuggcauuagauuuucuuuguuaaggaauguauuuuaauauuuuaauucuuuguuuguuugagauggaguuucacucuuucgcccagucuggagugaaguggugugaucuuggcucacuguaaccuccgccuccuggguucaagccauucucuugccucagucucccaaguagcugggauuacaggugcccgccaccaugccuagcuaauuuuuguauuuuuaguagagaugggguuucaccauguuggccaggcuggucuugaacucuugacuccggugaucugccugccucagccucucagagugcugggauuacaggcuugagccacugcgcccggccggaauauauuuuaauucuuaacuggcccuuuugcuaauaagaauaauuuuuacaguuggccauuaagauuuuaugaucuguugauauuuauagugguggcuuuauuuguauauuucugauagauggauaauuaggaacuuaucuuuuaaucauagguggcacaagaucucuguaaaguagcaggcauagcaaaaguucugguggcucagcaugauguguacaaaggccuacuuccag

SEQ ID NO: 12671 - RNA, 3120 nt, Homo sapiens
cuggaaguaggccuuuguacacaucaugcugagccaccagaacuuuugcuaugccugcuacuuuacagagaucuugugccaccuaugauuaaaagauaaguuccuaauuauccaucuaucagaaauauacaaauaaagccaccacuauaaauaucaacagaucauaaaaucuuaauggccaacuguaaaaauuauucuuauuagcaaaagggccaguuaagaauuaaaauauauuccggccgggcgcaguggcucaagccuguaaucccagcacucugagaggcugaggcaggcagaucaccggagucaagaguucaagaccagccuggccaacauggugaaaccccaucucuacuaaaaauacaaaaauuagcuaggcaugguggcgggcaccuguaaucccagcuacuugggagacugaggcaagagaauggcuugaacccaggaggcggagguuacagugagccaagaucacaccacuucacuccagacugggcgaaagagugaaacuccaucucaaacaaacaaagaauuaaaauauuaaaauacauuccuuaacaaagaaaaucuaaugccaauagaucuuacuacugacugaccuuacacuguccaacuaccaagcauuucaacaaaaauuccugccuugaaaaagaaaagugcuaauugacaaaccaaaaucaacauggcucuuuauucaaauuuuguuauaaauugugcuuuuuacuuuugguucaauccaaguguaaguucaauguccuggaaauggugaaaaugaaguucucuaguaacaucccauugucaaccacugaguuccugcccacauacacauauuuaucuaugacaaagcaaaauauuuccuauuuuaauucuucauuuuuccuguuuggaauuagaaugggguucugagaaagcuuuuugaugauucagauuuucuauauucagaaggcaauuagauuuccccuuuuuaaguaucuuuauuaccucauggcugguuuccacuuuagcuaagucauaucagucauacuaucgucuucugucuccuuguuuaccuccaaacugauucauugauucacugaugaguaggauuaaaaggcugugccuugugccacccucauaugaacuguuagcuugcaacaauauucacugaagaaaggaugcagugcaagaauacauucucugcuaaaccaaguguucaccggcauaccauuuguacuacagaggcccuuuauuauggaugcagcugcauuuagcuucucaaacuuuaagagaauuuccaauuaagaaacucaguuaauugcaauguagcugcauagcagcaugggauagaaaauggggcagaauuuucccauugaaacuaucuuguuuuuacuggcaaaacggcuggcauuauacagaagaauaacuugcuguuuaugacaaguagcugaauaaaaugguauaaaaccgaacucuauuaaacgaucucuucauacagguacugguuguuuucuuuaaaauuagaacaugacagguuaggauuguaacugaguacagaagacgauuucuauuuugauuuuucucaaaguaguauaaaguaucaaagucuuuuuaaaguaauauuacaauaauuauuuuaaaucacagcaaaacaaacaacaaaucacaaauuccuauauauccaaaaacagggaaaccaaaaagauagcuuagccaucauauacuguggcuaauacagacauacaaauagauagcuuagccaucacacaucacacauuguggcuguaucaacuauguaagauccuacaguuguuagcaggaauuggguaaagaaauccacauaacuaaucauaaacccaccagaauauguucuuuuaucaauuucauguaaaaaauuagacagaagcaacaccagcaguaugaaccuccauuaucacaugcucugaauuauuguuauuuuuaauauauuuuuugagacacagucucacuuugucacccaggcuggagugcagugguacaauaucugcuuauugcaaacucugccaccaagguucaagugguucucgugccucagccuuccaaguagcugggacuacaggcaugcaucaccacacuggcuaauuuuuauauuuuuaguagagacaggauuucaccauguugcccaggcuggucucaaacaccugaccucaagugaucuacccaccucagcuucccaaaguccugggauuauaggcaugagccaccaugcccagccagcaucaauuauuuaauaaaacauaaaauccucaaaacauacucccuucagauuuauuccucugugaaguuuaagcccccaacuacacacucagcaacuccuauaccaugugagagggaacugguggcugaagguguguaagcuuaacugaagcacucaucuauauugcaggcuggugguauagacccugcaaaucauaucauagcaccuuucuagaggguuaguguuccaagcuguuaucaucugauuucaacaauaacaacaacaacaacaacaaacaaacccaagaacaucuuuuaguaccagcuagaguuuggaaagaauaguacuuaacauucaaauucuucuaccaauuaaaaauuaacauccauaauacuuuguccagauuuaccacuuucaggaauuagaagcaauuaccaaguauauucaucaacacaaaaaagagaucagcuauuaaccucuaaggggacucaaauauuaucauuccacuugguaccugauggcacaugauggugccaguggaacuaaaucaaguauucuacugcauuucaaaagauaaaaugcuuagggaagaaaccuuuuaguuccuuuuucacacaugguaaugguugugacacugaccauuuaaugaggauuagagcccaguuuggguuacaauccuaagcauaauucucuguugccaucuuuuccugucucuugauggagauaauauuugcuauggcugaccuuaaaaauuucucaccuugucacauuugguuccagcuacuaagcaggacacuucaccuccaaggcguguggcugcaguaaugguauuuaaaguaaugggugcuagggaaucauuugcaugcucagcuauuaccaggguacucugaaaucguagcaaugaggcc

SEQ ID NO: 12672 - RNA, 79520 nt, Homo sapiens
cggcccccggaacgguaaacaguggggucacgugacacggccccucuccagcucccgcgccgccgccgcacgccgauggcugcggggucucgcgccgucgcaccguccccacgcggcaagcgaccuucgggcucagggcggcggcggcugcaacgaggauuaggagggcggcgcggaagccaagaauagugucgucagcagcagccauuuggucccaggaggaaaagaggcuguggcagcgacgccgacguccugcgcguacccccucuccgcggcacccaccgggcccccuccuccuccucuucggcggcggcagcguccaccaucuuccucuugcugccagugguagcgcucgucuggcggagcugggugaguugcggcuguggccgcggccagggagacgggcaauccuccccucccccauccccuuccacacgcacagcgccuccgcgggccucuccgccccucccgcggcggacucuccgcgcuuuucucccgcgcagccgagagaucgccucucgggccucuugcgcaacguccucggccuaccugggccgcgccgcuggcgccuguggaccauuuggaccgcgggcuggggagggagucgcagcgacgcggucgccaggcggagggucgggaccacggccucucucccgaccacugguacccagccgucugcugcgagggcgccccgccgccgcugaggcgcgggcgcgcaggcccgaggcacggcgggcgcugccuggaaggcccgucucgcaggcccccggauccggccguuggggccucuuccuucucagggagccccagcauggagcuuugggccuugguuucgggaaacugggacuggcccuggcugcuaggcugcucccugcugcugcuuuuuggagaugagaguugcucuuccauuuauccuccaguuaccgcgcgcuuuugugcccgggacucaaacuguggacuccuuuugcuuaguuugaaaugagaagccuagacucuugccuuccgauaauacauguaauuuaaugaaccacuugucgauacguacguguuaauggugcuaaauaacugaucaccugacacggggggcgggggcggugcggagaguagaaaggaagagaauguugauaucgcgcacggaguccugugucccuccuuucccucaggauguguugccggguuaggugaccuuuuuccaucuuugggcuuuuaaaugccaauuccuagagacuagauuggggugguuauuagugcuuuccaguagucacgcguagaauauguucauggauuaauguuaaguggcaacacugcuuuaauauucuaguccuaaucugcauuacauguagcgauauuuaauuuaaaaagaauaaucgauuauugaggcuucucuaaauacuaacuuuacuaucuuauuuuaagcuaaauuuaaaaaccaaugcaguaaacucuguagggaguacuuaaacaguacguuguuguauuuaguuacuauuuuggggucgaacuugucuucccuuugacaaaaugauuguuaaaggccuaacaaaacuacgccuccauuauucauuuuucgauuccugaaugaaguguuuggaacugugaaaauauuuguagaaaaagauguauguuuguguuagagcgacauguugagucaaagcaccagaaacuuuucuauuguagcauacuuauguuuuugaauuuauagcucccuuccacagcacaaaaagguguuguguaaagauuauuguuauuuuaaauaguaauuuuaaaguuuaguuaucacuuagaccuuuuccccacuaauuuuucucuucauucaucuguuuacuggcuauauauuaccauaaugauucuuuccuucaucaucgucauuaucacuguuauuauuauuuuacaauacauacuucauuuucuggugauaguagcagaguuuaguggcagacuuuuaggagugaugauuccucugauugagccacacaaucagucccgaaacgggcuacuuuuauguaaaaagauuacaacuuuagauuuuaagcuuuuucagauagcuguacucgguaauuugucaaaaugauaaaaaugagccagugaugggaccaaaguuugccucuuauuuacauuuuuuauagguucauuuauugaagaauagaaaaauauaguuuauuuuacugcuuuugcauacacgugaauuaugcauucucucuuguugggauagacuucagauaacuuuaucauguugaucuuaugguauacuuauauguugcauaaucagaaaagucaccucugagaaguggucuauguaaauguagguaaaaaauugguuuggucagaugcacauuucaagauagaaaaaucgaaaggaauuugucuuuaaucauuucaaacuauguuauuaaaauuuaaauuuuauugaguauuggaauccacuaggaaaguugacagucuuugacuuauguaauguauuacuuauaaaaguugggaggcagcaaguggcaauuuggaguauugcaaaaucaagagcuuagauuuuuuucauaguauaaggccuacuuggaaaaacuggugaaugaaaauuauacauacaauucuguguuucaguuacugaaauagaugauguuuaucuuccuuaacauggugggaugguguuugcuuuuuugauacauuuugccuucuuaagauccauuuaaauuucucauaaaauccuuuuuacauauguuuuuucuggagauaauaacuuuucuguuuuuuagugagauaaugagauuuuuuggucaacauuuagguuuguguauuaccaauacauauuucaccacacagugucaaggaguucaggauucuuagggugcugauuucuaacaguuuuuauucauccacauuucaagaauucuuucugacaaguggcugcuggauuuuuuucuuuucuggaaaaguacaucuugggcucuguuucucuuauuucuucuuggagcacucucucagaauucuggaguaucuuuucagaaggauagacacuuuuucaacuauaaaaauugcuuggcaaacuguuagacauuuaugauacuguugcauuuuugagaacacagucaaaaaauauucuuuaauuguugcccuuugauuacacauggaaagauauugagaguauugaugugauuaaacauacaugagacccugaggcuguuucuauucucaguaaagauauuauagucugggaaacaagauucauugacaucugauguuaaucaguguauuagaguuaaaggggaaaauaucaagaguuuuaugaggaauugcuauauguguggacuugacaauuauuguccugcauaaugugcuuaauuuagaccauuuuuaaugguauuuuaaaauuuuaugacuauuauacagugaagaguggauauagagaaauaguucaguaaaaauuuuaagauauuuccagaaguuuuaaccuguuggcauaaucuaacuuuauuagacaguuucgaagagcgugguagauuauacagaaaggcugaacuuuaacauuuuaauucguuuguaauuugcaugagcugggcacaugaaagcauaaaguuuuagacugaaaauaaauggaaaaguuuguagcugauaaauugcuuuuccuccaaugauguucauaugcauugaggcuuacauuuuguuuuuuuuuaaauguguagaggguggcuaagugcauauuccuguuuuauuuuggaagaaggaugagucacuuuuguuucuagcauuuuuuaagauuucauuaaugauauauuaaaagcauaaaaauuaauguguagagugcauuauagaguguaaaaguguaggcucaggaaucacacugaauggguucaaauguaggaauauuggguaugugaccuugggcaaauuauguaauuaucuaggucucaguuugcucuaaagagaaaggacuaauaauugcaccuaccuuauagggucgcugugaggaacuaaugagauaaugcauacgauacacagggccuggcauauagugugugccaauuacacguuagcuuggguuguuacucccuaggccauaguuuuaaugaugagcuagguccacuacuuuggugguuuauucaaauuccuaaugcuuauaaugucaguuaugauauaaugccaauauaguuguaaacuuugaaguuaacucuuucuuguuacuguuggcuacuguaauucuguguuugccaguuucaacaucuucagauccuuuccuagggacuuaggucugcuuuggucuuaguugucuuugugcagcagacacuuugauaucuucuuuuuaccagauacauuuagaaaaguuaugauccuugcuuucuauaaugaugucuugccaauagauucuaacuaacgaaacugaaccagauuugaaguggggguguagaguagaugacuagguugaauugcuuuguagaaugauacuuuguaguauugugucauaccacauggccuaaccacuuauuaauuuuugacucuguccucgaaggauggauaacccaugauucaucuuuaguguuguuauaucauaguaguuaagaacugaccuuaguguaaugcagaguggaucugaguccuggcucugucacuuauuuauuuuguaauauuggguguaacuuugcuaaacuuuagccccucucuuguaaauuggggaugauaguaccugccuaaugguuugguugugaggauuaaauggcaugaugcauuuaauuuguuuagcacaaugccuugcacacaguaaauauccagugaguuuaaccuuacaaacacauagggcaguuguaagcacauugacucuuaaaugaaauuuucuggguucagauuuuagcucuguucuuccuguaggagauagcuuaaacaaacaaacaaacaaaaccaaacaacuuuuaguuccaucaccuacuauggcaaauuauuuaaacucuuugauccuaauuucauuuuauuucaauuuuuauauaaucaggauaauaauauaagguuguuuugaggauuaaaugaauuaaaaaauguagagcagaauuucuuaaacuugacuguugacauuuuuggcuggauaauuuuuuguguguguguggggcuguccuagugcauuauaguauguuuacuagaugcaaauaguacccuuuccaguugugauggccaaaaaugucucuagacauggcaaauguucucugcaugggcauacucaccucugauugagaauuauagauacaaagcauguagaacaaugccugucuugaaguuugagcacaagaaguuuuguuuuaucauuacuggugguaguuuguucuucuacugcuacugccuauuaggaauuuguuuuugguaagcaugccugaugaaauugcuuauuuuaaacgaugguaugggggcugaaggcaucaagugugcuccacuuuuaagaccuuuguacuucugggucuuugucuggauugcucuuuggcauuuaugcauugaucacuaccucacuugagauuuugguucaaauguuacgcugugaggccuucacuuacuaucauacauagaccaaucccccaucaccaccaccaucacuauugccuuguauaacuuuucuugagcgauauuagucuccugauaaauuuuugcuccccucacaccaccccccuacacacacacccacagacacaaauguagacuacgugagagacaacuucaucuuaguauauaaccucuuuggccuuugauagcuuuagugauuuauuguuagguguguauguguguguguguguguguguguguguguguguguguguguuuuaggaaauaauaggauagaauucauagguuuacuuugaagguguuuuaaagugaguuuuuguaaaguguaauuuuuuuuuuucgagacggaguuuuguuuuugucuuccaggcuggagugcaauggugugaucuuggcucacugcaaccucugcuucccagguucaagcuauucucccaccucagccucggauuacaggcaugcaccaccacacucagcuaaucuuuuuuguuuuuaguagagacgggguuucgucauauuggucaggcuggucucgaacuccuaaccucaggugaucugcccgccucguccucccaaagugcugggauuacaggugugagccauggcgcccggccuaaagugaaauuuuuuuuugcuguugacacuuucuaaaucucaucuuuuugcguucuauuaauacuugaaacacuugaaaagcaauuaggcuauuuuguuaguauaaacuaaaccugacuucaguauaauucucugagaauuacagaugaaacauauuuuaaagcaggaaauaucuucggacucagauuaaauuuuauuugacaaauuaguaccaauuauuuuuaguuguauucugagucuuuauaaaugguccaucaggaccaaacucagccauucauaauuaagacaugcuguucccuuugccuagaauauccucuggaccauuaggauccagcuuacacaucaucaccugccuagccuuuguuagcuuccagaguuucaccuuccucugugaagcccuucaauacggcauuuagcauuuuguugugauguuuauauguguuguauuugcuuauauguuuaugucauuuugaauugugaguuuuucgacuuucagauggguucauuucacuagacuuaaaaugcuuuguaguagaugcuuaacacauguaugaguaaaugaauaauuuugaauuaugcagauuauucacuuauauacuuagcugcauauauucuguugucuguaaaaaugaauuuacccagaaacaauuucugacuuuaacauguauauucccaaauuaccaauacggauuuaauuggauauacacguaucaucagccauuuaaaauacacccuauauaggcuuauuauguuuuaauuauuuagaaugccaguagaugggcuuccuauguuuuauuaaauuuagaaugccaaauauaggaaagcauuuaaguaaaauuuuaguguaagaaacaggaauuuguuuaaauuagacaauuuguuuaauuaacaaagauacuaaauuggcuccuaauuuucccccuuaauuagaucugauuaucuguuagccacauuacuagguaucccagaauauucuuagauuaguuuuuuuaagacuuuauuuuguaauaauuuuauauuuauagaaaaguugcaaaggguguguaguguuuguauauacucuuaucuaguuucccugauuauuaacaucugacauaaagcuagugccuuuaucagaacagagauuauuauuauugguguauuaccaaugauaaugguaaauuacagacuuuauucugauuuuaccgguuuuuuuuugcuacugucccuuuucuguuccaugaucuaauccaggguaccacauuguguuuaauagauuaguguauccauuacaagugaguaaauauuucuacauuuggcuaauuuguuugccuguuuagcauuagagcuauuuuauuuuugagacugaucacuuuguaucugaaacugauuuuuaaaaaugaauuauaccuccaguaaauguuacuuucaagggaguucuuuuggauggcuacaugcuguucauuuuuggcauuuucucuuuggaauuaucuccagagccaguuggaaccacguaagaaaaauuauucugacucauuuauaacaauuuuccuuaaaacgugucccaugaaacacuaggauugugauuuguccuguggaaauugucuucuuuggacucacaaaugugauacgcuuuauuacuauguucuuagaagauucccauuuucauuagcuuacuaaacaugucucacacaaugguagcugcuuaguaaacauuugaugaauaaauaaacgguauuguuaaagaaacauaacuucagucuaucuccacuugugacuguggaaaccuuuuuccggauaaugccuguuuaaaucuggggaagcauacuucauaagucauaauaguuuugacuuaaaaacaguacuggaaaacuugacccauuuuauuuacaauaugcuuuauuuaaaaaaaaucgaucuucaagaaauauauuacaggcucugaagccacuuucaguaaaggaguuuuaggaugguuucacuaauagcaguauuauugaaaacaaaaaaaauugcuccuuuagaugacuaguuagaauggccuggucuucaguauagcuaugggaucuugagcuuugugaccauaacuucugaauguugugaauguucccaucacuugaaagcucacagcauauaguugguacaacaggaagaccucauaggaaguuugcagaauuugcuggccucauguugcuaugguaacaagugcauuuacuuuuucaguagauucaguauaccguuuuuugaaggaagguuagccauuuguuucuagggcugaaacugccuuuuuucuuuuugauugaucugagaaaaaagauuacuaauugggaugcaacucucugaagaggagguggcuuugguuugcuguauuggauuccaguauguucagauaaaugaauucauugguaguucuacuuaauuuuguaaacauuuagugaauauuuucauaaauuauuuuuaauuaccagaauuuaauauacuaaauuuuuuuuuggaaccuaaaaacauauugggcguaaguauugguguuguaugauaaucgagacuuucuuuggcacugagaugauauagugguagggaauucuuaaaggaacuuguccugaguuuucuucagcauugcuagcuacaauuuucugucaguugagagaaugcauguaaaauaagcagcaaaucuguaaaguaguuagcauuuucuuucagugcuuuauuaacauuucaguguaaauaaauggaaaaaaaaugagaagagauacugaaacuucuauuuagaaggacauuaacuuuugugagagaggaauuugcuuuuuuuuuaaaaaaaauugagguauaauaaaugcauucauuaaaaaugaacagauucgugaaaccauuaucacaaccaagauuuaggacauuuccgucaucucucagguaugcaccugcccuuuugcaguucauccuuucccuauucguggccccaggcagucacuaauuuguuggauuuuuuuuuuuuuuuugggcacagguucuggcucuuuugccaggcuggagugcaguggguugauuucgcugcaaccuccacuucccgggcuuaagugauccucccaacucagccgcccgagugacugggucuacaggcacacgucaccacaccuggcuaauuuuuguauuuuuuuuuguagagacgggguuucgccuuguugccuaggcuggucuccaacuccugggcucuagugaucugcccacuucccgaagugcuaggaauacaggcaugagccacugggccuggcaggaaaauuguuuuuaaagagcccuuaaugagucagaucaucccagcccuuagcucagugugaaaggguaacacuuacuaauggguaugggcuguggagcuugaaacccaggcuagaauuuuggcucuguuuugugacuuuggggaagacauuuaaauuauucaagugcauuuuuuuaaauaaugcgaggauguuaauagacccuguuuauuauuggggcuuaaauuauauaaauguugguuaaauguuuuguacaguaugacauauauaacuagugaauguuagcauguaucugaaauucuucccucauuuuuauagggggagagaauucaagacuaguuugaggaaauuuuguuaaauuuggagcuaaucucaaaaaucuuggaauuaaggagcccaggauguuauagguuaaucacugggacuuuuuguuaaauuaauauuaacuuuuuucgguugacuuuccacccccuaaaauauguugauucaguuuucucucaaacugauuuaacuuaauuguuuuaacuuuucauaauugaggcuccuguagagcuuugaaaugacuuugcugagcaauguagguacaauucaaaugggagacuaacuugauacuuguauagaccacacauaacuaaaauaaaucuaaauacaugauguagauugucuuugugucauuuaucuuguuuuuauccuauaagggggccuugaaaaaagguguguuugugcacaucuuuguguguguguguagucuuuuaaguuuugauuuguuggguuaauaguuucuuuuucauuuuccaccucuucccccacaauaaaagcccuuugucuauauauauauuaccuuucuuuaaauaauuuuaauacuuuguaaauaaaacaagccuacuuuaugguuuuaauagguaugggauaaaaauuuaaaauauuugauuuuagcucuuuuauguggacuuauuguaaaagcagugucugaugcuuaauuugugaaaagguugugguuaaaaacaauaguuuuuaugcuuuaagccauguaauucuuuuguaugugucaaguuaauggacuauauacauaguuuuuuuuuccuaaaaauaaugaacugaguaaacauuuaguaggauuucugguaaaaugauauacuacaugcaugaugaagaaacauuauuuaguaaagauucguucuacauuuccaaauguauauucuaaaaacaagugaggauuuuuuuuuuaaacaacaauucagaaauaccuuaaguguguucuuagacucaaaacuauuaaaauaauuugguauuaggugauuuucaauugauagcuuuauuucuuaugguauuuuuuuugucuuucuauagggcugaaagacacacagaagucuucauggauauaguugauacauuuaaucauuuaauuccuacugaacacuuagaugaugcccuauuucuaggauccaaccuggagaaugaagucugugaggauuuuagugcaagucaaaaugucuuagaggacucgcugaagaacaugcucagcgauaaggauccuaugcuaggaucugcaaguaaccaguucuguuugccuguuuuggauagcaaugaucccaauuuccagaugccuuguucaacagguaauucuuacuuuuuuuuuuuuuuuuuuuuuuagucugcaauuuaaaauaaaaaaauuuucagcagcuuuuucuuuuuucuuuuuuucuuuuuuuuuuuuuuaaugaggaggguaguaaauuuaggguuauuuccuuugaauuuagagcuucuuuuccaggcaucagaauuaaaauuuaaacuaaauuuucuuccaaggaguguggaguuauccucaaggauauuauggauauagguagggugaccauauaauuuauuauccaguaugggacacuuacuagaauuacagagaguacuuuaauaauuacaucaugacaacagguguaaauugggacucuuuaguaaauagggauugcccggcaaauugagacauguggucaccuuaggccugcuggagucgggggauggcugaauugaccuuucucagcauaccucccagccccugaaauauuuacauuguuugcucccauuucaccuccuuugguauuuuguacauguaucuuaaaaccagagaaagaacucuauaccucugcugcccuggacaguaaacacuagccacaugucauuugcaaugagucuggucgcuugcaaugagucugguccuaauugagaugugcuauaaaaugcacauuagauuuugaagacucaguaugaaaaaaaguuaaaaaauauuucuucaauuuuuuuauguugcuuaugugcugaggugauauuuuggauauuugugguuaaaauuuaugucacuuguuuuguuuuuuuugccuuuuuaaaagugacuacuugaaaauucaaaauuacauaugugucuuauauuucuguuggacagaaaagggucuguaguugaaguaacugaaagacugaagauaguaauuuucuguaaggcuaaacuauccuuaauaagaaauuacuuugucauguuaauguauaaaaaacaguuuuucuuuuauaaagcagagaaaauauuacuguaaacguuguggcaauuacuaauagcuauucugugaguaaaauuauagguaaagguaaaaucagccucccauggaacaguaagguuuucccucaccauucccuagaguaaauaguucucagguuuaugugauguugguuuguuuuucauugacuagacuuuuucuccuguacaguuuguucagcauauuuuucauuuuuuaaaacauuuucuauguauauuuuaaauuuaauacggcaauacuuaaaguugggaauagguggucugcuguuggcccuuaaguuugccagguuacucugccugaggaccucaacacuggcuacuaggaagcuucauuuuaacaacuuaaaacugaggucuuuugaauugcuugcuaauaguguaucucugaauuauuuauauuauguuguguuauuacuuagguuuacauuguucuguuguuguauucuaaauguuuuaaagcuuuuaaaauuuuguuuuauguaugcauuguucaaguuuuuuacuuuggugcuugugucaguauaguagcucuaauuaucuuuauuuuuaagcauuuuugacaguguuugguuguaugcugacuguuuccuaguuuaguccaaauucaggaagaacauuuauuuaauauuaacaugguuguugcuggaacuccaguuaccuucaagggugguuauauuggauguggaacugacacaugugucaucuuguuagacuauuuuacuuauaaaauuccaccccuauaguaauaccuguauuccuacuuccuguccuuuuuuaaaaauugauuucuguugauaaugaaaaguuuuuauuaaugugaaaaaucucuucaguuuuguuguacauuucuuuugcuaauagaagacuuagagcaccuuuaugaaguacauagaaauuuuuugagauacgauuuauuauucguuugugauucuguuaucuuuuaaaugaacuuuuaaauuuaggaacuuaaauuacuuccuaaauuuucugauauuaaaauuugguuacuagaauuauuuaucuuugauucuguagcagaauguuuguauugguauauguauaguguauauguuuuuaagauauguaaggaaauaugugggggaaacuuaauaaggcuuuucuguuuaggauuguuuaaauuucauugugccaucuagcaggggauuuaucuugauuucuucaaaguucuuuuccuuuugggauauuugggucaguaaaaggcccacacauuuucugaaagcaaaauggaaaacauuuuugaaaaaaaauuuaacuuuuuguuagauuuaagagauaauugcaaaaaagaaaucuuauuuauuuauuuauuuauuuauuuauuuauucauuuauuuugguagagacagggucuuguuauauugcccaggcuggucucuuaacuccuggccucaagcuauccuccggccuaugucucacagagugcugggauuacaggugugagccacugugcuuggccugggaaaucuuauuguaauuauugaugaaaacccuguguggacaggaacuuucagcuauuuauaaauaacuucagcuguuuuuaaauaaaaacaacauaguucuugcccagauuguuguuucuggcacaaugggcuuuuacuagcuguuuucauugaagcuaagcagggaaauaauccuauauguauuccuuagaccaaugaaagcuauagacuguggcuauuuuguaaccuuagugcuaaaauuagcuaccaaaauaauugcuacaucaucuuuucuguuaugaugaaccaggcugguuucggaccaguauuuuuguuguugacauagugauuuggauuguauuucagcugucucaaaaaaucauaguuuuagaaaauuauaaaaauaagaaacauagaagauuacguuuagugcucuguuggauacacaaaaguugggaugccaguuguuuuauuuugagagaaagcagccagcuuucuucuuugaaugcuuuugacugugucaaguauuacuucaucuaauuguaguguuugcauaugguuuuuagaugugcccauuaauauauuuuuuuaaccucuagcaaguaagcaaaagaguauuuucccaaguaacagguuugagauagugaauauacuguuuauauauaccacuugaggaguguauucaaaaucacugaaaugguguuuacuggcaguaucaguguuaugaagaaauguuuauuuuaucucucauuuuacaaacaaauguguucccuuuuuacauugacagcuaagcuaugauucauaaguguggaacaaucuuguguuuacaauccauuucuuaauaugguauauugaaaauaaauguucaguggcuguaaguugauaucuuuaguuuuuacaauauaguucaacauuguuuuaagaccaacaaaacagacauacuguagaaacaugagccuuucauucagauagcacucuuaucugcuacuguagguuacuacuugcagcuacugcauccuucagugaaaccaagauguccuuucaaggcugcauuauggcuagcaaaaucaucauucacuuaauuaaaaaaaaauucucuaguaugguuuuuggagguuaagcaaauuaaaaagucauugaacucuuacagguaucccaaauauuugggaagaguugauucauauuguguaauugaguauuuuuucaaguaaaggaaaacaccugcuuacaucacauguugcuuuccuaucauaaaugacauugauauuauaugacaucaagcaguguuguucgauagaauuuuuacuugcacugcuuucaagcaaaguguuguaauacuuguaauauauguuaagacuaguuuuacaauuaguaaaacuaucaguaauagugugauuuagucccuuuuuuggcauaugaauuuuaaacuuuagucauaccuaguuugaggcuccuuuaucacuagacaauucaucuauguaauauuggaaaaauuauauugcacuuguucuggaaaaaagguuugguguaccagugugucacagauuuguuuaaaaaguuuuggguuuuauggcuuuguguuucucuuggacagcauuucaaucagacaguacauugaacuaaacguaguggcucucuggucuagugaaauucaguuuucagauauuuauuacucccuauuuguacuuucuuggggguugguggggcuauuugugcauauuaauuagaucucugaauccaacuacacauauaaguucauuauauaucuucacuggagucuugacuguuuuuguuuauuauuaguugauuuuuuuaaagcuucugugcuucaaugaaccuuuuacauuaauaacuuauuuuugagaaucgaguuuuaaaaaauuguuuuugacacauaauuguacguauuugugggguacaguaauauuuuuaugcauguguacaauacguaaugaucaaauuagguuaauuugcauauuuaucagcucaaauauuugucauuucuuuguguuaggaacauucaaaaguugcccuucuagcuauuuggaaaugcacaauaaauuguuaauuguaguuacccuguaguguuaauggaguacuagaauuuauuccuccuaucuagcuguaauuuuuucuuuuuuuuccuucuuuuugagauggaguuuuucucugucauccaggcuggagugcagggggccgaucuuggcucacugcaaccuccaccucccggguucaagugauucucuugccucagccuccugaguagccgggauuacaggggccugccaccaugcccagcuaguuuuuguauuuuugguagagacaggguuucaccauguugaccaggcuggucuugaacuccugaccucaagugaucugccugccuuggccucccaaagugcugggauuacaggugugugccacugugcccugccuaguugugauuuuguauccauuaacaaacuuuuggcuauucccccugcuccuuccccuuccccaacucugguaaucacuauuguacugucuacuugugugagcucaacucuuuugcugcuauauaugagugagagcaugcgguauuuauauuucugugccaggcuuauuucaccuaauguccuagagcucaucuguguucccauaauggcagaauuuuguucuuuuuuaaugguuaguuaguauuccauuguguauauauauaccacauuuucuuauucauccaccuguugguagacacuuaggucgauuucguauuauggcuauuguuaauagugcuguaauaaacaugggagugcagagauacugauuucuuuuccuuuggcuauuuaugcccaguggugggauugcuagaucauaugguaguucuguucuuaguuuuuugaggaacuuccauauguuuuccauaaugacaguacugauuuacauucccuccaagaguguguaagaguuccccuuucuccauauucuugccaguguuuauuauuuuuuaucuuuuugauaauagccauucuaaaugggaugagaugauaucucauuguaguuuugauuggcauuucccagaugauuagugaaguugagcauuuucuucguaugccuguuagucauuuguaugucuauuuugaaagaugucuuuucagcuuauuugcucauuuaaaaaauuggauugcuuuuuuguuguuguuguuguuugaguuccuuauauauucuggauauuaaucccuuguuggauggcucaguagcaaauauuuucucccauucuguagguuucucuucacucuguuuauuguuuccuuugcuguccagagcuuuuuaguuugaucuaaucccaauugucugcuucugcuuuuauugccugugcuuuugaggucuccauaaaauuuuugcacagaccaauguccuaaagcauuucucccauuuucuucugguaguuucuuaguuuuggaucuuacauuuaagucuuuaauccauuuugaguugauuuuuguauauggagagagaugggguuuaguuucguuuuucugcacauagauauccaguuuuccuagcaccauuuguugaagagauuauuccuucccaaaugauuguuuuggugccuuuguugaaaaucaguugguuauaaauauguggauucauuucuggguuucuuuuucuguuccauugguguguaugucuguucuuaggccaguaccaugcuguauugguuaucauagcuuuguaguauauuuugaaguccaguagugugauaacuccagcuuuauuauuauuauuauuuuuugcucaggauuauguuggcuaguuuuuuuuuuuuuugugguucuguguauuuuuuuuugugugugugguuuuggggauuuuuuuuucuauuucuguaaauaauguuacugguauuuugguaggcauugcauuuuuugcucaggauuauguuggcuaguuuuuuuuuuuugugguucuguguauuguuuuuuuugugugguuuuggggauuuuuuuuucuauuucuguaaauauuguuacugguauuuugguaggcauugcauugaaucuauacacugcuuuugguagguaauguggucauuuucacaauauucuucuaaccacgaacguuggaugucuuuccauuuuuugauguguguucucuuuaauuucuguuauuaguuuuuuuuguaguuguccuugcagagaucuuuaaccucuugcuuaaauuuauaccaaaguguucuacauuuuucggugaguaggauugcuuucuugauuuuuuuccccacuaguuuauuuugguauauagaaaugcugcugacuuuuguauguuuauuuuguauccuacaaguuuaaugaauuuguuuauaaguucuaacagugcagauguacaguuugacuucuuccuuuccaauuuggauguccuuuauuuaauauuuuuuucuuuugcuuaauugcuugggcuaggacugccaguacugugucgaaugaaaaugggcauccuugucuuguuucagauguuagaggaaaaacuuucaacuuucccccauuuaguaugauguugacugugguuugucaugccuuuauuguguugagauauguuuauuuuauaccuaacuuguugagaguuuuuauugugaagggauguugaauuuuaucacuuacgcuuuuccugugucuauugagaugaucauacuguuuuuguucuucauucuguugaugugauguaucacauuuauugauuucauauguuaaaccauucuugcauuccugggauaaaugcuacuugauuguggugagugaucuuuuuaaugugcugcuggauucaguuugcuaggauuuuugcauuuauauuaaucagggauauuggccucuaauuuucuuuuuuuguuguguuuuugucugguuuugguaucaggguacuguuagccacacagaauggguuaggaagaauucccuccucuucaauuuucuggaagaauuugagaauugguauuuguucuuuaaauguuugauagaauucugcagugaagacuggguccugggcuuuucuuugaugggagacuuauuauuacagagacaaucaugguugaacaugaaaaauacaaauuuaauacguguagccaugcagaugagauggaaauacauugguuaagacaaaguauauacuuuuuaucaaauguugaacaagaugaacugaugaaccuuguaagcacauacauacccuuuaagaauaaaaauuucuguaagauugaugauuaagauuacauaucauuuugaguuuuacguagagagguucagaugaauguggaguauguuuugaagagagcaaaagauaaaagagagguaaacacuucauagaauuagagcuguaacuuagggaagaagaggaaaugccaaaagaucgaaagaguaugaccuaguagcugccauagauauuuggaaguuuaucauauugauaagagauuugacuucuuuaugaauaaaagggaaagaccuaggucccuuaggcagcaguuagagggaggcagaguuuaaguggcuaaaagggggaacuugugguucuccaaaauggaauaauagguucccuggcugggcauauaggauuuucgcuuuugcugguuaugacccguugacugagguguuucaguggggauucaggcaucagauaguuauuuguauuaggugaccuuuuuuuuuuuuuuuuuuuucgagauggggcucucacuguguugcccaggcuggagugcagugguacaaucucagcucacugcaacguccacuucccaggcucaagugauccucccaccucagccugccuaguuguugggacuacaggugugugcugccacgcccugcuaauuauuauuauuauuauuuuugagacagaguuucacucuuguugcucaggcuguagugcaaugacacuaucucagcucacugcaaccuccgccucccggguucaagcaauucuccugccucagccuccuaaguagcugggauuauaggugcccaccaccaugcccgccaccaugccuggcuaauguuuuguauuuuuaguagagauaggguuucuccauguugaucaggcuggucuugaacuccugacuucaggugauccaccugcguuggcuucccaaaguguugagauuacaggugugagccaccaugcccggccuguuuuuguguuuuuuuguagagacaggguuucaccauguugcuuaggcuggucucaaacuccugagcucaagcgagcugcccaccuuagccccccaaagugcugggauuauaggcaugugccacugcgccuggcuucaggugaccuuuuaaggucuguuccaaacuaaauuauccaugaaacuguuauuucuuuuuauaaaaagaaauacaaaugauuuuuuauguucacuuuaguccuaaguuuuauugguaggcuuuauguauuucauagcuucuuuaaauuauaugcaauauagcuuaaaagcacagugguaacuacuacauuuauauaagcagcuuuaauugcucucaguucgguuuguuucuuguuguuuuauuucuuaugcuuuuucuggguuauagacugcuguucuauguagauauuucuucuuuuucuuuuuuuguugcaguguugggguuuugcuauguugcccaggcuggucuugaacuccugggcucaagccauucugccgccuuguccucucaaaguucugggauuacaggcaugaaccacugugcccggcccugcuuuagacauuucuaauagauugugcaguucuuuucaaauauuuuuccauagucauugcugcagccauccuuaauaacaaaaguaacaauugaacucagaguuaaaacauacacaucuuuuaauguaaacacuaaaguaucacuuuauaaauucagaaaauccagaguagggaauuucuggcccaaggccggagcuuuccaguugaagucuuuauuuugcauauucuguggcuuuucuguuuuaguucuacuugcuuacauuuauuuuugcuuuccauagcuugacauaauauaaaacugaauauaucuuaguuguacuuugcauugacuauuuaauuuuuugucuuuuuaacuuaaaaugugaaauaaaauuaaucuugucuucauuacuguaucucugauaguuuuuguuucuucaucuguugcuuaaauuuauuccauuguauuacugaaacccuaaaaaaaccaagacaccuuggaccaagacuaguacaguuuuuauucuaguacaguugcugacuguguguuuguauguguguuuguauaaacuugcauuucugugcuguuacaagagacuucuuuuuccaagauuuugagccuacuauuggucuauugaauucauuuuuccccuggagauuuguugcccagagcccccugaguuugucauuuucuaggcauguuauacaucuucugucucugagcuuuacugcucuccuugauuagagcuguuguuucccuguauucgaucuucuuuauuuuuuaucuauacccucuuucuuuguugaaguccuugguaauuuucuaauacucucauacuugaguaaugauuugguuuuacauagaauccaaaguugaauaucacuuuuccuucaaauuuuaacucauuguuucuuagccaucuagcauuuaauauugcugcuguguugccugauacuuauauaaggcuugcugcauuguuagguugccuuuccuccaacccaguuuaggaucuucucuuuaccuuuugauguucugaaauugcagugauguaucugcauuagccuuucauuuauuucccugggcacuuggugggccuuuucaauuuggaguguguucucuucaagucugggaacuuuucuuguguuuucucugcaaacuccuggaagacagauguuggcuggugcuuuuuacguauuucuugugucuuuccaacauuuugcuuuaugucuuucuagaugcuuauugccauauuuuccaccucuuuggauauuucauuuugacaaauauuuuacuguugcuaagaauucuuucauguauucucuuuauuccauguuuuuaguaguagucuauucucaaagggauauacaguaggcucuugaauaaugugggauuuagggucacagagcccccauucuuugcauucagaaauucgcauauaacuuuuaucuucccccaaacuuaaguacuaauagccuauguugacuggaagccuuacugauagcagaaacagcugauuaacacauauuuuguacauuauauguuacguguauuaucuacuguauucuuacaauaaaguacacuagagaaaugucaugaagaaaaucaucaaaaagaauauguauuuaauauucauuaaguggaaguggaucauuaaaaaagucuucaucuucaucuucauguuuaguagguuguggaggaggaggaagaacaggggcuaguggcuagucuugcugucgcacagguggcagagguagaagaaaaucgauguauaaguggaacugcgcaguucaaacccauguuguucaagggucaacugaauaaaucucucuuuauauauagucugaauuaauuuuccuauuuguuuauuuugaucuuucucauaguacugugugcuuuccccaaaggucagauuauuuuugguugguuguuaauauuuacagugaauaggaaaucuagucaaguuuugcugugggauaaguaggcuuuagauagauagccugagguuauuuuggggaaccagggugagaaguaccuuaucauuagaugguaacuguccuauuuccuucaguucauucaauuuaaguucaggguuaagaaaauacuuucucuuacuuugaguucaaugcuugguuguaggccuugcuggguauucaaguaggggaagagaugagguugaccucucaguauuaaaguauuaaggcuuucaguuaauccuuaugucuagcccagcucacuacuuauaccaucuaucauuucauuuuuagagauucuaaaaguuagacaagguuguucacaacuucuuaagcuucagcuccuuuggacucuaggcuaugacuuuuucaugcucuguuuuaguaaucuuuucuguucaguuuucucuucaucuccuagaauuguauuuaaaucuuucauuugcuuuuggucuucuuuuuauucacuuuguuguuacagguuuuuaccuucuguuucuucucauuuuaaugggauuuggggguggggagagaaauaaagauguacaaagucugccauauugaaccagugacucuuuuaauuaagucauaauaaauauaaaauuucuggcauccaguaauuuuuacuuagggauuuuggaacccucuccguuguuaccuugauguuuauuucuuuuaugguguguuugcauuacuuuccuugcuuucagauuuuuucaucuguuaguaauauuaauuuuguguuaguaauaaagcuauuaacaaacuucacugaguuugcaagguuuuccagagaaacagaaccaauagauuuuguguguguguguguguguguguguguguguguguguguguguguuuauaacgagagagagagggagagauugauugauugauuuuaaggaguuggcuuaugugauuguggagacuggcuggcaagcccaaaaucugcaggguaggcuggcaggcuggagaccuagggaagaguugauguugcaguuugaguccaaaggcauuuuggaagcagaauuucucuuauucaggggaccuccauuuuugucucugaagaccuuuaccuaauugauuguggcugacccauauuguggagaguaaucuuuuuuacucaagucuuuugguuuaaauguuaauuauuuaaaaaauacuuucacagcagcauuuagacuuguguuugaccagauauuggggaaucauggccuagccaaguugacguauaaagugaacaaucucucaccacaaaaaaguugaugugaguuaaugcauguuaauuaauuugauuuagccauuccacaauguauacauauaucaaaauauguuguacaccauaaacauauauuauugucaacuaaauaauuaaaaaaucaaauuaaccaucacaguaaggucccaaaaacucagaagaugauaaauuauucuuugaacugcuauuuuauauauguugucaugaaacuaguguuaaucuuaggauuuuugagaaagugauuucaagaugaguauuguaggcagaugcagcuuaaaaagaaagcacccagcucuuuucucuuaagggauuuuauauauaaaggaaguugaaaaaauaguuaaaauguguggauguuaauguaccaaauacugugcaaaacuacuuugcuagcucuaucuuacuaaaucuucacgaaaaccuuaagagcuguagauacuacagguugaguaucccuuaccugaaaugcuuaggaccagaaguguuucagauuuuggauuuuauuuuuugguauuugcauuauacuuacucguucagcaagccagccuaaucugaaaaucccaacuccaaaaugcuccaaugagcauauccuuuugaaugucauuuugguguucaaaaaguuuuguauuuuguauuuugauuuuuggguuagggauacucaaccuguacuauuaaucucauuuuauagcccaguaaacugaaguuuugagaaugguuaauuuccugagguuauuaauauguaagucaugguacauagauugcaaucauucuaaauuuuuuuugccuucaaguacauaaguucuguuaagaucagugcucuaaaucgguucucagauuucauuuagcuuuguagucagcaagauuaggauguuauuuuguuuuuguguguguguguguuucuuuuuaguuuuguucuugaaagaacaaagaagauaguucuuuuuccuguuuaaagaauauauguguguuuguaggaaagaugugugagugcccaaaauggcgcuuaguuauuaaagaccaagcaauuuagacagaaaaauagucauuggccagugauuuuguuaaucuugaauaccagagacgugcucuaaagaugugccuuugauaaaugccaacagguagacguguacugcaagcuacuugaacccuucuuuaucagauaaaguugauucaggauggaaugcaacuagauauaagaaaaaaccucuaacuucauacucauuuuacaguugaagaaauugugguuuaggaauaaacauuaacuuggauaauuuuuuuguacaaauuagcugauuuugacuuuauucauuuauugaaugucuguuauaugcuagguaauaugcuaggcaguggacauacaauguugaguaaaacaaaacuugaugaucucuucuuaauggagcuuaaaguuuaguauagaaauaauuuuucuucuuauuuucccaggauguuuaauaagucuaguuauuuaacauaaacuuacugggagagguugucugccaugaguuuugaguguucuugagcuuucuugcucagcauggcaagaaagcaagguccugaccacucuuuuccuggaccauuucucagggucauaauugcagcaagcagcauugaaggaugacauuacauuugcucucucaccccuaccucuuaacucgacaaucagcaggcuugcuuacugcucacuauaaaaggcaaugccuuuucaacaauguugcucuccuguauuucaacccacuguguuuguaggcaucuguauaggcauaucuguguugucccuguggaacuugaggagacaggguuaucuugucaucaugcugcuugcugugccaugggugacagaguucuuugucuuuuacccaguacccuugugucuucugucaguaaacaugaaucaguaaugggcuaguucauuaguuugugaguaggguaaaaaaucccagacccuuuacaguucuugcaguucucaacauuacuguguuuaaucccaggaauuauucauggagguuuagccauacuuuaauuauuaaagauauuuaaauaauuuaccuccaggaaggcagggauugcagcuauguauguuauucauaccggcacuagaauaguaggcauuuaguaaauuuugacuggaaaaacgcacaagaaaaaagugggaccagauaaugagacuagaaguuaagaaaauaaaauguuugaugcaggugggguacaacuuugccuaucagauuuauagcaauuacuauugaagaggaaacauuccaaggugaagaauacaauguccugaauguaaaaacaaauuuaguaucuaggaaaaggaaaauaauuuuugacacuaaaacuggaaagaaauuucaaccagugugauauaaaaaaaucuuuaacauaauuucaaugaacauagggcuuuuucuuauaucccucaauauauauuccaguaugagcaguauuacaggggcuaacaucauggucugacugauccaaucccagguagauuuuaaguuaucuuucaaacagccuaccuuggauaucaguucucacuagauuuuuuaauauauugauaagaagaugaguuauaugauacuaucugagaacuguugagaauguaauuagccuuuuguuuucuuuugcccuauacauaaguuuuauugaucaccagagcuggguaugagauugcauaaauuuaggcucugauaggaguguuucuuagaauaggaggcuguucugcuguccuuguuguagagcagggguccccagacugugggccauggacuaguaccaguuuggggccuguuaggaacccagcugcacagcaacaggugagcugcgggccagugagcauuaccgcuugaguuccaccuccugucagaucagcgguggcauuagauuuucauaggagcgcgaacccuauugugaacucugcaugugagggaucuagguugugcucugcuuaugagaaucugaugugugaugaucugagguggaacaauuuuaucacaaaaccacccccucauccguggaaaaauugucuuccaugaaacuggucccgggugccaaaaagguugggggccacugcuguagaggacagggccaaaauuuuccucaaaaaguuauuuugggguccucuuuaaugccuuaaauagacaggagaagcuccacagcuucagacacaaaggaagaucauuuugguauaauuuuuguuuuauagcccacauuuaaaguaagaacuagcugaguaaaauucaucaauuuuauuuucuuuaguucuagugauuuuucucgcuguuuucuucuagucaugacaggauugcagaaucccuuguugccauuuuuacuauaguugcugccuggauucuuuuggaacucuguagaccugugucuucuccccuuguacucuuuucccuuccauauuuauugcuuaguuggaggaucuucucaaaagauuucugaucuggaucuacugguauuggcacuauuuucugccaucucuuccucccuaaaauacugucuuucccuaauuuuggucuuuggucauagguuuuuuuaucaugucuuuaagugaaucgugaaugacaaauuaguuaucaaauaugugcuuacauaacaagaacgauaaauugucauggaaugauuacauggaaguuuccugaaguaugagaauauccaaaauggugacauuguuuaaagcauaauugaugucauuucuauuuuccugcuaaagcuaauuuucuauaaacagagucugagauuaggaugagagcauuuuacugguugacaacuccaguugguaccaaucucagaagauacagugugaauaguccccuuaaguugaguggacaacagccuggauaguuuaaggaagugaauaaaaaaauaauuuugauauaaagaauaucaaggauccuugagcaaauguuuucuuaaccuuaguuuugaccuccuuuuccuuugucuaauuagccucauaauuacuaauuuuuuucugucaggaagcaaaguaaauaauaaaaucucuaaggucuuugcuaucuuuugaggacacugaucaaaaagaaauucugaugaaagauagagagcugcaucuugauucuuacgggaucucaagaugagacuggcuaauuuauaguggcccagaagugugauuacuuguuucaaggcccuauccuugguucgccuucacuauccuagaaauaggauagcuucuguacccgccagcuacagaagcugaauuucauaauuccuuggcaguggcagauccuuguuuuuuuagagaaguaggaaagcuggcuaccuagauuucuccaaaucauagaccuagaccuccuuagccucccuggcuguccauuucucauuuccucagccuccugucugaccccagaaacacuuucuguacuccagacuuuauauuauuuuccuagucucuguugccaucauggauuugcuucccauagguuguaauuuacugagucaucaucuugacucagaauuuuuggccuugguuuuaguuaggauuacacucagcuaacagugauagaaaacuccagauaacagugguauaaagaaagaaauugcaguagcucagaaggaagugacugagagcuaguauggagucgcacagugccagggacccaagcuccuucuaccuugcgcuauuaugugugaugacuaauuucaccuuuauugcauaauuugagauggccccuucagcuauuagauauugauuccacucaauaaaaaaggggagggaaagguaauaucuccuucauuuaaaauuguaucuugaaaguuguauguucauuucuacucacaucccauuggccacaccuuaguaaccucaucuaucaguaagguagauugaaaagugucauuuuuuuuauggguaaccauguacccagcuaaaaaauaggaauuccaguaaaugagggagaauggcugaaugguuauugggcaacagcuagcaguuucaaguacaauuucuauaguucagucugugaggaaucugagaucaguaccuuuuccuaguucauuggucauccugggacccagguuugacuacuaggcuuuuuuucagagcacauccugccucacuugucaaagacuucuagacuguauaucuguauuuccucccuaacaaguggaacuugggaaucagauaaaguccaguucucuguucauagagcaugaucauuugcucguaucagaaauuuuagagggagauucaauucuuguuuuacucugaaggagaugggugucaaaauugcuacuuguguauuggagauauuucauuaagguaagauaaccaaacuuuuuugauuguguaaguuuauauauaagacauuugagugcacaccaguauuuuuacguguauuuauauuacuugucuuacuguuuuacuguauuaauguauuuuguauaacaaauacaguagauauuaaauauuuuaaaauguugagccauagauaaaauauuuauacuuuucaaauuauuaacuaaaauuauuaguuguauaagaacuuacuuggaaugcauuaugauugcacaugcuuaauuaguuuuggaaauuucaucuuauuuugauaaaauuuuuuacauaucugguuccaaguugagcuugauacuggguuuuaauggcuaucauagcugaaaaagauaacucgauuauacauacauuuaaauggaagaaauuuauuguaguuauuguacaauaacuacaauaauagaaauuuauuguaaguuauaaucuuaguuuuuuuuguuuuaaauacagaaaagcuuuuauuuuaguuaauuagaacauuucugccaucuuucagugugcuuguuuuuuaaaacuacuaggaagugguuacauuaaauaauuauuacuauaugagaucaaaauucacugaacuuuuuuauuugggaaaauuuuuaaauguccagauuaaaaacauuuuuuaagugccacauuucauuuuuuagccagauaauacguaacaaugaaaacauaccuaaacaucaauuuucuuagcccgaguuuuuucuuuuuaaaguaagaaaaagaguuucuuucuuaucacuaaaauaucauuuuaucuagaagggacagauuaaagguguguauuuucucauaugacuuaucacaucuacuuagaaaaggccagcacguuucuaacacuugucucauuuguagaacauuuauuuuguaaaccaaaaauguguaauuuauuaaguauaauagcucuuuuaaguccuuugcuaugaauuaauggauaauuuuuuuguggcauaaagauuuuaauaaucacuuccuguuucauuaaaauuacuguuucgcuuugugguuuuuuuuuguuuuuuuuuuuuuuuuuugagacagagucuugcucuguugcccaggauggacugcaguggugugaucuuggcucacugcaaccuccgccuccggcuucaagcaauucuuuugccucagccacccaagcagcugggauuacaggugccugccaccacaccuggcuaauauuguugucuuuuuuaguagagacggggcuucaucauguuggccaggcuaguuucgaacuccuaaccucaagugauccacccaucucagccucccaaagugcuaggauuacaggcaugagcugcugcaccuggccuaaaauuacuguaaacagucuacuguuuuuacaaaguauuuuuaguauaaaaggaacuauauuuauauuaaugacauucuguaacaaugcaaagugcugaaggcaaacaaaagggugucaacuccucucuacuuuauggaauuuuuacucuuucaguauccuuccuuuuggauaaauugacugacauguauucaucaaggauacuaguggcaaucugauuaaauacuaguuaaguuugauuucuuuuuaaaauuuagguagcaguuaaucauagauugauugucaugucuaccgcuuuaguuauacacacccccuuaggaaaugauuugcuuaauguauaaagucuaauaaaagcugcuauaaggaugucuuuugaaggagugaccaauuuagagguaguaccuuuuuaagguauacugacuguuuuuucauguguuucuccauuaaagagcuuugcugaauaccugacaaacuuugacuuuuagucuucaugagaucagggaacaccuaaugaaaguaaauauuuguaacuuacucuggguacugacauuauucuugaguucaucuuaguuucuuacguauauauauuuacauauauauauguggcauaaagauuuuaauaaucuuuaauauauauauauuugcuucguguuugucagcauuuuuuuuuucuuuuaaaacauucccuuauauuguagagucauuccgcgguauccauaggggauugguuccaggacuucucccugccacaauaccaguauacucauauguucaagucucugguauaaaaugguguauauuugcauauaaccugugcacauccuccuauguauuuuaaaucaucuuugaauuauaccuaauacaauguaagugcuguguaaauaguuguggugaaguauucuuuagggaauaaugacaagaaaaaaaaggcuguacauguuucauacagacaucauugucccccuccuuuuuuuuuuuuuugagauggagucuugcucaguugcccaggcuggagugcagugguguaaucucagcucacugcacugucugccucccggguucaagccauucuccugccucagccucccaaguagcugggauuacaggcacgugccaccaugcccagcuaguuuuuguauuuuuaguagagacagcauuucaccguguuugccaggcuggucuugaacuccugaccucaagugaucugccugccuuggccucucaaagugcugggauugcagaggcggggucuccuuauguugcccaggcuggucucgaaccccugggcucaagcaauccuccuaccuuggccuucgaaagugcugggauuacagauaugaguaccauacucagccuucccaaauauuuuugauaugcuguugguuuuauucacauaugaagaacccauggauuuggaggguugacuguauauccuuuuaaaagacacuuuaaauauguuuuggaacaaaguagacuguaaaugagauauaugcuauuuagauaccugguuaaggauacuuguuauuuuaagcuuuaaaaaaauuuuuaauuuaauuuuguauuuugaaaauuuaaaacauacugaaaaacaaaguacaguauacucacauuuagucaucaccaauauucaacagcuguuaauauuuugcuauauuuguuguauuaauuuaucaguuuaccaguucauccauccagucuacccauuuaguugaacuuuaucauguaucuucccaaaaaggacuuauauauaacaauaccauaacuacaccuaagaaacaauuuccagguaucaucuaauauccuguccauguucaaauuagucauuuguccccaagcuauuauuuucacccgguuuguucaacucagguuguaaucaaggaccuaguuuggcauuuaguuguauuuccgaagucucugcacuccuuuuuccauugauacauuuugaacagguaagaccaaaugucucuuagcaacauccugaguuuuagauuuuuuaaacuggauuuucugcaaguuggaaauuagguuuaaaaacuugauuagagucaaacauauuuggcauucggaaaacuucauaggugaagcuguauaaugucacaucuuagaauguuuaucaucugacucuugauguuaaauuggauuacuggguuaagguagugagagcaaaaucucuucuuccuaaauacuugagauggcaaguaaucugcacagcgaugcagccuuggcaauaugaaaauauuuauuuccucaucagccuuuuuccuaaugguuuuaugcauccauugaugauauucgcuggagucaguuguagcaaaaugauggcuuucuaaaucuaacuuuucuuuuacauuuauuugcugcauucugguaagggaaaguuuuguuucauuaccugguugcuuacaguuccuacugaagaggcagauuagaaggaaagaaugaacauuucagaguuaggaguuggaggaaugaucuuucagaguaaagaguuuuggugaaaugaucacugcuaaugccagagguggcaaauaauuuuuuuggcuuccuccucccucccccuuuuuuuugagacaggcucucuauugcccaggcugcagugcaguggcgugaucauggcucacuacagccucgaccuccugggcuuaagugauccuccugccucagcuucccaaguagcugggaccacagguguguaccaucauaccugcuaauuuauuuuuuauuuuuuauuuuuguauagauggggucucuccauguugcccaggcuagucuugaacuccugggcucaagugauugucccacaucggcuuccuaaaccugggauuauaggcuugagccacugcacccggcccucuuuccuuuuugaugguuauaaugaguucauagauuaaaaaaauauauaugucacagugcuuuuuuccuuaagaugcucaaauuuuuuuuuaacccaaucaccucacaauguagucagugagauguacuuuuaauuguguguuccauugcauaguuuuguuacuguuauagaggcagaaugcuucuaaaaguacuugcugauuuuuuuucauucugcgauuuuuaauuuuggccuuaggaccauauuuuccucuguuacguguauaauuacaaucaauuucaguauaagauuucuugauaugcaacuucaaaaaagcaugugaaauauguaaaaggaggucagcuuggaaauuaacugaucgguugugaggguuugguagaaaauuuuucccuuaucuuaaggcugaauguugaucaugcuuuaaauuaaauuugauacacacuggugacaggaaaauugucaaauaaaugaccuugauuaguggacagaucagucuuggcuuuaauacagaaacauucuugugaugauuuagggaaauaauuauuguaaauaaaucuucaagaaacugacauuuaaaaaacuauauugauaauucuuccuuuuuaaagcaguauagugaacauaauuuagcuuuuaacuguugauuuaguagucuugggaaaccagugauuguauuauuacuuauuagcaacauccuuagguacuguuuuuguagguaaggcuuuuggucccuguauuaacugggccugggacaaauacacuaggaaaaaaauugcuuuugaaugauguguuucucgucuuuuuauaauaccgucuuaggaccuucuaguuuaucuuucucaaacaucuaaaauauucgauccauucgucuaauugugagaggccaggaaacuugaguuauuagaaauaugugaaauaaaaauaagggacuacacucuuaaaaagguguguauauauguaaaacacauggacaaauaaaccauauuaaaguaguuuuucucugaggguuucuauauacuugauuuuucuugaggaaggcucuagaguuggaaaguuaacugaaaugaacuugauguaagggauuacccauucuaaacuguucauaagaggccagagaaacuuauggaagauaacaggaagcauuuacugacuucuaaaccuacauuauagaauggagcaagauacauuuuacugcuguuucaaggcugaauacauauaauaauaauuuuuuucucauuaaguuaugaccuuuaccuagguauguuuaucagaauuguguuuuccaaguuguaguaauucucuuauguguuccaaauuuauuacagaguugacauuuuuuuuucuauuaagguucauaucuuuaaucucuuuaauauacuugaugaaaguuccuuuuauagaaccguuuuuauacucuuaaaaggagacugugauucuuaggcauacacccugaaaaaugcuacuaauuggaucuuuuugagugagcagcuuuuuuuguaguuauuugguuauuccauguuuggaugcuuccuucucaucugugcuuucuaaacugucauccuaauucugacuucugcauggguuagucaacacuaugugauggaguagagguguuuuuuguuuuuuuguuuuuuugcuuuuuugagauggagucucgcucuuaacgcccaggcuggacugcaguggcgcuaucucggcucacugaaagcucugccuccuggguucacgccauuguccugccucaaccucccaaguagcugggacuacaggugccugccaccgugccuggcuaauuuuuuguauuuuuaguagagaugggguuucaccacguuagccaggauggucucguuagccaggauggucucgaucuccugaccuugugauccgcccaacucggccucccaaagugcugggauuacaggcaugagccaccgugcccggcggagguguuuuauucuauuucuuuugauugcugaggauaacuuccugauuugagucuaguugaacauggagguucucaucuguugagauagagccaugauauuuuuguaugcacucaugcauuuguucauuuaagcuauguuuuaagacugaauauuuuauguuccagcugcuguucuagcacuagugauacaucagaaaacaaaagaauaacaaauuccugcucuuguggaguuuuaauucuauuuaguggagcauauaguagcauaauagucuuuuccugggcuacuacaaauuagggcuguaaauuguuuaacucaguuuccuggccucuuuuacugaaaaaaauaugugauucucuaagaacucuuuuggugguccuguuugugucuguuuuuuucauauauuugaguaaauggaacugaaauguuacagaaugaagugccuaguugggaauugacuuauuagaaugugaaacucaaugaauaauaaugagauccauauuauaagauggucgagcugcuuuuuuuuuuuuaaaccuauuccuguuuuacaguaacgugauuuucauuaaauaacauuccagggaucagcaguuuacaacaaucguauguaagguauaaugauuuucuuugagauaaaagugauugguacuguacuguuuguuuaacaaauauuuauugcauaccuaucauaugccagacuguuuccagugcuggaggauagagugguguuugagacaaaguccuugcccucauggagccggcaaguauuagguuagugcaaaauugauuguggcuuuggccauuacucucaaugggaagaaacacgauuacuuuugugucagccuaguaaauuguaaggugauagaaaaugucuaauugcuuuuugguggcagaggucaugguuuauuugacuugggcuaguuagggaaggccucucucaaacauugagaguagcugcaugcugagguacucguaguggccagccuuuugaaaauccuaggcaaguaaaguacauuccaagcagagaaauagcaaaugaaggguacucaaaauguuuaguuaauacuuuuaucagauuaaaguaauucaugguuacuaaauaguucuaguaucucugaggguuguguuuacaugcuuacauucauauuuacaguuguuuuguuuuguuuuguuuuugagacggagucguccucugucgccaggcuggaguugcaguggugcgaucucggcucacuggaaccuucgacuaccugguucaggugauucuccugccucagccucccaaguagcugggauuacaggcacgcaccaccacacccagcuaauuuuuguauuuuuaguagagaugggguuucaccauguuggccaggauggucuugaucuccugaucucaugaucugcgugccaccacgcccagcuaauuuuuguguuuuuaguagagaugggguuuuaccauguuggccaggauggucucaaucuucugaccucgucgucuguccgccucagccucccaaagugcugggauugcaggcgugagccaccgugccuggccaauauuuacaguuuuuuaccgaaccaagucuguaauuagugggcuguauaaauaaaugaacuaugagacaauaacuuucucaugugcuauugcauaaaaaaaucuaagaaauaaaaauaauauuuaaacaauuaggaagcaauccauaaaguauucuccccuucuccacagacacagauacucauauuaacagaguguauacuuuaugucaccauagauuuucuaaaauugguuagugucuggccaagugccuccuuucugccuguuuuuauacacauagggcagacagagcuaaucgaaaugaaaauuuggaauguguauuuuuuuauuuuucuuaauuucauaauguugcuugguagguuaaaaaacacuuuaauacauuuuuagccuuuauuauaauguccuauauuuagauacuccuuuaaugaaauuagaagaucauguuuuaugguuagguuucuacugcucuguuuuccacagguaugguuugugguuacaugauaggauaucuacuguuaaagcaaacuaaauaugccugagaaggacucuacuucuauauuugaguccuuguggaugagccguaaccuagcuuaacagcagacagauuagaaaccuaacuugggaguaugugccuguaacaauagcugaguauuggucaaucccagccgccauacuugaaccacucagacuucuguguguucaaaguguguucacauaaggcaaacaccaaccuguaaccaauccagcuguuucuguaccucacugccgauuucuguaugucacuuucccuucccuuuuuugucuauaaauuuguucugaccaagaggcacccuaggagucucucugaaucugcugugauuuugggggcugccugauucaugaguuguucacugcucaguaaagcuccuucaaauuuauuucuccucaaguuuuuccuucaacacugucuuauucuuuguuuugucuaugcuugggauuuuuuuuuuuaaugucaacaaucuuguauuaccaaaugugcaggauuaacacuuuaacauggcuaacagcagaaacagcaccgcuaacaagcucaaguguggaggugcagacccaauaaguauugucucuuagaaaaggauugaaaagauacagauaucugcuuaaguauuuuuuguuuuuaaauaaaauuuuccaguguugcagaaaaaauaucccaaagugauuucaguucauaaaaaagcagcauuaggcagccugugcugccuuauaaaccccaacucaggauaaccauaggagaaaaccccugaaacauuaaaaaaaaaaaucaccguuucuucucguccuucuccagcuucaacugcuuauuccacgaaauaccuaauaacaggauaagcaagaccuagcucacuucugucagccucuugucuguuuguuaagguuaauccuucacaucuacaacaaucaguaaauugauuucuaauuucuggcucagauuucuagaaacuugcaaaacauguuuucuucaaggauggggcugaggguuccuugaaaaaucaagggggcaggguacccgccugagacuggaaugccucccagacccuuucuaagcaaaagcaucccaauaccuuacaacugaaagucuaaccuaccagguaagaaaaaguagcaaaugggcaccaaacuguggcuguaccaaaaaggugaauaucuccuccucuuaacuauaaagguaagggaguugacaggagccaaguauuucaccuuaucugucuuuagaguuugcauaguuugggcuaaagccauauugcagagaaaaacauucagucaaaggauagggguggcuuuugcuguaucugguaaagcugccauuccugggcagccgaauucguugcucuuuuauagaagcucuuuugccuuauacaaaguacuuaagaauuaauagggaaauuuuaaauuugacuuaauaacugacaaacuuaaagauauacaaaaaggcgguguauaaauccacacaguauucaagcuuuuuuaguaaccauguuucuuuuaaaaaucugaaauuagugcuagugaguucuuauugagacaauaugaagcccuuugcacuguaaauauuuuauauuuuuggagagacauuugaugauaucuaagaguaaaaaugaauauauauguguguguauauauacacacacacauauauaugguguauauauauaccaucuucaacucagugaaccuguguuuuaaaauguaucguaaagaaggaauagaagaggggaagaaaagcauuauuuauauagcauuguuaauuuuuuucaaauuaagaacaugauaauaucuacaaggauaaauucauucccaaauaguuaauuguauguaacauacaacucgauguaguguaucauaccucagccucuuuuuggagugaaucuguuacucauucaugaaggaaagaacucuuaccaacggguggucaaguagagacuggugaucuccugcgauguuagagggguaagguguaggggcucuguuaagaggagguguucacauauuuucuuacuauacuuaacacagccccuauaaaguagauaucuauucuuuauuguugugauacugcacagauauguucuuuucccccucaagucugguacuuacugccaacuuuguaauagaggaaauaaccgacguagaaguauaauaguugagcuaaguuugaccuuugugcugccugcauaauuaacgcauuccaaaugugaagagucccuccuguuacugauuuguaauucucccccuuuguaugguauuaaagugauuuaaacaaaucucuauuguugagcagugcaauaaauuuaacucugaaugguuuuuauucucuuuaucucauuuguccccuuuccaaaaagauagguuuaaauuacauagucuggaguuaaaauaguaucaaggucaggaggacuucacuuaagcaaguuuaauuagggcaauuugggguugggaugggaggaauuugaaugugauguaaaaucaggcucgaagagauuucugaguaugaucauggauuuuaugccaaaauuucagaaccauuugggguuaaauuuauuccauuucucaacaguagggauugguuuaaaucacuuuaauaccacacaaaaaggaaaauuacaaggcaggacuaguagggaguuuuucacauuuguuaugugaugauuaugcuggcagcacaaaggucaaacucagcuuaacuacuucuagaucaguuauuuccucuguuauaaaguuggcauuaaguuucagacuuggggguaaaaaugagaauggcaccuaguaccuaguucuggaauauaggugggaagaaaaaacauacuggaggugcuucuguuguuggggcucuugaauguucagcaugagagcucuggaaacucugaaggcaauguagagcuugauuuaauguagaaauggauuuuugaguugaaggaaguguguugucaggaggagcaggaguucaaaaaaagaugcaugcuuggaaaucuuaccuuugagaaacaucucaaaugcagucuuaguuauucuaauuguagauuguugaccaagagguuguucaaugauagaaccucaagucaucacuuaccuuccaaguuauuuuccagcacauauaaacauggucagaucucuguugauuuuucccucuucuguccccuuccuucucuucacuuuccuccauuaaacuuaaaagcgacuacaauuauugucauucuucauuuacuuacuucuuaacuccuucucaucugauucucugcuuugugugucaaacuaguggauuucucuccuuuauucguucuuuguguagcaguuaaccuuccugauucccacuacuuugaaauuuuugugauguugcuuuaccuugaugcaucuuuugucugaucuuuuuccuucaugucuucaauauaucaaaaaagugaagucaguauguuacuuccaaauuuguucuuuccaacuucucuguuuggucaauagaaacauuuucucucacucaucaaggcuuaaguucucccagucugucuuuucucauaauucuuuuauucagcaaauauuuucuggaauaccuacuauacacaagguuguuauucuagguucuggggauucagccacaaauaggagacaaagguccuuaccugugcagcuuacacucuaguggagaagacugucagauacuuaaugucauauagagaaacauuuuaaaggauaaaguaugcuaaggauccauaggcaguaaugggaauaugugcuguuuugcauaaggugguuagggaagguuucucugagaaggugacauguaaguaaaaccugaaggaagggaaagaaugaguuauggguauuugggagaagagccuucaugcagcgggaauagcaagugcaaaaaccuggagaugggcuuaugcuucccuauguucaggaaaagccagugugacuggaggagagugaaucagcagggggaggagaugaagucaaagaaguuggcaggagaagaucuuguuauaggacccugugggcccuggcuaggauuuugggcuuuaugucuaaauguguugggaagguuuuagaggauuuugaacagaagaauauuaacgugaucugacuuaauauuuuagaaggaucacagugauaacuguguggagaauaaacugucaggggagaggggauggcaguagagaaaccugggacacuaggaggcuguuacagucuuagaugagagaugugauuugggaguagcauguuagcuggucagaugugugauacauuuugaagauaaagcuagcaggauaugccgauagcuuggaugugucagauauggggagaggagcuaaggacaguucuagaguuuuagaauugaacuaggugauuuggagguuccauuuacucugaauaccuugggaggaacaguuuuuugagggggagggaggauugguagaaucaguguuuauuuuugguauguuaacuuugagguacuuauuagacaacuuaaugaagaugucagauuacacucuucugaaggucucaugagcuucgggcuggagaagauaccuaugggaaucauuagaguauagaugggccuggauaagaucaccuuagggauaagugagugugaagggaugagugaguaugaguguagauaaagaagaaagauggggggacugaacuguuguauccuucaguauguagaugucugcaggaagagaaggcuuuaucaaaggcuguugacaaguggcuagggaaaugggaggaugugguaucccagaagugaagugaaaaaaaaggagauucagaaaguggagaggaaucagcugugucagaugcugcuaggaaauggaauaauuuaaaaccugauaauugaccuuuggauuuggcuugcgaaauccuguugauucugcuuuguaauacagcucuaaaauucauuacaugacuucacucccugucaacaaacacuauucaucaggcuuuccuucuggucuguuuuucuauuuuggaugguucuuuuuuucuccuguuuacauuguagaauacaugcucauuauagaaaacuuggaaaagucagagaaaguauaaugaagguuaaaaaacaacagcaauggcaaaauuccuuacaacuaaaucacugauugaacagucuguuguguuuuuccuauuaauguuucuuaugcaucuuuguaaugcauauacuauauauauaugcuuuucuacagaauuaaugaaaaguagucuuaaaauuuauguauuuaaaggagcauaguagaccuguaaucuaaugucaaaacuuuuuugaggcugggugcagugguucacaccuguaaucccagcacuuugggaggccaaggcagacggaucaccugaggucaggaguucgagaccagccuggccaacauggcuaaaccccgucucuacuaaaaauacaaaaauuagcugggcaugauggcacacaccuguauucccagcuacuugggaggcugaggcaggagaaucacuugaaccugggagguggagguugcagugagccaagaucgcaccacugcacuccagcuugggcaagagugagacuccgucucaaaaaaaaaaagaaaaaaaaacaaaaaacaacaaaaaacaacagcaacaaaaaccugaggauguaugugaauguguggcaaccaauauuccaucaugguggaauagccuaacuggaguuccuaccugucuuuacacaaauuauaucuuaaauuaauccugauuaauuuuucuaaagcauauucuccuccaaacuuuuagcgcauagcauaaugguuaaaagcgugggcucuauuuuuacuuuuauaauacaugcuuauagcaggaaauuuggaaaauaggaaaaagguauauucuuaucuguuuauggauaagaauuacuguguaugauuacugguauaauuuucaucuguuuucugccaaucuuuuuuuuuuuucuaucuaaauguacauaugcaugcauuuuauuuguguguuuguuucuaacaaggaucacacuguuuucuggucagcauuuucuucauaauccauucuuuccucucuuuaaauuuauuuugaucaaagcauaugagcaguuucaugauucuguuuguugucaaauugcucuucaaaaagauugugucauuuaaagguaaacuuaugaagaauuuuguucucuuuaaauuuuaggauagaccacuaucuuguugagcucuuuuaaaugaaguucuacuuggacacaaagaugaggacuagauaacuccuugagguuccuucuaaccccuaggaugaagauaauaacuaacauuuguauagugcucuaaaguuuacagagugaguucucauacaucaucucacuugauccucacaacagcccugugagguagguaggacagguauuguuauucucauuuuagagguaaagaaacugauagagagguuaagugacuugauaaagguguuuuuuuuuuuuuuuaaacguucuaguaaggauuugaauccagacuugcuggucuaaauaaucacguucuuuuuggcaagauuucauacaacugcacauuuagaauuacugauacauguuggcuaaguggcauuuguucuacacagaaauaaaccuaaugacaauaugaguacgguguuacuauuucuuugacuguuccugagucuuuuuacauucuuucuccaccccacaaauuaaauacaugagucugucucucuuuugacuaggagaagguaauguaauuauauagcuauauuaaacaucuacuauuuucuccagcauuugggggaaggggaaguuacauuauguuuuucauuuuuuuccucucucuguuuuuuuccguuucuuccuguuuuuuuuuucuuuugguaccagucaaaaguacaucugcauugcuugcuuucauacauguagcauaaagucuguaguagaguauugggaucccaguuagaaguagaauuuuugauucuagcaugaaccuagaaucuuucaggguauggaacuccuguacuaccuuaaccaaaauugugauacuugaguacuccagguauagucaccuaugucuuucacaaggggucagcaaguaauaaauggaagugauauuugaggcuaaaucaggaaagaguauaauauagcuaauacucucuuugacuaauuacuuuacaagguggaaguuuauaaaacugacuugauuugggaguuugguaguggcaauuucacauguuagaaaauuucacauuccagauuuucaagaguauguaguguuacauuaagacuaucucacaguauuuucuguacugccuuuaauugccuaacauucccaauauuuuuaaaaguuaauuuuuuugucguuuuuuucuaguuguuggucuugacgauauuauggaugaaggaguuguuaaagaaaguggcaaugauaccauugaugaagaagaacugauuuuaccuaacaggaacuuaagggacaagguagaagaaaauucagugagaucuccaagaaaaucaccucguuuaauggcacaagguaauccuuugagagaggucuagcuagaaaauuagagguauagggacagauguguuagguuauaaaccugcugagcagaaaucauauuuucuugauguuuugcuaauccauucguuuugauggcaaucaguuuugagaucauaucaauuuguuguauaaguuuucaguacccaccaccccacacuacccauuucuccuuccccaggggaaaccacuaguaacucugagcugguuuaauuuuuuuuuuuuuuuuuuuuuuugguauuuaccuuuauagcucuagguaacaugcauauguugcuguuuuuugauuauucugauuuauuauucauccaucuauugacuucccacuguggaugguuuucuuccugcuacuuguccccaucauauaauuuuguuagaucaaugguaauuauguuaguaugaguaauaugcuauuagagaugauacauuuaauaaacuacaguuacuuuucuuguaugacuucuuguguuucugauuuaaguguuuuaguuucucaguuguuuaguguguacauaccagcaguuauacuaaaacugcucuaccaguugucuaaaucuacccuaaagauauuuguguauuucagguauucugucauauccauuuuauugaaaacaccucuuggagccuucugauccccucuuauguagacagacuccuguuaguccuaugagccugaugcaaagcuguucagggaucucccuuuaccauuuuucuggaagucugugcuuugugcuuuuguuguaguuccuauuuccucuuucuggauucaauuuuuuuauuuuggugaugcaccucuuccaguaguuuugugagaaaaaggagcugugagauacacuuuuuaaaccuuguauguuuaccuuguauuuagucuauucucauacuggaaucauggucugguuggauguaaaauucaagguuggaaaucauuuuccuucagaaauucugaagguguugcuccauuuuuuucuaacuucaggguuguugagaaguuuauuuugauguguguguguaggaguguauguuaucugauuucuucuggaaguuuguggaaucuugcucuucagcuuugguguuuugauauuucaugaugauauguauugguuuugguguauuuuguguauggagcucaagacacucaguagauccuguuagucugaaaaauguuauuguucaauuccgggaaaauuuuucaaauuauuucauuguuaauuccucucuuuauuuuguuagcucuugauuucuggaaccuuuauuauuuguuacauaacagggacuggucccucuguuuucuuuauuuugccuacuuccuaccucuuuguaauuuuucuuuaacgugcuuaaauuuucucauauuuauccuccaacuuuucagucaaguuuuguacuucugauucuuaaauguucuuuuuguuguuguuuugagaaugguccuuucuguaguguucuauucauguuucauggauguaguaucuucuuuugucuuuauuaagauacuaauggcguuuuaaacaguuuuugucuccuuucauaguuucugacuucucaauguugcauuauuuuaaaaaaaauguuuaaaaagguuuuggccuccaucuuuccuagaugcucuccugaaaugucugacccuugauuauugcucauguuuaaggguagggaacuaaaauuaugaaacuucuaaguguggggauuggguuuuaccagcuaugagcgucaguguauagcaaucuggcuguacuguuguuuggcagaacccuuccuaucagaauuuagguuauuuuccauaacuuauuagauugcuagcauauuauggaagccuguaagggaaacugacugggguuucucagauuucaguauauacaaauucacuuaaucuuacaaauuucaauguacuuuacagccagucucaacugugccucauguucuuuagccuagaaaccuugcuuuacuaucuccagagaauaagcuacgaguuuuggcucaggacuagggaagggcaguugcccaacaaauggaguaggggaaagagggaucuagaaaucuaacugcuacuuuuaaagagcuuucagcccuucuaaguguuaagcaucugucuucauucccacuuuagaaucaucugggaccaccaagucuuaagacuuuugagguguuaaugguguuaguuuuugccaacacugccagccuaguguuuuauuaauuacuuuugggucucuuaugucaaauacuugguaaucaucucuuguuugguuuccaaaauuugcugcugguuuuuccucucucguucuuccuugccuuuuggacuuuucaaaaaaugucccgcuguuauagcuucaguaggguuuugagaagugaauaaauuuagauccauguauuuauuucaucaucuuuucuugaucuauguuuuuaauacauuuucaaaaucaguuauuugguauauacguguggcuuugagaaaugaaaagaauagaauaaacauuguaggaaaauaaaacuuuuuugccuauagaaucaggcuucaaacuaaggcagguaauauuuagaggagaaaaagugacuuuagccuuugcuuaauaaauugcuuccuauuggaaaaccacuuuuuaucugaaaauccuucacagcugaauauacuauucuuuugucauuuuuagcaaccgcuuggguguuaaaagaucuuuauuuauuaauguguaauaaguguuaaaauccuucauuuguuucauuucaaggaugaauagagcuguaaauuacuauaaucugucuuuaaagcuuuaaagaucaccuaaauauugaaacaaagcuuuauuaaaauuuuaguuauuuaaaaaaauuuuauaacugaauaugugauaaauaguucauaacccaccaaguaauuuuuaaaaguuauuaaguacuuaaccuaauacucagauacuuuguuguguccuaugggaauuagaaagggucucuaagauaaggaugacuauauaauuuuauuguucaaauugggcauacuuuugaaaaugaaagugugcuauuaauacuagaucagaacuacgagcaacaccuggacauuuaccuuuuuaaagauucucacaguucagugauaaaugacaaauucaguuuguggguuguuuuuguacuuacugaauuauuuagcucucuuucuuuuuagcucuuuucauuuuguguuucuccuuucuccugauacaagggggggauguaucagaauagggaaaugaaacucuuuucauuuaauggacuauuaggagcauugugugggaagcuuuuaaauuuucauacuuuccuuaugauacauuugcuugguuuaagucuuuuaaauuguguuucuuuuuugaugagcuguaugugguacucuguguugauaucauuucuuaggaauagcuuuaaugcuaaaauggugaccuaagggaagcacauugauaaaggaauuagaguccguuugaggcuguauuuugaaacucgcacagauccugguuugugauaggagguuuuuaguucagguuucuuuagcacuggaauauauuugguuuuauauauuuagaaauauuuaauguuuaaaaauccaugauggucuugcuuuaauaugggcauuaaugguaaaggaagcucauuuuacuuacgucacuccuagguuacuuuuuauggaaaagagauuugaugaaaacauuucuuuuaauaagguauaauauuagucugaauuuuuuagaggcuuuucccccugcuagaauucagagaacuuugauaaauauaaaauuugacauauguuaaauuauauauauguguauauauaucaugucaccauuaugaguacuguucaauacauuuuuguugagcaaauuauagcucagaauaaagaagugauauauucuaaauuguauugaaauaaaagcacaugacaaaauagcuaaguauuuuuauuuauuuuuucccccugugauagaacaaguaagaaguuugcgacagagcacuauugccaagcguucaaaugcagcaccauuaaguaacacaaaaaaagcaucugggaagacuguaucuacugcuaaagcaggagugaaacaaccagaaaggagucagguuaaagaagaaguauguaugucacugaaaccugaguaccauaaggagaauagaaggugcagccgaaauagcggacaaauugaagugguaccugaaguaucagugucuucaagucauucuucagugucaucuugucuugaaaugaaggaugaagauggauuagauucuaagcauaaguguaauaauccgggagaaauagaugugccaucucaugaauuaaauuguucacuucuuucagagacuuguguuacuauuggagaaaagaaaaaugaagcuuugauggaauguaaagccaagccuguugguaguccauuguuuaaguuuucagauaaagaagaacaugaacaaaaugauuccauuucagguaaaacgggugagacuguuguugaagaaaugauagcaacaagaaaaguugaacaagauucaaaggagacaguaaaauuaucccaugaagaugaccauauucuugaggacgcuggaucuucugauauuucuagugaugcugcuuguacaaauccaaauaagacagaaaacagccuuguagguuugccuaguuguguagaugaagugacugaauguaauuuggaauugaaggauaccauggguauugcugauaaaacugagaacacccuugaaagaaauaaaauugaaccguuggguuauugugaagaugcggagucuaauaggcaguuggagagcacugaguuuaauaaaucaaacuuagaggugguugauacuaguacuuuuggaccggaaaguaauaucuuggaaaaugcuauuugugaugugccugaccaaaauucaaaacaguugaaugcuauagaaaguacuaaaauagagucccaugaaacagcaaaccuucaggaugacagaaacagccagucaaguagcguuucuuacuuagagucaaaaaguguaaaauccaaacauacaaaaccuguaauucauucuaagcaaaacaugaccacagaugcuccgaagaaaauuguugcagcaaaguaugaaguaauacauagcaaaacuaaaguuaaugucaaaagugugaaacgaaauacugauguaccagaaucucagcaaaauuuucauaggccagucaaagucagaaaaaaacaaauugauaaggagccaaagauucagaguugcaauucugggguuaaaucugugaaaaaccaagcucauucuguacugaaaaaaacauuacaggaucaaacuuuaguacaaauuuucaagcccuuaacucauucuuugagugauaagucacacgcucauccugguugcuugaaagaaccucaucauccugcacaaacuggacauguaucacauucuagccagaaacagugucauaagccucagcaacaggccccagcaaugaaaaccaauagucacgugaaggaagagcuugaacacccaggcguugagcauuuuaaggaagaggauaaacugaaacugaaaaaaccugagaagaaccuacaaccccgccaaagaagaagcagcaaaaguuuuucuuuagaugagccaccauuguucauuccagauaacauagcuaccauaagaagagaaggcucugaucauagcuccucauuugaaagcaaauauauguggacucccagcaagcaguguggguuuugcaaaaaaccacauggcaacagguguguguguauguguguaugagugauguguacauugaaaauaaauugcuuuuuugggggugggauuaaugugagaauuguuuuaaagacauuauuugauacacagagaccugugcaaaaacaaaaagcuucaucagucuuggauaaaugauagaaagauggaucuacugaauuuacaaauauaucauccuagaacauuuaaaaaagcauagucuggccaacagcugacauacauggaaauauuuugucauugucacagguuagacaguguaauuuagccacugcaucugcaaaaaagccaaacacuuccugguaauuggaaaauuguuauacugcuuugggucuguaaguuauauauuaauucauuuggugugagaagaacuaguaauaaaguaugaaggucauaauggaaauucuauuuuucuuuugaaguuuuuuuuuuucuuaaaaugaaacauauuaaagaacaccauuucauaacuaucaaacuuuaucuugcagugaaauuugacagcuaaacaauuguuagauuacccaggucaacaugaaauagagugaaaaacguauuucuuuuuuugaauguuuuaaauaauuuuuugugaauucuagucuuuuuaaaauuugagaugauuuuagcacugacuuucaucauucuuucuaguauucagugauuuguaguuuuaugacacugcaccccucaauccccaauguguuuuuuguuagcuuuuuaagaaaaggaaagcaagagaugaaguggaguuugcagcuaccagauuauucuguucaaguguucauauugcuguuggaacuucuuucaaugcugauaugauaaaagaacauuauaauuuguauauuauauucuucuuauccuuauucaugaaagugugcuagagugauuuuucccagcacuaucuuaguacauaaaaaugaagcucuuuagggagggacaauuuaguaaaguguguuguaacauauuauuuuggugguguuagggugauuggggagaucggaaaggagauguuggggcuauuguguaaaauaaguuuuaugucaaaguauuucuucauuugugauccagcccguggccuauuuuuagcgucaaggguuaguuuauaacaauauauuccaguuuuuaaaaguugucacuuguuugaauacagugcuacauucacugucacuuacaugcucuuaauuauaugguuuuuuuauuuaaaacaccuuacucagccaggcgcagucgcaugccuguaaucccagcacuuugggaggcugaggugggcgguaggcagaucacuugaggucaggaguucgagaccagccuggccaacauggugaaaccccgucucuacuaaaaauacaaaaguuagcugggugugcuggugcaugcauauaaucccagcuaugugggagacugaggcaugagaaucacuugaaccugagaaauggagguugcagugagccgacauugagccacugcacucuagcuggugacgaagugagacugucuccauaaauaaaugaacacauuacucaaauauucugaagugggccugcuguuuucaggcaaaagagaauuaagaguuagguggugcuuuuaagugcuccuuuaaaccagccuuuuucucucugccagaaucuuuaaaaaauuaucauguggacagagagauggaauaggugccuuaaguaaaugaauuucuaacaugaaacuuuggcauagaguuggaagccauguuaguaaguuauaauguaacguacuaaccuuguagauaaaguuccaguccagucuucaggaguuugcccaggcuuuuuaaugaugacucaugcuucaccaacauuuaauaauuuuccuaaauuaagaguagguguuagucccuuuguuguuguuuacuugcugccaccuuuuggaucuacuguauagaaucuagaguguuuuugcucaagucuguagaaugacuuagaaugucaggugcauagagauuuuggguuuacacucuguaauugaugugaauaauuuaacauuggaaacaauuauggaagcagaauuuucgauuacuucaauuuugugaauuaaagccuuccuggcuaacacggugaaaccccgucucuacuaaaaauacaaaaaauuagcugggcgugcuggcgggcgccuguagucccagcuacuugggaggcugaggcaggggaauggcgcgugaacccgggaggcggagcuugcagugagccgagaucaugcuacuccacuucagccugggugacagagcaagacuccgucucaaaaaaaaaaaaaaagccuauguaauuguuuuuuuccccuccccuccccccuuccccuccuccccccucccuuccuccccccuccccuucccccuccguuccccuccucccccuccccuucccccucccuuccccuccccuccucuucucuuguuuuuaagacaaagucucacuguugcccagggguggagagcaguggugugaucuuggcugacugaaaccuccaccuccugaguucaagugauucuccugccucggccucccaaguagcugggauuacgggcaaaugccaccaugcccagcuuauuuuguauuuuuuguagagaugggguuucaccguguuggccaggcuggucucgaacuccugaauucaggugauccgcccgccucagccucccaaagugcugggauuacaggcacaagccauggcgcccagcugauuguuguuuuuacauauuaacuagccuucacuacuacugugauucuacuacuuugauacauugugcuuguauacauuucguuuacucagaaaaugcaccugucaugcagguugcaauuuuccuauucuaauccuuguguaagaauauaaauuuauuagaaagggcauguuuggaaauaauuuugauccuucucuuugauuucaugcacuagauacauugaaagcuguuuguuaauaugacacauuuucuagcauuugcaacagcuuugccucuguaaagacuauauaaacgcuuuaucauuuuacguauugcaguugaaguuaguuuccuugugugugcucccaguuggaaauuauauuuuguaauauagcugugucauggcuagaugugauauuaaucauaagcaacuucuaugcauauccuaaagacaguagacccuuaaagaagcaacauaugcuagauuuuuauugcuuccuuuuauuuuccugauucaaacuuacaucaaagguguaugauuuuaaagaccagauuauuuaauccucugauuuuuaaaauuaaugcaacuuuugaacuucuuuuaaacguaagucaguuggcauuuuguaaggaggaagucuuaguuuuuucauguuauuuaccuugugguuucuguuuuucuacuucuccagaagaugcuugaguuuuuaguuugcauuacacuuucuuggccccaauuguagaagacuaguauaucagauaauauuuaaaaaacaaacagacuuagaaaauggauuuauagcuuucaaacaagaaaacuucugagaagaaauuuucuucuagaacaaaugauucuauuuuucucugcagauuguuaguaacaaaaaugauuuaauguuuaugugacauagaauucucugaucuuagaagagugagucuuuucucucucucaaaaacucuuaaaacugcauuuuuuaaccuaaaauauaaacuauuaagauacaucuguagauggcacuagaguuuugcuuuuuauagccucucaaguuugaaugagacauuuccaacuugaaaugaggcuuauugaaagaauugcuugauaaauuucacgaucaucaaaccacucuucccugguugugaaauaaaaaugugaaaauuccuuaauaugugcuuuauauuuugaccuuuagguuuggauuuggaacaauagcauuauuuguacuguagguuuuuaagucaugucucacugaaacuaucccagacuugcuuugaagaaaucuuaauauaccuuugauuguggaaguaaagggaaaucauuagcuuuccuucagcauuucagaaacauucauguuagacaguugcuuucaagaaauagcaguuagcccauuguuaggaaagcuacaaugcucauuacaaauaaucauuuuuaauauuuuagcuuugcaacucgaagugggagaacuuuuaaacaccugcauuucaagcuuuauuccacuuuugcuagaauaucuguaucauuaugggcccaucaaaaaucucaaaccuguaggaauuauuucugucuucuaaacguguguuaacauuguucgaaaguuuucuugcuugucaaccccaaauauucuauauuauuuuuuuaaaccaaauuaaucccuagggaaaugaggacuuaaccugcuaaagcuagcacagguauuaccagcaaggauaaagaaugauaaguuauagaugugaugaagucaagucucaaggcauaguagugguuuuauacacaauaggcacaugaggaagaagaaaaggaagugcuguuauugaggaaugagguauuuggcaagacuuuaaaaacacuguaaggauuggaacucacucuuguaguuuuuacaguuuuaacauuaaaacaguaccucugguauauuuugaauugaccauaucacccaguguguuaccuucaauauccucucucuuggauuacagcuuuuugaaaggagcuugguacuauugguggugccacuauuaucaaaaucaguagcacggucuuuagauuguuaaaguacauaccuaaauccuucuaagucuuucagcuguaucauaaauugcuagccugaagaugaaaaaaggacaaaguuaaggaugguugucugaaagcauugcagcuuuccuaaccauggguuaaaaagcagguaaauuaaauugcuguguauauaucucauuugcuauuauuuucaaaaguaguuauagauacuccuuuuaaacuggaaagauagaagcuuuuuuagagucauacguuucacaucccuggacuuuuccuauugguuagugaaguuauuacuuagcuaaaagacagugaugggaaaacuuuuauaaggagauugggaauuaaauccaacccaaguacuaauauuuuuauguuaagauagaauagugaucuuuauuuggaaaaagaaauuuaucuaaaacacauggucauuaguaaggaaguccuuugaacuuaaaaguacagaaaaagauucuuuagcugaaucagcgugacaccaugaaccagaauauuuugagguuaucuagguaagguggcuaauaaacaguuugagaggcuccaucaugcuaguuuuugaguuccauuuuuguuacuauuguugguuuuuucuuuuauuuaaaacgauuuguuggauaaacaauucuucccaauuuuauaugugaugucacgucuguggugagguagguagcuguaacuuugauggauuguccgugaugaaauuauuaccaagaucuuaccacccuucucaguggauaaauuuauuguuagucuauacuuuguuauuguuuauaguauucaagacugacaaaggccaguugucuuuucuuccugaugguuuauuguccccucccucccccagcauuuucucauucauaccagaggagaaauauuugaggucuuaaagguaucauuuuaauagaauauuauuuucuuugaaaacuugcuguauguugaacuuauggaacggauagagauggaaaacaugcaaaguuucagaaaaucagauauugaaaauuuaauuuagccucauuuuugacauagauuuucuuguuaaaaaaagggauaaaaguuuuuugguguucuguuuuccagguuuaugguuggcugugggagaugugaugacugguuucauggugauuguguuggguuaagucuuucucaagcacagcagaugggcgaggaagacaaagaauaugucuguguaaaauguugugcugaagaagacaaaaagacugaaauacuagauccagauacuuuggaaaaccaagcuacaguugaauuccauaguggagauaaaacaauggagugugaaaagcuuggauuaucaaaacacacaacaaaugauagaaccaaauauauagaugauacagugaagcacaaggucaaaauuuuaaaacgggugagcucuucauuaaugcauuauuuuguuuauuuaagagcuuuuuguauggacugacugcaauaauuuugaaauuucucuuuagaaguuuuaauguucuuuuacauuuucaaauuuaguuuuccaugaaagugaauagguuuuuauuuaaaauuuuuugucagucuuggugaaaucagauggugacuuuuagaauaugcaggccuuaucucuuacagucuuuuuugccauuucuagccccuaguuugguacuugaauuuucuguuguaggauguguguggaucuuguggccauuaaguguaaauugugcuugcuaaguuguuuuaaaaaagcuuuucaguccauaaauaucuaccagcccuuugaccauuuggcauuauuuuuuugacuaccuucugaaaguauuuucuaaauagaaauuucaagauauuuaggcuuuaauaggagaaauguauaaaggacacggcauuuuaucugauuaaauuuucuuuccucauugucuaccuuuuuauuaccuaucacuuuuuuagucguuaauuuguuauucuuauagaauacugauagagaggagaaacaguggcaacacauguaugugguuaggcaaguauaauccaaaacgcaaagaacaugaaucuuagaguuggagcuuuagaaaucuuuugguccaaucauuuugauuuauuaauaugccuuacaacauuucuaggaagugaugaucuaguuucuguuugaaauccauugcaaggggauacaucuucauuuuuaagcaucuaauugucagaaaguugaucaguuugagcugaaauuugcaucccugaauugaagccuccuuauuaaaacuuaauuucucugcaacacgauauggaaguuaauuuagauugaagagcaugaggauguguucuccagaaucuuaccuauuaacaaauccguuucuuucaggcauuccuuguacgacaaaucuggauuaaguucuaguuugucauauccuuguggcaucuaauauuuuuugucugucaagacuuuuugaaaaucagauucuguccuucugauacguguuauuacuuuguugauuugaucaucaaaguaauugauaauauggaucugagagccacaaugagaacaguuuauagcaugucuuuggaaaacuucuauuuauuauuaacuaguauuaauaaucaccucuuacguacagcuucuuggccauauacauaugcaguacaaugagaaauauagcucauuguauugaccauagcugaguugucucugucuugcuuaaaaagacaucauaaaggcugagugcaguggcucacaccuguaauccuagcacuuugggaggcugaggugggcggaucgccugaggccaggaguuugagaccagccugggcaacauggugaaaccccgucucuacuaaaauacaaaaauuagccgagcaugguggugcaugccuguaaucccagcugcuugggaggcugaggcaggagaaucgcuugaaccugacggagguuguagugagcugggauugugccacuuuauuccagcuugggcaaaagagugaaacuccgucucauaaauaaaugaaaagacaucauaaaacguuaacaauuuuaacauuuugagaaccucuuuauccagucuguaucagaaaagaaucugaggugagucugauuuuguaaaugugugcaccauacaagugaucacugcuuccuuuucuuuuugaugugaacuguugacucucucuuggacuugucugauguuaguuuauggaaucugcuuuucuuaucccuagauuuuuauguugaacuauuuauugaguuucuguuguguggcauagcacuacgugccuuggguguauaauauugaaguauauuccugcucucaagaaugucuaguugcagacaaaaaccagacaaauaaauaaaaaauuagaggauucuuagucuagagaaaagcacuauuuugauuguacccuauuuuaaaaccugaguauaugucugacuauauagcguuccucucccugucuuucaggaacauuaguaggaugugauuaauuucucccaaggaucucagaauuccaguuuuacugguaauucuuuguggauuauaauuagaaccagaguagcagguacucugaugguuuauucuaccucaugggaauuaaaauugccaauaggcauacugagaacuuaauugauacacuugcuaguauauaagugaacuuaauuucauuuguuuuagaauauagauacuuguuucuuuacaauuuccuccuuuuuccauauccagagccaaauaagagaauucuuacuaccuuauuuuuaauuuucuuucuacuaaugguauugggaacaugaucucuauguccuuuguuucuccuuuauaagcuauuauguguucuacacaaaauaggugcagaauagauuucgaaugaaagagugaaucucauuuuacuaauaaucaagaguuauuuuuguacgucuuaaaaaacaaagauuguuuaguuauuuucauucuaaugaauuaaguacucauuuuccaggagucuggugaaggcagaaauucaucagacuguagagauaaugaaauuaaaaaauggcagcuagcuccucuucguaagaugggacaaccaguuuuaccucggagauccucagaagaaaaaagugaaaaaauaccgaaagagucuacaacuguuacuugcacaggagaaaaagcuucaaaaccagguagugagaugaacagaaaaaauuauauacuaauauauuuauaucuuauuuaagauacaauuaauuaguauacuuagggaauuuuuacaaauuuaacauuauuaaauguuguauugccauuaaggcaauacaaauggguuaggugauuggccuuacuuguaauuaaaaacuugcucuaaauucuggggaagcgcuagugaaauuaagauaagaccccucuucucauggcacuuaaauacuaauggaagaaggcaguaaguuugcaaguaagaaaauugcauguuauuuuacagcuugagaagaaaaaguggaguaaugggauggauagucacaggugggaagaguaaugggacuucuguuuuacauggaauggaggaaguaacuugugaggugggauuugaaggggugcaaagauuuuuggaggagguacuagguaagggacacaucaaaucuuaaggcuuugugguagaaagaaguguggcauuugaggagcaagaaagccacuguagagugauuagaagguaauacauaaagggauagaacaguguuagaagaugaguucagagaaaauuauugcucguacccuauuuuaaaaccugaguauaugucuaucuguauagcguuccucucccugucuuucaggaacauuauuaguaggaugugauuaauuucucccaaggaucccagaauuccaguuuuacuaguaauucuuuguggauuguaauuagaacaagaguagcagguacucugaugguuuauucuaccucaugggaccuuuggggcuauggcagaguuuauauuuuguucugaauguugugggaaaccuuuagaggguuuugugcaagggaaaacucugguugcucuguacaguuuggauuguaggaaggcaggagagaaagagaguagccugauuaguccguagcaauauccuaggaaagaaaugaugguagcuuggaauggaaauagaaugaagguagugaguaguagucagauucacauauguuuuauaauagaguugacagaacuugcugauggguuagauauagguugguauuggugaaggaaauagagucugagaaaagaaaaagguuuggggaagaaaauugaaaaauuauguuuuggccauuaugagauuccuauuagacaucgagauggaaauguuuugaguaaaucuuuggcugaugagucuggagccuauuagaagacuuuggagguugguauauaaauuugggauuuacuagugcauagcaguuaguacagguuaaacaucccaaaucuaaaaucugaaacuugaaugcuggcaugaugcacaaaggcaaugcuuguuggagcauuguggauuucagauuuucugauuugggaugcuccacugguaaguacaaugcaaauauuccaagauuugaaaaaaucugaaauugaaaauacucuggucucaagcauuucauauaagggcauacucaaccuguauuuaaaaucaugggcuuagauauaaauagcuacaggagaguuugacaaugaagggacagaagcagagcccuugggaagcaccagcauuuauuuuuacuuuauuuuugugacagggucucacucugucacccaggcuugagugcaguagugcaauagcagcucacuacagccuugaacuccugggcucaagcuauccucucgccucaaccuccugaguggcuggacuacaggugugcaccaccacacccagcuaauuuuuugauuuuuuguagagaugguguuucguuauguuggccaggcuggucucaaacuccuggccuucaagugaucuuccugcuuuggccucucaaggugcugggauuacaggcaugagccauugaaccuggccaucagcauuuaagaguuggggagagaagagguuauacagcaaaggaaacuaauggguggccugugaggaaagaggagaacugagacugguggccuggaagccaggugaaguuucaagaaggaaggaaugaccaaaugcugucuggacauuuaguaagauuaacacaagauuguuaagucuaugacuuagcaaaauggaaaucacuggugaccuugacuagaaugguuucgguggagcaguagggaaaaaaaccaguuguaguggcuuaugaaugaauggaagagugaggaacuggagacguugauuacagauaacucucagggaguuuugcuguuuaaagaaacaaaugccguaguaguuagaaguggaugugaauuuuuuuuuuaaagaagauaucauagcauguuuguaagacuaaugggaaugauccaauagaaagagacggcuagagagagaugauguugaugauguaagagagagaagugauaguguaggugugaaacucgggaagacaagaggggaugggauucacuccacauggagggagguauuuaucagaaagguaaagcucauccauuggauaguagggaagguuguaugugguagggggaagaacuaauguagguagguuggauuugguaaugggaaaaugauaguugacaguuuuuccauuuuuuuucagugaaauaugaagagcaaaucaaaaagauuguaguugagaaggagguauuguugguuugagaugagaggagaaaaaguaugaaauagauaucuuaaaaagugggagagcaaauuuauuaggaaaaguuaauaggauuagggcagaagguugaguuaccuacuuaaaacuugugguuauaaauuuaaaaugacaucugucaguaccagugcuuauuuuucucccuugucuucagccguuuguugccuauuugggugaaggauaaaaguuggcuuugagcaggguugugguuuugccaacacacauguuuaaaagagagagaauaaagauauuaaguauacgaggggcugguaaugguauuagacugucuaaucuaaguuuauaauguaugaaaagugaauacaugaagaugguaaaaaucauagauuuaagaauuguuggcaugaggagauucuagaauaaaugugcugguauaauaagucagagcagugggauguuugacauugagauuuuggagaugcuugggaauuaguaaugauagaauaaaaauaauuugaaaagcuuaacauucaaauuaguaaaaccagaagagauucaucaauuuugugguauuagguuaucugcuccuaauaaguucagaucaaaauuucugaaaacuuuuuaaaaguuaauuaauauauauguguggaaaaauaacuagcucuaaaagccauugucuaaauugaggaaagaguaggaccaguuuuuagucacuauucauuuuaauuaggauuucagugucaggaauauuucaauauggauuguggguucugaucuuauuucuaaauagugacuuuuaaucaguuuuguuuguaaacuuauucauuaaaaaggaaagauauuuuuaaaagcaauguaaugaguuucgauauuuauucaaauuagguacucaugagaagcaagagaugaaaaagaagaaaguugaaaaaggagugcuuaauguacauccugcugcuucugcuuccaagccuucugcagaucagaucaggcaaagugucagacauucucucaaagacauucuuaugaagagguaacauauauuuuuauuauagaaguaucaauaauuaugcuuuauacauuugaaaaauaauugaauuguucuaauuuuaagacuuacagacucaaauuugaagguaccagaggaaaaggcagcaaaaguugccacaaaaauugagaaagagcuuuucucuuuuuuucgggacacagaugcuaaauauaagaacaaauauagaaguuugauguuuaauuugaaagauccuaaaaacaauguaaguaugcuuuguucauauguuuaugcuuccaacuuuccugaguacauagguaucucagauuguaauacaguagaucuauaauuuauuaauuggagugagauuauaauuugcuuuugauguagaacauguaauuuuaauagucuuuuugcuacugaauaauucugcauacuaauagcauuaaccauucagucuacugaaaugcuaaacgugucuuaaccugauuuauauuauuuuuucuuuacucuccuuuauauaauacaauuuauuaaaaaauucauucauauguauucuucaaaaacuuuuaagcuaaaauuuauaacacuauuuuuuucuuaaaucugaaaauagagcuauuuuguacuuaaaucugaagauagaguaaaaaugcuuuuaaauuguuuuuaucgaaauguaauuuauuuucuuaagaaaauacauaacuuuaguucuaaagauagucuuaaauauaacuuuaguuccaaguauuauagcaguagaguaaauguuaauuaaaccccuaauuuuuucuugggauuucauguuuuggacagaggaaaucuaaaggcugugcaugugugugcguguaugugucaguguuagcucucaacaccaaaaguaggucucugauaaguacaauaagcaaaaaucaugccagcgaacauuuuaaagguucagaacaugacugaucucuugugugugacauuuaccuagguccaccagcaguuuuuugcuauagauuacucuagguaacagaaugugauuagaugcaaccuuuuugcauaaaagguuuucacacaacugauauaaauuuguauaaggauauuugcuacaguaggugauuugagguauuuucuugaaguacacuaacagagacuuaaaauuguacauucugccaucauggucccgaggaucagaugcuucuggaauuacauaaucuggaagcuuuucuucagcaauuaaauaaagauuuauuucccucagguuuuuuuaucuuuuuuuuggagacagagucuugcccugucgcccagguuggagugcaguggcgccaucucagcucacugcagccuccacucccggguucagaugauuguccugccucagccucccgaguagcugggauuacaggcacacgccgccacgcccagcuaauuuuuguauuuuuaguagagacgggguuucaccauuuuggccaggcuggucccaaacuccugaccuugugauccuccugacuugcccucccaaagugcuggcauuacaggcgugagcugcggcacccggccucccucagguuucuuucagguuucuuucuugcaggugguuuuuugcucugcaguuuccuccaagccugucaggauuuaaauauguaaaaucuuaaaacuaugaagaccauuacauugaguaaagcucuuugaugcaguaccucgcuauacuauagauugcuuauuguuaugguuauauugugucccuggguagacuuaauacaacuuuuggguagguauuguaaugguucuacuguacaugcuucuccauauauguugauuuuuauaugaaauguguguuuugcugccuuaaauuccuagaacacaaagcugucauuuaaucucuguguaguagguaauauauaaauaauuaaguauuuguaaaucagucuucaaaaauuguaucuuuauuauaaauuucuguguaguagccacucaaaauguuugucuccccuucuauuccuauuuuaaaauccuuccagauauuauuuaaaaaaguacugaaaggagaaguaacuccugaucaucuuaucagaaugaguccagaagaacuagcuucuaaagaguuagcugcuuggagacgaagagaaaacagacauguaagauuaucuauaaauaugcauuugacuaucaaaaucuauguuuuucagccauuggguaaaaauuauacagagguaaauucaacacagacugcauaauaacacagacuuucuguuacaugcuucuuuuuuuuuugagauggcgucuagcucauucgccaggcuggagugcagcagcaugaucucagcucacugcaaccucugccuccuggguucaagugauucuccugccucagccucccaaguagcugggauuacaggcacgugcugccacgcccaguuaauuuuuguauuuuuaguagaggugggguuuuaccucuuaaaccaggauggucucgaucuccugaccucaugauccgcccaccucagccucccaaaguguggggauuacaggcaugagccaccuacaugcuucuuuuaauuacuuguucuccauuccucuaguucuuaaauucuguugguuucucugaucuugucagguuuuuuucucauuuucuccaguuacuagguuacagaauuaccuuguguuuuauuauaguuuguaaaugagaaggaugggaaaagaauuaacaucuuuucauaauuacaucuguauuuuucagcagcacaguuugaagguauuaugaauauugguaauuuguagagccagaugaauuaagucagaauaaaaauguguacaggcuuaucucuuauccaaaguuucaaaugccaaaagcccugaaaaauaaaguuauuuucgcauaacuaauuuauugauaaagcuuaaccugaauugccauguaugaauguucauauucacagaaauauuguauauuuaauuacgugucucagaccuaacuggaauguuauguaauauagagugugugcaccauauuucauguuuaaauuuaaaaauucugaaacucacagauagcaagaauuuuuguuuggagauugugaacuuaaagguauuuaaaguaccuuuaaaaauuaaguauguuacuuagagccauugugacagugagauagccauguuauccaauuuuuguauuacaauggcaucagaauguuagccccuuauucuagaaaauacugguuguaguucauauuaacucuacaugauuuaucugauucuuuuguucauaauauuuaguuacaucucaggcacuaaaccuccauauagaccuaugccagaucuaguuugaagcucaucuagaggccuugauuugacauaucauacuucuucauacauuccuuuaccuucaccguauguaauuucuccuccucuuauauuuugaaaauaauaucaccuccucuuccuucccuccauaucucaaauaugcacaugccacucuucugcuuugaaacuggcugcgaguaacaucuguaucagaaaaugccagcuuguucuuucuuaaggccauguaccugauuuuucuuuaaaggaugauuuguacuuaacaaaggcaguaccaucuaugccuuccuuaccuguucuauuccuggcuaccuuuauacuacuacuuguuauacuugcuuaauuuugauguuuuguugcuaagcuuguucaaccgaauuuucagggucacuaagcaggcuuaguuaggagacagcuaacaaaggacuaccagaucggucauuugaauaaacuacuauugugggggauguuagaacauugaauuaggaauuuaagagcaaaauaguuccuauuucccuguggcagcugcuaaaaaguacuaaaucagcaaacagauuucaaauacaaauaguauguuucaccacuuugcaaauuacuuuggacuucauuugccuccugauauaaauguacaugugaacuucucaugguugagguacggggucuaauucuuauaaccgcaguacuuaaaacugucucuggcauauaaaaguacucagaauauguuuguuauaugagacauuaccuuaagauuaaaagucaucuguggugauuuguuuauuuuuagguaagcucuuauuauuuaagguguacacuuggaaauacauauuuuaaauuuaauauuuuuaaaaaaguauuuucuguuagaccauagaaaugauugagaaagagcagagagaaguggaacgacggccaaucaccaaaauaacucauaaaggugaaauagaaauugagagugaugccccaaugaaagaacaggaagcagccauggagauucagguaaggauagauaugccauguuuuauagcucaaaacaugaagauucagaaaagguuuauuugccuaauguuuuuaaaguagagaaaagaauuuuaaaauaugcauccauuuaaaaguagccuauuuuauugguuuagugguuuuuugaguguugaguaaugucucucaaauugcauuauagguaccuguugaacaguuauuacaguguagauuccuggagugcucugacuuagugaauuucuuuuuauuuuuuggugggauagagucuugcuuuguugcccaggcuggagugcaguggagcaaucucggcucacugcaaccuccgccucccagguucaagcgaugcugccaccucagccucccaaguaguugggauuacaggcaugcgccaauacacccagcuaauuuuuguauuuuuaguagagacagaguuucaccauguuggccaggcuggucuuaaacuccugaccucaagugaucugcccaccucggccucccaaaguguggggaucacaggugugagccaccgugccuggccugacuuagugaauuuuuuaguaggcuuagaaauuuguaaguguuucuuaggcagagugucauuugauagguggcauagcuuuucuuauuuucaaaagucagugaagaaauaauuugaaaucuuacuagaaggcuugaagaauggggaauguuuuaauuuuugcucuuuuaagucacaguuaaaagcuagcauucauuuucuuaagaaauaguaaaaaaaaaccaaaaaacaaaaaucaaaaacuuaucuauggaacaacugcauuuuaggaaaauauaaauggaaaauauaaauugauuuugauaauugaggccaaauuuuaucagcuaaaacuaauuuuuacuuugacuuacguuaggaaccagccgccaauaagucauuggagaagccagaaggaucugaaaaacaaaaagaggagguugacucuaugucuaaagauaccacuagucaacacagacagcaucuuuuugaucucaacugcaaaaucugcauagguaauuggaaguuuuucuucguaaaauuuugcauucauuaugaaagaaggauacuuagauacuaguauauguaauuuaaguagguuuuguuuucccaauauugguggugaggcacucacucacagucuuuaagcuuucgugugacugguuuucuggguugagguauaguuugauacugugguauagucuacugucuagaccuaauuauacuauauaugauuugaacuuaaaaacuguucuugcuggagucaaaugacaagaauuuaaccauuagaaugaacaucaaacauugugggcaguugugaugauacugucauuuacuaaaguaaaggaguaaaauagcauuuauauuuuauuauauauaacauaagacaaaucagaaacugaaauuacuuuuuuguaaaaaagcuuuuuauuuuuaagagcacuuuuagguucauagcaaaauugggaggaaguuacagagauuucucacauaccugcugccucccuacgugcauagucuccacuguuagcaacaucccacaccagaguggugcaguuacuacaguugacaaaccuacauugaaaaauaaugaccccaaauccauaguuuacauuggcguucacucuuagaguuguucauucuguggguauggacaaauguguaaagacgugaaucuagcauuauaguauuauacagaguauuuucacugcccuaaaaauccucuuuacucugucuauucaucccuucccccaacacccccaccagccccuggaaaccacugaucuuuucauugucucuguaguuuugcuuuuuucagaauauuguguaauuggaaucaucuaguauguaacauuuucagauuggcuacuuucacuuaguaauaugcauuuaagcuuccccuaugucuuuucauggcuggauaacucauuucuuuguagcauugaauaauauuccauugucuggauguauaguuuuuccauucacuuaauguaggagaucuuguuuuauuacaaguuuuggcaauuacgaauaaaacuaguauaaacauuuguaugcagcuuuuuguguggauguguuuucagcuccuuuggguaaauaccauggagcacaauugcuggauuguaugguaagaguauguuuaucuuauaagaaaccuccaaacuauuuuucacagaggcugagccauuuugccuuccugccagcaacgaaucagaguucauuuugccuucccgccagcaaugaaugagaguuccuguugcucuacaucuuugcuagcauuugguauugucaguauucuagauuuuggccauucuaauagguguauagugguaucucucuguuguuuuacuuugcauuuuccugaugacauauguggagcaucuuuucaugcuuauaugccaccuguauagcuucucuggugaggugucucuucaggcauguauagucaugagcuguugcuauauaauccaaaccuggauacagauaauacagauuugucuuaguucuucauguuacuucucgagacuauuggaauuugguaaaauugucagagaauuaagaaaccuguuuuagguucuaguaauaauauuuucauuuuagcuugucugaguuguuuaacauucucuucuucuaauuuuucacuucacuaagagaggaauuacuaccuuagggguccucaacccccgggccacaaaccuguacgguccauggccuauuaggaacugggccucacagcaggaggugagcgguggacgauacugccugagcuccgccuccugucagaugcaguggcguuagguucucauaggggugcaaacccuauugugaacugcacaugugaaggaucuagguugcgugcuccuuaugagaaucuaacuauuaaugcuugaugaucugagguguaaugguuucauccugaaaccaucucuccccucaucccaccguccaugggaaaauugucuuccaugaaauugguugcuggugauaaaaagguuggggacugcuaaucuuguccauauuuacucaugauauguuuuacauguaggaaauaauuauaaagagauuuuaaggggaaauuaacuuuauuacagguagaaccaugcaugauuugcuuugaauugcauuucagauaagcuuaggucccuguauauagaagagggcuggcaguggggagaacacuagugaauuuucugcugauucuuaaaugugguugugauacaacuaaaugaugacaguuagauauaaccccaggaaauguaugguuacucagcaauugaaucauagaaccugaauaacuuuagaaagugaaaauggguuaaguuauaaaaguuguaguuaacaguugguuucuuuugauguauucugggcuuaggucgaauggcaccaccuguagaugaucuuucuccaaaaaaaguaaaaguuguuguaggaguagcucgcaaacauucagacaaugaagcagaaaguauagcagaugcauuaucuucaaccucaaauauuuuggcuucugaauucuuugaggaggagaaacaggagucuccaaagucaacguucucuccugcuccacgguaauuuucucuguuguaaauucuguaauacucauuauagaucuuugccagauuauacuugcaagucuucaaaaacagaaaagugacauuuugggaaccucucauuugagaaaauaacuguacuuuccuguacuuugagauaaaacaagacuucgaaaauaaauauauuuggaguguuuucagugagagauuggagcguguggggaaacagcuuuaaaauucucuuuaauuaugcuggucccaaaagucagggauagauuauuaaagacgaaauguuugcacuuuucucaaucuuaguucuccuaagccagccaagagggaagauuuuguaaaacauuacuauguaaauaugaauguaauuuuauaaaaugaaagugugaacucuuugucaauagccucauauuuuggccuucuucacaugcuaaaauacgaguaacugaugacuagguaggacauugauuuauucaucagcuugucuuuaggcuuuuuaaugucauuuucuaguccagagaugccuggaacuguugaaguugagucuaccuuucuggcucgauugaacuucaucuggaaagguuuuaucaacaugccuucuguggcaaaauuuguuaccaaagccuauccaguaucuggcuccccagaauaccugacagagguacugugaacuuuucugcuuuucugugcaugaauugauaauguguguuucugaaaguaauugacagggaaauaagacagaguuaguaauagaaauauuuauuaacaaugauuuuuaaacaguccaaguaauauaauuaugaauuaacaaauggaucuuuagaauuguaaaauaaacuauucucugaaaguuuuaaacuccuauguccugcacuuuucccaagauguacugccucacugugucagauaauucaaaaucaaugagagucuacauggauauccaaguuuuucuuugaauacacacuuaaauaaaagauuuacauacuuuuggucuuuaauguuaacacauuaagaauuuuuuguuaaacagaucuucugauuuccccacugcuuauguuuccccaucuucaugacuacuguucuuaccugccuauuucugugaaugugguuuauguagacugggaguugaagcuuuacagcuaguugaaaaccagugagacuagugacuguaguugcugcaagugauacccuugguugguucuacaccugagggaaauagaaagaaacuauuaugugguauuuauggaaaauaagcagcaguaacauuauaauauugugauaaaugagacagugacauuuuugaauuauuuugaaggaaauguauuuuuauauguguauagaaggaaaauaaaucaguacauauauacuguauuuauguugagaucauauuuugcuaucuuguucguaucugaccuuuuucauuuauucucuaucugcugauuuuaaagaauuaaaagauuguaaaaaaauuccuuuuauuauuugaaaaagccuaaaucauuugccugucuuuuuuuuuuuuuuaaggcuaacauaaacuucacuuuucuuuggauuaggcugcaauuaguuuaauucaauguaauacuguuuauguaauauugaucaguuuauuugguuagcaguuguggguuuguuuuuguuuuuguuuuuguuuuuguuuuuguuuuuguuuugagacagagucugcccugucgcccuggcuggagugcaguggcgugaucuuggcuugcugcaaugucugccucccggguucaaccauucuccugucucagccucccauguagcugggauuaacagaugugugcuaccacaccuggcuaauuuuuguauuuuuaguagaaacggggcuucaccauguuagccaggccgguucugaacuacugcccucaagugaucugcuugccucugccucccagaauacugggauuacagaugugagccaccgggcccagccuagcaguguguuuucgauuaauaaacagacuaaucacuuuuauauacaguuugcuugauauuuuaaaaaugugagcuuuauaagagaaaaaugaauuagauccaugauguucuucuugagcaaaucuguuuagaaauuuauuauuuggucaguccauggugaagauaauucuuuaaacggagagguaagcccuuaacuacaaaauccuuuugauuuuaaacaagauuauuauuuuccccuccgagacacaguuuuuaugugguugcuuuccagauuuucacuuccguuuuguacuuguuuuuaguuuggacugaaaucccaaaucaaauauuuuaaaguaguuaauaauuuaaauaaacuaaauugaauuuaauaucaauuauguuuuuaugauuuuccucagucuucguggaaaaaauaggaauguacugaauaaaguuuuaaauauucuuaauugcuuucauguguagucaucuguuuucagaaagauuaugccuuuaaaaaaauaaaccuugaauuauuacaauauuauucuccuuugugcaaaaauacacucuguaauuacauuugguaaccuuugaaauucagcuguuaauuauuaaggaauuuuccugccuacugcuaccaaaaggggagguuacaaucucugcuaauauucugaaauguguuguguucuuucugaauuguuaaugugguaugcuugccauugcuucccuuucccaucuuucauagugagauugggcaugaacucagacucuuucuuaguagcuguauuuuaggcaacagucauuuguaguuggcauuucaaguaaaaccuaauugcucucuguauucuguuuuccgaugcauuuuucauaaucucuuuauuuacuuguuuuuauuacuguuucaaauuagucuuagaaucaaauuuguaugaauuacuaaugucauaauaaagauaaucuauauauauugaucucuuuuuuuuuuuuuuaaccauaggaccuaccagauaguauucaaguagguggcaggauaucaccucagacaguuugggauuauguggaaaaaauaaaagcaucaggaaccaaggugaggaaaacuuuuuucacuauaccagcaugggaaaauguuuagaaaguaaacaguuuagaauucuuaugcaagggugcaaagucuccuggggaaaggaggcaauacacauuuuaagucuauguaauauaccucacaaaacugaacaaaagccauuugcugaggcugucaacaguacagcauuuuuuuuuuuuccucuccugggaugcucucuuuguggcuucuguuaauguuuuagaagaaauguuuuagaguaaguauugaaauucacccuggaauuuugccuugcuucuauuacagacaaguguuugaguuagggcacagcuaagcuauugcaaaaaagagaaucuaaaauauagugacucaaaaaauacagaaguugauuggaguguuguccucagcagucaaacauaccaaauaggaguaaaugaggaauaccugucuaguuguuugaaaggcaaauugcagucauuaacuuccauuggaaagaaccuagucacauagccauccauacauagcugcuagggaggcugggaaauguaaucuuuauuggauggccaugugcccagcuaaaaguuaagggcuucuuauuaguaauaggaggaaaggagaaaagauacugcgaaauggcucuaucacaauaauauuucuccuuuuccuuuuucucucuacauuuucuuuucuuuuuuuaacuuauagaauauuacuacagaggaaaauuuaaucauuagaagaaauuguuuuucccuccacgggaugugauaguaccuaguauauuaacagucauucgauaaauaaaucuugaaugaauaaauguuacuuuuuugccucuuuuucagaagucucuagcuuuucuuuggaaugauccaaaauggauaaucuuaagcugaaaagaauauuuuguuccaguauagauuuuuagaauuuaaauugauacaguguuaaaauacaaauaaacuuuaaagcacuaauaaaaaugagaaguauuacucuugggcauuuugagaaucacucuugaauccacacauauauuacugcccaacacuuuauaguauguuccaauuuaacagauuuaaacacucuguaauaguuguuacuaacauauguauggugauuuuuacucuaaaagagggcaguuuagaugacacacauuuuauaagagagucauauuucagcucauucacauguuuuccuuaggagcuuguaucaguuuuaggcuuugcagcaaaucuggcucucccauuucggccauauaccaucaugaaaaaaaacauuguuguugaacacuaccaaauuaauaacaaauuaggacugucuuuucuaucugaaacaaaaccuagaggcaagcaagaaaauuccuaagccaaauuacuuuacaaaauuuacggucuauauguauuuaaggucucuucauccagcccuuuuuauuucuaaauucagugccuaguaacuggauuauuaguagauuugucuguuuguguauauaaauguaugguaggguggaaguguugggugcuuuuaguucccagugguucaagaacauaagcagcccuuuguggagguuacagcauuggaaaucaggauauaguguagauauuagaagacuuggguuucaguaucaucucugccacugacaaguuguaucugucaccuucaaaaaagucauuaaucaccuuuggacuccauuucuuauguuuccguaagaaauguaagcuaucagauaaauccaucaauggaucaguaaagaucuuuucuuaagaguuacuugcuuuuaauauucucuucuguauuuaaguugguaaaccacguuauuugguaccaucauuauaaaguucaauagauuauuacuaauugagaaauaguuuuaaaaccaagcuacucuuuagcuuauuaccuuaaacaauuauuuguuauuuucuugaacaggaaauuugugugguucgcuucacaccaguaacugaagaagaucaaauuucuuauacuuugcucuuugcauacuucaguagcagaaagcgcuauggaguagcugcuaacaacaugaagcagguuaaagauauguaccuuauuccuuugggugccacagauaaaauuccacacccucuugugccuuuugauggaccugguagguauacguuuuaauaauaggauaagaaugaaauaacaugggaggugggaccagagugaaaagacugauucugccuucuuucucaggauccagcccucuagagauggcuugacagggccaggcaccauuuaauauccuguaauaaguuagaggcagaauuuuaccuuuuuuugcaaugauugaaaaugaugaauuaauugauguuuuugguuuuauacagggcuugaacugcauagaccuaaucuauuguugggcuuaauuauucgucagaaacugaagcgacagcacagugccugugcuaguacuagucauauagcugagacuccugaaagugcaccaccaauagcauugccaccugauaaaaaaaguaaaauagaaguuucuacagaagaagcaccagaggaagaaaaugacuuuuuuaauucuuuuacaacuguauuacacaagcagagaaauaaaccucagcagaaucuucaggaagaccuuccaacagcaguugaaccuuuaauggaagucaccaaacaggagccaccaaaaccuuuaagauuucuuccuggcguguugauuggcugggagaaucaaccuacuacucuggaauuagcaaauaaaccucuuccuguggaugauauacuucaaagccuuuugggcaccacuggucaaguauaugaccaggcccagucagugauggaacaaaacacuguuaaagaaauuccauuuuuaaaugagcagaccaacucaaaaauagagaaaacagauaauguggaaguaacugauggugaaaacaaggagauaaaaguuaaaguagauaauauuucagaaucuacagauaagucagcagaaauagaaacaucaguaguaggguccucuuccauuucugcagggucuuugacgagucuuagucucagagguaagccaccagauguuucuacagaagcauuuuuaacaaauuuaucaauucagucaaaacaagaggaaacuguggagaguaaagagaaaacauuaaaaagacagcuucaggaagaucaagagaauaauuugcaagauaaccagacuucaaauaguucuccaugcagaucuaauguaggaaaaggaaacauagaugguaaugugagcuguagugaaaaccuuguugcuaauacagcgaggucuccacaguuuaucaaccugaaaagggauccuaggcaagcagcaggacgaagucagccuguaacuacuucagaaagcaaagauggagauaguugccggaauggagaaaaacacaugcugccuggccugucacacaacaaggagcacuuaacagaacaaaucaauguagaggaaaaguuguguucugcagagaaaaacucguguguucagcagagugacaauuuaaaaguugcacaaaacucaccaucaguagaaaacauacagacuucucaagcagaacaagcaaaacccuuacaggaggauauuuuaaugcaaaauauugaaacugugcacccauuucgaagaggaucagcaguagcgacaucucauuuugaaguuggaaacacauguccaucagaauuuccuucuaaaagcaucaccuuuacuuccagaagcaccagccccagaacaaguacaaacuuuucacccaugaggccacagcagcccaaccuucagcaucucaagucuagcccaccuggauuuccauuuccagggccuccuaauuuucccccacaaagcauguuuggauuuccaccacauuugccaccuccauuacuucccccuccaggcuuuggcuuugcucaaaaucccaugguucccuggccaccuguuguucaucucccaggucagccacagcguaugauggguccucucucacaagcaucaagguauauaggcccgcagaauuuuuaccagguuaaagacauucggaggccagaaaggcgccauagugacccuugggguaggcaagaccaacagcaacuggauaggccauuuaauagggguaaaggggaccgccagagauuuuauagugauucacaccauuugaaaagagagcgacaugaaaaggaaugggagcaagaaucugaaaggcauagacgcagagacagaagccaagacaaggacagagacagaaaaagcagggaggaagggcacaaagauaaagagagggcacgguuaucacauggugaucgaggaacagauggaaaagcaagcagagauaguaggaauguagacaagaagccagauaaaccuaaaagugaagacuaugagaaggacaaagaacgagagaaaaguaaacacagagaaggagaaaaggacagggauagguaccacaaagauagggaccacacugacagaacuaaaagcaaaagguaaaauuugcaggcugcuucaggauuacauuuaaauaacuguuaaaauguuguaucuuguaaacaaaagaaagauugccugcuaggauugugccaucuuuaaaauuuuuacuauuggucauuugcagaacaguaaauucuguguguugguacagagugcucuguaccagugcucaucaucccuucuucauaccaacggucccuaguuauaggaauuuaauauuuuuaaaaguuuuacauugcuguauauucaaagauuuguuuuauuaauaugcaauaaaggcuuagaaauuuuaguuuuauuccuuaauugguaaauaugguuaacuauggaauauauuuacuuccucuagugaauguccuuuauauaaugacuaauuugggaguaaugugugcucuguaaguuuguuuuaaauugcacuguuuuuaaagaaacuguagaggagcaacaaaaauccaagcaacuucauaaucagauuaugcuaaucauuuaguugagcaguuuuugaccaagaaucagaagcccaagggguacauuuauugcuuuaaucugcacucauugaagucauuuauuaccauauacuacagcuuugugguaggccauuauuuucauuuucauuuuuggcucuucagaaacuugaauacuuaagcuuguacaugaucuuguguuuugcuauccuuuuuacuguaaaauguaaauauuuuaagggauauuuugauucuaaauaugauaaaauaauuucucaccuauuuugugugugugacuugaaauucaguaguaaaagaauuucuucuuuaaagcuuuaauuaccuucagacauugauuuuuuguuacucagccaagaacauauagaaauagcuaucuaugucaggcauuagaugaggggaaaaacaauuuuuuuaaaaucuuaaauuguaggcugagaugaauuguguaguucuaaagaggcuagaauuuagaacuaccugugaaacacugugcagcuauagcccacuuuauagguaaguuucugaaaacuuuuacaccaucgcaauuugguacucugacucacuaaucauuaaaauuaaagaccgcagaacuugaagagaaauauguuuugaauccuuuuauaaaaugugcgauuuagccuaauucguaaaguaacuguacaguuucauaugccaguuuuacuugaaaaaaaaauaugaaaacuauuguuaauucaaaucuaaauuuauuuaaacccuaaaacacaugguuuugauggcuguaauuuaaaguaagagcuaucaaaugaugcugacaaaagaaaaaccuuccaaaauacaaaagaaagagaacucuauuauuuacuuaccuguauuaaugaagaaaaauauaaauaauuccacaaaauugauuguuuuccuaaagagcuuaaagauuagaguuaaaaauugguuuugaaacagaauuauccuuguuauuuuugcuggagagaagggaggaaauucagaaccaaacauucuauuuaauuugcaaugacuugcaguacuuuuuucccuauccuuauccugugaaacuuacuaucauaagguucuaaaacagagaacuuguguuuaaauaaagcccguuuaacuuuggucc

SEQ ID NO: 12673 - RNA, 1849 nt, Homo sapiens
ccuaaagcgcgcaggcgcggcagcgacgcaggccgcggcccccggaacgguaaacaguggggucacgugacacggccccucuccagcucccgcgccgccgccgcacgccgauggcugcggggucucgcgccgucgcaccguccccacgcggcaagcgaccuucgggcucagggcggcggcggcugcaacgaggauuaggagggcggcgcggaagccaagaauagugucgucagcagcagccauuuggucccaggaggaaaagaggcuguggcagcgacgccgacguccugcgcguacccccucuccgcggcacccaccgggcccccuccuccuccucuucggcggcggcagcguccaccaucuuccucuugcugccagugguagcgcucgucuggcggagcugggugaguugcggcuguggccgcggccagggagacgggcaauccuccccucccccauccccuuccacacgcacagcgccuccgcgggccucuccgccccucccgcggcggacucuccgcgcuuuucucccgcgcagccgagagaucgccucucgggccucuugcgcaacguccucggccuaccugggccgcgccgcuggcgccuguggaccauuuggaccgcgggcuggggagggagucgcagcgacgcggucgccaggcggagggucgggaccacggccucucucccgaccacugguacccagccgucugcugcgagggcgccccgccgccgcugaggcgcgggcgcgcaggcccgaggcacggcgggcgcugccuggaaggcccgucucgcaggcccccggauccggccguuggggccucuuccuucucagggagccccagcauggagcuuugggccuugguuucgggaaacugggacuggcccuggcugcuaggcugcucccugcugcugcuuuuuggagaugagaguugcucuuccauuuauccuccaguuaccgcgcgcuuuugugcccgggacucaaacuguggacuccuuuugcuuaguuugaaaugagaagccuagacucuugccuuccgauaauacauguaauuuaaugaaccacuugucgauacguacguguuaauggugcuaaauaacugaucaccugacacggggggcgggggcggugcggagaguagaaaggaagagaauguugauaucgcgcacggaguccugugucccuccuuucccucaggauguguugccggguuaggugaccuuuuuccaucuuugggcuuuuaaaugccaauuccuagagacuagauuggggugguuauuagugcuuuccaguagucacgcguagaauauguucauggauuaauguuaaguggcaacacugcuuuaauauucuaguccuaaucugcauuacauguagcgauauuuaauuuaaaaagaauaaucgauuauugaggcuucucuaaauacuaacuuuacuaucuuauuuuaagcuaaauuuaaaaaccaaugcaguaaacucuguagggaguacuuaaacaguacguuguuguauuuaguuacuauuuuggggucgaacuugucuucccuuugacaaaaugauuguuaaaggccuaacaaaacuacgccuccauuauucauuuuucgauuccugaaugaaguguuuggaacugugaaaauauuuguagaaaaagauguauguuuguguuagagcgacauguugagucaaagcaccagaaacuuuucuauuguagcauacuuauguuuuugaauuuauagcucccuuccacagcacaaaaagguguuguguaaagauuauuguuauuuuaaauaguaauuuuaaaguuuaguuaucacuuagaccuuuuccccacuaauuuuucucuucauu

SEQ ID NO: 12674 - RNA, 10913 nt, Homo sapiens
gcgccucggcgcguguauuggcuccuucggcugcgggccggcucggcuacgcgcucugcuccgagccgcucacugcaugguagagucuggugcccccgccgccgccugcaucgccgccaccgccgcuccgccacgaccaccgccgccuccugcccugcagccaccgccaccgccugugucgccgccgccucgggaccggcuguaugauuaggccacaaucuucaaugaguaaacauauuccugugaguagccgucgcaucgucgccucucgggcugggaauccacgaccggccccccauccccgcugucgccuuuguucggagcccggcgucuccuccagguugccccggguugcgguuccggugggucccgggugggagcgggcggguuauggcccuguggccggccgauugcggccggcugugcggaggcagaugccgggccccucggggcugcgggguggcgguuggccgccggaggcaccggcuuuugagucccucccgagcccggagcgacgggggcggcgcgguccggcuucugcggcggccgggggcaguuucggcuuccgcagcgggccggguggguggcacaaaagccgcuuugugaccgccgccuccgcccuuggcccuuuggucuggcgcgacccguccgggcauggcaggcuccgcggcgucccggggccucuuuguucggccggaggagaguggcugcacugggagcgggagacguggcccgggguggggcgagggcugcgcgugucacugcggagccggauacggggagggcgcggcgguggcggguucgccuccagauccgggcgggcgugggguaggccggacagccaggcacgggugguaacgaucugguuccagagcuucucggagcuccggggugggcgcgggacagccacugggugcagcuacacucuugugcucgacggccgggacccgagccucagacaaaauggccucggcgcccgcgccugacugaaggcgcggcgcgaacccgugauugcggcgcggagagggggcgcagcgggcgugcucgggcgcacacagccgcgugcgcggggcggcggcccucuggggcauuccgcgagcugcaccccugcccgggccagagugggguucugcuaggugagaacuucggccguccgccccgcccuccucccaggcuccaccugguaauucgagcuguuccggauuuaucgccccaccucgggcucgugauaaugggaacaagucuagucuuguccuuucucugggccagucgucgagaaauggccugguucggagcgucuuggaaacugacagggcuacuguuaguuacacugacgcgaaggacuucccguccgggcaccagcauacauuuccccugccaauuuuggaagggcccuggauggcgccuuuuaaucggggacuguuuagaacuaucccugagcucugugguguaauauguuguugccuccuguugguuuguggcagcaguagccaaccagagacggaauucugaggguuuuuuaucuucuguccgcggagcccccuaccaguccacgaguauuaaguuauuuacacuacgauuggaacuguugaccugcccgacaucuagauccugaggcagugcuuccuguuacucagucaguugaaaacuagaaaacuaaaucauucccaagagugagcagcauuuuacacaugcuuucuuaggugcccuaagaccuaaauagauguggaacagacuauacaacgaauuguuugugacaaaggaguuacacacauuaauuggcuugacucugcaguauaauaaugauuuaagcuucugcacagagauuacucuuuccuccucucccuucuuguauaugauugugauuauaaugcaacugauaggugggagggaaaaaauccccauuauggauaguuuuuccuguggguaggagauugggaauggaggagugucuugggcggaacagaaaucuaucgguggccaccacugcuuuaacagacgaguccccccauccacuagguggcuccacucaguaaaaauaaccauuucaggaagggaauucuuaauauaguucuuucucugcuuccugaugaaagugcuuacuuacaugaagggauauggccagacuagguuguagccgacaggaguuuuagcuauuaaauauggaaauaguggugugaaauacugccucaaauuagcuuuuaauugaaaaaaagguaauaccuagaaauuagaauacugugaugagucauuauaaagcuuuuaaagaucauuguaugucauugggaaagugucagaauacacuuuuuauucuacggagguuguauuuagaauuuggggugaaaguauaaugaaauuauuuucagauuacuacaaucuguauucacuguaacugugauggcuuuguaauuuagacacuuaauuuuuuaacccagcugaccaacuaggugaaguaaccucugagggcuuguuugaacaaacuugugauaaugaaaguuaccuuuuuuaugggaccuuuugauaaaugauuguuaaugcuaguuguauguuuuaccagaaaaguagacuggguuuuugacuugauguuuucugcaguaaucaucauaagaauuauucuucaaaauuuagcaaaguucuagaaacuauaacuagcaugggacuauuuaaagguguaaaauggaaaugggagcagaucguuugaauuuuaauuuuaagacuucaaaugcuuaaauuuaagcauggaaacuaauggaaccuuuuguuaaaacacuuugguaaugagaguacacaugaagugcuugaggcagugacuaugaauuacugcucuuguuaaccuguuauuaauacuuuccuuagugcccucuuuacucccgaguacacaaguaccuuauaaacuauuuggaagaagacugauuauuaacaucagugucuuccauguacauauuuuaaaaauaugcugugacuauugguuuaauguuugauauuggcauaaaaaugguuuaguucuuaagggggaacuuagagaaaauauaaauacauucauauuuguuuauauuuauugguuacaguaguuaccuugcuuuugagaccugccacuuccaccuucaacaucccuuuguccgccuucucugaguuggauuucaguuuugaguuguauaugugaaauuuugguuuuaaaauacaaaagaacauuauuaaaauuaugaauauuuucuuuacaguuauaaaugagaguuguuuccuuuuuagauucauaagcauacauucuuaugauauuucacauaacaaguugauuuucagagacucauuuuccucgucuucaguuuaaugggaaugauaacagauuguuaaggauaaagugagauucuaaauauaggacuuaaaucagucuaagaaaaggauauaaaagcauaaaguuggaaaagaacuuagauguuucaguuuaugaguuaaguaaauuaugcaagacuaauaacuucagaguuaucuggaguuuguauuaauguguaaaaauguuuuuguuaguuggaaaaaucaacauaaaguguauguaauuacaauguaaagaaaacaacuaucgaaagggauaauuauuagaaucauauaauuauauauuauauauagauaguauauauacagagaauauaacuagauagaauauauaugaauauauauaugaauuucacaaaaauguaacaauggguuugguuuuuuuuucugaggaaucuugguaauagaucauggauuucaguuuaaucuaucugacugcuuguuuuaugcugauugauuuaaucuguacucaccccuugaguuuugcaauucaaguaaaagucgaugaagcggcucaggcccugcuuuagaaaaauaguuguguacuuaaauaguguaaaacccuaauguauuucuuuugaauuggaaaauaacuuauucucucuuucugucuuuuucuuuuaaacagcaauucugugguguucuuggucacacauuuauggaguuucugaagggcaguggagauuacugccaggcacagcacgaccucuaugcagacaagugaacuguagaaacugauuacugcuccaccaagaagcccccauaagagugguuauccuggacacagaaguguugaauugaaauccacagagcauuuuacaagaguucugaccuggaugggguaaaccucagugcacuucuuuucuguuggccucaguauuacuggauugaagaauugcugcuucuuguuaggagguucauuucacuuaucauuacuuacaacuucauacucaaagcacugagaauuucaaguggaguauauugaaguagacuucaguuucuuugcaucauuucuguauucaauuuuuuuaauuauuucauaacccuauugaguguuuuuuaacuaaauuaacauggcucgaaugaaccgcccagcuccuguggaagucacauacaagaacaugagauuucuuauuacacacaauccaaccaaugcgaccuuaaacaaauuuauagagguaagauuugauauguuuuaguagcuuaaauugauugcaauauaauagugggacuuauagcuaacaaaauaaaaacuacuuuggaaaaaaugagaugauauaccuacaauuccaguucccagaaauaaaugucaaugucuucuauagguuagagguauauuuguacauuuugagaagggcaugugcuugaguuaauaguuauuguaccugaguuugcuugaauugguauguggacaguaaaacaguauagcucuuacuuaucuuguaagaaauuuacaugggaaagguugccauuuauggauuuuuuauauaucugcuuaaccuaaugacuaaugccauaaaccaguugguuuuucuugaaccccaucugaugcuuagaauccaauuuucaacuacaaauucuguuccuuccuaaugguagcuauguagccaaaacucuaccugccucuuuuuacuaggagaaaggaauugaaugcugaauaauauaucgggaugugcacauguuuuauuuuauaaauaccuacaguuguuaagaaauagcaaauaggccucucagaacauaauggaaauacuuuuuuuuccuuuuuuugagauggagucucguucugucacccaggcuggagugcaguggcaugaucucagcccacugcaaccucugccucccggguucaagcaauucuccugccucagccucccaaguagcugagacuacaggcguacgccaccuugcccagcuaauuuuuguauuuuuagauguaguuucaccauauuggccaggcuggucucgaacuccugaccucaggugagccaccacgccuggcugggaaauacuuuaaugguacuuuaauuuuuauuacuauauauuauauauacacuaauauauacuauauaguguauauaauaguauauuauauuaguaauauguaauuaguaauaaugcauuuugaagccuguaguuuuaaaugguaugugggcuuuuuuacuguaguuaagacuucauucaauguaaaucaguaaaguuuaaggagugaguauaauugagugaagucagauuacccgauuaguuauaaauaaugccuuuaguuacauuuaccuuugucugcauugcugcuagccccuuuugguuaauguuucaucccaauccgguauuaccaugacuguaaacaacuucaguguaugaagggggcacacaauuuaaacaaaagaaggaaaacuuuuccaguuuauuaaaaauauguaugguauuuaauauucacuuuucuuuuuauauucuagcauugucacuuaaaacaaaauuugcuuuuguguuaaacauaaauggauucuagcauucuuuaaaugaucuucuguuaaccagcauacuuacugaucagagaugaucagaauauaaaauguugaguuauagugaugugguuaaacauuaagauuuuuuuaauguacguuuuauccaggaacuuaagaaguauggaguuaccacaauaguaagaguaugugaagcaacuuaugacacuacucuuguggagaaagaagguauccauguucuuguaaguauuuaacaguucuuauggguuuauggugcugugcuacaaaaguuuauucaaauaguaaauucaaauaaauaucuauuuaagucauaaauagaccucaaaaagcuaaaaacaaauauuauauuauugugcagaaucuuaauuucuaaauaaaggugaaaagcuaagcaaggauuugaaguugugaaacauuuuuguaaagauugagcauuuagucacauuugguagacaacaggguuuaauaagauuugauuaaacauuaaaaugagaaugcuuuugaaaacauuuccauguuagaaauuuagaauuauuacuacaguguuuauauuaaugaucuaaaauguuuaaauauucuucugacuuaggauuggccuuuugaugauggugcaccaccauccaaccagauuguugaugacugguuaagucuugugaaaauuaaguuucgugaagaaccugguuguuguauugcuguucauugcguugcaggccuugggagguaaaugaauuuaucaauuugauucuagguaaaaaucuauugauaaugaaaauacagaaacuugaaaaauucuuauaauuuuuuaauauaaagucaacauuugucauagguauuacuuaaauaggaagggugguagauaauacuucugaguuggggaauguuuggagaaauaaauuuacaaagaucugauuuugaaaaaacuauuuaucaaaauucuuaccucaccagagcuccaguacuuguugcccuagcauuaauugaagguggaaugaaauacgaagaugcaguacaauucauaagacaguaaguaauggauucucuuuucauuuguacucucuuucauuuccuuguugagugucagugaguuuaauagucuaauagcccauuuaaucauuaugauuauuuuuugagauaguauuaaaaccaggaaaucaagaucuuacauucuuuuuugcauuucaugcaguugcucauauuacuaagauucuaauccaacaagaguuuuugaauuauuguuuugcuuuaaauacuugauugaauauguugguuauuuuguauuuuuauugagguauaauuaagauacauuuaaagauacaauaaaaugcacaggucuccaaaggagaccaguugacaauaacagccaaauuaaccauccaauacaacacauagaauauuuugagugcuguagaacaugccuuuguggcuuuuguagucaucuucccugcuaccagaggcaacuucugacuucacuauaaauuaguuuugucuuuucguggacuuacguguaaauggauuugugagucgacuguuguaaccaauacucaaacgaagauauaaagaaaauuaacuuuuuaugauuuuuuccauuuacacugaugugccuguucauauuccuuucugcaucaggucacagccuaauuaaucaaaagauaaauugccacaagagaggugaugguugucuauaagacacuaaauauuacuguagggggcuuuugccuuguuucauuuuuuuuuuuuuuuccucccagaaagcggcguggagcuuuuaacagcaagcaacuucuguauuuggagaaguaucguccuaaaaugcggcugcguuucaaagauuccaacggucauagaaacaacuguugcauucaauaaaauuggggugccuaaugcuacuggaaguggaacuugagauagggccuaauuuguuauacauauuagccaacauguuggcuuaguaagucuaaugaagcuuccauaggaguauugaaaggcaguuuuaccaggccucaagcuagacagauuuggcaaccucuguauuuggguuacagucaaccuauuuggauacuuggcaaaagauucuugcugucagcauauaaaaugugcuugucauuuguaucaauugaccuuuccccaaaucaugcaguauugaguuaugacuuguuaaaucuauucccaugccagaaucuuaucaauacauaagaaauuuaggaagauuaggugccaaaauacccagcacaauacuuguauauuuuuaguaccauacagaaguaaaaucccaggaacuaugaacacuagaccuuaugugguuuauuccuucaaucauuucaaacauugaaaguagggccuacaugguuauuugccugcucacuuuauguuuacaucucccacauucauaccaauauacgucagguuugcuuaaccauugauuuuuuuuuuuuuuuaccaagucuuacagugauuauuuuacguguuuccauguaucucacuuugugcuguauuaaaaaaaccuccauuuugaaaaucuacguuguacagaagcacaugucuuuaaugucuucagacaaaaaagccuuacauuaauuuaauguuugcacucugaggugcaacuuaacagggagggccugagaaaagaaugggagggggcuauuaauuauuuuuagcaaaauguugccuuugucuugugcaaacauguagaauaugcucuuuaauuuaguaaaauauuuuuuuaaaagguagagaugcuuuguuauuguaaucauaaacuuccugaaauucuuguaauuuuuuucccauacuuaucagaaguguguuuaccaacuuauuuuuguuugaaagugugauuuuuuuuuuccuucccaaccucucuugcaaaaaaagaaauggguuucugcuaaugaauugagcagacaucuaauauuuuauaugccuuuugagcuguguaacuuaauauuuggauacuugacaauuuguuuuauuauguaauugauaaaauggugauguguauuaauguuaguucaaccauauauuuauacugucuggggaugugugguuauaguucugugggagaaauaauuuugucaguguucaccagcuuguaaaaacuuagugcgagagcugaaacaucuaaauaaauaaugacaugcauuuaucaucauugagauugguuugcuuaaaauuaacuuauuuuguagaagacaaaaugaauugcacuucacuuaauguguguccucaucuuuuuacaaauaaaugaaggauuauaaaugaugucagcauuuuaguaaacuuuuagacaaaauuuguuagggucauucaugaaaacuuuaauacuaaaagcacuuuccauuauauacuuuuuaaaggucuagauaauuuugaaccaauuuauuauuguguacugaggagaaauaauguauaguagaggacagccuugguuuguaaagcucaguuccacuaguucaugguuuugugcaacuucugagccucaguuuucuccuuugcaaauuaauaauuacauaccuuuauagauuuugaaauuaauuuaaauauuaguauuugguacaugaaggcuuaauguuaaguuuccuuuaaugauccacaauaaucccuuugaucacguuaaucuaaaucuagaugucuuugucuaauuuuuuuugaauagcaguuauaaauguaaaggacucaaaguuuaaguaaaaagugauacuccaccuuguguuucaaagaauuuaguuccaccucuucauaccaguuuaacacuuaauauauuucauuggauuuuagacagggcaaaaggaagaacaggggccucuggaggcccuugguuauuuaaaucuuggauuauuugugauaguaaucacaaauuuuuggcuaauuuuuaaccugagguuuuguuuuuuuuuuaaaggaaaugcagccuagucuugagaacauaauuuuauauaaucaauuacuaaauguuaaacuauuaccacacagcccauaaaacagcauuugcguuuauugagagagaggaugugccaucaugauuaaugaaaacuaucuuuugaguuugaaaagaaauuaauuugcaguguuuggauuguauauauggugcuaaaaauaaauuaauuuacuuuauaaaccuuaucuguacauuauacgaugugaugaaauuugcuuuuuauccaaauauuuuguaucuuguaaauauggcuaauuauaggaaugccuauaauacaucuuagauuccuuauaucuaauaagaguucaaagaguuaugaguugaagucuugaaugcaggaaacuaucugauaguguucuaaaauuugguuacuuggguuuggauacccuuagugggaugauguaaauagaggcuagcuaccuaggcuugucuauagcaaccauaauguugauguaaguaaugcgguuacugaaucauaagaaaaugccaucucuuuuuaguugaaggaaaacucuggaaguaggugccauuggucauucugcagugcacugcaaccauuguuuccccuagugcccucuuuucccuagggcauugcucuccuauucccacgccuuaacacagcucuauaccuagaagcagccagcccaggcaugcagucacauuuaaucacaucccccuucuagagugcuucaaaaugauguagucccucaacuuggcuaaagaaucucaaucucuugaaauuuauuuuuuuaaugucauauucaucugguaaauaucuacuguuugccaggcauuuaagaauauggcaaagaacauaaaagauggugucaccagauuuuggucaccaaugaguacccgacccguugccaugauuaagagagaaugcuuucuauuggaguuucaggaaauauaauuugagaauacuuuaaagggaaguggaaguauaagugaaugauauuuuucuuuuacauguaaacaaugaaguuauuucaaaguuaaguuuuaaacaaaauacaugaaguagugucugccauacauguuaauauucuacauucuugcuuccuuaaauuaauauguuuguguguauauaugugccucacaccugaauugaaaauuaaagacugguuuaaaagugguuuaaaagugac

SEQ ID NO: 12675 - RNA, 15565 nt, Homo sapiens
ucuuccccaggaagaaaauaccuauacccacaauaggucugcaaaaucucccacaggcaccucuucucccuuucuugugguuguuuguuaauugguuuguuuugccuaaaagcaagauggcaaucuuaaucaaaaagggaagcuagauuuuuaaaauaacuuaaaaaaaccauuuuuauauaaagcagcaaaaacauaucuuccucucugcagaaagaaaaauguuaacaaggaaacacagcgaugugaacggacuguccgucaacuccugcuccacuggaucccccauccagcuucaccucgagcuacuccuuaacuccagcagugcugucugaagaagauccuuuggcgucuucaacugcucuuuuacuuucuugauugagacuuucauuuucggaccuggucccauuagggauagaguuuucaccguuuacaagcccguuuucuguggccuuugcuuugcugauugccucucugauguucaaggcauccugcacuccagccuccuccucgagguuucucaagaccagggggagccucgagucccccacgcugcucuccaacagcccaagguuacucucuucauauuugggaagcggagccuuuuccuccaucuguuggcgauaguauucccgguugacagcugcacucuuuacugcuuuuuccaaaaucucuuucucaccuaagcgcaauuugauggccauuuuugcacgaacagaaagaucgugguuuuucaagacggauuuaucuuccuggaaaacaagagcaaaauuaauuacaagaagucuaaaccagcaaaacuauagagacagagggcacaacggcuggggauggggacaugagggaacuuuuuggggugacgggagguucuaacacuugacugggcagguggucgcaugaccagacacucacaucaaaacguacgcuucagaaguaugccuuucauuguauguaaauuauaccucaauggaaauguuacaaaacaagaaagaacagccuaaaucaaacagugcuaccccaucugccagggaacuucacugauuuaaaaaucauccugucuaucuugggcacugauguagccccagggcagcacgugggugaauggcaucagugaaggaacgaauaaaugagaaagauguauuugaaguuaguggcucaguagugaacuuaaaaagcacaaaugaaaacauguuugugaaaucacgugaauuauaaauuauaaaaaaguauugaauaaucuuaaaaauguaucuucuaauaaacaaugccuaaauaugauuuuuugggaaaugaauggaaaauuucaaaugcaaucauuuugcuaaacuauuacaguaguuuagaauuaacaagaaaucuuucauuaaauuuuuuuuuuuuuuuuuuuuuuuuuuugagacggagucuugcucugucacccaggcuggagugcagugucgagaucucagcucacugcaaccuccgccuccuggguucaagcgauucuccugccucagccuccugaguagcugggauuacagaccacacccagcuaauuucuguauuuuuaguagagacgggguuucaccauguuggccaggcuggucuugaauuucugaccucgugauccgccccgccucgaccucccaaagugcugggauuacaggcgugagccaccgcaccaagccucauuaaacaucuuaacaacacaacaaguucaaaaccucauuuauuuaguguaauuaccucaauaguuguuuuauauguuuuuaaaagaagugaggcucuaucuucaagaaauguccaaaguuugaccucguugucccagcuaacaggaaauuccgaguuccccaaggugaagauucuaucaauagcgcugucucccagcaaguguucuuucaguucuucuacaagaaauacaaauggcaaucuguuaggaggaaaacauagcacuccucauuugaacaagcaaucuaccuuagaaaauauuguuuccaacaacgccauuuucccacgguaaaagcugucccuacgcaaugggccaggccacuccuagacucuccaaaguagagcagagcuaaguuuuggggagcaacaccaggucaggccucuccauguggaauccugaucaagccuugguagcacuccaguuuucacuguuucuaugagggacacugagagccuuuagacaguuucacaagauacuuuuuaaagacaaucuacagccauguacccccuuauuuugacaauaccccuuuugcuagccaugagcuccaucacaccaagucaaaaaagacauuuaggugaacgauguaaacggugaaaggaacaagagccacaacaaucccgcaagcccauaacuguaaaucugauuggcacuuauucuaguagaugaccugaccaagcuauuuaagccacguucguaacaagccacaaacugaaagaaauaagagccuaaaucaaacagugcuaccauaaggagcacuaucaaaaucuuaguuaaugggccgggcgcaguggcucacgccuguaaucccagcacuuugggaagccaaggcagguggaucacuugagcccaggcguuugagaccaaccugggcaauguggcgaaaccccaucucuacaaaaaauacaaaauuagccagguaugguggcacaugccuguagucccagcuacucaagaggcugaggugcauggaugacuugaacccaggagguggagacugcagugagcugugaucgcaccacugcacuccagccugggcaaccaagugagacccugucucaaaaaaaaaaaaaaaaaauucucaguuaaugaaaaauaugcccaucucucucacuugucaggaauuuaaauaggaauuacaaauacacacaagugaacaucucaauuaucuccaaauauauuuaagaagaggaaagaauucagcaacugcucuuagcauuuuaucucccggcacauuaucuccaaaaccaaaacaagccgauccuauucaugcugaagaaacagacccaugcuucuuaugugauuaggagacagugucucuuucagagcaaaaugccccacagcugucacuauuuacgauucaaacugaagaacugcggcugccagcaaaccaaacuuuuauuaguauuaguuagaguaauucaaagauacagcaauugucuugacaugacaaauugucuaugacuagagaggaacuaaagagaaucaacagaccuaaaaggauucaagcaguuuuaagaaaacaagcuaucuaauguucaaaaaaguuuauuaacuuuuauuuguuaguaaagaucaugauaaaauucaggauuuuuaguuuugagucauuuuauauucuuugcauacaacauggacguucuguuuuuuuaagcuuucuuaguggcugaaaguucuuuucaaaggcccccaguaugaagguuacuguuuccuucccucaucuccuuccucaaucugcccaaguugcacucugcaaugauggaagcugcaggugugcggcagagcuuucucuccgcuacuuuuuaaaagugaaacuggacucauuucacauuucuggagaaauaaagccuacaaaaaggggaguaagacaauguagcauguggccugccugcaggccaggagcuccugcagcaggugcccuccugagcuuuccuccagcaaacagggccugcaaauuaucccugcaccucauucuggccaccacagugugugcucaccccggaggguacagagcccagugcccuccacccucucucccuagcuccugcucaagcuccucccuaugcuaaaggucuucagucauaccccuccccuccugcucuaccuuguccaaacagucgcugagcuccacaguuuaacuugaaugccauuuccuccagaccccuagagcacuaagacuuuuuuccauguacuauguuaucugugaaccagcaggagcaaugugggauguccugcacgugggcucuggaguuaacagagguggguucuaagucagggucaucacuugcuuacugagcaaccucggccaaguuacuuauccucuuuggguuuuuuguuaguuuguucguuuguuuguuuguuuuagacagggucuugcucuguuggccaggcuagggugcaguagcaagaucacggcucacugcagccucaaccucccaggcucaaucaauccuccaacuucccaaagugcugggauuacaggcaugagccacagcauccagccaacuuuauacucuucccccacuccccacccaccugggucucacucugucacccaggcugggguuggcuuacuguagccuucaccucccaggcucaaacaauccuccuaccucagccucccgaguagcugggacuagaggcacgugcuaccacgcccagcuaauacuuacccucuuugaaguggaaucuacaucaguaaaaugggagcacuucccaaucaaggcugaugggauuaaaacugagcauguaccaaauguagcaucaugccuggcgcacagugaaugcuucacaaauucaaggaauaucaucaccaucaccucucuuaauuauaaaugccuugaguacaugaacugcaacauucaauucuguauccauauauaugcaagaaaagcucacaguuaaccccuuaacucguguucauuacauugaauugaugaaccauuacccaaguacaaaaagcaccaaaagcucccacuugaauaaccguaaaucuagcgacaggguugcuuaugaggaacaaugacuguaucucaguuuggguucugcgguuggugugugaacugccucuccuguuucgggacuagguuuuuucugccuccagcaugacgucaaacccuggacuugugcugcacugcucccuggauccagacauuaaaaccaaagccagugaccgccgagcacagcagcuucccccacaugggccaugacugcuuccuccgaccaaggaagugcuugggcagcuuccuuccagaacacuuguucgucuguucacucacucaaacacucauuuacucauuccuacucagacuguucuguacaggauuuaagguaguuaacaacagcaaaacauacacacacacacacacacacacacacucucucucucucucucucucucucucucucucuuucucucucuuaaaaaugaaaccucagggccaggaaauuuguaagauacauuuuaggaugaaaaauaaaaacacaaccacgagaggucaaaucucagcauaagaaaccccaaaugacuuguuuuaagcuaauauaaaaguagaugcucaauacaaauacuuaacucuuucugggcaugaaauaagaggcuguagccaggaacauuuuguguucuacacagauucuguuugcaauguuauuuacucuaacaggaugcuuggcauuaaaaugcuugcuggcaauuucagauuuagaaugcagaguagguuaacaaauaaaguccuacgguccacguaugccacagcugacuacacaacaucacagcaucaacugauccugaacugcucuauguaagugaaaaagacuagugccccgugagugaaaugaggcucugucaggcuacaaauguagaauuuugauauauuuacccuauccaagauguuuuaaguuuucuucaaaugcaguugagaauuauuugcguauuacaaauuaauacugacaacacaucgaggauuuaauaaaacauuucuaggguaaaacaaaucuauuucuucuuucuccaguauuguaucuucucucuucccaaaaguacuguaguuuuaauccacuuuaccuuuaaucugaaucccuaugcuuuacacuuucaugauuuaaaaagaaaaaagucaacaucucuuuuuuccugaaaugacuuaccuucagucauacagaauacucggagaaaagccaaaagcugagcagagaugggcggcucgguaaaaugcaaugcaaaaacacuggaacugauaaaagcagaaagcaagaucagucacccugcugcgguuacccacuugcuccaaacugagauuccuuaagucuacagcacgugugguuguccucaaggagagcugagcuggaaugggucauuccagcuccucaucucaacugugagcacgauuuucagccccugcaaaaggccgcaggcuggggcggaggcaagcggacauccagaauuggagaccauccucacaagcuuuuccuagagccuaacagcuguaaucucagguugcacauaauacauucaaaaauuaaacauacacaugguuuuuaaaaaguguuaacaauaauuuauguugaguucacacuuuaaucauuaaucaaauauugacaaguucaauaaaaaaaaggucugcauaauccauuuucauuaagaaugguuccucuauucccuggagaacuaaugaauccuaauuccugucuucuuuaucauuuuaugccucaaaugcaagaaaaucuuaaagaacuuaacuagaaauucuugaaaucacugaggaucaugacuucauuacagaaacuaaugguagcaacgaauuaaaugaaacaaauugauccaggccauuaaccuuuucaaggugaaagacaugaaugauacgaaaguaguuauuuaacuuaaugaggauuucaggccauaucccccagaacugacugugaaugcgcccaacgacacaauuauguuuaccugaaaacgcugguaagccaccaagcgucgccauggcuuaaauuugcugugccacggggauaaacggauuaagacaaacuacuggagagaaguuuuauuaacacaccaauuaaacacuaugcaacuggaaauaguucaaguacugcaagaaagggccaaccgauguuuuucuacguacguggggaugccggcacgagccaagaccucggccuucauggcguagagucugucacuuuuacucacuccaagcuuuauuuucacucugucgugugaguuauugucaaagaaaaaaccacuguggaucacaaacucugcguuggaucgagugccauaaaaaauguaaaucugagaugcaguaaagaaaaaagaaaagggcauuagacaaacuuggcauguauucuuaacacagggcagggcagaggcuuagugcuacuuuacauuuagacacuaaauagcugaaaguauugauacaccuguuugguauagguugcaagggugaagcugugcaauuuucccaacuuuccaaacugucugagaccaagcacccacuuccaccaccguguggagaggagaggggaggccaggagaaaguaccaccaaaggccuuacuaguacucaaaggaccccaggugaccuggggucaccaggccucuauuauaaaccucuucuccuuccaaaggacagcaaggcuauuacuauaagacuguauuuuaaaauucaccaaguucuuccuguccuuuuaauacagcagggucucuucuggaacuguaaagcaguaucugucagaaacuuauuucuagauccucuggcaauuaauccugcaccuggcagguggguuuauaaacuuuucugaagaaggaacagaucaguacuuugcuaggcaaguauuuuucauuuugucucaacuggaaugucaauuauggaugugaguuccaugacuguacugucugcuuggguguagacugauagaauguaggaauuuauagacacguauuuucaaacucacccaaaggcuuaccccuccucccacccaaacuacuagauuaaaaaaucagagauuaaaaugaaaguauaagacaacagauucccuugcuuuugccccuuaaauacucuuauaaaguucuaaucaguagaaaaaauaaaggcaacaguuuaugaaauguuaaacauuguuuagugucauaacacacuuuauuuucaguuaagaguguuacaaauauuuacaaauauuaggccaauugugcaacuaacuguguuuaaaucuuuuucucuguggacccaaagcacaaugcaaagcacaagugaguaaagcacaagugaauauguguacuacggguucuggucucaagauguguuccagaaaaacaauccucaaugugaauuccacauuuuuuccccuaaguuaaguuccuuuuuaagauuaccaacacgguguuaacguuagugcccacuggcuggcucacauuuugugagaugccacgagacccaccugcucuccagcccgaaaauccugcagagccacacacucacagcggucaucuuccagguuguaaccaguagugaucuagcccggggaggaggaaggaaaugauggugaggcaaacacacgcacaucucacuuaaucuacaagcuuguuucuggcaaucagaggaaaaaggggaucccaagguacucaaaagguggcaucugaaugcuuuggaaaauggggcaaagaacugcuugagcacugagguuaacucuaguuauaucagagaugauuauggaaaauuacauaccugaaauaaaggaagcacaguuagauaaagagacuauauagauugucacuugcuggacucaacaaaacauaaucgccucugggccucccugguggcagugagggcagugagcccacaggccacgccucccacaggugcaccuaagccuccuuucuguucacugacgaucugcacuauucucauucauuugcaaguauuaucuuuaucuaauguuuggccauuaagaaauccaaguggguguuccauuggauaaagaaucagggaaaagaaaagcucuauuucugaauuauggauauaugcucugaauuaaagaaauuaaaacuuucaagcaugcaaaggcaaaauaaaauaacugcuguuuuuuaugcccucucuuucugcugagaaauacaaugugagaguuucuaaguccauuacaaauaaauauagaaaauccucucauuauaccccaaaccugcgucuccuucuaagcucccccgucuuagugaaggucagccaaugucauggccucagcacacaaguuacaaggaaacccucgcgucucaccuggucagcauuucaucuuguaaauacuguuuggacuuucuuccucauuccucugcauggcuauaguccuuauuccuucucaccuagcuuguuauuugcaaaaaccuuccaacucuuggaaccuagucucaaaauccaauacuguccuucuggaguugcuaauuguacgaugucacucuccuguucaaaaucuuccuaugauuccgcucugccuucggaauaaaccccaaguuccugagcacggccgaauaaggaggcggcucacgcuucccuccagcuucaggaacugccacccaccugccaucccaguucccuccugccugacacuaccuucuacuccuguuguggccuggcuucucagggaagccccuccuuacccugcccuccugugcacucccacagcccaguccuuaugcgcuccagcccaagucacguuaucugugcaccugccuccccgucggucacacuuggaagcuggagccccuuguugaucucugugucccgagugcucagcacacagaaccuaaaaccugaaguggucuuugagaauauucacgugaugcaugaacccgcaggggaaaggaaaggguccccagcuucuauuaaaaccuccuucucagaguccugucuuuuagagcagcgcccaaucucuuagguugucugucgauggucacugauuacuuuuugaccuacucauuuuauccuggagaaucaaagauucacagcagcuacaagugcuccuugcuaauaagguaucaauagcuuggauucaaaagaugacuucugagucuagggaauggcauuuugggauggaaggccauguaacacuaaucuuuaaacucaauaucccaagaauaaauaugguuuauuaaccauaugucuaaauuuccuucaugcuucugaucugcaaagaccagugauaaauaugcagcaaugagaaauaaaugaagccaaguauucuagaacauuucacucgcagaacauuuuaaacacuucaauugaaugaaaaucaacuccaugaaguuccugcccaacaucggauguacuuuucugaccccaaaacaucaccuugacaacaaaguggaaugagaagcugcccauaucaugaacucccaggagggaguccaggcacucccagggugcuggcaguacagguacacagggaccugccagcagcacaaacaggagggagguuagaggaaggaagagaaaauuuagggagauuguggagaaaggauuauggguguuuaaggguauuuuacagauauuucccacucucagcaaacgucaagcucaagaaauaguuuaacauguccacagcaacccggacaggcaaacaggcugggauccugccccggucugcagcccuuucucagcaagggucagaauguuuggaggcugagugucuaacuucuuuguguggcacugccaaacacuuccucuaggacgguaucaagugugucucagugcaaagaagugcaggcggaagcacaggccucgccccucccuugccugaagccagguuucuagaggacucucucagagcagagcccucccagggugggccugcagaggggccuuccaaggcuguaaggaccccacugcucagcaagggccuucuggcaggagccccaggaaauuaccaccuacgcccagaaaucugcagacgcugaccaggucugacuugaagcccagacuaggagaggagggguugggaaggccagggcugguccaggggcagccacccgaugucaagcaaggacaggguccuuccaccuccuccucgcccagcuccacgugccgcuuccugccucccacacugccagcuaacuucccuucuacaauacugagugccauacuaugccaggcccuaagcgaggcacuuggaaaauggcaugaaaagucucagucccuacccauagggacaucuaguggaaaagacacagggagaaaaaaauuuauauauauacguauauauaaaagcaaguggaacugagaauagccccacaggagucucaagugugcccaggggaggggagcggguggcagccggaguuuguuggcaaugcuggaggaggaacccagcagggaguggaagccuccagcagcuccauggagcccugcucccugaaagccaccaccugccugcagcgcacaccacucacaucuguggcuggcuugguaacucaauggcacacuuggugcacagcuguauucuaguuucguuuacauauuaaaaguaacauaggaggaagagcacgauauacauacacacacaucccuaagauggaaacagagugaggaccauuuacauuuucuucucuguguuuuucaaauuuucuuccacaaauauguauuauauugauuucauggggggggggaggauaaaguaauacaggcucaucaaauaaaauuuggaaaauauuuuuuaaaaaacaaagaaaaaagaucacaaucacguuaacauuuugguuuauuucuuucugaucuuuuuuccuaggcauggggcuuuuacagucauuuauuuaccggucaugaauucauuaaaaaccacagcgauauagcaaugagcaaaacagacccucccccaaaaucacccugcguucauggaucuuccauucuaaugggaggcgggggggugaaccaacaauaauuuuuuaaaaaggcagaaacaagcggaucuggacaauagagggaaauguaacaggacagggcaggagggcggaugagcuggaggcguagucauuccacauagggugcucagggcagccacgcuggaggaggucuaugagugagucccguaagugccuaaggaauggagggucuuaggcagaggcgacagcaagagcgaaggaaucuucuggugucugaagaauagcagggaaccagaggugagucagaccugugugcacggaggguguggggggacagguuguucggagagacuugucugcuauuguaaaaaugggcuuuugagacuguaagacucaucuaaauauaaauguuuuagauuuuuuuuucaauacacaaacagaaggacccugaaaaagaacuucccuccguugugccugaauuuccagcugcccuuucaucccaccugguagagucgcagauucaaaugcaagcacugauuauuccaacauacucucuguaugggaacuaauaccacugucuaacagucacuuagaaguauccuugucauaucaaccgaaaaauccucaacaaaggaaaccugcugcuuacauuaaguuugaacaaaucaugcaagauauaaagauguguuguuucuuccagcuuaguaccacaccuuauaacccuuccuacauuuauuucucugaguggcuaggaaauuaguuuauauucaccagaaucucuagccuagguguucauccagccccuuacuuucuuuagcauuuccuugcugucacugguuuggaauuacuguuacugacuugauucuucuguuucuacuaccauaaucagguuuuugggauauuguuagaagcagacagcguugcuggguuacaaauucuaccuacucccugagugauagucaggguagacugacaauaagaagaugaucgucaggauagacacacacaaaaaagaaaaucucgucuuaaaagccaagccuugauuucaagacuuuauuuuuaaaaagacauuaacuguaauauauaucauaaacaacuuuguaguguuaaaaaauagaauuucuuaaauucuacuccaguaaauuucccaugagaucuuauaauuacaaugggaaacaguucaacaagagugcagagugcagaaugucaggaacauaaccacuguaagacaaaguaccagcauccugaauaaaccuucuacagguuagcaauguuucugccaggacugugguagguuaaaaaguauguagucguauuagggaaaacacagcacugguugucaucaauuucuuuauuuugagauaaaccucuuuuuuuuuuaacacuugguagggaaaaaggaauuguuuuaucccauuuacauggaagcuaaacaaaaaccaaugugcagaugagugugugaggugccaauggauggaagcuucgcuagggaccacgguggccugguggcggccucaacaccaucagguggacuguggggcuggggguagggcacugcucaccuugcuacagagguuccuggguuaauucuuuuuguuuguuuagaguaaagccaagcauuauugcuuuaauuuuauuaaaaagaacucuaauaaucaauugaguuugggaacaaaugaucucauucaaaaaaagaagaagaaaaacacuacagucagauauuaaaagcuauuugaagauuucuuaaauuucaagcuuaccgucaauuuaaaauaacucugaagaaaaacaaaacaaaaaauguaaaauuauauucauuaaugaaaauaaguuauaaaacaugcuauuauguuuuaguauucauuacuaauuaaauuaaccauaucuaaauuaaggccaaaauguaauuauaaaaauggaacuauucuuucuugccacaauuuaaauacuuuuaagauucaagaacauacuuguugcuagaccuucccaaauuagcacuaggauauucugucuucagugucuggcgcacacuacguguguucuggccauuccagggaauucaaugugaaauaaucauucacggcauuucuuuauucuauuuauaauacugcuaauaacaaggaaagcugacagagaaaagaugaacauaaaaccuaaucaaacaguauacuaguauaaaguaugauauuucaaaaugaucugaaauguaucuuauuucugccuacuaauaucaggaaaucuuuaucagacaacccucucacagagcacagagcgcuucaccuaugcugcugcccggaauccgaagaauguggagaaacagagccugccuccaccucuucccagcugugggggaccauaauaauacaacuuccuccuccccaggcuucccagguaugaugaugccagcugacuccugcagucaagggcgaggagcccaaggcaugagcccccuccucccgccccacagcaccagggaaagcaaguaacaaacacagguucauaaacauggccagggauucgucagcccaucaggggaagggaccggggacaagaaagaaucaaagguacagaacuggaaacagagugucagcaaagaaaagaagacacaaaagggaaaaugagaaauaugauuuuuuuuccccaauaaaugagcauuuuaaagagaauaaguaaaaagaaacuuugguuuagucugugguacaauaagauaagaaaaugaauguugaggcuggaauuauggcuuagcaaacacauguaguucacuguggcuuuugaaaaugguauaagauucaagcucccaguuuucaguauuagucaaugcaguaaaagaaaaauaccagcuucuaucugugggcgguggggaggaguggccgguucgguuuuguuuguuccuuuuggagggaggcaacggggggaguacgauggguagguggaauaacagcccccucccaaagcuuagcaacaacagccucccagauucaacacaacacaggggaagaggucguuaccaggccguuggugugguuacacauaucccauaaaggaaucagagccagggucacgcgggaaccauccucugugggaauuugguuuugccucgucauaacagaagagacugcccaccuauaacaagauaaauggugacuuaagguuggaacauuuaaaagccaauugcaguaagaaauaacauaaccaaaaauuuagguuugaucucuuacaaacguacaaagucuuuuccuaaguaacaaagguaauguuuggccuucaucaucauuuaaaaacaaacccaggguuugaaagagccaggggaaaugcaggagugaguguuuaaggcagacuguucccaagaagcagagccagaaggacggcuuugcgcagggcucaggccccuucccggaucuucgugacucacaaaauccacuccccgacaccccccaacccaacccucuuuugcccaaaugcugacucugcaccuauuuuaagccucauugaaaagcaaaccauaaaacuccuuucugaucagaaauccucugugaauuguaagaaauguaaaaugugacuuuuuuauuacacugugcagugaauuaaaucucuccguucaaaaaaaguccccauuuuacacuaacauagucuuuuuuaaauaagaaaagaaaaauccauaggaccacccaacacuaauguuaaucucaaguagcauuuggcuaccucagcuaauccccugccaugacagguuaauggcaauuucuacauggcuaugaaaaugcugauacuuauccaagcugcuccugauaacuucugaaagaugagcucuguuuggaugcuuuaacggucacagcaggucacuucucacugaagcccuucccucccuuccaggaucccacuucacuuagaaaccacccucaauacacagacacacucacagcccacaccaaccuguaguccucguaagugaaagaauccuucaaggguaguuuguuggcaugaggaugggucugg

SEQ ID NO: 12676 - RNA, 12670 nt, Homo sapiens
cggcgaguccucccggguugcccccgcgggcgucagagggagggcgggcgcccgcguggugacggcgacgccugcagcccaaggagcgcuccacucgcugccgccggaggggccggugaccucuuggcuaccccgcgucggaggcuuagauggcucaggcgaagaucaacgcuaaagccaacgaggggcgcuucugccgcuccuccuccauggcugaccgcuccagccgccugcuggagagccuggaccagcuggagcucaggugagcuccgggcgggcggucucgggcguucugcucgccgcgcgggcgguucgcgggcgguuagcggacggaggccgcguguggcgggccggggccuggggcacagugaggcugcggcaaccgaaguugcuuguugagauuuguuguggauggacgugguguaguuuuguuuguuucuuggauuaucuccccuaguccgagagaaaacgcauucgauuuaagcuaaaccugugagggcguuaucgguggccacacuuugauuaauuuaccuagguguuagggagcggaaaaaaaucagaggagauaaaaguuacagugagauuccaugcgauuaaggacuguggcagcuugggucugcagaacuucuagaaccuucuguguggccccaaacguuuuaacuuacucuucucguuaugcauuuuuuaagggaggcagcaguuuacaguggcccuccacgugaaguuaaguuuccuugcuucagaacaaaaaugaauaaaacaaaaccaacccagcaauccauugagagcaaagauuagacaggagugagggguaggcaguaaguuaccgggugcuucgugcagcagagacguugccgcuucuguuucuccccuaaccucgcggacgggauucagcgguuccguucgucucucgguauuuauugggcaccucccuacauagaagacuaagugcuaguuacuggccugaaagcaugaaaagauaguuuuccccuuuucuugcuuaagaauuuauuugguaauacaguaguagacuuguauagaauuucuaaacaauuuaauguuaauagauuuuuggaaagacuuuaacgguguauugaaaaguuuuaucuacuuccugugaacguuugucucaaguuacuguguaaauuuugugagcagguguaguuaaaagaaaaucuuguuaggcaccugcaauuccgugaaacuguacacaggaguugguuacauaguuuugucuagguugugcaugagcaaagaagcaugugagccaaaaaguuuaggaaacacugcaugugugucuuuaucuuccuacauuaauacacccaaacaugaaguaucuguuugcugagaaaauacuucaauaaccacgguaucucuuaacaagugaggcauuauuauuguuacuauugggagaaaagagccagagagugagagauucuccacucaaaauaauuucuuggauuauuaagcccuacaccagguucugggguuccacucagaaugaggcaaguggaagagagaaguaaugcuuccucauggauuuucacaauacuggcaaaccugaccguuccacucccagaaaaaguagagcgaaaguagaaauugguggccucaguuacuugaagucccucuaacugguaauguuucuuuuuagggagccacauaacaaguaacacacaucucuccaugucuucagaacguugagggcauguucucaaccacuucauucuccucucccuuagccagaaagaaaaguuuuccuaaaggaauggggagguuguuacuccacuccgccuuccuucaagcugagucauuguccuccaacuugaauuaaugccucacaugugguagguacaaaagcacucugaagugcuccucuuuaaaagaaagccucagguuuugaauauuauuauauucuacuguuugauuaauguaaaaugaauucugauugcacaucagugauuaaauuacaacuugcuuaauuaacauuugagcugaggagaaaagugauuaauauguggcuguucauuucaaggacuuuuuuuuaguaauucuggacuuuuguaggccuuuuuucuucuuuuuaaaaaaguaauacuagcugaaaaggaaggauuuccgaagguaagcaaaaauagagaaaaaugcuaauguagauccuauuaaaguuuuuuuugaaaccacaugggcaauggcacugaacacuauuaaaaacuagaaucaugcguagaagaucgauuuuuaaaagaaaacaugaaacucauauguaauuuugcucuaauaguuugauuuuguugacuaauaaaguaguguaacuguguagaauaaaaccuuauaguuuguacuuagaagugugcacuuaauguucccuaaccacacugauccugucaauuguggaagaaauuucauacuuuaugaccuggaguaugaacugaucuacaugauguuuaaaauguuuggcagcaguuuuacaaacuguuaaaggauuuccauuuaucucuaauggaauuuaucaauacaguagcccuuuuuuuuggacugcauuuugucuucuguauuucuuccuucuacagaggugauucccuuuucuccguuuugacgaucaguucuaaauggacucugaguuuugcauucuucaguggcucaaaccaucuugcuuacuauuguuacuuuuuaacaauuauuguaauuuguaaaaaauacuaugauauuacgauucucucucucuguauauauacaacguuuuccuggcucauaacucccauaacccuuguuacagucuuauguuauaguuccuggcucauaacucccauaacccuuauuacagucuuacguuauaauguuggggugcuuuaggccucaggaaaaagaaucucucucucugaccuucuuucaccugccuuaccucuagucugauugugggucaaaagacucucguuccagagaggguccugcccuaugcccuggaggagggcauuuagcacccagaggccaagaagaaucugaauagacuggccuugcuggguuuccccauucagucuguuagagugagggcauacucuuuuuguccaaucacuuuucuacaugguugucauucaugcuuauauaaaagaagcaagccuccauaagaacccaaaaaggacaggguuuggagagcuucuggauagcuggacauguggaggcuccuggaagguggugugccccuucccccuguaccucacccuacacaucucuuuauccauguccuuuguaauacccuuuauaauaaauccguaaauauaaguaaguguuucccugaauuuugugagcugcugcagcaaguuaaacccaaagagggggacaugggaaccccaauuugaagccaguuggucagaaguucuggaggccuagacuugcaacgguggaggguggggucuuggggacugagcuuucaacuugugggaucugauaccgucuccagguguagggaguguuggaacugaguugggggauacuuagcugcaaaucccccacauauuuggucacagccuucuguguuguuacagugugagagcagaggaaaaacacagugugagaguuuuuucuaaaacacaggcuaauguuuauucauuuaauguacacggacuaugugccaggccccaugucguuguuacuauuaucaccauucuacagauagggaaauugaggcuuagaagcuuaaaugacuuguccaaagucacacaacuagagaguaguaaacuccaaauuugaacccaggaagacuggcucuccaggcucuaauacuuuaugccugaauuuucuuaaauauaucacauuucaaaauauagaaaugauauauggaugaauagaugagcuuccucuaagagauaaaaauucaaucuaaauuggccuuuaauucaguggauauugaacacccacuauguguuagguauuggguagcuccuagaaagcucaagaugguaaugaagauguuugggggauggguuuuggagacuggcagaggggaaaaugauaggacugggagauuggcuuuucauauguuucccaaaacuuauaacacaguggcuccuucugccuuccugucagccuuucacuguggcuuaaccugcacccagguagugaagggaugggguugggggugauagggaucauucgucuggcuuaaaguuucauguuagggugugccaguguucuaggagucacaaaacaagauggcaucauaguuaauacugugugacagccuguaauuuaaaagaacacuucauauauguuauuugaaacuuuaagaacccuucgaguuagguggagggcacauacucucucuccuagaaaugagggaagugagguccaauuaggaugaaguggcuugccugaggacaugcuacugaaaaguggcucuucacacuaaaaacacuagucccuucuuuuacaccaaaaugucuugacaguaaauguaauuuaacauuuuggugauuaggaaaacacuucagaauuuuacauugccuaaaagugaucauuauagcauucuuuugauauaggaguauggaauaagagacagaacuaugaguuuuaagaaccuguuuuaggccaggcgugguggcucacuccuguaaucccagcacuuugggaggcugaggugggcagaucaccugaggucaggaguuugagaccagccuguccaacauggugaaaaccaucucuaauaaaaaauucaaaaguuagccagacgugguggcgcaugucuguaguccuagccacucgggaggcugaggcaggagaaucacuugaacccuggagguggagguugcagugagcugagaucacaccacugcacuccggccuggacgacagagugagacuccaucucaaaaaaaacaaaccuguuuuagaaauuauuucuuucaaaucaugguaugagcauuugccauuuucccuccuuuuuaugaaagcacaaauuuucaucauuaauaaauaagcccacauucauaaugguaagaauauaauagcuauuaauacuauaaauauaugccagugccaauucuagacacauuauacauauuaacuuguguguguguguaauuuuuuuagucagugcuaucagucacuguuaaacucuaccugcuuuacuucauuuagucacaagcacuguucccuuaucaucccuguuucauaggcgacugacccauuugcacagcuaguaguggcagugcuggcgcaguuuucacugcauacucuauuagcugacauauuaauaguagccacaguuugcgcaaaauugcuguuguacuccuccuaagucucccagcaguuugccguuucgauacugagacugcagagguuugugaggugcccaagaccuggguacuagcugaggaugcaugcgcuccgguuuugucuuccuacugaguacucugacuaaaauuucuuuuugucaaagccuacuuaguugugauuucaugcagggaguuuuccaggagcacagcccaggccagccuugaugugaggaaaaguucuuucccaauuuggacguguagcugcuuccgggaucuguuaguaaaaacagaacugcccuucuccgccagaaguguugccagaugagauauuaagaaacaugaaggauaaagugagaugguccaacauuucucuaaccagaguuccagacgaaaauaacagaaggggagacagggaauauucaaagauacaacagccaagaauuuucuagaacuaauggaaaaauuguagacaaaagacguguauaugaguuuaaggauagcaauagcugacaaacaguacaaacguuacuuaaacuaaguagagaucuagguucagcuuuuuaaaagaaaaaauguaaaauaugagguagacauauuuuagacuguagaguaaauggauguaccagggccaaaaggagcaugaauugccuuaagggagaggaagggggaagcuaaggaaacaauuccugcugaagcaauuggguuuugaaaaaggugaucccaguagacaagggucagggagaaagaaugcuaccugaagagggaauaggacaugaaaagcccauguugccaaauaaacccugagaucuuuacauuuugaagaaugacauuuuacccuugcaugaaaugaaaaagguauacauaaaaauguauauaagaaguucuauaaaugaugaaaucugguuuucacagggauaaugcccugguaauuucuauuauguauuaaaaaaagccuugugggaugggggugggggagggucccuaaaacacaaacuuuagcaguuccaccuaacuauuuggucucauuuaaugauaaaauauuuucgucauaugacaggcuuauuauauuuuuucuagaaugucuuuuuuaucuauuuuguuaagaacaugaacuuacugcuguaacucauaaaugaaaccuuccuuuucagaauagcauuguucucucuuaucaucuuacaauugaauacaaaccgaaaagguguugaaaaauuaaucucuucuuucagcaucuucucauuuaucaaucacaugauucaccugugucauuugucuaaauauuggagucaugguuugugcuuuuagcauaaauauuuagugccaacuccgucucuuuccuauguucugggcccuaguuuaucuuucugagagauugcuaauguaaaauguuuaaguaaauacugaaugguccuggaauagggccugauacuugcauuacuauuaguuaguagaauauuuguauuuugauuguguucucuagccaaauuugucacaugcgauucuucccaguucuuugcuuuuacuggcucuuauaaacacacuuugacauauauuuaauaucuugaagaauaaagauauccugugauuuuacagccugucaguacuauuuugggguauaacagguggguaaccgaaggggaaaaggcaugugugugcuuagggcagggagaggauccuuuuauggaauugaacgugcuaaaacauuggugaaguuguucuuucugugcacacuuaagacagcaguuaggauuagaucuuucaugaacuuguauuucuaagaccauccaaauacugggaauaggucugucacuuucauuuugcaaaaguuggcaucuuaguuacuguaauucauaauaacaacguucccuggaaguauagaacauguuaaauauacaauauauauuucuuuauuuugcccuuauuccacagcuuaguuuuuuagugacuggguauauucauguguguguauagugugagugcaugugugugcaauugagugaagugggaaaguagugcuucuauaguuugaucagggcuuuacacaaaaaagccacagagauuuucccuuaaauuugggaaaagacaaagauacccccaugauugccacuguuuaauacaguacugaaggaccuuuucuuaaaaaaaaaaaaguaauaggauugggaaggaagaaauaaaaacugcagaugauauggauaugauuauuaaccuagaagaaccaacagaaucaacagacugaacacuaaaaugaauacauguaaaucaagguugccagugacaagauaaaccuacaaaaacagcacuucucaaaccaguaaaaaucaaguagaaaauacaaauucacaauagcagcaauauccacgaagacuacuaugaagaauacaugggaacucuauagaucugaauaaaugaagagacauauaucaugccuuuaaacagagagauguuauaaagaugucuaauuucucuuguuuuuugagaaacacaauaaacuuacccuagaauuuauauggaaaaguuggagaaguaaaaguccauaaauagcuaaguuaucuuuaaagaagauugagggaccugcucuaucaaauauuaaaguguaguacaaggcuagugcuauuaaaaaaaaaaacccaaaacuuggcacugguauaagaacaguuaaauacacuaaugcauggcauagagauuuuagagauaaauagcgaauauacauucgcuaggggaaagauggauugcuugguaaauaauguuggggaaaauggcuauuuggaagaaaaaaacaaaacauucuuaccuaacugcaugcagggguugaugcuagguggauuaaagacauaaauauaaggaagguagaacuauaaaguuaauaagagaaaauauaggaaaauaggaccaaagggugggggaagaccuuaggucaaaacuucaaaagcauacgccauaaggcaaaaaaaaaaaaaaaauugaucgcaucaaaauaagagucucucuuuagugcaagacaucccagacgugguucauauaugagaggaugagagaugguugcaaugucuguaaccaacaagaaucucuugaguauacaaaucaacaagggaacaguaacuccuguuuaaaaauagaaaagcaaaauaggaaaagucuaugaauaggcuaacaaggauacaaagagaugucugaaauuauuaggaaaacacaaguuaacacugacauaucaguguauuucugucacacuggcagcaaauagaaaguuggaaaaugcagaauguugguagggauauggggaccccugugcuuugcuguggagaguggauagguacagguguucugcagaauagucauaauacuaagucaaaagcagaguacacauacccuuugucuuagcaguucuguccugguauauguccuaaggaaauccucaccaagguccaaaggggagauguauucauagaaguguuauuuguaguaaugagaagcugguagacaaccuaaguguccaucucugggagaguggagagggaaaaucagguagguauacacauggaguauuauacagcaauuagcagcaacugauuagaaguacacauagggggcugggugugguggcucacaccuguaaucccagcacuuugggaggcugcggugggcagaucacuugaggccagcaguuugagaccagccuggccaacauggugaaaccccaggaguuugagaccagccuggccaacauggugaaaccccgucucuacuaaaacuacagaaauuagccgggccuggaggcugaggcacgagaaucacuugaaagcgggagguggaggcugcggugagauugugccacugugcuccaaccugggugacaaagcaagacugucucaaaaacaaaaaacaaacaaaaaucuagcaaccuggaugcuaagugaaaaaauaaaaacagaaugagauauaaauucaaaauauacaaauaauacagaucuuguaaaaaacaaauaguauuaauuagauaaacacgaaagaaugauugccuuaugagcugggaggaaaaugggagaaaggcaaguguauagaaaaaugaaagaauuuuaaagcagaaaugaagaauuuuugaaaaguuuggugaucuuuaaacuugauuuggguugaaugagagauaaagaaaauuaauaggaagaacauccugcauacaauaaccguuuuguuuucccaauuucuauaggguugaagcuuugagagaagcagcaacugcuguugagcaagagaaagaaauccuucuggaaaugauccacaguauccaaaauagccaggacaugaggcagaucagugacggugagagccaucuccacagaaggggcucaucuuuuacacuccuuuaaagaguuuaugauaagugugggucaauuuuugcuugacuuuugguaugcguacaccaggccacagcauuuaaugugagccacagagagcagcugcagcugucaguucauuacagcagccacuuacucagagauuucuuccagcaugcucucuaccccaagccccuggcuaggagagauaggaaaaagccugcaagcucagaaaagcuggccccaagcaguaaggccauguguuuuaucccagguucacaguccuaacuucaguuccucacaaguuacuggacugcaagagauuaaaaaagcagaggaagagggugagagaguggaagcagagaaguagagaccaaaaaaaaaaaaaaaaaaaagaugaauugagguacaacauaaagagaagggacaaaaugcagagaaaaugaggaaacuuguaggaccaauaaaaggcaugaauguaaaaaugugcugucauuuucuuuuuucuuuuuuugagauggaguuuuacucgucacccaggcuggagugcaauggcgcgaucuuggcucacugcaaccucugccuccuggguugaagcgauucuccugccucagccucccgaguagcugggauuacaggcacgugccaccacgccuggcuaauuuuuauauuuuuaguaaagacaggguuucaccauguuggccaagcuggucucaaacuccugaccucaggugauccgccugccucagccucccaaagugcugggauuacaggcaugugacaucugccuaaccugugcugucauuuucaugugaagaacaugaaauaggaauaggucacuucugauuuucuuuuauuggcacuggacuuccuacuugggcuccuuuggugccacacaggccacaugguacugggccaaguggcuggugagguaaguaagcaaccuaaauccagaucaaaacuguuacacaucuauagguaggccaugaucuagucucuacgcuauccugcccaaagaucaaugaauuaggaaguuacagaagcaggagcuugcugacuuucucauauaaauaaugaaauguugauagagcuccucgugcuggccaagacuuuagaccacuguccugcuucuaucuggagaaggaugaagucagugccuaguauugacgacagaagacagcuuaucuucuaucguggcuacauuuucucaaccaaaauuuggggcauuguauucugauaaaugcacaugucguucuggagagaucugggacaucugaucucuggagcucuacccagcauaaacccuauaugugcuuacugcucacaguguuaagacuugaucuccaucccaguuacaaaugcauaccuacccaaacuuuugcagacaugccaauuugagaagucaucugguaucccauauaugcagauugucaggaagugguauucuacaaccucuuucuguaaucuaauacauuucaucaguuaaucuuacaugcuauaguuucagcuuuuaucucuaaaaaaauuucauggcagagguaaagaaaauaauaaauuuagucacaaacaaaugccuuaauguuuuugacacagauaaguuuacaucucauauugauuuuuaggagaaagagaagaauuaaaucugacugcaaaccguuugaugggaagaacucucaccguugaagugucaguagaaacaauuagaaacccccagcagcaagaaucccuaaagcaugccacaaggauuauugaugagguggucaauaaguuucuggaugauuugggaaaugccaagagucauuuaaugucgcucuacagugcauguucaucugaggugccacaugggccaguugaucagaaguuucaauccauaguaauuggcugugcucuugaagaucagaagaaaauuaagagaagauuagagacucugcuuagaaauauugaaaacucugacaaggccaucaagcuauuagagcauucuaaaggagcugguuccaaaacucugcaacaaaaugcugaaagcagauucaauuagucuucaaaccuaagagcauuuacacaauacacaagguguaaaaaugauaaaauacuauuuuaauugauaacuaguucuuuguuagguauaaccacuuaguugacacugauaguuguuucagaugaggaaaauauuccaucaaguaucuucaguuuugugaauaacaaaacuagcaauauuuuaauuaucuaucuagagauuuuuuagauugaauucuugucuuguacuaggaucuagcauauuucacuauucuguggaugaauacauaguuuguggggaaaacaaacguucagcuaggggcaaaaagcaugacugcuuuuuccugucuggcauggaaucacgcagucaccuugggcauuuaguuuacuagaaauucuuuaccuuaagcagcacacacauuuacuacacacacaguguuaacaaagcacugugcuuagaggguaaaaaggaaucacaaaacaagaaucuuuccaaaguugucucauucagcaauguuaaggcaucuguaucaaauuauuuuggauguaaagauuccugugucucauaauaugaauguauuuuuugauauacaagaaacugacauaaaaugugagaaaaccaccuauaauuuaccacugugaacaauuauauaucuaucugcuucaucuuuucucaaaugcaucaauucucuaaaauuccuauauuguaacuugccuuuuuuuaaaaaaguuagaugcugauauaaagucugcuuaauugucaacuuaaugagcucuauuuuguguaguuauaucuuuauccauuccucuuuuauggacauuuagguuguuuccaacuuguugcuauuacugcaacauauuuuuguacacaggacuuuuuccuucuuucauuuuuguuuuucucuguauaaaggcccagcagugaauuauauugggucaaaggauauagacguuuucauggccucacacauauuaaacuuuuuuuguauaaagguuacagcaauuuauacuuuuuucaguaauuaaaauauagcuauuucacugaaauau

SEQ ID NO: 12677 - RNA, 343 nt, Homo sapiens
cuauaggguugaagcuuugagagaagcagcaacugcuguugagcaagagaaagaaauccuucuggaaaugauccacaguauccaaaauagccaggacaugaggcagaucagugacggugagagccaucuccacagaaggggcucaucuuuuacacuccuuuaaagaguuuaugauaagugugggucaauuuuugcuugacuuuugguaugcguacaccaggccacagcauuuaaugugagccacagagagcagcugcagcugucaguucauuacagcagccacuuacucagagauuucuuccagcaugcucucuaccccaagccccuggcuaggagagauagg

SEQ ID NO: 12678 - RNA, 17498 nt, Homo sapiens
gguggucguggugacaggacuggccgcuauggagccacugaccgcucgcaggaugaugguggggagaaccgcagccgagaccacgacuaccgggacauggacuaccguucauauccucgcgaguauggcagccaggagggcaagcaugacuaugacgacucaucugaggagcagagugcggaggugaggagggggcgcgcugcgccaggccuggcugggaugggcucccaagggcccucugugucuggcugcagcaccgugugcaggcagcucuccacucccgugccuucagacugugcucgguggcuuugccucaccuggagggccuguucccacuccccucucugagggcuccucucccaaccugggucucccuggcuuccacaugcuuggcucuguacuucugagggccccuggccaccacucuuucccuuucucccuguuguucaguucgggcccauggcucacugugaacccuguacugcccgcucccagccaacuugggcacuugaagagccucuuccaugggacccggcgucugggguugggaggacaacaaggggacugcagaccaccaagcugaggagcucugggaggccagccaugggcauucccaguggugauagagccccuagacagaagggaaggacccuucuggagaagccagugccauguuggguaguucacccuagccugcgggaugaggcgcgauguuuacaccaucagggagcccccacccgaggggaagaaacaggcuugccuuaggggaaucccaguuggaggggcagucagggaccugguccaugcgagcaggcagcucuccuguccagcaggcugggaagggaguucuugcaagcccagcccuggggggcagucugugagcugcccacugcccucuggaggguccagggcaaaaaccccuuugguggacugccaggcuucuccaguggcagcugucaagcugugcccagacgucuccaggagcacugggcccuggccagggugggaauggagcaccaaguuaucuggugcuuccccacugugggcgggagggcuuuggccccaggccugcucugcuuaguccuggaauggauggauugggcaacagcccagagcccaacagccauaccguuuugagcguggugugugguggaggacuggccaaggcugaggaucagggacugaggagggagugucugcagcccucacaccaccuccaccagcuccugcugccuggcucuggcugagaucugaagcuguucuuaugcccccagcuugguugcaggguggaaccguaggagacaugcagccuucggugguacagugaagcaauugagcacacccccugagcuggccagagaggagaggaaaaucaaggguggggucuggugugcugaccccaggccaucuugccccaaggagguuuaagcugugucuugucagcuaccuuugggaguuccccccacaccaauacugucaccuaccucuccccacccacugaaggcagcccccaaaaggaccccauggagaauuuacagucccagaaagauugcaggccggggccugcccacccugccugccugagccuuuagccggagcccgcacaucccuggcuuucagagccugccugccucacagagccagcggccagcuccuaggccugcccagacugacugcccgucuggugucacucaucucauucugucggccaggauuccuacgaggccuccccgggcuccgagacucagcguaggcggcggcggcggcacaggcacagccccaccggcccgccaggcuucccccgagacggcgacuaucgggaccaggacuaucggaccgagcaaggggaggaggaggaggaggaggaggaugaggaggaggaggagaaggccaguaacaucgucaugcugaggaugcugccacaggcagccacugaggaugacguacgugccccccauggccccgggcaggaggccaggcugggucuccuccagggcccucaacuucuccccaccccucccucaccugcaaccucagcgccuuucaucccuucucccccuccagcuccuaucccccagcacugauccguccucugugggcaggucccaucggccccccggucuggagggaggagugucagagaggccggcuuggccaagggacauuggccaugggugucugguagugguggguaugggcgggagaagagcaguccugcacauuccacuggucauccagccauuuugcaugugugcaucaugggccagacgcucaccgggccagugcuggcuauugcugguagcagagaugacacuggggcccuguaaccauugggggagggaugggauuuucugaaauuuccuucucuuuuucccccauccuuuuuugucagcagccuggccuggccucagagccuuggguggcugcuaacagccuccacgccugccucccuuuccuccuguuuccuuuucauacauacuucucaugacagccacacugaagccccacgaggccuaccagaauaaccuccaagaauaguguccugaucuugguccuucuuagucuacuccgccgccccucacccccuacccccaugaauucucugaucagcccuccucugaaaucugcuagcugcucauuuuguaacagagaaaaucccacuuguguauuugaggguuucuaaggucuggcccaccugcccuguucagggucagacaguagcugguugcugacauuuguugagaauguaucucagggugggccauguguuagguaugauucaguccccauggcagcccagcagggaagguacucuuuguauuccauccuucggaugaggaaaccaagcccugagugggaaugugacuugccccaggucucauagccagugaguggcagagcagagcuggagucugaacccgggcagcuggacccuagagcccacuuuuugcugcuuccucagccuucccugaguuuggaguccugauaagcucuucuguguguuuuuccuuuucacccuguguauggguguguguaaggcuaauguccugucuguuguuuaaccugguggggaaacugaggcccagagacaugaagacuccuucccaagaauggcuggcauaggcuccugguccucagugagagaccucacuggccuagagacccugccucaccugggccaaauccugaauugccucugcaguuucccucuggccuacuccaucugggaagcaauccccaggacuacaucuuuuugcuuuuugucuccacccuaaguuauugcuacagucauggucuagggcacauggcugggauuugcucagacuccuguccuccccaguuugacauuuaugucauggaucucuuuugacgcaagcugcaggucagcagggcaggggcgggggugcggguuauccccuugccaagggcaagaauugcaucccagguuuccuuacuucguggcugccagcgagcccuuugucagaucacccugcccaccguucuuaaguggcuggcucacuugcucucuuguucucugugccccugagggucguccugcugccaugcuuuaccuugcucugugcccauuucuucauuugauucacuuucugcaagucuggggcugaaagucaagacugugaacuggugugggccuggggcuguugucacucagggaaaagcugcgaaagaggcggaggagacugugugcacaucaccgaugaccccucgggauccagaggccuccagccagccucagguacccagcggccccauugugcugagccugcccuacucuguaucuccccguauagauccguggccagcugcagucgcacggcgugcaagcacgggagguucggcugaugcggaacaaaucuucaggugagcuuuuguucuagugcccuccccuucaaguggccagccucagccuccgaaucucccuccugccucugccuucucccccacucccuccaccaccuuccugccacagcugggaaugggcagcguggggggugcccucucuucucucccacuccccacacucuccucacagcuccagccaaaagccucuucaauggggcugucggggcaggggugcagcucugagcugagcugggugcucccuggggucagggccagggccaggcucccaggcaccuccucucugggacucugaguaucugagaugguaacccccucccauacacucccuucccucuccuuucuucuccuuccucugccccucacuuucccccacauuuuuugguaacagccucugaccagaaaguagcucugacgugguggucccacaugugugucccaagggggaagcaggggauggcucuuauccaaggacacaucccaaggaacagccaggacuuccuggccucgccuguucccucccucccucccucuugcaggcugcuuggagcuggccugagguuagcaggguggugguggggggaguugucucuacaggaccucugcccaggcuccccaaggcaggcacaguggggccucacucugccugggcuucucucuccaucucucagucucuccuccccacaccuccaucucucucucucucucucucucucucucucucucucucucucucuuucucccucucucucuuucucucucucugccccccccaacuauauuauucauuccauccuccuaugcauccuaacgguuauucuuuugaacauuaagcaugcccccccaagccccucucauccaagcccuccccauguaucugccucuaaaggacaugcuauccugaggccucaacccugaaucccuuucccaagccuggaaucuugguugcauguaggucuugcucugcaucaccccaacuacaccacacacggacagcuucugggucucucucuccacaaggagguguuccaggugcggccuucucaauggcccugggcgcuucucccaggcacccauugauucuuaccucuaagguccuccuggccaauccuggccaccauucuccuuuuguccaggggaaccuggacuguuuguggcuguagucuccacccuguggcccugagguggcucccuagcgaggcccgccuccccugcgcugcggugaggcugagaugaggucgugucuuuaaccgccccugguuuccaaugggccaagagccuuccuagccucgcagagcagccuggcccagcuucucuuuugcuccugugauucaacaccuguuacaggaccccuccugggcaccccuggccuugagcugggcccgcccuggaguuacguauuguggcuuguguggagccagcagccugcccaccauccccucccuccuucuuuggaggcagaucucucguauucuuucccucccagcugcuucucuccgucucugucaccccaggcuggcugggcaggucugcccgagccccaucucucucuucccaguuggugugugugucucucccccuaccgaccucuggccucuguuuuucucccuccaccuucccugccccaccuggccaucuaccuugccccccacgcccgcuagucuuucucucucugauugccucuuucucuuucuuccuuuuuccucuuccccuuucccucucugccccccguccucuccccucgggucccgcccccgggaacgccguguguccaaagcuguugacuaacccacugcgucuguaucugaaugcugucuccaggucagagccggggcuucgccuucgucgaguuuagucacuugcaggacgcuacacgauggauggaagccaaucagguugcuuugccgcacuugaacccccccccaaacaaauacuacuuuguaaucgagcgcuccccaucgccugauucuuauggacacaguucccugcccuguggcccugugucccauccccccgcccccucucuccccuuccugacccucacuaucuccucuucccaucucucgcuaccccacugggcuucucauccagagcccacacucaccacuggccccuuccuaccaccaggcacuagugcugccccuucaccucucccagcugagcguucagagaaagagcugccaggguggguucuuucaccuagcuucccacucccccggggcugguggggggggcaccccucucugggguuagccagagccaggaccucauuccacccucaggaccacuggaaguccugccagugaggagcuuagcuauuggcacagucacuagcaagacucauuuugucagccccaucccugcaugugaauuuggcccuuugauuuucaugcaaggggacagcacugcucuguugaucucaaguucccgucgaguaugauaguuuuaucgacacccuggccucacuucgccgccccuacccuuccuaucacaucuccacacucgcaggaggcaccaccucaggcagcucugucuucucggcaaggaccugugcacagucagcccuggggggagccugucccccaagccuggcacgggaucccaacucagcagcuuugggaccuccgagacccaaagaucugccuggucacccaccccugcccagaucccugguguagggcacuggagagcaguuucaggggaggaaggggcagaggugguagaaugggggaucccggcagaggcagcccuggggccgucuccucgggguugguaggcuagugccaugggcccaggacccagccauccaugggaagacggccucauggcagaaacuuccaucuguucgaaauggcucuuucuuuuuccccuucuccagcacuagcgcaccugcgcucucuuucucuuuuucuccccucucccucccccucccugucuccccucaccccccaaguguagccuguguaguccuggcccuggguguggccuggcagugucagggccgaguggggguuucuccccacuguccggcaagcgucggucagccgaacacugugugccuggugguguguguucacaugugugcgugcgugugcccggcagagcagcaaacagcugcgcccgagagcuguggcgcuuucccucccuaccucccuucuucccuccauccgcucuccgaccucccuccguucccugucccucauccauccagcugaagggcucgcucacucucuucuccuaugcugaaacggugcguggggcacugcugccuggaccucacugugcucugcuuuuucccgcagcacucccucaacauccugggccagaaggugucgaugcacuacagugaccccaagcccaagaucaaugaggacuggcugugcaauaagguacaggggcggugggcagcaguugucauggacagagacagcaacagcaguggcggcgaucucucccuuccucucccgcucuuucucccuccaucucucccccucccccaaucucuccucucccucugucucucucucucucucucucucucucucucauucucuaucccuugcuagcucagcuugaguagucaccauuccuagccagccauauacaaauguguagugagcguucacuuggugcaggcucuguccuccuaaaaugcagucuugccuggaguuccaguagacuuuaaggaaauauauacguggaugaugaauuagugacaguguagacuugaaguggugguguggagaaugugggcuucagagccagacuggcugaaaugagacuaucccagaucggccuugauuuuggccaaggugcuuagccucucuuugccucacuuuccccaucucuaaaaugugaauauuaaugacaccucucccaaaaggugguugggaggauucagcuguguuaaugagagaguaacacucagaacagugccuggcccacauuuaacacagucgaauuguuaacuguaaucaugaaagaaaagcacagagcguucugagagcccauagcagguagcucaagccugaaggccacucugaccaggccaagucaaaccugaaacuggaggcugugguuuuguagucaccucugucuucccugaggggaagcugaggcucagagagguggaaccaugggugaaccuuuagcugugcccugugccuugcuccugaucacagggacuuggaugccacaguggcuucaggucugcccuggggccagcauugugauuccacaguuuguagaggccccaacccucuccccaggaaguacucugccuagucagggagaguggugcaucuguuuuaaaaaaaaaagucccaucagaggauuggugcuuaacauuucuggagagauaaagacaaagugacaguggaacuccuuccuguguuuccagauagccucaaaaccagggaauucucuuuuuuuuuuuuuugagacaggaucuggcucugucgcccaggcuggagugcagcaaucugggcucacugcaaccucugucuccagcgcucaagccaucagccuccagaguagcugggaccacaggcgcaugccaccacacccacuaauuuuugccuuuuuauuuuuauuuuuuuugguagagacaggguuucgucauguuugccaggcuggucuugaacuccugagcucaagcaguccucacgccucagccucccaaagugcugggauuacaggcgugagccaccacgcccagcccaaaaccagggaauucucuugaacuccuuccccuccccugcauccuguuggccaccagguccugucacuuccaucacagaaacgccaccuucccucccucgccauucccgcugcucaugccaaucgucacgcucucacccacucacuguggagcccucucugguaugcuggccucuuguccucuuucucccacgcccucaccuggaacauuccucaaaaccaccucugacuacccacgccucuccuccucugcuuaaccagccccagcucagcuuaagcauaagauccuccauuaccuaacuggcuuccuuccccggccuuggcuuuugcuucuccccuuacucucccacaccaguuucggaaaguccauuguucccuccgauaacaaucccuccccagcaaggcuuaacaaaaugaaacuucugggcaucccaggucaaaccucccugcuucugugcagggacugucccugccgaguaaauggcaccccacccccagcccauuucccuccccgagccccugcuggaugguccaugcagaccgaccugccccucuucaugcugcaucugccccugugcuauuaggccaugagggcagagaccauguucuggccaugugcagcagggccuggcccaggaguggugcuuaguaccugagucuggaacagagauggagugugguagaagcugggucuccagaugcuggaacauucaaggaaaauuucucaagcguagcaggauccaacccaguccuagagcuaagaggaggggugcgggucuggcuacugacuucuagggcugaaacacugaaagguuucugaauagaggagcaaguuucagggagaggaaccuaauaaagggauugaauaccugaggcggggaacaguccugggaguugguggccuuaagaaggcagaggaaggagaggagggaguuguuguaccaaaugggggaguuguuuauuccugagcugaguggguuggcacagaggacaaaugagagucuggaaagggaagaugcacaguacugagaacaacaucagaagguucagaaggcaccugccaccauugccuaggggcuuuccuuccuggggcacugcggggucccugggagaucucuucauccaaguuuggagggugcagugggaaaucccugcucccucugacggccuggccugugccucacaguguggcguccagaacuucaaacgccgagagaagugcuucaaauguggcgugcccaagucaggugaggcccaccuaccucucgugcucuccagggcggagcgguuggggagaagggaagggugaggggucugugcucagggcuugguauagggaggagggugaccagucguggagccuuccccuuaucaccagccugucucccacugccccugacagaggcagagcagaagcugccccucggcacgaggcuggaucagcagacacugccacuggguggccgggagcugagccagggccugcuuccccugccgcagcccuaccaggcccagggaguccuggccucccaagcccugucacagggcucggagccaagcucagagaacgccaaugacagugagucaguuguuccuucuuccucugugcccuagggugucgggcugggcucaccaagaccagagaaauggcagugagcaggaccucauccucauggaaucuccacuuggugcggggauagacauuugauguagggagaacagggggaguggcaacaucccaccugacuuugggggugugucgggaagguucucagcagacaggcagccaggcuggcaccuggaccgccaagcagaguugauccuggaggaagcagugagggaagcggcaguugcaaaggcacggagugagugggggcagaggaaagggagcagugggggcauugaagggcagggcuggcaagagugccagggguguccucuaacauugggccccuucccacagccaucauuuugcgcaaccugaacccacacagcaccauggauuccauccugggggcccuggcacccuacgcggugcuguccuccuccaacgugcgcgucauaaaggacaagcagacccaacugaaccgcggcuuugccuucauccagcucuccaccaucguggugagggcggcacaguugggggccgggcagccagggucccggcccccgggguggagacgaggguccuuuuccccagccucccaccgcggcugccagccuggaaaucgggcaauggagccgggggccuccccgggccugacccuucugucccugccuccccuccucccacaggaggcagcccagcugcugcagauccugcaggcccugcacccaccacucacuaucgacggcaagaccaucaauguugaguuugccaaggguucuaagaggucagggccccaccugugugccuucccacccuuccccuccccacccucccacuccccccuaccgcuuggggccuccuaucucacucccagucucuaacauccuccucagggacauggccuccaaugaaggcagucgcaucagugcugccucuguggccagcacugccauugcugcggcccagugggccaucucacagguacucagaccccuugugccucccagcguccugagaccugggcuuucucaacccuccugcacccucucugaagcaggaaggcuggcuugcuauccauggaugcaaaacccucucccaguagcuggcauggcuauucuaccuugcuccuggcucucuagacccccugggacauuccccuucaucaucaccgcagcuuucuucccaauugccucccaugcgcucauguacgacgccauugugccuggcauucugugcuguuuggugggguuuuuauuguccugaauagguaugauauacacauauccuuauauguaauauauacauauaugauauacacguaucauauguuccugaauaaaaauaacguauaagugguugagagaaaauugggagaagagaauaaagaaguaagaagauggugucuuccuuggccugacacccaacacacacgccacacacagcagaaucagcagaaucagcccuggaacauuuuggcguucaucuguuuuucugucuuguguuugccacuggccuauuuguucucuuguggccaggcaacccucgcuuuccacuugucuuaaggcugcaugcuuugucugucagguagaaauacuagccccacgugugggacagaugcuucuagcagguuccccaccccccacccccacaccuuccuguucuaaugaaccccucccaccugcccuucaggccucccaagguggggaggguaccugggccaccuccgaggagccgccggucgacuacagcuacuaccaacaggaugagggcuauggcaacagccagggcacagagucuucccucuaugcccauggcuaccucaagggcaccaagggcccuggcaucacuggaaccaaaggggaucccacuggagcaggugagccccagcaucucucucugcagcuguggugggggccagcaggcauaaaguccccggccccauuauucacaggcauugucccugcccugucccuccuuacaggucccgaggccucccuagagccuggggccgacucugugucgaugcaggcuuucucucgcgcccagccuggugcugcuccuggcaucuaccaacaaucagccgaggcgagcaguagccagggcacugcugccaacagccaggugagugagcccuguggguauguaucccggggaggcaggcaggcggcagggguggcaugggcagacacugagcccuguucuccugucuggccccaugaccagucguauaccaucaugucacccgcugugcucaaaucugagcuccagagcccuacccauccuaguucugcucucccaccggcuaccagccccacugcccaggaauccuacagccaguaccgugaguagccacagccuguggguagggguggggaguucuuaauaaagcagggaauagugugaccccguuccccucacccccuagcuguucccgacgucucuaccuaccaguacgaugagaccuccggcuacuacuaugacccccagaccggccucuacuaugaccccaacucccagguaauagggcagcccagggagggaugggaucgggucaggucgcgucaggaacagcuagcccugcagguucccuucacaaggucuucccucacauccccucuucccuccuccucccucaguauuacuacaaugcucagagccagcaguaccuguacugggauggggagaggcggaccuauguucccgcccuggagcagucggccgacggacauaaggagacaggggcacccucgaaggagggcaaagagaagaaggagaagcacaagaccaagacagcucaacaggugaacaccaggguccagcagucacuggcuggcuguguggugucuuccagcaacggcacucugucagcucuugcccucuccugccaagggagauggcgggcagguguggaugugggcagugacugcuuagcagaccaugcucuugccccagcucugcucuuugcugaauggccuugagccagagcagucuccucaguguguggcaggguugcccaacuccaggagguggcuugugccauccgagugagcccugucaggugucuucugucccaugguggggacccucacauucugcuggugaauauacauguaugccagagaaauucucacaggccauaagggggugggcaggaaaaaagcccugcaauguuuugugggagugggcagauggagggcaccucagugucucucuguggagaaagggugugacacugugagcguagcguuuacaagcaagcacuaaguguuaccuuagcaaccugaugaauucuaaaaauggugcugugcuggggggaacauggaaauauagaauguggcauugugucaugcauauaaaguuauacacaaauaaacauuccuaugcauuuuuaaaugauaaaauggaaaugcacaacaaaugugacagcguggguguaugucaggggaagaggagugucuucauccauuugcugcuccauaacaauaccacagacuggguaauuuauaaggaaaagagauugauuuggcucacaguucuguaggcagggaagcccagugguguuggcaucuggugagggccuucuugccgcaucauaacauggcaaagggcaagagagcaugcaugagagcaagagaaaauugggccaaacucccccuuuuuaucuggaacccacucagugauggcauuaaauggagacucaaaagguggaggggggccgggagccguggcucaugccuguaaucccagcaguuugggaggcuggggugggcagaucaccugaggucaggaguuugagaccagccuggccaacauggcgaaaccccgucucuacuaaaaauacaaaaauuagccaggcgugguggcaggcgccuguaaucccggcuacucaggaagcugaggcaggagaaucacuugaacccaggaggcggagguugcagugagcugagaucgugccauugcacuccagccugggcaacaagaacgagacuccuucucaaaauauauauauauuauauauauauaaagguggaggagaugggagggggugaaggaugaaaaauuacuuaauggguaugauguacauuauuuggcugauggaugcucuaagaacccugacuucagcacuauacaaucugugcauguaacaaaagcacuuguuuauuuuauuuauuuauuuauuauuuuuuugagauggaguuucgcucuuaucauccaggcuggagugcaguggugcaaucucggaucacugcagccuccaccuccuggguucaagcaauucuccucccucagccucccgaguagcugggauuacaggcauccgccaccaugcccagcuaauuuuuuuguaauuuuaguagagacggguuuucgccauguuggccaggcuggucucaaacuccugaccucaggugaugugucugucucggccucccaaagugcugggauuauaggcaugagcuaccgcgccuggcuacaaaagcacuuguuaccccauaaacuuauacaauuucuuuaaaaagcagccgcgaucucuugaggagggcagagccuuugugaccuaaucaccucugaaaggcccugccugucaacacuguugcaucagggauuaaauuuaucuuuugagauggaguuucacucuuguugccugggcuggagugcaauggugcaaucucagcacacugcagccuccgccucccggguucaaggaauucuccugccucagccuuccaaguagcugggauuacaggcauccaccaccacgcccagcuaauuuuguauuuuuuuaguagagcugggguuucacuguguuagccaggcuggucucaaacuccugaccucaagugauccacccgccuuggccucccaaagugcugggauuacaggugugagccacugcacucagccgggauaaaggcuccaccugugaacacuguugcauuagggauuacauuucugacacaugaacuuugagggacaaaaaacauagcagagaacacagccagagaggggcuuggcaagaagcacuggugacuggugacagaaaauaggaacuugcacuacugugucccucaccuucugauuguucugccucagcuuccacucaucugccucccagaugggcccgccacucuguccacacugcuucugccaccucaccauugcaaaccagugggggugggggcacaggguguguucagugaugaggucaggaguagccaggugccaagugccuugcaggcugugguugcgaguuuggguuuauucuuggugugaugggaggcgaaggaaggguuuuaaggacauuguauuugggggugggaguggcuuauacuucaugaaagagcgcucugcugggaaagguggucaggagccguagcccagaggccagaugaagccuucugcagugguucggacuagggauaguggcuggcccguguuugaggaugcagggcagugggucagcagauagaguuaguagccccagggucaugaggguucugggaaccucaccuccacccucacccccagauugccaaggacauggaacgcugggcccgcagucucaacaaacaaaaagaaaacuucaaaaauagcuuccagccuaucagcucccugcgagaugacgagaggcgggagucagccacugcagaugcuggcuaugccauccucgagaagaagguguguuggggccaccccccugcacccugccccacaaucuuguccuuccuuugggcccucuguggagucccugaauuucugugucccuccaccccagggagcacuagccgagagacagcacaccagcauggaucucccgaaauuggccagugacgaccgcccagugagugcccaaggcagagaggggcgggggcucugaucuggccaggccugaccgcccacccucacccucuacagagcccuccgcgaggacugguggcagccuacagcggggagagugacagugaggaggagcaggagcgugggggcccugagcgggaggagaagcucaccgacuggcagaagcuggccugucugcucugccgacgccaguuccccagcaaagaggcgcucauccggcaccagcagcucucagggcuccacaagguaacagcggaugguuggcagggcaugcuggggccuggcccacugaggcucauccucuucacuucucauccugucccucuugcagcaaaaccuugagauucaccggcgagcccacuugucagaaaacgagcuagaagcacuagagaagaaugacauggaggugaggugugaccugacccugggcucccuccccugugucccuuccaaguccccaucaccucaggcagcuggaguucaauuucucacguguuaaccccgugagccuucuuccccauuuuccuauccuggcugcuugugccugugauggccugacccucaggaccugagccucauuagccagauggcaugcccugugggaccccacuccccaugccuguguugccugagaaaagagaccagcuccccaacauucacauacacauacaaacuuucagcaaaugaaguaccgggaccgugcagcugaacgcagagaaaaguauggcauccccgagccgccagagcccaagaggaggaaguacggcggcauauccacagccucugugugaguggcugggccaggugagggggucuggagcccggggccggggccggcaggccgaccacucaugcugugcaccgccccugcagagacuucgagcagccuacucgggacgggcugggcagugacaacauuggcagucggaugcugcaggccaugggcuggaaagagggcagcggccugggccgcaagaagcagggcauuguaacgccuaucgaggugagucucaggcaguccugucccaucccccagcaccccucacagcaucccccaccagccugacagagccugccucccucacacaggcccaaacacgggugcggggcuccggccugggugcacggggcagcuccuacggggucaccucaaccgaguccuacaaggagacacugcacaagacaauggugacccgcuucaacgaggcccagugagcagcuucaagagcaacuucuccacauguuggguguccauccuggggcagggaaggacagaguguuggauggcugggacggggccuugcucuugucggccagcccacuccccagccagagagggcuugaccaaaucaaauugagguggugacuuuuguuggaaaauugggcugggaucacguccuguuuuguaauaaaagcugaaaagucugca

SEQ ID NO: 12679 - RNA, 15973 nt, Homo sapiens
cauagaaguuuuuaaguauucuuggaauuucacuccuacuuaaaaauuguuuaaauccuaauuuaaaauggaccuucagccaaaauaauagagagccaaaacaucauauaagcuuuggacacuuaguauguucauucauaacuauucaacuucaaggguuauucuuugguccaaggaaagaugugacuauuaagcuaucuugugcuuuuauucucuucucacuuaugagggguacacauaggaccuugguauuggagugugacaacugugugcuuugcugguauuuaacauacuuuaacuuccagguuucaucuuuccuuaguuuuucaaugaugccaaagaagcuacugauuacuuaaggaaucuaaaagaugccauucagcggaaguacagcugugauagaucaagcagcauucacaagcuagaagaccuuguucaggaaucaaugguacuaauacaaaaccuaugcauuuuauaaguaugcauaagugauuagauuaguguuuuauaugagcagaacuuuguauuuuauuggcacucuugauauuucccacuaauucaauuacacauuugcacauucaguuuuaguauucuuuuggcaacaaauacaacagaaguguuuuuuuaaugugauagcuuugauauuuuaagaugguuuuuagugucgugugugugugugugcacguguguguuuaguuauucauuuugcaaauacuuuuuaaguucuuaauauauccugggcacuguuuuagguucuagagcuacagcagugaacaaagcagacaagaaucucuaccuuuguggugcuuacaugcuagagagggaguuagacaauaaacagaauaaauaaguaaaauuuguauaguauguuagguaguguaaaugccaaagaggaaaaagaaaaccaaacaaaccaaagaaaggaagagggauacaagaugggguggaggaggaaagauugaaaauuuagacuagguagucagagagaagacuuuucugaugaaguuuaauuuguguaaagugcugaaggcauggagaguacaagucuuuuacuucuuaaaauucacuguauuuauuacuuaggaagagaaagaagaacuucugcaguacaaaagcacuauagcaaaccuaaugggaaaagcaaaaacaauaauucaacugaagccaaggaauucugacuguccacucaaaacuucuauuccgaucaaagcuaucugugacuacagacaaauugagguacuuguaacuccuagaaacagaccaguuucugucauuauucauauauuuuguaaaugagaucauauugcuaacuagugaucaagauuucccgccucauaaaacaaaaaaaaucccaggauugaguauggaaaacaguuaacagugaccucauugaguuauucugcucuuuauuuuaaaccagauaaccauuuacaaagacgaugaauguguuuuggcgaauaacucucaucgugcuaaauggaaggucauuaguccuacugggaaugaggcuauggucccaucugugugcuucaccguuccuccaccaaacaaagaagcgguggaccuugccaacagguuuguauauauuagcuaaaaauguugagcuaguuuugggggcccucugaagguugaaggaacaaucaauacuuugucaaggccccacaggaucaaaagucucuagaacucauccguggaauauuucacacaaaaagaaaaauugcaguguguuuucagagggaguaaaaacauuaaucugaguucucuuucauguauuucagaauugagcaacaguaucagaauguccugacucuuuggcaugagucucacauaaacaugaagaguguaguauccuggcauuaucucaucaaugaaauugauagaauucgagcuagcaauguggcuucaguaaguaugaaucuguaugucaacucgauauguccaaaaaugugcaugccuuuucauaugugucguagaguuuguauuugcuuuagaauaggauggaguccggcaaauccaugcuaauauucauuuauucaaugaauauuuguuauaugcccauagcauauaaggcacuuuuuaagaacugaggaaaucuggagaucacaaauuucauucagaacuuacugugagauagggaggcagaauguaguuguuggauauacgaugauggguacaguugauuucauuugaguuucguagacuuguuuuucuuugucguuaaaaccuaaaauuguuggcugggcgcgguggcucacgccuguaaucccaggacuuugggaggccgaggcagguggaucaccuaagaggucuggaguucgagaccagccugaccaacguggagaaacccugucucuacuaaaaauacaaaacuagccaggugugguggugcaugccuguaaucuuagcuacucgggaggcugaggcaggagaauugcuuggaccuggggggcagagguugcagugagcugagaucgcgcuccagccugggcaauaagagugaaacuccgucucggccgggcgcgguggcucacaccuguaaucccagcacuuugggaggccgaggcgggcggaucacgaggucaggagaucgagaccaucccggcuaaaacggugaaaccccgucucuacuaaaaauacaaaaaauuagccgggcguaguggcaggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaagagugaaacuccgucucaaaacaaaaaacaaaaaaaaaccaccuaaaauuguuaaugaaaaagacaguuaauuucaaauguuccuauuuaugauuauucguuuagauuggcauauaccacacgaccaguuugaagugucucccauucaaaucuaugaguaauagaaugaauuacaugggucuuuggucuucuuuagauaaagacaaugcuaccuggugaacaucagcaaguucuaaguaaucuacaaucucguuuugaagauuuucuggaagauagccaggaaucccaagucuuuucaggcucagauauaacacaacuggaaaaggagguuaauguauguaagcaguauuaucaagaacuucuuaaaucugcagaaagagguaaagcauggggaucccugucuuuuuuuccccauagguguuuaguucuggcuauuuuuugcucucaaugggaaucucaaucuuagguauauuguaucacccagccuaugauauguagacacaauugguggaacgguaaaagcauguuugagguaggaagacucaagaagggauuaauuuguuuccaaaugauaaauuaaugaaaggugccaaccaacugguuggacaaacaacgaauucuuacuuuucaacguuuucacuauuuugcaauccuucaguuucagaaaagauucaauuauuuucccauuuaccaaacuuggauuuuauacaaggauuaaagcaaaagguuuuugccuaguuaacuuuuguuaaauacagauuuuauucugaacuuuaaaaauuuuaauuagagacaauuuuauuaguaauauucuauuuuuuaaaaaucuuaaacauuaaauauuauuuaccuaauauuuacuuuuaaggauuuuuauuugauuuuuguaauuaauuuuugcagcuaauauaauucacauuuuugugaacauaaaauagcaacguauuacuuuggacagcauuuaaucggaaauugguacuucaaauggcauuugggaaauuuuauuaauucuucuuaaauuuuaagauuuauguuuuaagauuuauauccuuagaauggguuugugaugaaaacaggaaucauuugcuugacuagcugugucccaguaauauaaaauucucauauuaaaacauaaacagaagcuucuaagagauagaaaacaagguauuuucuaaacauauuuauuuucacagaggagcaagaggaaucaguuuauaaucucuacaucucugaaguucgaaacauuagacuucgguuagagaacugugaagaucggcugauuagacagauucgaacuccccuggaaagagaugauuugcaugaaaguguguucagaaucacagaacaggaggugagagcuauaaauauguugggaaaaaaacuaacucucuuaaugaccuuauguaucaacucuugugacuucuuaauguucaguuuugcacacucacacuagccagucuagugugaggugaggucugauuguguaauuauugcugauuauaaacuaggauucagucuaccucugacucagguaaacaugagaauauguacacgcucaccuucauugugaugaaggauauaaggacuuguaauaaaagucauuauacaccugcugugugcaaaaguacuaaguuagauguugaggcuaaggagaugaacaguaagggaauuauugauuguaaaacuugaaugcuaugauguaguuucuuugauaacaaacaaagaauauguagauuucuaagucauugguucuuaaugugaaauguguguuuuucaacuaguuuaagaaaaacaccucaucacaggugauggccugauaccuuuguuuguucucuguuuuauagaaacuaaagaaagagcuggaacgacuuaaagaugauuugggaacaaucacaaauaagugugaggaguuuuucagucaagcagcagccucuucaucagucccuacccuacgaucagagcuuaaugugguccuucagaacaugaaccaagucuauucuaugucuuccacuuacauagauaaguauguaacugcuaucucaauauauaaauugcuucauacaacucucauuuuuauuuacuauuaauuuaaaauuuuauuuuuauuaauauaaauauuaacuuuuauuuugucuuaagaaauacauuauuggcugggcgugguggcucaugccgguaaucccagcacuuugggaggccaaggcaggugaaucaccugaggucaggaguucgguaccagcuuggccaacaugguggaaccccaucucuauaaaaaauaccaaaguuagccaggcauggugguaagcgucuguagucccagcuacucgggaagcugaggcaggagaaucacuugaacccgggagguggagguugcagugagccgauaucgcgccacugcacuccagccugggugacagaggaagacuccauuucaaaaaaaaaaaaaaagaaauacauuauuuuuauggauugaugacacuucucuauguugauaguggaugugcuucagagaugaguguguaauguaugguccucccacauuuugcauguaauuuggguagcucagcaguuguagccaaugaauuuucaucucauacuuaaacaaaguuagaaagaaaccaucuuauguugcagucucuugcugaauaccacuuguggggcaggggauggguuggagcacauacucucuauuaagaagaaagccagaaaaaugucaguuucauaguaaauguaucaguguuccaaggugaagaacauguuaugucaugugucauaauggugcuucaggacuacauuaugcaaaaauaaacauuuaaccauagguggcuauuguuuaauuuccuuuuuaagguugaaaacuguuaacuugguguuaaaaaacacucaagcugcagaagcccucguaaaacucuaugaaacuaaacugugugaagaagaagcaguuauagcugacaagaauaauauugagaaucuaauaaguacuuuaaagguaugagacucacuuuuggauauuuuuaaauaucguauucuacaaguauuucucuagcacuuagaucuucaaacaucaaguguuaaauaucuuggauuuuugaauggauuuauuccauuugugucucugugaucucacaguuuacucuaaguauguucagucauuuuaguuugaggagaguucucauuugaaguuugaacccuuuugacaguagcuuuugauagucaauucauguuggcagcaggaggagucgaagcuaaaaauuaaauuauuuguaauagauuaacuugcugaaaaagaaguuaauuuaagauaucaaggagguaaauagagaaguuaaucugagaaaggaaaaagacuuguaguucaacucaucuauguguauuucuuuagcaaguggugaaacuauugcaaagcaauuuuuaaaaguuaucucagugauuuuuaaugcauguauuucuuuuuaacagugggauuaguaggcacuuaaaagcagacaaugaaaaagacauauuuuauuaauggagguagcaaacuugcuuauggaauauauuuuauuuuguugauaugcaaauuuuauuaggcugaacguuauaaaauugucauuaaaaaaucagaguacaaauauugaaaauuucauaagguuugaacuaauauaauauugugcauaugaaagauauucuuuccuuuaucuuauuuucuaccugucauuuguaaauaaauuguaaaauuagguaaauaauauauuuacccagugagugguuaacauuuuuauaacuuuuaccaauuaauguauuuuagcaauggagaucugaaguagaugaaaagagacagguauuccaugccuuagaggaugaguugcagaaagcuaaagccaucagugaugaaauguuuaaaacguauaaagaacgggaccuugauuuugacuggcacaaagaaaaagcagaucaauuaguugaaagguggcaaaauguucaugugcagauugacaacagguuaguauccuuuuuuguucaguuuuagcacagauuuaaugucuaucuaugguaaaugaguaaaaucuacacauaugaggcuauuuuuuuacuuccauaguuaauuuguuaauuacaauaccucuacuuagccauauuucuuucuuacuuggaggacuuuaguaagacauuuaacuuaaaauaagcauuuuuucaacucuguuacuauucauguauucuagcauuuauauaguuaaucugcuugccuuuucugaaggaaaaaacaauguaguucucuaauuauuaccaacuuauaauauucaaauaaccaugacuuaguaagagcaugaagcaugcaugugauagggcuguguguagcuucuauacuggacuuaagaaauguaaauaaauggaaaugcccugauguucauuuuaauugaagauacaagaaagucaaaauucucaguuacugaauuaaaaaagguuuuaggguucaucuuaaaauaaaugaauucguguccuuucucauucacuuucgugcuuauauuaaugcaaauaaaaugcuuuuaugauacagugccauucuccaaaaguaaaauuauguucaaauauguguuaucucuguaacaaauaugauacauagguuuaauguggugguuuuuuaaaucauagagacagguauguaaucacagcuccuggaaaauacucucugagaccauguugaaccauucauuggacuaccuuaucguuauuucaaaacugaacugccauuugaugcaagccuuacuauucaagacacuguaauugauaauaauuaagguuaagcuuccacuuuucuugcuuuuuaaguuuagcuucuugggcuugucccuagaauaaucacugucacuaaauugcacaacucagggagcagaauguuuauauucaacccaauaaggaaugcccuugggggugugccucagggugcugcagccuugaguucuuuauacauacccgucuugugcuuaguucauugcaguccaauuauuuugucucucccaucucuacaucuuccacccuccugauggauaucgcuggacaccgugacuauucgguuacuauucucuuagguuacgggacuuagagggcauuggcaaaucacugaaguacuacagagacacuuaccauccuuuagaugauuggauccagcagguugaaacuacucagagaaagauucaggaaaaucagccugaaaauaguaaaacccuagccacacaguugaaucaacagaagguauguaaaaauaauucccucuacugagguuaugucugcauuuggucagucaugcuccucaucuuccuuuccuauguuaaaugaaaaagucaccaacucuuuagaggaagguggagaguauauaaaaaauauuaaaaucuugcaacccaaaccuacauacaugacuuauuuuuauuucuuggaaguaauuuuugaaagcauggguaaucagaaaguggagaguguugggauacuuuucaaauuccuaaugauaauuuauuuaaucauagguauagaaaucucuuugacacuuugcuggccucaauaguuuucuagguuccuaaauaaguaaaaaugguuagcaauggaaaauuaaauaccacauuugacagaaaguugaaugcuuugagauuuuuguucuaucuuaggggccaaucaucucuagcucuauuuucuucagaaauaggugguggccaagggcaucaagucugcuuuuggauaauuccuaaggaguuuaguaauuucugcuuugaaaaccacauggggugggucacuucuguggcuuaaucugaaaguuuguaauuuucccauaaggcaaguuguguauuaagugcaaagggcuaaggagcuguacugugaagugauguagauaugucuuaguuacugagcaucuuauguaguagaauagcugaauuccuugucauuuuuguucuaaacuguguauauuuauagaugcugguguccgaaauagaaaugaaacagagcaaaauggacgagugucaaaaauaugcagaacaguacucagcuacagugaagguaggaagauucauuaacuuuaguaaaauuuaauauucagguuugugauucuacauguacuguuaaagccaugcaagucauuucacucaguguuuaaaagaaucuucauuugaacuuuuuugacacuuaucuaauaauucuuugugaaauuagucacaugacagccccccaguucauucgucuucuucucucucacauauguacaccccugccacucccagccaccagaauacauagcucuguaguugguuucuuaucacuuuucuuucuuuuuucuuuaacauuguuaggguauuucaugggagagcuucuaacuuucucacuuagggggacacuuuucaugcuuuucaaguugucauugacaacuuuucaguuuuagcccuccagauccauaguuccauugcuuagcuggaggaaaggggggcugcauagggcuacacuauuguuacauauauuuucaugagcuucuaaacagacuuggaaauuacccgaccacccuacauguuucugauuuuguccccaucuuggaagcaucuccaggauuggauagauuccuaaaaauguaauuuugcucuacagucauguguuguuuagcaaaggggauauauuccgagaaaugcguuguuaggugauuuuuucauugugcgaacauuguagaguguacucacauaaaccuacauguuacagcuuucuacacacuuaggcauaugguacagccucuugcuccuagacuauaaaccuguacagcauguuacuguacugaauaguguaggcaacuguaacauaaugguaucuauuuguguaucuaaacauauuaaagguauaauaaaaauagggaauaaaauacaaaacaugguacacuuguauagagcaccuaccaugaauggagcuugcaggacuagaaguugcuuuggugaguuagugagugagcucugagugaagguagaggccuaggacauuacuguacaccucuguagaauuuauaaacacuguacacuuagacuacacuagcuuauaaaaaaauuucuucaauaauaaauugacauuaacuuacuguaacuuuuuuacauuauaaacuuguaauuuuuuuaaccuuuugacucuuuucucauagcacuuagcuuaaaacaacgaacacauuguacagccauacaaaagcaucuucuuucuuuauacuuuauucuguaagcuuuuuucuauuuuuaauuuuugguuuuuuuuuuuuuuuuuuacuuuuuaaacuucuuuguuaaagccuaagagacaaacauacacauuaacuuaggccuauauagagucaagaucaucaauaucauugucuuacaccuccaaaucccaugggaaggucuucaggggcaaucacauguauggagcugucuucuccuaugauaacaaugccuuuuucuggaauacuuucugaaggaccuaucugagucuguuuuacaguuaacuuuuuuuuuuuuuuuaaauaaguaggaguacacucuaaaacaacaacuaaaaguauagugugguaaauauauagaccaguaacauagucauuuauuaccaaguauuacauacugaacauaauugugugugcuauacuuuugugugacgggcagcacaguaaguuuguuuacaccagcaucaccacaaacgugaguaaugcauugugccacgacaucacuaggcgauagguauuuuucagcuccauuauaauuuuauggggcuaccaucauguauacggucugucuuugacugaaauguuucaugugaaacacgacuauauuuucuuuauuuaaacuuaauuuaaugaaucuagguucuaaugaucugugucaaaucacuaaaguuauuuuagugaaucuagguucuaauuaucuguguuaaauuauuguagaaugaaacucuaguacuuugcuucaauucauuuuaucuuauugacuccuuuauacaggacuaugaauuacaaacaaugaccuaccgggccaugguagauucacaacaaaaaucuccagugaaacgccgaagaaugcagaguucagcagaucucauuauucaagagguaauaaaaguaugagagaaagaggggaaggggcauaaaagaaagaacacuuacuuuuuaaauuuuauuuuuuguugugguaaaauauacauaguauaaaacuuacuauuuuaacaauuuuaaauguacaguuuaaugacauugcaguauaucacaauauugugcaacugguaccacuguuuauuuccagaaccuuuucgucaucccaaagagaaagucuacacccagaacaauacauucuauuaaggguuuuuaaaaacccuuuaaaaauguuuauucaagauuaauuauuaacuauggagauaaauaaauguacuuauguacuucauggugaaauuuagaagagaauuaucauuugccaugauuugcauaauaguaauaauaagcucauucuuaucauuuauuauggggggaguugugugcuuugcugucugaaggccuaguuaauguaauuauuauucaaaauucauucaacuuaguaagaguaacuggagguaaugcuuuuauuauuuuuuuccuuacuugcaguucauggaccuaaggacucgauauacugcccuggucacucucaugacacaauauauuaaauuugcuggugauucauugaagaggcuggaagaggaggagguaaucauuaacagugagcacccuguaaauauaaaggagcuagagaugagcaguaacuacaguguaguuugggaaagcaaaacauguuucaugauaaauuuauguggccgguagcagauguacaaauaaauauugaauuauaaaauuacaaugaaaaugacugaaggccuaagauuuuuguuugucuuuaagauucauucaaauagaaagucauuucacuucaugacuuuacauuuucacuucaggacucuaauauggugggguuaaugucuuaaauaaauuacgaaauuuuggcaguuuggcagaauauuuuucggcuuucucacagcugagagguauacuucuuugaaguauaguuacugcugguaugaugucuacaggaauaccacacgaacacauuugucuuaugcauuuuaaauuaauuuguaucucaagaaguuaaaauuauuauacauaauguaaagaugcuaacuuagaaguaguagacguuuuuacaaaaugauacuuuuuaagaauuuuggaguuuuuuguuguuuuuuuuuugcaaaaagauauagcacauggcauuuaaaaaggcuauuuaaaugccacucugauuuggagaacuucugcagcuuugauucugcauuuaaaaaucauauuucugcauuuauaaaucauauauuuaaaaaucauauaggaagaguaaggacuuauuuauaaagaucaguggucaccaaaggcucuuguauguaaucuaaaagggaguaugcuaugcuuuguuaucuugauguacuuucuauuccccagaacagacaaaaauaguagaaugaauguugaaauaaauaaauugugggccauuagcuauuuuaaauuggacuguuguugaaauucuaaaggugauuaugcuuaauguaacuccauaugagagcugaaacagcaguaaacaucuauuggauguuacuuucucaguuuccuaaaaaugugaccacuuuuauaaacuguuuuagucuguucagaguuaacaguuuucugcagcuaaaucacuaacauagcuaauugcaagacuuuauaacccucuuccuuugugcuuaggagaaccaggauauuugugaccaucuuaaaugcaugcaucucucaucuaugaaagaacauccauaauuuucuuauauuuuuaguuuuugagagaucuuauuccauuuuaaaugguauacagaucuuuuaaauugaauaugcaguaguuaaauauaaaauaaaauaacuuaaguucuuuucucauaguauguaucugauuauacauauaugggccacuuacucgauuuaucugaugaggcagaaugcuaacaauugauagaaacaaaaaauauuuuagaaggccuuaauugaaugcaaguuauuauuguccuuaaaaaugucaaagauuuguaguuaauugaaaccagcaaauacaguuauggaagaacaagcgaaggcuauaauuuaaaauagguuaaaaaaaacuaccacuuaacauuacguuaauggaaugucguguaaaagauacauagcuuaauuuuuagacucaaaagauugguguuucugcaacugagguuugaagacccacaugaaaaaccuuggucuaaagcagaauuuuccauaauaaacauaaaaucaaagauggaugcaaguuaauuucagaaguaauacugauuuaguuaaaagaaauguuacuaaaauaucuguaauagauauuagauauuagagagagaugcuuuagucugugcugagaacaaaauaugcuaaguauuaaucaccgugauuaaagggcaagauugaggaagauuuagagaaaaguuaaggaaguuauuuuuaugcaaauaaguuugagauccacaagaaagcaagucagcaauuggacuaaauuauuucuaguaauuuuucucacauuugcuaaaaaagucaagagacaacaugauuuuuuuuuuuuuuuuuuuuuuuuuuugagacggaucucuguugcccaggcuggagugcaguggcgugaucucggcucacugcaaccucugccuccuggguucaaguaauucacugccucagccuuccgaguagcugggauuacaggcgccugccgccugccaccacgccgggcuaauuuuucuauuuuuaguagagacgggguuucaccauguuggccaagcuggucuugaacuccugaccucaugauccacccgccuuggguucccaaagugcugggauuacaggcaugagccaccgugcccagccgagauucuuaacaaaucacugcauugccuaaggcauugaggguucaacaacagauauuuuuuucugagggaauuuuuaguuuuucuaaaucugagcaugagaaauagcucagaauuucuuagcaauagcuaaguuuuaaaggagguuugauaagcaacugagacugucuuagaaauaaccuccucaagaaauacugaaaacuuaguauuuaaauagauaaaaugcucaugugucacaggauugacccugauacuaaaauaaagaaaauagagugcugaagauaacagauuaugagauuuguuucuguaugaauuauuauuagaaaccuuauuuagguuagcaaagaaaacaacugaaauucucaucaaaauuauuggagaucaagaaauuagaggaagcaaaauaagauguauggucuguaauagaaauuaaauucuugaaauucaccaaagcuucucaaugaaaacaaaucugucuaaaauaauuucuguauuccuguuuaaauuauuuuauggugaucuugaguugaugauacaaaacuaacacacuagaauauuaauaaagagaaauuaaauuguaauuauaaacuaauccugaucauguaguucuauaaucaauguaaagcauacuccucccagcugacauugauucugucccuaguagaguaaaaauuuuuucuuauaauuuuuucuauacauuggagcugaaucccuaaguauauauuuaaaagcuauuauacuuaacaaauaucuuuauauuuauggaguauuuaaaggugcuugucaaagugauucauaugaggcauguuauuaacaacagcaacaaaaucugugaguauaugaagcgcaucuuuuccagagccaucaggacuguagcugccuuugcauuagcaauucugauuauuauaauugucauaauauggcaaguauaaacaaauaagggaucugacuuuagaaauuucaaguuuuuguauaauuuuccuucuuccccauguuauuuccuaauuuggcucucuguucuaaaguucugugcuuuguuuuuuuaaccauaagacaugggaauauaaguaucauuuuuaauuucuauuagguuagaaaacuaaauucuuuagcaucauuugguuccuauguguuggguguucuuccuaccucuuaggauuauguugcaugcaagagaagaaagggcaccgucgugagaguuuuauuucccacuuugucacucacccaaugugaguuugcaaaaauaucuguccuccucguuucucccuuuccucaucuguuguaaauucccuucuugcuauaaaauucuaagcuagcuaauuuuuaaaauaaaauuauuccugaggggcaaaaagauauucuucagaaaaccugucgugaaggguuuuuuguccucuucugcugacuuucugaggcuuccucucugaagaaggugaugcugcuggugguggugauagcgcuuguucugcauuugaguucacuugguuuuguaaguacuuuuaugaacauugauucauacguuguaagauauuuugaacagaacaggcuugacacuuucaaaaugucuuuuguagauuaaaagguguaaggagacuucugaacauggggcauauucagaucugcuucagcgucagaaggcaacagugcuugagaauagcaaacuuacaggaaagauaagugaguuggaaagaaugguagcugaacuaaagaaacaaaagucccgaguagaggaagaacuuccgaaggucagggaggcugcagaaaaugaauugagaaagcagcagagaaauguagaagauaucucucugcagaagauaagggcugaaagugaagccaagcaguaccgcagggaacuugaaaccauugugagagagaaggaagccgcugaaagagaacuggagcgggugaggcagcucaccauagaggccgaggcuaaaagagcugccguggaagagaaccuccugaauuuucgcaaucaguuggaggaaaacaccuuuaccagacgaacacuggaagaucaucuuaaaagaaaagauuuaagucucaaugauuuggagcaacaaaaaaauaaauuaauggaagaauuaagaagaaagagagacaaugaggaagaacucuugaagcugauaaagcagauggaaaaagaccuugcauuucagaaacagguagcagagaaacaguugaaagaaaagcagaaaauugaauuggaagcaagaagaaaaauaa

SEQ ID NO: 12680 - RNA, 1445 nt, Homo sapiens
ugccaacacugagucaaugaguaaagaguaggaucaacuuuuaccaacauuagagggagguuucuucugcuuuccaaaaauguaagcauagccuccuugaaaggaaacuauuaauauuacuaaggcuauacucauucaguaaaagaaauugauauuuuuaaaccuuaggguugcuuucugcacuuaccccauuuuagugcauuuaagcguuauuaaccuauucauauauuuccacuguauaaaaggaaggcauuauuugcuggguucuguaguaagcuuuuuauuauauauguuuucuacuugaagaacaacugaauuuuggaauacuggguuuaaguaucucugacauagaguguuaguuuuagggccuuccaauauuucaacuuagcagucaauuccaggaccccucguaugagagaagauaaaggaauauucuggaauuuuuuuucucuuucagaaugcugauuguaaaauaugguacuguaugccuuagacaugauaauuuuauauuugaaaaugaauauauaggaguaaaauauauauuuugguuacuugacaugagaauuaaacuaaaauuggcuugaaccaagugagaaauuuuagaaccuuuuaauuauaaucucuagauauuuagugucaucaauugcaaggucauuccagugggaauaacuagcaaacuguucucacacagucauuucaggggacauugauagaguaaagguacauccaggaagguugcaaauuuaggggaaaagaaguucaucauuuaaaaacuuaauauuagccagccugggcaacauagugagacuacaucuguauaaaaaauaaaacaaaauuagccaaccauggcagugugugccuguagucccagcuauuugagaggcugaaaugggacgauugcuugagcccagguguugagguugcagugagcucuaauagaaccacuacacugcagccugggccacagaguaagaccccaucucuuuaaaaaaaauuaaaauucuacacauauaacguuuuuguuugaggauguuucauaaccagaaaggaaaacaauugcauuaaagaugauauuaacauguuacaaacuagcaaacaugguguuaucuuuauauuuucaggugcuccaaaaugauguauuagcccaucaguccacaguggaagccguuaauaaagcaggaaaugaucuaauugaaucaagugcaggagaagaagcaagcaaccuucagaacaagcuagagguuuuaaaucaacgcuggcaaaauguuuuggaaaaaacagaacaaaggaagcagcagcuggauggugccuugcgccaggugaguaagagaauaaauucugaaaguuuuuauagcauucaagaccaaaauagcauggaauucuuuuauuaguucacagacuccuguuuaauuuuuauaccuuaaggagaggaguaaaaauaagug

SEQ ID NO: 12681 - RNA, 3290 nt, Homo sapiens
cacaccugccaggugaaggugagauugaagauaaccagcuccccacauccccugcagaacaaguggagcagggauggaaccagcaaacagaccgcgaugauucugaaacgcugucccagcagagugaaaguggaucagacacaaaaacugaccccuuugaaagugccucugacacagaguccuugucuggguaccucccgaggggagucuuccacccucuaagagguacucccguagauauagaagcaccuugggaauacccugaugucucagcaacuggacccccucaggagcagcauuugaccaguguuccugggcuucaugcaaaggaagaacucgauuuguccccuagcuuagaggaugacucuugcaaaaauggguggcgagccuuugccacaguugcuggagaacaggaggcaggacaccucugggacugcgcgaccagccuggagcgagagucuuugcuggcagggguuccccgacacacagggugcugcuuacagagggccacagacagcagugguccugagccaguacaggggguggcuguucaagaccucagagggcucuccaguguuucucuucagaaauccaggucugagagcuaucugggcaucccaguggucuggcccuuccuucucuggugcugugaacugggucggaguuggccacauauccacaacagggccagggcacuggugcuaccuagcagaggcccacuggacaacacagccccucuggggaccaggacaaagaaggaaaguacucuaggcccugcaggggacacagaauugcucuggucccagccccacucggauguccccugccagccuccuuugaggacaucuugccuccuacgcaccaaccgucaccauagugccccagaaacuacuggugacaagaacagggcaucccccagacucaacugugggcacaugagggcacuggucagggcccauuccauagcaggguuuucaccagagugccccgaggaucccgugggacagaauguugugaagucugggacccaugugaaggaaggggccaaaaaugaacgagauccaagaauacaaaacaucccuuccccugcacccacccagcugucuggcccgauuccugcuuuucagaguggggcuccccaucugcagggucccugcaagccugguggguuucgcuugcaaagggccucucaggacacuccuucugcaggucuccugggggaaaaccaguuaagacaggauuccaggucaugucugguggcuucaugccucaccucagaguuagugaagcucagugcagaggaagugccugagcccgcugagugcaagucagagcaaagcccagaaagcagaacccaggaaccccaaggcacccaacucgcaccaagagcugcugaugagagagagacacagaagcaccucuggggcauuucuguccaggcaggaaaccaaaccaguaauuacacaucaaaguaugugcucagcgaggaaagcaagucaccuaccagggccaaguucccacggcagccuagcagugaggggacccagguguggaguggagacuugaugggcugcuuggaagugagugacaguucagaugccccugagaccacccagaaaucaagcgcaauagacacuucaaaggcagccgaagaagccaugguucuagaccccaacuacagggaacaggcuuugcaaggucuuucagaauucaaggcagccacggugucucacugcggccccggggcugaggagggugaacaggggccugggggugccgggggccggcagcuggagcccaaagcaggcggcgaggccucgaggggcaggggcgcccucaucauuguagcuguggagcagaaaggucuucaggccagcaggagcaaugcggggccuguuccagaaacacugccccgugacuuuccuaaggaaagaccagaaucucccuugagcacuggcgagacccccugugagucucccacuagggggaaaacaccagccgguaaugagugugaguugccagcagcccccauacagggagcuggcgauggggcucuucagcggguggcccaggccgcagagcuugggagagugcuggucccccaagcugcuucggaagagacgccgagcacagaggagcccccgggagagagacugcguggggagagccggagcuccgggucaggggagcguggcccggaggaggcccccgaaggcggugcugcagcagcccggggccagcgcccccgcguccccgccuuggagccgccccagccgccacgcgggcuccgcaagggcgcgcaggagccugggaagcgcccgacguuuuccaaggugaccuccuucaggaagggcaggcccuuggccacugagagcccaggaggggucccggccccgaccaccgagggucgccgcuggggcucuucaggccccgaggggcuccccagggagaauccgcccgcugcggccggucgggacgcaccgccucugcaccacggggacgccagcgccuggcccgaguuugucccgcaggcugcaggcgacaggacugcagggccggcaggagcggggcacacggggaccucaggggaucuugguagccgagggccuuccucugagagcugcaacgcaaagagacucaaaacaacggagaaaaaacucagggcaagguuggccuuggcucauaagaccuuuucaaacuuuauugagucaauaguucuagagaaagagaacacccaugaacguuccccaaguucucccaagggcgagaaggagaagagcaggcugcgccaggguuccuggcgggcguuucugaaaagcaaagaugccggaagccccaaaaagcccacccuagugagucugccucuaggacccgaaguucucuccccagcagagaccgacagccacugugaggaacgggcggaggacaaagagggcuauguuuuuagcgaucacugggcacccccacuugccuccacaccuuuguccuccaguuuaguuucuccagaacacaggaggaaaagugaaccgaccaucaagugcacagccacccaggaaggcgguagguaccuaccuucagguaucuuuccggaaaaguccuggcuggcgucccccggcagcccucgggcccagcaggcuggaaucgcacacacccugccuuccagcucugccugcugccuggcauaugaaaaccccgggacgcccugcagacccacgagccccaagccccugagucccaggccuagugcucagcggaugggucuccacuaccccgggagggguagcgccauc

SEQ ID NO: 12682 - RNA, 4010 nt, Homo sapiens
agcaaaacaaagacagccuuugaagcggcgaaacggccgguccacucggcagcccgggagcggcggccaggccgagucuacgcgagcuugcuccagcaguuuggggaggggggccugccaaguguugagcuggagccagcagugagaagaaacgcgaugggccugggacccccacucccuaacagggcacaggugcagcucaagccacagcccaaccucaguaccucagcuugggggagggcgagagagacagggucugggggcagcugaggccacaagagccaccagaggguacagaaagggaaggaggugcgggggacacugaaugugaggcuaccaacuuccaagccccauucucccugucccucuuaccgggcucugggauguccuaaaagccccaguuccaggaugggacugucccuccccacggagucugggccacauuugguggugacggacagugagagcuccucagaugguuucguguguucccauuucaccuacggggcagaggcucagaggugccaguugacgucucucaacuguagaagcagauuaucggaggcccuuucuaccucugccacaccaaguucuaggccccaggcgggucccuaaggccuggauugggcucugagcucugcugcggggugaagcccucgagccccgaccucccaccccuccugugcucuagcguugccuguaggcgcagugacgccaccgugcgugugggcucccaccagaggagcccggguggggcaagaggcaccuguuguccuccccuggggcccgcggagcacuccuuacuggcccaagacucugcaaacaaagggacacuggacccgcagcgccuugggacccccugggcccucggggguccugcaccgcgcaagccccaccacgccggcgcugggcggagggugacgcgaccccagcccgggcgaccccuagacaccgcggagggacggagcgcgggcccggguuggcccgcagcucccgccgagcgcgaagccgggcaucgccugcaagcucguagcccacgcucuugcccucuuccccugacgcuccccagccgccaccccgucccuucugcagaccgagggaagacaaggggacacacaagggacaggagaggagagcaaccagggaagcgaccccucuccuguggggcugcggcgggugggcggagagacaggagaggaaaagagaaaagggaagagaaggaaggggcagggggcgagaagccgggcuccccggaccaucggcgcagcccgcggccgaaagaggaacaguggauccuacaaagcgcauugagcaaguucuucacacccgcgcagccccuuucaggaaacggcggccgcagaggaaagggccgcgcgcucuggacccggagucugugcccggcggcgccgcgguucugaaaccugcgggaugucacggggcggaggggcggcugccgacagcugucacaacaaauuagcugagcccagcucgagguggaaaccgcagcaggaagugggacgacagagccguaccgggcucggcauauuucaggcaagagacggcgaaaagaguuucgagauaaacgcccgggaagccccuggccgccaaaacuuuuugucuuuccuuuucucgaagcucgcgcggacgcccagccucaccccuuccgcgccggccggggagcgcugaagccgcgggccgggcucgcuccccuuggcccgcgccccgaaacccaccccgggccccucuccgccccacacagcgcaccgacugccacgagggcuggaggggacccggcgccggcaccuugaaccucccugcagggccgccgagccccuguccgggccgcgccgcagagccgcuuacccauggcccggagaggucccgcggcgcccgccccgagacccucagcgcgcggcuguccggaccccgcgcucucugagauacuggcucgcggcgcggcccgccggccaccuccccgcagucccgccccgucccgccccugcucgccccacuccgggcucccauugguaagcccggcuucgucgcgcggagaaggcggggggcggggaccgcccuugaguccggggaccucugggaauuguagugcgcgccccucgccucuaggcuuucagacuggagccccuggaauaggcuccucaccuagaggagcggaggcaggacccucaguaaucauugcugccuugugccucaguuucccuggaggcaaaacuagagccuuggaaaaagccuccuugcuuucagcagagcacugaggacucuguggagcgagcaaagugcuucugacuuugauuugaaaguggcccugugcauuucccaguccccaccuagcccaacaaagaaggccaggugaggccgggagcggcggcucacgccuggaaucccugcuuugggaggcggaggcgggaggaucacuugagcccagaaggucgaggcugcaguguguuuugaucacaccacugcacucuauccuggauccugggcaauagacggagacccugccucaaaaaaaaaaaaaaaaaaaaaaaaaaaaaaaaaaaggagaggugguuagugugagcuagacaaggaccaaacuaguaaauccuuggccuaggcucuguggccaggccugccaguaauagucaauguccacacacauaaugcagacagaguguggcagcuacaagcugaguaguccaaagaaggggcaugaguucaggcugugggaggugggaaugaggccuagggcgaauggaggcaggaggaggugcccagccagccauagcagcaaccuggaccugugcaggccaaagaggaagaaauggaggcucaggguuucagucucagcagguggcuagcuaggaugggaacccuguuccuagcacauagaagcuacacaaaaaucuuuguugaugaauuuuaauacucauaauagcucuaugcacuugacaccaucauuguccucauuuuauagcguaaaacugaggucugagagauuagcucaaguagcacagcugguagguguuggagccagagcuagacccaggaagaggagcccucauacccaggcauccccccacccgcuuugcacccauuacuaaccacucaucauacuggugccccuccucacacuaaacgaagggaccagggcugcaguuuggugaaccugaaacccuggcccuuacccuuuggcccugggauggaagaugucugcaggcucagucuagagcagacgacccugugggcucugcaggauaaauccccugucuaccucauaauggguuggcuuguaagagccagcaccuguagaauugguaauagacacccagaacaaucauaaugguaauuauaacaaugcaucccacuuuggcaaguuuacaagccacuuuccccuccaggaaagcuaaggcugugguggaagacacuaugaugggaugccaucaggaagcaccuuuguacauucuggaagcauugauuggcaggcacuaugcccaagguuggggauggagcucuggaugcagcccccggggucacaaucuaggccaaccccucacuuguggguuggauaccccuaaugacaaggaacucacuaucuuauaagacagcagcucaucccaccaagaguuaggguuauucugccauccgggcagcugggcacauucugacagacaagggcuguugugcaaagccucagcaagucaacaccugccugugccagccugggaacgauaggaucuaaauuuaauugcuuccugaggcaacuguuugcaauagaaaguaauuuacaauggccaguaaauccugcagaaaacagacaucuccauucaucuggcuaaaagcauaaacacuuccauugcucaagccuccaucucacacaccuccacuccggcccaaagccacccuccucugcacccuccaaccacaggaucccaggccaggacgccucugugccuacagagggggucagcuagccccucaguguccuggugucucucugugugucuuaauaa

SEQ ID NO: 12683 - RNA, 19178 nt, Homo sapiens
cgagcgggguaggcugcgcgagaggccgagagggggcagcaggcgauggcggcggcgguagcugcggcgggucgguuaggcugguuguucgccgcgcucugccugggcaacgccgcgggggaggccgcgccgggcccgcgagugcugggcuucugccuggaggaggauggagcggcgggcgcggguuggguacgcggaggggcggcgcgggacacgccggacgccaccuuccuccugcgccucuucggcccgggcuucgccaacagcucuugguccuggguggccccggagggggcgggcugccgggaggaggcggccucccccgcgggcgaguggcgcgcgcugcugcgcuugcgccugcgggccgaggccgugcgcccgcacucggcgcugcuggcggugcgcguggagccggguggcggggcggcugaggaggcggcgccgcccugggcucugggccugggggcggccgggcugcuggcgcuggcagcgcuggcgcgaggccugcagcugagcgcgcuggcgcuggcgccugccgaggugcaggugcugcgcgagagcggcucggaggcggagcgugcggcggcgcggcguuuggagcccgcgcggcgcugggccggcugcgccuugggcgcgcugcugcugcuggccagccuggcgcaggcggcgcuggcggugcugcuguaccgcgcggccggccagcgugcggugcccgccguguugggcagcgcggggcucguguuccuggugggagagguggugccggccgccgugagcgggcgcuggacgcuggcgcuggcgccgcgagcgcucggccucagccgccuggccguccugcucacucugcccgucgcgcugcccguggggcagcugcuggagcuggcggcgcggcccgggcggcugcgggagcgggugcuggagcuggcgcgcggcggcggcgaccccuacagcgaucucagcaagggcgugcugcgcugccggaccguggaggacgugcucacgccccucgaagacugcuucaugcuggacgccagcaccgugcuggacuucggcguccuggccagcaucaugcagagcggccacacgcgcaucccgguguacgaggaggagcgcuccaacaucguggacaugcucuaccucaaggacuuggccuucguggaucccgaagacugcacgccgcucagcaccaucacucguuucuacaaccauccgcuccacuucgucuucaacgacaccaagcuggacgcuguccuggaggaauucaagcgagguaacggcccgggcauggugcaggggacgcccgugcgagugcccucucccugaaaagggguggagaguuauggaagccuucuggaaagggucccaccccuguggagagcagugagaccucuaaggucccuuuucaagacgguauuggccuugcagcuuggaaugaccuuuugaaauacuuaaaggccaucgaucagagugggaggaauccuuuagacagcgaacacuuuaacccccgcgucaggauagccccccccccccauuugcagggagggguauguccgcuuguccucuaaucccccagcucuuucccucucccagaguguuucugugugcuugacuuuguagcagguccaaauuuuuggauagaaacuagaagaacauagaaaagaugguagucuccagguaucugggauauuguugugugcacacauguaauaucaaauugacuggaccuguaauguuuccuucagagcauucuuaaggucccuggcguuacugcagauaaggguauuuaggugucaaucccuuaucugcgguaaagucagggaaacuuaacacuuugcuuucaccaaaaguaacuccauuuaugcugacuuagucucccuuucucccagcucugucgcgcaggcuggagugcaguggccgaucucuuaucacugcaacuuucgccucccagguucaagcaguucuccugccucagccuucgaguagcugggacuacagaugcaccccaccauuccgggcuaauuuuuguauuuuuaguaaagaugggguuucaccacguugaccaagcuggucuugaacuccugaccaggugauccacuugccucgcccucccaaagugcugugauugcaggcgugagccacugugcccggcccuuuuuuuuuuuuuuuugcuuuuuaaucuccuguuuuuuaaaauuuuauguagagacagggucucacuauuuugcccagccuggucucgaacuccugaccucaagugauccucccaccuuggccucccaaaguguugggauuacaggcgugagccaccgcgcccagccucaccucuucuuuucuaacccuaaggucucaaguucucccuuaacuccacauuuucaucccucccuucacuguuuuagcugagcaguucggagauugaagguaaaaccaguacccuccggaugugaaggugugguuucuucugcaguccucuccaacaucauccuuaguggugcuccccagaguuuggugcucagaccuugguuaacagccaugcuucucacaccugcacuccuguagggugagggugggagcaccccaggguguuggauggacuugacccuaaaggcugccagcuguaaggccaagaaguggcaaagcccccugguauuuguggcaggauguuucuggcaccgucuguugagagccccuggccugucguugcaggaagccaggcuuugugauaaugaccgcuacuccugacugagcacugccgugugccaggagcugaugggcacuuucuguguaaucucgucccucauuccuugcaggaggccugggugcuaaguuacuguuacugcuguagcucaggaaugggugggaggcuugggugggcagcucuauucuuuuagacucuugggugcuccuggcugugucccuagaacauggccaugccacccugcccuggggagggagccuggguuuggguccagacagagccucgcggugguaaguacucccaucugggcugccagaggcagccccugaggcaggggugguucuccuggugugguggccaacauugcaacccuggaaucagcggaguagguuccauccugcccuugccugcccccaggcccugaaggcugcucagccucuuguggugcaaaguccucugcuguuagugauaagaguggguaaacagaccugcggggggagacucaucaagcacuuuggccagugccuggcgugcauaugcugugugcuuggcguuagcaggugguucuuacuccgggacaggcucugcugguaggugagcuguuugccaauccaggagcaaggggugaaucuggaauugcagauuucuguucuucuaggcaggucaccagacuuccuuuuuuuuagggaaaaaguggaagacuguagcuguccuuuugguguucaaagcacucacguuucuagauucuuuaagaaaaagcucacucuggugucuggcuucagcuggcugcugcuuucaacaguugagcagucaccaagcagagauuuggagcagcggagauggaaggguuguccuguucagaacuaaaggcaacuucuguaguuggucaugaugcucaggaugaggcuggugaaaguggucuuucauuuuccaaaccgccagugucaggaucuucgcugccauggucuugucuuucagaugcgauggaugagcuugguccagggugguuggggauuccacuuggggaagaauaaaaaauguucauguucguugggaaggagcgcagaggcaggauguccccuggcgggggggcuugugugcuguguaaggaacuuguacuugaucaccagggccaugagcaucaagcagcagcaucaguuauuuuuacagaucaguaacaauuguggacaccagcgcagggagaccagcggugugagggauccaggugagaggggaugauaaccugaacaagguucauggcaggccuggagaggagccccaagagggcagcagagguggaauugggaagauugguaucuggcagcagggcuaugcaacaaggaggagcagcugaggaugaggcccagauuucuggcugugugguggcggugcgccuucacuaagggccgggcguggggagcagguuuuggccauugaauuugugucugugcagugucccaagaggcaaacuccuagcaggccguugaugugaaaugcaagugggaggcagaauaggagugucucucaagucaugggagggaggcagagagccucagccuccuaggagcacaggugugucaggggcaagggaagcccaggagaagcuggccaggaggaggcaagaccaaggaaggaggaguucccgagaugcggaauguccuggaagcuaagggaagagaccacuuucccagggaaggugagugacaggagaggaggccagcaaacaggaugccguugaccuuugcaagagcagauuuggugccacggcaagggagccauuuggggaaugaaugagguguggaaagguacgagaaccaauguagacagcccuccacagaguguggcugcagagagaagugacuggcagaggaugugggacaggggaggaggccuucugcuguuugguuuuaagaugggcaaguccaguagguucagauugaaaugcagguugaaauguagcuaggaaggaaauuagagaggccaggguccgggcugcuccuguucugggcuggguggccuccaggcaggucacaagcagcccgaugcaggaggauuugggguugagugccucugcuugaaacagaccuuucuaaaagcugccugacaacaugcugaaaaggauccccuuggaagacagugggggagguuuuuggaaccuggagguuaaauggggagcucuuuaaucccccuugacuuccccgcuccuguggugagugagggccauucgugggcagacuggccaugucuuucuggugacaucccggagcuuuuuucucugcuucucuaguucagugcaguccuuuggcaaauaucuuuauuuuuuccguguuaaaguccuuuuuguccuuccuaaccuucuuaagcauuccuccacuuaggaacaaagggcauauugcagucuuuguggcgugugagguuuuaaaaaucgauucccuuuccaucucucugccaagcuaaugagccucugaauuucguggagcuggagucccugccaucuuggcagcuuucauuccgggucuuguuucuuuugcugugucugcuagggaacuuuguagucugggggcaagguaaccuccccagcaaggcgccccucaaucagugccaacuugagaugacgugcugauuauuuugugcagacgucaccaggaagagugagugcuuuggagccauaauaaauaacuuggacagcugcuccuugacuuacaaauggaguuauguccugauaaacccauuguaaguugaaaauaccuuaagucaaaaauguguuugauacaucuaaccuaccaaaccaaauaguucagccuggcccaccuuaaacaugcucagaacacuuacuuuagccugcaguugggcaaagucaucuaacacaaaacuauuuuaaaauaaaguguugaauaucucauguaauuuauugacugcuguacugaaagugaaaacagaaugguuauauguguuugaaguaugguuucuacugaaugcauauugcuuuugaaccaucaaauuugaaaaauuguaauuugaaccauuguuaaguaagggaccuuaauguacaaaagaacauuauuauuauuauuauuauuuuuuuuuuuuuuuugagauggaguguugcucucuugccaggcuggagugcaguggcacaaucuuggcucacugcaaccucugccucccggguucaagugauucuucugccucagccuccugaguagcugggacuacaggcgugcaccaccacgcccagcuaacuuuuuuauguuuuuaggagagauggaguuucacaauguuggccaggauaguuucgaucucuugaccuuaugauccgcccgucucggccucccaaagugcugggauuacaggugugagccacugcgccuggccaagaacauuauuauuauuauuuuugagacagagucuugcucugucaccuggguuggagugcagugaugugaucguggcucacuguagccucuaccuccugggcucaagugauccuuccacuucagccuccugaguaagcuggggccacaggugaacaccaccauccccagcuaauuuuuaauuuuauguagagauuggggucucccuauguugcccaggcuggucucaaacuccuggccucaagcgauccucccagcucagcuucccaaagagaugggauuacagguguuucccacugugccuggccgcagucucugcuuuaaaggaacccagcucugguuuccugucugcugggagccagaugauugccaugaugcggaaaagagucugaccagcuccaacagcagugaggagcgucagcacacuacuuuugucuuucucacaguauucauucauucacugaggugcuuuagaaaacagaagagagaagguauuccaacuguuauuaacaucauagaaauugggcauuaugaaaggguacuuuggcauucaaauaauugggguacccuggagccugcuaacuaaaauuaaacuugaagcuuuuccagggcuuucugcuugacguuggcaagacacacugugagcugcucguggcuccuuggagcuggccugugggcaggcaucagugugagugguuccacucugguggcucagcagaugagaggugaccuugagucccugcagcugcccuugcucugucccucugcugucaucuuuggcugccaucuagaccccucagacauucuucuugggauucagucacacgaccacuguuccaggggaucuuccagggccugcuuucuucuguucgugauagaaucaucccaguguggcaggccauggagaauugugugccuuguucuagagaaguuugaaagcaaaggagugagucccuuucuguaggaaaccugccaaaggggcuggcuuccugggagaagggagccgagaugaggccucucugcgccgagguggccauuuagauccugggcuuuggugcuggaauccaagacauuaaccaaaaccacaugucgcacuuggccuuccuggccuggccuggccugacagguuuguacucugguggggcagccguggcccauguagagacggcacccagcacaagcacugaggguuagaaggugucuagaaacgcgguucagcagggcugaguggcaaucuccaggggcccuagccuuccucccggaaagcggggagacgauucauguggccauuuccagcuuuuuguccagggcaaugcaagcauccuggagaacugugcuuuauuuaaucaagcccaugggauguaaaguaugauccacacaacaacacaaacuugacuguuugauuucccaggagagucuugaagcagauacccccucacaggcagguccaggccaguuaccccucagcguuuccacuagugacaaacgagggccugguugaaugaguugcucccaucccccuguccuggaccugugccgcccaggccggcagcccccuccaccuggggcugugcuaccuaaagguggagucugaguugagaugugcugugagcauaaaacacaccagauucagagagugcaacauagacaaaaugucuaugaauauuuuuuguauugauuacguauugaaaugcuauuuugacuauauuggguuacuuacaauauauuauuaaacuuaauuuuauguguuucuuuugacuuuuuuaaugcagcuauucagauuuuaaauuacuuagguggcuugcauucuguuuuuuucagacgggucuaacguaguguggaugaaaagcacuuaucugagacauaguaaauuccugaagccuccccagcauuccccagcacucugagacuugggcuuuuuuccaagcuuacauucccucacuaagcaaacaaaccaaauaggaagcuaaccugagaaagacauauaggguaagguggaaaaucucagccuggugcuccuccucccugcacagcuuggcucccgaguggccagcuaccacucuucucauccccuaguugacagccccuaaugggcagcuuuaagaauuaggaaaaccaaaagauacacagacacacacacauacacacagucuaucugucugucugucuaucuuucuaucucuuucuaauuucuaucauaaagaaggacaagaagccaugcacauuuauguaggauggacagcauauauauuuacuuuaagaagaaaaagacuuaggaaauccucccaaggacagucaggcuggguggccccacucagcugccccguguggacugucgcaggagagccuguguuuccagagucagugcccuuguuagccugcaugugcaggcuggcugaugugugaggcauuuguguucuccacuggagggaggcauccuugucuaaacugcauccaugucauggaggugcacggaccuggagcuggaucccagcucugccagcucugccuggggggccuugugcagaugggcaugagcccacugcuucauuuucaaccugugugaaaauaaggccaguucucauaaucacgcugggagucuuaaguaaaaaccuagaaaagaguguggcucugugccuggcacguuguaggagcaugaacguuagccguguccuuuuggugggccuauaccaggggagaugaaucaaacuggggggggcccagcaagcuguuccaugaguguccuccccccacagggaagucccaccuggccaucgugcagaaggugaacaacgagggugaaggcgaccccuucuacgagguccugggccuggucacccuggaggacgugaucgaggagaucaucagguccgagauccuggacgagucugaagacuaccgugaguccagacucuuggcaguucugucuccgcugggccugcacacuuccccaggcguauguugcgucagaggccagugggccucugugcugcuggaacccagcaagauccacagccaggcccccuucugagcccugcaugggugcuggcagagagcccccuugcaggagggcucacgccugcaccuccacacaagcaugguugccugugccagcgguggccuugcaaucccagggcucaccuggggcuccauuagcagcaguccuauuaguuuccuccauuacugagagagcucugcccuucaugggccuuucccagucuucugucucccuaggugcuuuuguuuuugcagguucuuuuguacauuacagaaauguccccugaaagaacccacuguuugccaugaagaaagucuuccuggcugggcgcaguggcucacgccuguaaucccagcucuuugggaggcccaggcaggcagaucacgagaucgggaguucgagaccagccuggccaauauggugaaacuccaucucugcuaaaaauacaaacauuagcugggcgugguggugcgugccuguagucucacauacucaggaggcugaggcagaagaaucgcuugaaccuaggaggcagagguugcagugaguugagaucacgccacugcgcuccagccugagagacuggaggggguggaaauaagucuucccaaagcagcugaucccgugcccuugauugcaugguaaaaguguccgccuguuagcaugguggcugaggucugcagggcuguacagagucugugcgucauggccgggccgccugcccugcaugcuuccagaaguaucgcuuuaaucaugcgucgauuuucaaacauagcaucucuaguuccguucuugagacugccauaggcauggggucuccagguuaauugcugcccauuugcauugguaauccuugaauacaugcuuuauagugagaaguuuuucaguggccagagaggcuguuauuauuuuuuaauuuuuuuuuuuuauuuugagacggucuugcucugucauccaggcuggaguacaguggcgcauucauggcuuacugcagccucaacuucccagacucaaguguuccucccaccucagccuccugagcaguugggacuacaggcgcaugccaccacacccgucuaauuauuuuauuuuuuuguaaagacacggucucucuauguugccuaggcugguguugaacuucuggccuuaagugauccucccgccucagccuccuaaagugcuaggguuacaggugugaaucacuacaucuggccuaaauuuaaaaaaguuuuuagucuacauccagugaccuaucagggaugcuuguuauuuuauacaagcugcuuuguuaucauaucagcauucucuucagccagcuccaaggcagauagucaccccucucucugugugguuggggugggagcaggccccguggagggagcggugcugaggacaugucccuggcguuccgaugcugcuccaucgaggacccccuggccucaggaggaaggagcaggcgaugcagccccuuaguguggucguguugacugacagguggcugaugccugagcgcgcccucuucuuccaucuuaggagacaccguggugaagaggaagccugcuucucugauggccccucugaagcggaaggaggaguucuccuuguucaaggugucugaugaugaauauaaaguaacaaucucgccucagcugcucuuggccacccagcgcuuccugucccgaggugaggcgggagggugguccaugcccccugcucuccucaccguucugugggucaggaggccgcccagggccgacacugacucugcuccccacuccuagcaggcgggugcgucuugaggacuucuguguucucugcagcccugccagcaucuugggucaugggagagacaccuccucucugccagaugaccaagagcagggccaggccagugccacgccuggugcaccacagccagggggccucagcucucagcugggcggauguggggugcccugcccaguucuuuuuuuuuuuuuuuuuuuaaagauagggucucgcucugucacccaggcuggagugcaguggcacgauguuggcucacugcaaccuccgccuucuggguucaagugauucuccugccucagccucccaaguagcugggauuacaggcguguaucaccacgcccagcuaauuuuuguauuuuuaguagaggcgggguuuugccauauuggccaggcuggucuccaacuccugacugcaggugauccaccugccucagccuccgaaaguguugggauuacaggcgugagccaccgcaccuggccccugccuaguucucuuguguugagguguuaggggcagcugcucacaggccacccgggagaucccuggugggcacaauaacuuuaaauugccuacaguguugggugugguuccacuggccacuaggccccaguggacacugucccuuuuuuccaccacgugcagaaguggauguauucagcccgcugcgcaucucugagaagguccugcugcaccuguugaagcaucccagugucaaccaggaagugagguuugacgagagcaaccggcuggccacacaccacuaccuguaccagcgcagccagccgguggauuacuucauucucauccugcagguagcugugggucccaggccuggagucccuccugcuuccucaggccagggaagggucuaggagaagaggggagcaggggcaugcggauaugcacccucccaccccaaacaauugaggugguggguuucuccuuccgcugucuucugacgggaaagguaaucuggccgcaucuguuucucuccuugccacuccucccagggcaggguugaaguggagaucgggaaagagggucugaaguuugagaauggggccuucacguacuauggagugucggcccuaacugugccauccucggguaagccacggcccugcugaugcugagggccaggguggaggcugcagagccugucccccaucaucacuugggcucucagugccccuccucaccucuccuuccaccugagcccaccaccccacaaggugguguagccccugggcuuccaggagggagggcagcauucuucaucgcucaacuuuguggcccacuccaccccugcaaaaccucucccggcuguguuuguccuucucucccagcuucccaugcacauugccucuccagagugauugguggggugggucuucgaaacuguacaguuguccccaccaggggaggaggcucccagcugccagcauggcuccugccaucacugauuguuccuuugauaguucaccaguccccgguguccucgcuccagcccauccgccaugaccugcagcccgacccaggugacggcacgcauucaucugcguauugucccgacuacaccgugagggcgcucucugaucugcagcucaucaaggugacugccugggcugcuugugggugcuggcuuuagccgacuuugugucaccgggggcuagaccagcuggucugagacugcccggaacaaggccuuccacucauccugagggacacagaccuuugcacccaguuuccaagcaaggucuuaaaaacacuugacucaguugcucuucucugcccuuaacuagcuuaaaguugugccucuguccucuucgggcacggugucaccuuuccugccuaccuucugcaucucgcuucaccaauugggucccaguaacgcugucauccuccagguuacgcgacugcaguaccucaaugcacuccuggcuacccgagcccagaaccugccacaguccccugagaacaccgaccugcagguuauuccaggcagccagaccaggcuccuuggugagaagaccaccacagcggcaggugagugccaagugguacaucgugcauggugucuggaccugagggccgugagcucacacacacagacuugcacucucgccgcccccccacccucugucuuuuuucucucuuuucuccccauccuuuucccuucuuuauauauauauaucuauauauaaauaauuuuuuuuuuuuuugagauggagucuuacucuguugcucuguugcccaggcuggaguacaauggugugaucucggcucacugcaaccuccggcuccuggguucaagcaguucuccugucucagacuccugaguagcugggaauacaggcgcccacgaccacgccuggccaauuuuuguauuuuuaguagagaugggguuucaccauguuggccaggcuggucuugaacuccugaccucagaugauccgccugccucaccuucccaaagugcugggauuacaggcaugaaccacugugcccaacccccuucuugcuuuuuuuuuuuuuaauucauuauucaacuugaacuucuugcugucuuuaauagcauggaugacaccaaacuauagacuaacugguauuuagaguagaguauaguaagucgguauuucucucaaggacgucuuagaauggauugacuuaaucagagauuuguugggaagugggaauaaguuuuaguucagacacucuuuuggccauuuaagauuaaguuuaggucacuuugagucagcaguggcccuggcuuagaggguguguggcuggcagacaccauccuagacacuagaagggcauuugugaagaguuuggucaguucauacuaauauuuaagcguggcccauccagugcuccacugcgagcaggaagauuguguuggaagaaauuuugcaaaucgaacuaaagguugugggauauggaaccccauccccacacugcaaggagggaggugaaagagucugaaguguaggcuguggguaggaguggugaaggguuucuuguucuuguuuuucaagaagauacuuuaauucugauugcguuccuaagguuggggucagagauaugccugaacuugagauuccuggaagagcugguggggcuguggagggagcugcaggcuugccuccucccacccccaccugccccaccacgaggaagacaagcuguuaucagcacuuccucugccaggcacugugcuaggagcuuccaugucuaacucugcuaaccuccccguggccagagggcugcuagcuguucugccuguucuacagggcaggaaugagagccagagagaaggcccagggacucugaccugcuuccuguaggccucccguggagccacuguggcugcucagacccacacucgagagcacaaacauguuuuucuaauaguccuuucugaauugugaggucacaugcaggugcaagggacagaaaucccacccugggccauguggaugcuucagccccugugggcuccagaucuggguguuggcaaaaaggcagcgggugaggucgugcugcuuaagucuuggaucuggggauggguugcaucucuuccuaaagagaucucucuaaggauggugcugcacuuuuuuuuaagagauaaggucuugccauggugcccaggcuggcuucauacucugggcucaagugauccuccugccucagccuccaaaguagcuggacgaguagcuagugccgcaccuuuuaggguuguugaggcuucugugcuuacccacugugaugguuucuuauuguauggggugccccuucuacagaaguucacauugucacauuacacuggggucucagaggccaagguuuuaaaaaugggagucuuuugguuuugguucucccacaugugagccuuuuucuggcucacugcuacucagacugcacguguuguagugaagauacagaccuaaucccaaaauaaugcucuucccaucacugcacacccggagauuuuuaaauaaucuucacugggccguccuguaagagaauaguugauaguggcuuugugggucauuuccucuuuguaauggauuauucucuagacacaauguugguuauuuucacuuaaguacaaccugacaguugcuucagugaggcuggccugcugucuuucuguuucuugccugaacucggguuguccugcauuuugucccgugagcuuggcacuucacuguccggaggagcguagggccgcugcacaccuggagauuuugguggggcacugcuuaaaucaugcagaugagaaccaguuucuggagaccuuggcacuagacgcccagcagagaagugccuuuuuugagacuuggaagacacaauaauuuuaaauugccuacagcagggguuggcaaauaguggugcaagggccacaucuggcuagcagccuauuuuugagaaugaaguuuuaugagaacccacacaucuguuuguagauugcuauggcugccuuugaguuacagcaguggagcugaguagcugugacagagacuauaugaccuacaaaaacuaaaaauauugguccuuuacagaaaaaguugucugaccccuggccuacuauuucaaauccuggguagguccuccacgucaguucuucauggaacuguauugccgagggaaaggcaguccccacacugugcagcccuccaugcugugcuccuggcuuucucugccauccugagccgcaggcuguggggcagcgcagcaccagcacugcagcugccagcucucccucagcuuccccugcccggggcaccggcccucuccauggugcugcccggagccaagaggcacaaccauuucugcucaauagcuucuccucuucuuucucucucugcucucuuuagccuucccaguagaccuuucccucuuuggcacaguuggaaacugcaguugauaaaugacuguggacuagugcgcguuuuuuguuuucagagcacacguaagguaaauaucuucccucucccugccccuucacuucccuuuccuggcccuucagcugagggaggagcagagcccauggcuccccaggcuggggggcauuuuucuccagggguguggggugggcgcucccuuccauccuucuggaagacaggaggggucaugagacuccuccacuguggaaaauggugcuuccuuccagcacagggugcuguaucgucccgggaaggugccucuuguucagcauaaugaccugggacccucggggccagaaauccacagccccagcuuccccgucucccagggaaggcaucuguuggcugaccaucugcuaaccagucgcuccuguuucugcucugauacuucccaaggcaucccgaagcaccugucuuagcugccccuuccugucccacagaggauuuggcacuugguuuugacaggauacuuuaccagcuuugauguuaauucuccuucccuugucuccuguaggguccagccacagcaggcccggcgucccgguggaaggcagcccugggcggaacccaggcguuuaacggcucacuaggcagccccagaucuggggaacagaugagcacguggggagcuggagugagcugagcagaaguuuugugcccgccugcccccauccccuccaggccacguuuuagauggcccuuguaguugcggguccuggguguccucagaacuagacaucaaugccuggauccuucagccggcccugcccuccuuuaggagacaggagucaccagggcacagcccuccaggcccgccucaggaaggaaugaaaggaaugccaucaucucuaguucccagggcccagccuuccccuucucccccggggcagggacagugcggcauauucagauucagaccucuuugggcugagccaccuugugagugcaguuacugccuuuguguggccgugaccucuauuuguuugcuuuuaauuugccaaccuaucgcugcuggcagcacuuuuugagcaagccgagagcacccauuuuggcuggggguucagaucgauggccuuguccauguuguccuuucuggcuucccugauggugucauguuucagcgcaugcgccccagccuuucccaugugccaaaccagaagcuccacugcccguaggcugucccuguagcccugcucccucccuggaggcugcucuucugauucugagagcuggccuaguggugcugagggccccuuucugcuucucugcccaccugcugaguugccacucgcaguguugucaguucccguguucugagaagaggucaugccugggaggaagggaucgucaugcugcaucgaauccucucuccgccguguggcccccaggagaguagcugccuguugcaccugcuccacaccuccccacagccucccugcaggugcuguguggccgugaugugcagagagcagugagggaggguucaugaaccagguggauccucuuuaaaaaaaaaaaaguuuuuguuauaucucuagaacauuucaagucuuuuccuuuuuuucuguuccuagcuaugggguuuuagagaagugggaacaggaaggcauuugucuuuuucuucuaguuuacuacauuuuccuuccguaguucuucagcuguguggaaacgggcaucacaaggacauaggaucauagauuggguagggagggaggaggauuucuggaacuuuucucaaaggaauuuggacccuuauaaaugggacugaaggucaaaacaacagugauauccuugcuuagaaauuguccucaaggaauaaacucugagagcaagcccggguuggaaacagaugcuuuaaaauccucucuccagaacagugguuuuuuguuuguuuauuugagauggagucucacucugucacccaggcuggagugcaguggugagaucuuggcucacugcaaccuccaccucccagguucaagccauucuccugucucagcccccugaguagcugggauuacaggugcccaccaccacacccggcuaauuuuuguauuuuuaguagagaugggguuucaccauguuggccaggcugaucuugaacuccugaccucaggugaucugccugccuuggccucccaaagugcugggauuauaggugugagcuaagaucagggauucuuaaccuuggcugcacaccagaaucaccuggcaaauuaaaaauacguggaccugccaccagagcuugugauuuaaucagagucggcaucagaguuuucaauuuuuuauuuauuuauuauuauuauuauuauuauuauuauuauugagacaagaucuugcucugucgcccagacuggagugcaguggugugaucacggcuugcugcagccucgaccucccugguucaggccauccugccaccucagccuccugaguaguagggacuacagguaggcaccaccacacccagcuaauacuuuuaauuuuuuuuuguagagauagggucucauuauguugccugggguagucucgaacuccuaggcucaagcgauccuccugccucggccucccaaaguguugagauuauaggcgugagccaccgugcccagauucacagaaguuucauacaccuuucacccagguuccccuaauguuaacagcuuacauauaaccuugguacauuuaucaaaacuaaaggugcaaucauacuaauagcuagaguuuauuuggauuuuaccauuuuucccaaugucccuuuucugcugcagcagccaauccaggaugccauacugcacuuagagcuguugcuuucuuuuuuccuaacuuuauauuuugaaauaauuucagaugauaggaaguuguaaagguaagggccccacgcacccuucaucuaguuucccuccaugguuacaucuuauaugguuguaaugcaguauuccaacaaagacucugacacuggugcgauguggguggacaguccaaaucauuugucacauguacaucuguguaacuaccacugcaaucaggauaaagaagucccauccccacaaggaucucccuccccaccuucccuaacuccugguaaccacuaaucguucaucucuucuuauuuugucauuucaagaauguuguauaaaugggagcauaguguguaagcauucgggauugucuuuuuucacucggcgucauucucgggagaucauccaggcauugcaugugucaacaguuugcuccuuuuuauugcugagugguauuccgugguguaugcauuggcccccugaaggacaccugggauguuuccaguuuggggcuauuccaaauaaagcugcuacgacuauucauguacagguuucugugucaggauuaguuuucg

SEQ ID NO: 12684 - RNA, 9504 nt, Homo sapiens
gaaccaaucuuaucugggcuuuagauccacgagcaaauagauuggguggccagggaauggagcuguggucauagcuaugguggcaguggcugugcuggaaaagaacggaccagugggaaagguacuacagaagaaccacacaaccuggugacugacagagugggagagacagggaagaggaaagcgucgauggauaaggcucuaaccugggaggcagggagccaguggugccaugaacagagcacugugggaagaacuggucuggagggugcccuaauauggaguucuccgugcaaauucugcuuucccuuugagggccagugcaagcauaacugccuugugaccacaaagccucacaaaacgccuuggcagacaggccucaguacucuccucacuccuaccucaucuccucaguccuggggcugcccucaccccccacaaaccccaacugccuacaacacacugcucuggucaccaucuuucuauggcuggccacccaucucccaggacacagcuaacaauccuccaugugccagcucaacccaccuuuuuuguucaucucacacaaugaccacagaccacugaccuuucccugcugacugggcauugggucccugccuuccucuccagacccacuggucccaggugcuucuuugggcucucacaucugcauagaaugccuuccccaucccuggauaaccucuggauccuugcaagucggccugccccaccugucgggccagaugacuaacgccucggcccccacaacucuguacuaaaauggcucaucugucuuucucccuugacguguguauuuguuagggcaaggauauaacuuguugaccauuggccccaaacacacggcaccauccuggaaacacuguagguucucaaacacuuaagaaaguaaagagcagacauucuccaaacccuaauuccucacugcucuucugccuauuccucuagggccuggcuaagcucacagccucucugccucucccugccuuccccauccugacuugucugaaggcgugagcuugcaucauugcugguguccaccagccuuagcccuggcugaauggggugagcagaggugcucaaauaggccuguccaggguccgggggcaaagaagguagccugguucuacuuccccugguggacugcagcaggggagguaacaggcgagggaauuaugcuacagggugagagcccagccuccugaggcuuuuugugccacguuggcgggccaaccacugaaaccuucaugccgcuaagcuagagccagugccuugcugcauucucucugguccuuucucugaaaguccccagggauggaagaacaaacgauagcacagagagccacaagaaaacagagccacacacugggccuuguccauaauuauuacuauaaugauuuacaaaaguuuuuuucaggcaaccguguuaaauuauuguacauaucugagagagggagguggggcccuggccacagcaaaagugacgaccucuuucuugggugagguaagaaaaugucccccacccccuuuuaggucugacuccuuauuaaguggcuuccccucaauaaaugaugagcaucaacccuuucccacccagggugccgaggguagagggaggagcaaguggaugaagugcucugaaaaggauagugcagcggcucuagccaccgugcauccucugcccuggcucugaagggccugacccugggcugcacccccuugcuggggauggaagaccauucaguacucagcccuacaccagggcaucuacccaggaagauaggaggacagagugugaaaggggcugugucacccugucaggucacgaacaggagguggcaauggaugcagugacacaccagugggagcugcuggcugccccuugcagcccacuccccaaacuggcuacccaggcauccaggcauucuggcccuggagcucagggaggcagcccugagagucggagcagggaaccacaggccuagcuggcccugccagggggauacccacaacagccugacauggcgcucaauucccacacgccagcucaaggcuccuguccaugcagcucaauguuacuugugugugcauguccuguguagaggggaaggcugcaggggggcacugcugugccacccacccagggguucagggcaugcaggggacccuaagccuaguauacgagccaagaccaaaaaggguuaaaggcucugucuccccucccucccccucucccaacaugccccgcccuccuugggcacuagaaaguuuugcgaugaauagcacgggagccauccucuucauacuccuuuuuggacacccacaucuucuuaaaaguguccagcgaggccaggauggagccgcuguggggauggagggauaguauugcuguggaccugucagggagccaaccaccuuccugggugcucagaguugcauuucccuaauuugggagggaaauccacccaccuccacguggccuaggccaacaaugggaggagcauccaggguaaaguggucuccucccagagcccucccuugagccccgccucacccaauccauguggaguacagccguuccugcggggcugagaucuagaaggaggaaguggccacguuaacuguggauccccacccagaagccauccucccagccuuggggucaccuuccccagguccugaagccugacagcaaaggcauaagcuggggaguggcagcagcagccuugggaagaacaggacuagguggacgugagcuggugagcgggucugggggcagcauucaaccuuccuccccaugccaaggcugccagcgcccuagugccccagggggaguuucuguaaccucaccuugauuuugauauccuuuggggcaagcuucuucacuucacugaguaaucggucuccgaagccugugaacacaaagcuggcugagccuggggucugcacccggccuccucgcugcuagcucccgcacccagccuucagggcccccagcuacugcugguccucuaucagcagcucuucccaggaugaagggcaaggcugagaaaugauccagccccauggcugccugcgggcccugcguccucacagaggcagcgugagaugaagccgcacaugcuccuugcucgacucucacaauacacuuuagagcuuguguaaacuucuccucuauucacagaguaaacaaaauuuaauuuuaaauuuuggucuguuaaaaaaaauguucauugagcaccaccaaaaagccaacagaauauggcucuggguagggguauacucucugaggguccagcugcccugggccucgucucaccaccaccaacucucaagccacaguaccuuugaaaagcguugagccaccugagagcacgauguuggcgaacagcguccggcgcagguccaugucggacuuguguauggcgaaggccaccaccucauggagccccucacucucauccccgacaagguccggcuggaacagcagcucgggggcccggaaucgugcaggccccaccuuuaguguacaagauugaggcagacaggcuuccuggagaagcgggcuaccccuucccccaggcugggcaucggcugccacuccagugccaggcccggccacuuacaucaagcgugcugccgucuggcaacguguacugcaccuucuccgucuccagagccucauccuucuguggguugauggacagguagcacgcucgcugcggggacagggacacagcccucagaaggcugcaccugggacaccugugccuuggugccacccuuuccucaccccaggucguguccacacccucucgccccuugucaccucuuugauuguccggacaaccucaaacucagccgagguauggaagucaaccccuuccuugcgcagcaggagucggagguagcgggagacgucgcggccggcaauguccacccgcaugauggagugaggcauggcaaagcccucauagaugggcacagcaugagugaccccguccccugagucuagaaccacuccugucgugcguccuguugcguaccugucaccaggucagcauccccucaccucagccacugaggcacggggaccuccucacccaggggaggaacccuggcacaucugcauuaucuagucugaagagaggacacgagggacucccuagaggaacagucaucaaggggcuguuuuuccagggaagucagacccuggucauggcaagcaggacggcacagggaggacaggacucagggaggccaggcuuagggagcacucacagacugagcacagccugcauggagaugaacagggccggcacguugaaggucucaaagaacaccucugccgccuucucccgguucuuacucggguugagcggggccuccgugaggagcacaggaugcugcgagggacgggacaguuguaggcaucagaggaggcaacuugcaaggcccuaaaaggcucuuuccagagaaccacacccgcuggcgcacaggcagcucagccuccuaccccuccugagggccccaucccuuuaucugcuggcaguuacucuuccggagauccggcucucuuuggaagauucugccuagcagccacuggguacguaugcgcacccagacacacacggaaaggcagcaggcccucuagaaauguagaagggaaaugugggagcccggcgaggagggacgcagaggagaggggcauggccaggagaaugcagagcaugcaggaggggcagccgccacaccuccuccgagaaggucugcagcugauccuuggaguagacguacugccagaugcguuccaugucguuccagucucgcaccacgccgugcuccaugggguagcggauggucagcagcccccggugcuccugguggggugggaagggagguguggcacccggcccuugcucagcggcugcuuuccgcccuccuggaagcugacccucaccugcccugaccagaaccucaccugcccugaccagaaccaccccugcucacugggugucccagggucuguggcggguccugaacucagcaugggcucaccugcccaccagcuucuuaggcucuuagagcccagcuagcuucagcuggggggaucagagaggguggcagugugccccgcaaucugcaggcucucuucuuccccauucucacugccggcacaucccccacauucuccucacacucugccagcuccccucuggccagcgccggcaccuugcagccgcccaacacggccccuccugggccaccugugcccccugaccuacgccucuccccccagcccuuuggccgguccucaccaguccccuguuugcacugacaugcugccuccaccugcccuucgauguccccccagccaugccccuucucaccuagcaccacuuagcuccucucaccaccucggcuccuacggaccccaucugcgagacccccacccucugcaccuccagcucaggccuccccuuucugggcccagaaccacgcaugccccacgccccggcacccgacacaaugcuccucaggcgccuaaacugcccuuggccaagcucagcuugcugcucuccccacacccacacaugcucuccugagggucugaucaggccaugcagccccuuggugggacacuccggcuucacugugagaggcggccccauggcccucauuagagcagacgugaagugugugugauucugacucuuauaucacuuuuugaucaguucuugguucuguagcuuccaaauagcuucuaaaagacaggacacgaugagcucuacccaugcucccuagaagaggaacugcugccccaucucagggggaggugccccugcacagcacuucccagcuggagccuggaggagguacccgggaggucaccagcagaggcccaagaacacaugccauguuccugcaacugaggaccccacccccagggaaaggcaggcuccucgguguuaccucugcuuuugguccgaugaagaggucccccuccagggcuccagccaucacccgcaugugcuucggccgcccgacacuguuaggacggauaacgucagcaaggugggcagggagcauggcagagcuuguguccagaaaaaccgaaauccaaccauagucgcccagaggguaccuggccuccaaacaccaggauguggcuggggggcacagguuggaacuggggccuaugggguucggggcuagagagggggccuaggcaggacgagaagcucagggucagaaggcacggucagcagagacagcugcaugucugagcgccagaacccagcccuccauggcccagcccuugcagagggucggcuuccugcagccacagugacucagcccacgcuccugacuucgguggggcagggcugccgucaccauccacagacugagggaggacaaccccaggaagcugggucggggcucccuugugcacccugcucucacucagucaagcgcccuaccccacugccagcgcuucuggaucagagauucaguucuuggaaacuauaggaucugaugagcuaccacuaaaggcaaaggaaccucuaauuauacccaugcagucagaaaggaaugcugaagcucgacagggcgcaccaugcuagcucugucccagaccaggccgggcucgggcuagccugccacucggggccuaggauccccugcugcccgcugccuuuaggccacucauuccaaagccuccaggauuugugaagaggugccccuaagggcaacuuucccaaugggcucguggugggugcaaggggcaccccaggcucucuggguuugcaauucuuauucccgcccccaccaguaccauacagggcaaaggauccccucuuaacugaaacaagacauuuucuagagucugaaaacaagcccggcagaaaacacuuccagggaggaaaggguggcugugcaucuaauuccucacucuuccugcuccgaguuuagggcuccccucggagaugucucccuuuauucuugcugcugcuaccacaccccauccccagggaaaugcugguugcuuuuccuccuugcuggcucaacaagaccaaaacgagagacucccaagacaaaggggaacccuagaacgcuugucuuguucuuucagugcucucucaagagugucaaccucacaaauuugguguuuuccauacaggucagggcacaaauugucuucaaagagcccugugacagaaggccaauguucuuacagaagguaaacaaaaggacuaaggcugcugccugagccacacuuacuaguuugggaaacaguauuugggaaucuggucuccugcaaagccagcuuuaaucacccccgaacccugcaaggaaaaacaaaguugagcugcccacaugcaccaccagaugaagccagucccccgcaauggagagagcuggcugccccgucaaggcaggccaaggaggaagccagggacccugccaggaucauuuacaaguacaccuaugguucaagauugggggcaauuuuguaucccccugcucuggcaacauuuggcaaugucuggcagcuggggagaggggacaugcagugggggaugcuauuggcaucuagugggcagaggccaaggaugcugcucaacauccuacgaugcacaggcgagccugcacuaccaacaaggagcuagcccagaaugucaauaauauagagauagagaaaccacgaagggcaccuuccucugcacaacuaaugguuggcuccagcaggauuccauagcacaugcuacucccaaaagcuagaagaaaccccucugugugggucuuuuuuuuuuuuuuucaacagcuuccuucucccccaagaacccagaaggcauggaacauggacgaccuacagggccugcuggagaagaccaaugggugcaugggaugaccggcagcuucccucaaguggcuucccagagacuacuaggagaacuugguccuaucgcugcccccaccuggaagcuggacuuaaggaucccccaaagaacggggcaauuagaaaccucccacccagcgaagggauaagcuucucaacucagucccaccacucuucaucgcaacccucugagucugcagcagaaacaaacaucuccaaguuacagaggaggggauggaauccccaaggggccgagcgguagcccuuuuaacuuauaagccuguugauuagccuauacgaguuauuugcacgucaagaaaggaaguagccugcuccuuccugcagcguccugcuggugugacagcacguccccaagcucagugcuaaccuccuuauuaaacauccccugcugugacucagggaacccacauggguacucuaaaacagucauucagggaccccacggggucaugugggagggagacagaucccagaaagagcacaagugagucauuaccaaaaacuccaaggcccgcacaccggacgcacauacccagcuaggggcagacucaaagaucccagcccuuaucuucuccccauaucagagcucggaagccagaaaucuuccuaaggcaggugaaagcaagccgagccccacugcugaaggacaaagccacaggaagccugaugacaucuuuccucugaggcuuccaaacgaucaccccaaauugcuugcugauacugggaagaguggccaugaacucuccauugcucugcuggcuguggaauguuugcucagcacaggaagcauuuaaggagaaagucaaaguagccaaaaggcaaaccagauggugguggacaugugggugacagagcauccugcauuuguugccucggggugcagccccaaagauaaagccagcagugugcaaaugacaaaugcuaccccaccuccgccaggcagccagagccagggccgaaggacgcggaaaggaacugguguggaaaccugcccaggaaccgcacucucaacugagaagaguccggggcgcguccccgcccggccgcccggcugucacucaagcucuccugaacuuccccgcccgacucggggaggggucggggaagaggcucugcgacgcgggcgagggggcucgccccauggccggccuuacaaggccaagagggcgcgcgcccccggggcgaagccagcggcccggcgggggcgacggccacgcagugagcggaggacgcgccgaggcgggcgggggucucucccugcgccgccgcgugcgcccccgggggcggggcgcccgcccucccccuggcugccgggccucacguugucgaugaccacaggcugguuggcgaugaugucguaggacuccauggccgggccgcgccggcccugcccagcaggcgggcugcaggaggcaccggaugggcgggcgggcgggaggaccgggacggcggcggcucccgacgcggcgccgcugcccucccuccccgagccugcagccuacgcgagccccgcggggcuuucuggagggcgggcccggcggccaaucaucgcucccaccugg

SEQ ID NO: 12685 - RNA, 9504 nt, Homo sapiens
ccaggugggagcgaugauuggccgccgggcccgcccuccagaaagccccgcggggcucgcguaggcugcaggcucggggagggagggcagcggcgccgcgucgggagccgccgccgucccgguccucccgcccgcccgcccauccggugccuccugcagcccgccugcugggcagggccggcgcggcccggccauggaguccuacgacaucaucgccaaccagccuguggucaucgacaacgugaggcccggcagccagggggagggcgggcgccccgcccccgggggcgcacgcggcggcgcagggagagacccccgcccgccucggcgcguccuccgcucacugcguggccgucgcccccgccgggccgcuggcuucgccccgggggcgcgcgcccucuuggccuuguaaggccggccauggggcgagcccccucgcccgcgucgcagagccucuuccccgaccccuccccgagucgggcggggaaguucaggagagcuugagugacagccgggcggccgggcggggacgcgccccggacucuucucaguugagagugcgguuccugggcagguuuccacaccaguuccuuuccgcguccuucggcccuggcucuggcugccuggcggaggugggguagcauuugucauuugcacacugcuggcuuuaucuuuggggcugcaccccgaggcaacaaaugcaggaugcucugucacccacauguccaccaccaucugguuugccuuuuggcuacuuugacuuucuccuuaaaugcuuccugugcugagcaaacauuccacagccagcagagcaauggagaguucauggccacucuucccaguaucagcaagcaauuuggggugaucguuuggaagccucagaggaaagaugucaucaggcuuccuguggcuuuguccuucagcaguggggcucggcuugcuuucaccugccuuaggaagauuucuggcuuccgagcucugauauggggagaagauaagggcugggaucuuugagucugccccuagcuggguaugugcguccggugugcgggccuuggaguuuuugguaaugacucacuugugcucuuucugggaucugucucccucccacaugaccccguggggucccugaaugacuguuuuagaguacccauguggguucccugagucacagcaggggauguuuaauaaggagguuagcacugagcuuggggacgugcugucacaccagcaggacgcugcaggaaggagcaggcuacuuccuuucuugacgugcaaauaacucguauaggcuaaucaacaggcuuauaaguuaaaagggcuaccgcucggccccuuggggauuccauccccuccucuguaacuuggagauguuuguuucugcugcagacucagaggguugcgaugaagaguggugggacugaguugagaagcuuaucccuucgcugggugggagguuucuaauugccccguucuuugggggauccuuaaguccagcuuccaggugggggcagcgauaggaccaaguucuccuaguagucucugggaagccacuugagggaagcugccggucaucccaugcacccauuggucuucuccagcaggcccuguaggucguccauguuccaugccuucuggguucuugggggagaaggaagcuguugaaaaaaaaaaaaaaagacccacacagagggguuucuucuagcuuuugggaguagcaugugcuauggaauccugcuggagccaaccauuaguugugcagaggaaggugcccuucgugguuucucuaucucuauauuauugacauucugggcuagcuccuuguugguagugcaggcucgccugugcaucguaggauguugagcagcauccuuggccucugcccacuagaugccaauagcaucccccacugcauguccccucuccccagcugccagacauugccaaauguugccagagcagggggauacaaaauugcccccaaucuugaaccauagguguacuuguaaaugauccuggcagggucccuggcuuccuccuuggccugccuugacggggcagccagcucucuccauugcgggggacuggcuucaucugguggugcaugugggcagcucaacuuuguuuuuccuugcaggguucgggggugauuaaagcuggcuuugcaggagaccagauucccaaauacuguuucccaaacuaguaaguguggcucaggcagcagccuuaguccuuuuguuuaccuucuguaagaacauuggccuucugucacagggcucuuugaagacaauuugugcccugaccuguauggaaaacaccaaauuugugagguugacacucuugagagagcacugaaagaacaagacaagcguucuaggguuccccuuugucuugggagucucucguuuuggucuuguugagccagcaaggaggaaaagcaaccagcauuucccuggggauggggugugguagcagcagcaagaauaaagggagacaucuccgaggggagcccuaaacucggagcaggaagagugaggaauuagaugcacagccacccuuuccucccuggaaguguuuucugccgggcuuguuuucagacucuagaaaaugucuuguuucaguuaagaggggauccuuugcccuguaugguacuggugggggcgggaauaagaauugcaaacccagagagccuggggugccccuugcacccaccacgagcccauugggaaaguugcccuuaggggcaccucuucacaaauccuggaggcuuuggaaugaguggccuaaaggcagcgggcagcaggggauccuaggccccgaguggcaggcuagcccgagcccggccuggucugggacagagcuagcauggugcgcccugucgagcuucagcauuccuuucugacugcauggguauaauuagagguuccuuugccuuuagugguagcucaucagauccuauaguuuccaagaacugaaucucugauccagaagcgcuggcagugggguagggcgcuugacugagugagagcagggugcacaagggagccccgacccagcuuccugggguuguccucccucagucuguggauggugacggcagcccugccccaccgaagucaggagcgugggcugagucacuguggcugcaggaagccgacccucugcaagggcugggccauggagggcuggguucuggcgcucagacaugcagcugucucugcugaccgugccuucugacccugagcuucucguccugccuaggcccccucucuagccccgaaccccauaggccccaguuccaaccugugccccccagccacauccugguguuuggaggccagguacccucugggcgacuaugguuggauuucgguuuuucuggacacaagcucugccaugcucccugcccaccuugcugacguuauccguccuaacagugucgggcggccgaagcacaugcgggugauggcuggagcccuggagggggaccucuucaucggaccaaaagcagagguaacaccgaggagccugccuuucccugggggugggguccucaguugcaggaacauggcauguguucuugggccucugcuggugaccucccggguaccuccuccaggcuccagcugggaagugcugugcaggggcaccucccccugagauggggcagcaguuccucuucuagggagcauggguagagcucaucguguccugucuuuuagaagcuauuuggaagcuacagaaccaagaacugaucaaaaagugauauaagagucagaaucacacacacuucacgucugcucuaaugagggccauggggccgccucucacagugaagccggagugucccaccaaggggcugcauggccugaucagacccucaggagagcauguguggguguggggagagcagcaagcugagcuuggccaagggcaguuuaggcgccugaggagcauugugucgggugccggggcguggggcaugcgugguucugggcccagaaaggggaggccugagcuggaggugcagagggugggggucucgcagaugggguccguaggagccgagguggugagaggagcuaaguggugcuaggugagaaggggcauggcuggggggacaucgaagggcagguggaggcagcaugucagugcaaacaggggacuggugaggaccggccaaagggcuggggggagaggcguaggucagggggcacagguggcccaggaggggccguguugggcggcugcaaggugccggcgcuggccagaggggagcuggcagagugugaggagaaugugggggaugugccggcagugagaauggggaagaagagagccugcagauugcggggcacacugccacccucucugauccccccagcugaagcuagcugggcucuaagagccuaagaagcuggugggcaggugagcccaugcugaguucaggacccgccacagacccugggacacccagugagcaggggugguucuggucagggcaggugagguucuggucagggcaggugagggucagcuuccaggagggcggaaagcagccgcugagcaagggccgggugccacaccucccuucccaccccaccaggagcaccgggggcugcugaccauccgcuaccccauggagcacggcguggugcgagacuggaacgacauggaacgcaucuggcaguacgucuacuccaaggaucagcugcagaccuucucggaggagguguggcggcugccccuccugcaugcucugcauucuccuggccaugccccucuccucugcgucccuccucgccgggcucccacauuucccuucuacauuucuagagggccugcugccuuuccgugugugucugggugcgcauacguacccaguggcugcuaggcagaaucuuccaaagagagccggaucuccggaagaguaacugccagcagauaaagggauggggcccucaggagggguaggaggcugagcugccugugcgccagcgggugugguucucuggaaagagccuuuuagggccuugcaaguugccuccucugaugccuacaacugucccgucccucgcagcauccugugcuccucacggaggccccgcucaacccgaguaagaaccgggagaaggcggcagagguguucuuugagaccuucaacgugccggcccuguucaucuccaugcaggcugugcucagucugugagugcucccuaagccuggccucccugaguccuguccucccugugccguccugcuugccaugaccagggucugacuucccuggaaaaacagccccuugaugacuguuccucuagggagucccucguguccucucuucagacuagauaaugcagaugugccaggguuccuccccugggugaggagguccccgugccucaguggcugaggugaggggaugcugaccuggugacagguacgcaacaggacgcacgacaggagugguucuagacucaggggacggggucacucaugcugugcccaucuaugagggcuuugccaugccucacuccaucaugcggguggacauugccggccgcgacgucucccgcuaccuccgacuccugcugcgcaaggaagggguugacuuccauaccucggcugaguuugagguuguccggacaaucaaagaggugacaaggggcgagaggguguggacacgaccuggggugaggaaaggguggcaccaaggcacaggugucccaggugcagccuucugagggcugugucccuguccccgcagcgagcgugcuaccuguccaucaacccacagaaggaugaggcucuggagacggagaaggugcaguacacguugccagacggcagcacgcuugauguaaguggccgggccuggcacuggaguggcagccgaugcccagccugggggaagggguagcccgcuucuccaggaagccugucugccucaaucuuguacacuaaagguggggccugcacgauuccgggcccccgagcugcuguuccagccggaccuugucggggaugagagugaggggcuccaugaggugguggccuucgccauacacaaguccgacauggaccugcgccggacgcuguucgccaacaucgugcucucagguggcucaacgcuuuucaaagguacuguggcuugagaguuggugguggugagacgaggcccagggcagcuggacccucagagaguauaccccuacccagagccauauucuguuggcuuuuugguggugcucaaugaacauuuuuuuuaacagaccaaaauuuaaaauuaaauuuuguuuacucugugaauagaggagaaguuuacacaagcucuaaaguguauugugagagucgagcaaggagcaugugcggcuucaucucacgcugccucugugaggacgcagggcccgcaggcagccauggggcuggaucauuucucagccuugcccuucauccugggaagagcugcugauagaggaccagcaguagcugggggcccugaaggcugggugcgggagcuagcagcgaggaggccgggugcagaccccaggcucagccagcuuuguguucacaggcuucggagaccgauuacucagugaagugaagaagcuugccccaaaggauaucaaaaucaaggugagguuacagaaacucccccuggggcacuagggcgcuggcagccuuggcauggggaggaagguugaaugcugcccccagacccgcucaccagcucacguccaccuaguccuguucuucccaaggcugcugcugccacuccccagcuuaugccuuugcugucaggcuucaggaccuggggaaggugaccccaaggcugggaggauggcuucuggguggggauccacaguuaacguggccacuuccuccuucuagaucucagccccgcaggaacggcuguacuccacauggauugggugaggcggggcucaagggagggcucugggaggagaccacuuuacccuggaugcuccucccauuguuggccuaggccacguggagguggguggauuucccucccaaauuagggaaaugcaacucugagcacccaggaaggugguuggcucccugacagguccacagcaauacuaucccuccauccccacagcggcuccauccuggccucgcuggacacuuuuaagaagauguggguguccaaaaaggaguaugaagaggauggcucccgugcuauucaucgcaaaacuuucuagugcccaaggagggcggggcauguugggagagggggagggaggggagacagagccuuuaacccuuuuuggucuuggcucguauacuaggcuuaggguccccugcaugcccugaaccccuggguggguggcacagcagugccccccugcagccuuccccucuacacaggacaugcacacacaaguaacauugagcugcauggacaggagccuugagcuggcgugugggaauugagcgccaugucaggcuguuguggguaucccccuggcagggccagcuaggccugugguucccugcuccgacucucagggcugccucccugagcuccagggccagaaugccuggaugccuggguagccaguuuggggagugggcugcaaggggcagccagcagcucccacuggugugucacugcauccauugccaccuccuguucgugaccugacagggugacacagccccuuucacacucuguccuccuaucuuccuggguagaugcccugguguagggcugaguacugaauggucuuccauccccagcaagggggugcagcccagggucaggcccuucagagccagggcagaggaugcacgguggcuagagccgcugcacuauccuuuucagagcacuucauccacuugcuccucccucuacccucggcacccugggugggaaaggguugaugcucaucauuuauugaggggaagccacuuaauaaggagucagaccuaaaagggggugggggacauuuucuuaccucacccaagaaagaggucgucacuuuugcuguggccagggccccaccucccucucucagauauguacaauaauuuaacacgguugccugaaaaaaacuuuuguaaaucauuauaguaauaauuauggacaaggcccaguguguggcucuguuuucuuguggcucucugugcuaucguuuguucuuccaucccuggggacuuucagagaaaggaccagagagaaugcagcaaggcacuggcucuagcuuagcggcaugaagguuucagugguuggcccgccaacguggcacaaaaagccucaggaggcugggcucucacccuguagcauaauucccucgccuguuaccuccccugcugcaguccaccaggggaaguagaaccaggcuaccuucuuugcccccggacccuggacaggccuauuugagcaccucugcucaccccauucagccagggcuaaggcugguggacaccagcaaugaugcaagcucacgccuucagacaagucaggauggggaaggcagggagaggcagagaggcugugagcuuagccaggcccuagaggaauaggcagaagagcagugaggaauuaggguuuggagaaugucugcucuuuacuuucuuaaguguuugagaaccuacaguguuuccaggauggugccguguguuuggggccaauggucaacaaguuauauccuugcccuaacaaauacacacgucaagggagaaagacagaugagccauuuuaguacagaguugugggggccgaggcguuagucaucuggcccgacagguggggcaggccgacuugcaaggauccagagguuauccagggauggggaaggcauucuaugcagaugugagagcccaaagaagcaccugggaccagugggucuggagaggaaggcagggacccaaugcccagucagcagggaaaggucaguggucuguggucauugugugagaugaacaaaaaagguggguugagcuggcacauggaggauuguuagcuguguccugggagauggguggccagccauagaaagauggugaccagagcaguguguuguaggcaguugggguuuguggggggugagggcagccccaggacugaggagaugagguaggagugaggagaguacugaggccugucugccaaggcguuuugugaggcuuuguggucacaaggcaguuaugcuugcacuggcccucaaagggaaagcagaauuugcacggagaacuccauauuagggcacccuccagaccaguucuucccacagugcucuguucauggcaccacuggcucccugccucccagguuagagccuuauccaucgacgcuuuccucuucccugucucucccacucugucagucaccagguugugugguucuucuguaguaccuuucccacugguccguucuuuuccagcacagccacugccaccauagcuaugaccacagcuccauucccuggccacccaaucuauuugcucguggaucuaaagcccagauaagauugguuc

SEQ ID NO: 12686 - RNA, 10178 nt, Homo sapiens
gucgguucccgugacgcggcgcgccccaagggccggcuccguugagggaagggaagcccgcccgguggcggcuggggucggcugcugggaggagguggugggcugguucggacgugggucgaggcuguagcaggacuccaggugaggccugaggaccacucugcccucccgcggcccgggcucgcgccgggggccauuuaaucccgacagcuugcggccugacgucgcugcggccuggcagugaccaugucggcguccggccccucggccggcgauagaguugcggcuaaaaugaaaggacgcccaguuacauuugcaucguagauaaagaaagagcauuuaguauaagcauguccgaaauguugcgugggauguaggcauacuaaaaccuuauucguggccugucugaaauccaaauggagcuggguauucuguguuuuuauuugcuaaaucuggcagccguacccgcggccccgggcagggagggagcagcugggcucggccagacccugccggcgucuggggggccugcgaaguggaggggagacgggcagccgggcaguggccggcguuccccggagcucggaccgguuggauuggacuccgacgcuaccgcucccucugcugaacuauuccggauguaaaacacuagggaucggaguuuuucuugguuuuuuaaucucauucuagugaccgagaagcuugcuggcagugcgcugauggaucugugugaauaggccauuuauuugaccucuucaguaacacuguucuaaccggcugaaacugcuuucuuaggcauuuucuuaaaagcuuggugguuaagagcacggaauuucgagucagauuuccaaucuuggcucuaucacuauccucggagucauggggcagucacaucaucccugucucuguaaugguagcugccccuggauaaguguuauuaggugauucagaagggugggcuguugcccuugccugagguugcagucugcgguucccaagccccaagacccgccucagaacuaacugcauuugcuuuugacuccuggccuuucucuaggguugggaagaacauggaaagugaccucccugccaaauaacucagaagaggagugucgguagccaaauguuucuucagaauacguguaaaagaaauguuuuucuuccaucuaggaagauguuaccgaguacuucagugaauuccuuagugcaggggaacggagucuugaauuccagggaugcggcaagacacacagccggagcgaaacgcuacaaauaucugagaaggcuuuuccgcuuucggcaaauggacuuugaauuugcugccuggcagaugcucuaccuguucacauccccacagagaguuuacagaaauuuucauuaucgaaaacagacgaaggaccagugggccagagaugacccugcuuucuugguccuguuaaguaucuggcucugugguaaguguguuuaucugagauagaauugaacgcugaguguuucugauuagauuuuuuguuauaaauguguugugggucagaaucuggaaauauuggaaacuauuucuccuuuuuacugaagccucaaaaaaucucacaggaaagaaaguuguagucuugguucuacaggucccaagcagaugccagaguaaacuguuacccuaggacauugaaaagcaggggacaagauucacuccauaucuuuuuaaguacuugaaucgguacccaaaugucagcugacugugaauaggaauaugaaacuggaaauugcauuucacaggcaaauccacagugagaauuguaaagguauugaugggaaccugagaaacugaaguucuccaauuccauaaugcaagggucucauuuaccuguaggguguugaaguggguaagauauugaaguuuauaggguguuuugcaccuuaacuggacuuaaacuauguuagugccuucucuacacuggcguucuaaauacugaggccaccguggugaaucagccuggcaagggcccaccucaggaaacuucaacucucucaguggccacgcugugucccaagguaguguucacacaucuugggaguuuuguuuaaagaccugucucucccacuagccugggcaucuggagggcaagggauguguccuguauuuccagaaccuagcagagucccuaaaugaaucuugugaaucuuucuuucaguguccacuauaggauuuggcuuugugcuggacaugggauucuuugagacaauaaagcuucuccuuuggguuguacucauagauuguguaggcguuggucuucugauagcaacuuuaaugugguaaguaccauaacuuugguuuuucagauacugcuguagcaucuccauuuguuugcuucagagguacaauagcagcagauggaaauugaaacccagguagaguuacuaaaugaucaauuuugacugccaagauuauuacaauuuucccuccuguguugccaccuauaucagaaaauacuauaaaggcugguuuauaauauugucaaauguagcaaauaauugaaauaauuauguuuugaacccaaaauaucugagaucggucucaauuuagaaaguuuaguuugccaaaguuaaggacaugccugugacacagccuuaggagguccugaugacaugugcccaagguggucggggcacagcuugcucuuauacauuuuagggagacuugagacaucagucaauauguguaaaauguacauuguuuuaauccagaaaguggggaaaggcagguuacaguuagauaagagacaaaugguugcauucuuuugagucuuugaucugccuuucacugaauacacaauuuacuugugagaggcagguacaggaauagucauuuaugccuuaaucuggcucagugagucugcauuuuuacauaaacaauggggcagaggaagcaaucagauaaacacuugucucaggugaguagaaggaggacuuucugucccacaccuguaaagauaagcuaucuuaggaauaaaauaggaggcaaguuugccugacacaguuaccagcuugacuuuucccuuuggcuuagugauuuuggggucccgagauuuauuuucugcauacuaacaaaaugccugguuuugcaaaaauauuacagauuuagccaguucugcuuaaguugucuggaugauagcaugguuuucugcauuugucaauagagaccacuucuugauauucauuguguuuaaauccauuuagaucuaaaggguuauuuuguggagucuuacuuugaaucuuugcauuaaaugaaguauacuugaaaaagaaggauuuuuuuuuuaaacuucucaugccuuccuacugagaauaaaauucucucucuuucucucauacacacacacccuccgccccccccgcccccccaccgccacacacacacacgggcuuuaucagaaggguucucagucugacuuugguugauuuagcaacagcaguguacugaggauaaaucugguguuugguaaaguccuccugugugguuggcaugcuggaugaagggcaggggauguggcuagcgaucucaguagaggaccagugguuggguagacaugguggucauuguggagaacauuuuaguugcagagagaccuggguucaaaugccaacuuaguuaucugugaaacucuuagucccagucucuucuuuuacaaaaucuaguuaauuaccuauucuguccaauuuuugagauaauuauguuaugaaaauuaccugacacaguuaaguguucaauauuugguaguuacuaauauuuuaagcaaaacucugcaacuauaacuucugauaccagccuuuuuuuuuuuuucuuugagacgaagucccacucugucacccaggcuggagugcaauggugugaucucagcucacugcaaccuccgccucccggguucaagcgaaucuccugccucagccuucugaguagcugggauuacaggcacacaccaccacacuuggcuaauuuucauacuuuuaguagagacaggguuuugccauuuggccaggcuggucucaaacuccugaccucaggugauccucccgccucagccucccaaagugcugggauuacaggcgugagccaccgcgcccagccaauaccacccuuuuacaggcauaguucagauaugcuaguuccauuccagauacugcaguaaagcaaauaucacaauaaacugagucacacagauguguugguucccagugcauauuaaaaucauauuuacacuguacuguagucuuuuaaguguacaauagcacuauggcucuaaaaaacaauguacagacuaauuuaaaaugcuuuauugcuuaaaaaugcugacacagagacaugaagugggcauaugcugcuggaaaaauggcacaggcagacuugcuggacacaguugccacaaaccuucaauacguaaaaauuuaaaaacuacaguuucugugaagcgcaguacagugcagugugguaaaaugacauaugccuguauuuuccuuuguaacuucugacuaguacagcagagcuuuuguaugugcuaguuagccaauaaaugcuguccacuguuaauauaaaauucuaaaaucuggccuagaauuaauacuaauguaagucacguauucauuaccaagaaauucaugaaaaacaaaugguguguuuuaaaauuucaauaaauaagacuuucaaaggaauaguuucauucauaacaagcauucugcccugaaugcaguaauucuggaggccacugucuuagucuguucucaaugcugcuauaaagaaauaucugagacuggguaauuuauaaaggaaaaagguuuaauugacucacaguucugcauugcuagguaggccucaggaaacuuauaaucauggcagaaggcaaaggagaagcaggcaccuuccucacaggguggcgggauggagugaguacaagugggggaaaugccaaaugcuuauaaaaccaucagaucuugugagacucacugacuaucacgagaacagcaugggggaaauuacguccaucuggccccacccuugacacguggggauucuggggauugcuguucaagaugagauuuuggggacacagccaaacaauaucaggcacagaaggggaccaaaucagccuggaguuuagcacauuucaugugagucuguaucauaguuugaauuaaauagaaagggauucaguguauuuuugagaaccuauguugugugaggaacuagaaagagaaaugacuacauguaaugaugaccaucacagaggagcuacagaagccagcauaagguggugguuuguggagauggggaauaguugacuccuggugcugggaauugcaagugcaauggcauagaggugugaacagcacacuaggucugggagcauagggugacaccgagucacuggggaagagaugugacuagagaaauuggccuucaugccauucaggaaaaaaauuggacuuuaucucauagacugcauguguggguugggggcaaaaggagguggggagcuuugaggcuuuaaaguaaggaaauaaugucaaacucacacuaucuuuuccauggcaguggaggaggcaaaaguuggaguagugagugggcaaggcuggauacacuugcagaggucugcguaggaguagaggaggcccagauaguaugguggugauaggaauagagaggagagauggauucgagagcuuccugagauaacaagguaugaggggggaucaggaagagggagugggugggaggcuccuuugggaugaccuguaagauuuuggcuuagaugacugaggaagcagcagaugcagaugaagcagcccuugcuggccuguugaguucagggagcuuccugaagagugaaaagaaggucaguagacacugagguugaugacucuagaccuagaggcaagagucugggccaugaugagccucugacuggcguuaauauggagcugggaggugaaaaccacagugccuuggagugcucucggaaggcacaucugucuuucagaggaaagacucucacugaggccagaagcuugaaaagcgcccauuugggauaagcgggagaauaggggcagcagagaacgucuacagaaagggcgcucuuggggagcgagcuacauacugauuccauaaaauuugaauggcacacauucuuggcuaaaaaggaaacugucuugguaagcucuaguuuguucaguauuguuuuggcauuuucagauaacgaaaugcagggacuguuaacauuaguauuguaccucuguuuauuuuccauuuuuauccccagugacggaauagcguauucuuaauuguacccuugagaugaaaugaaauaauacauuaaaaaauacauugaauuuccaauauauguuuauaauacaaguuuuguucuuugaagaucuuacuuuucuguuacuuggauauuuuacuuuuuauucaucauugaacugaaaaacuaguaggccauguuguagaacagugacauacacuugaauaauuguucuuauggcuggaugcgucacucuuccuaacugcuucuuacuauuucauccuccuuuuaauaggggguugacccaggucuugggccuugggccuguucauuauccacauucauuuuuuuggugacaucauucaggcccguggcuuuaaauauuaauaucaucuacacacugaugaguuuauauuuccaguuuggacuugucuucuaaacucuagacauuguauacaacuucuuacuccauacuaguuggcaucuucaacauaacagguccaaauucaaacuuccgcacacuccuucccaccucaaaaccacucuucccacagccagccccaccucaauuaaaggcagcuccaucuuccauuuguucaaggcagaaaucucucagucauccuugaguauuuuuuucucauacuccaauccaauaaugucaggagcucuaccuucagaguaucgugugugccacaucuuagcaccuccacugccaccagccccucugcucaucucuuccuugcaguagccuucuaacuggucucugcugccagucuugucucuggagucuguucucagauccgccaccagggaggcucugucaaggcauuuaagucaaauacuuuucucagaacuccacaguggcuucucacgucaccaggaauaaaagccaaagauuguaaaacggccacaggcuucguaagacauggagccugugugacuugauguugggcccaacccuguuucuuuucuggcuucauuucuugcuccuuuucuuucagacacuggucuuuucaccauuccucaggccugccaggcaccaucacuauccuugggucuuuacccaaauguuacuuuaugacccucauauguacaauugcaucucaaguuuguauucuccacauuucucugcugcuuucucucuuuccauaauaccaucugacauagguguaucauugucagccuuccuuccuagauggaaggcagggauuuuugucuguuuuguuuacugguauaucuccagaauuuagaaugucugccgcauagaaagucgucaguaaacauuuacagaauucauuuuauuaugaaagaaauuuuaauuuugcucuuagguucaucucuaacaaguauuuagugaaacgacagagcagagacuaugauguggaauggggcuaugcuuuugaugugcaucucaaugcuuuuuauccacuccuggucauuuugcauuuuauccagcuuuuuuucaucaaccguaaguagcaguuaauuagaguauuauccaagucuucauugcaugcauugguaaagggacucauggucugcgucucuucuggcagauguuauccugacagacacauuuauuggauauuuaguuggaaauaccuuaugguugguugcaguuggcuauuauaucuauguaacuuuccugggauacagugguaaguaauuuuuuuaaauguuuuugguugagaacauagcaagagggggaaaguuguaacaguaguacaaacagcugcuuuuauggaacacuuacaggcacuauccuaaguauuuuaugugcauuaucucauuuaaucuucaugacaauuacacagguuuguuucuguuuucaaaugaggaaacugaggcagagagauuaagcaacuuacccauggucaugcagcuagaaaauggccuagcugguauauaacagauuuuauacuuucaaggaaacauguuaaaccauacugguuaucuccagaugacuugcaggaauccaagaccauucacuccucuucucccaugcuuucagguuguggguuaccagcaggaggguagagcgaagaaagguggggcccagcaucuuguuacauaggucuaugaacugaaguucucuaaagccuuuugaaucauaacuuuuugccccauucuuaguuuucaugauuaccguaugguucuguagacaaucacagaagaucgggcccaacauuuauuguccucaggacauguuugcagauuuacuguuaaauccuguugucaguucauuuuucuuaauaugaaugaggaacauauauuauuuuucauuuauguuaagaaaugaucccauuaaauaaagccaaauaaaaucuagagacugcgcuguacguuucuuaccccuuccuuuccuguuacuguagaugauuagggccuaacuguaaauacagauggcucugacuaugccuggcuccggaguuauucccaccccgguucucuccccccuuggcugguuugucagggaacacuuaaccccuucauuguaaugccuuguuuggggagugcuuucucuaguccaggggagauguuugugucauuucuaaugaauuuugaaaguguuuugugaugagaacacugcagcacugugguuucucuaagugguuauuugaacacuccugguaacgaccuauaccacuuagaauaguuggaguacagcucaguuuguuuaagaacuuccuauaugagaaauacuuaggucgggaugcaugggguagggucccgcuaacuaagcagugagcaagaaacaucaauauuuggagccagacuuuuauauuuaagaguuucaguucuuuucugaagccugggcuacuaguugagcucacacccucuuaaaguggggguauaaugcuuuacacuggaaaaucucaaauagcuaaaagauguuuuccuauaacgccauccaucucuguacuuuaaguuggacuccuagagguuucugaggcagucacaaguuuaaauucaccacuguuuucaugaauauuugugacauuucucccucauuguuaaccucucuugguccaguguaugaugucccacucagccucugugcugaaauaauuccucuccuagguuucuucccagcccuagacaaggaggaaacagcacagagggguugggaagaguagucuaguucugggcauaaauagcaucaucuuacugauucaaaauaugcauucccuuccaccccacauguugaaguaagcugucuuucaaaauguucauuuauuagucauuuauuuuuuuuuuuuuuuaaaucaguuuggauuccuuucuuuuccagcauugccauuuuugaaaaauacaguaauucuucuguauccauuugcaccucugauucugcucuacgggcuuucccuggcacugggauggaacuucacccauacucucuguucuuucuauaaguacagagugaaauaaaaagugagaagaagauucaaucguaacugugucaacaguauugugaagugaucauuucuuguaaaacuuguaaauaaacuaucaucuuuguagauaucuuaaagguguaaaguuugcaaauuugaagaaauauauauuaacacuguggucagguacauuccuuaaaacuaauuaaauguacauuucuauaauaaauauuuuuuaaacuaaagcauguguguucacucuaauauuugcaaauguaagagcuacauguaaaaugcuaauggcauggggaaaacauaaacauaaaacaauaugaauuauuuuugaaagaguaucaucuaguuggagaacaagggaauaaucauacagccccaucgcucuccuauugacaaagaugcauaaucuccauuucuaauuagcuguauuuuaaauacuuacuuacauaagccacaagaucccuucuaaccuucggaa

SEQ ID NO: 12687 - RNA, 15130 nt, Homo sapiens
caguuuggaggucgcgcucacugcgacggcaggcuuugaguguagcacuugguaguucuuccucugcucugcuucccuucggaggaaaauuucaggcugaagguuuagcgggugccggugaguggggaaugaguggcggagagugcggcauucuucgcaagguguauccgggaacccucugcagauccuaauugauuuucccuauugcguacugaauuggccgguuacggcaaccuaaaugggucugccccugaucccgucacauuggcucccguaaggccauuggccugcaggauccccccguuucccaauuugcaggauccagggccacgcggcuuuuugugcccagacucuuggagcucaagaacggagccgccgaggcuggacagcuugggaaagggaacccaagcagcauuuucugugcugcugcuuuauucauaacuuaggguugccacuggguauuaagguugcuuuuuuuuuuuuuuaaugaagacagaaaauugccuuuaucuuuguauugcuucauuuuauaaugcaaacauccaagaguuggcaguuagaauauuugccauuuuauuaaaacugugauuuguuaccauuuugaucgagaccuaccaaaagcuguuuguucugcccuuuuugccaagaggcaguaaugagggcugccuacugcuuguuaggcacuaggaguucagagaagagacacgcuuccagcuuucagagaucucugguaucucugcaagagugauuccauguuuugcauuucagaaguguuuuucccccuuuaauaauuguauacauugucgguuuagaaaaagaaaucgauuuuuaacauuccuguugcaugcaugcucauuguaaaaagacaaaagaacuaucggucgcugggggggagaagggggaggaaaaacgccuuuuuucauacccccagggguauguuaacguuuuucugacaaccuuccagaguuuuucugugauuacacacguucacagacauuuaaaaaaauagaaaugggaucauacuucuccugugaugccugauauuuuccuguuuuacagaagacagcguaauuguuucaggguccaggaguuacgugccuaauuauuaacaguaacuuuuacuuuauuaaaacguauuccuugccgggcgugguggcucacgccuguaaucucagcacuuucggaggccgaggcgggaggaucacgaggucaggagaucgagaccauccuggcuaacacggugaaaccccgucucuacuaaaaauacaaaaaauuagccgggcguccgggcgggcgccuguagucccagcuacuggggaggccgaggcaggagaauggcgugaacccgggaggcggagcuugcagugaacccagaucgugccacugcacuccagccugggcgacagagcgagacuccgucucaaaaaaauaaauaagauaaaauaaacguauucuuugagucaaacguggugacacacaccuagcuccaauuacugggaaaauugaggauugcuugaggcugaguucaauaccagaaacauagcgagacucugucucuaaaaacuuguaacuuuugacuaucacaccuucagaagucuguaaauauuuaaacuucaguuauucugcaaaaauauauuauaugucugcuauagggcagauaccgcuuuacacagauguuugggauacuucuaugaauauaacagacccaaaacaacaaaaucuaaaaacccuuuuccuauggaauuagcgugcuauugaauguacaugcacuaaacaacaaaaccuaacagauaauuaaguuacguuagaagauaagcacgauagaaagcagugaagaggaauugggaguguugacaguugggguaugggugaaaauguuaaaugaugugaucuggguugaccucauugaaaaggugagauuugacccaaaaauugaaaaagauaaggaaauuagccauguaaauaucaggaucauuccaggagagggaauggucagucaaagggagcaugccugcuugacuaguucuagaucaaacaaggggggcagcaugucuggugauugagcaagagaguaauuggagauggaguccuggagguggggaagguugguagugcuguacuacaaagacaugagagggugaggguuaagaauuagaguugggggugguggcccaugcuuguaaccccagcacuuugggagcccaggcgggcggaucaccugaggucaggaguucaagagcagccuagccaacauggugaaaccccgucuccacuaaaaauacaaaaauuagcuggacgugguggcaggugccucugaucccagcuacucagcaggcugaggcaggauaaucgguugaacccaggaggcggagguugcagugagccaagauugggccacugcacuccagccugggugacaaagcgagacucugucucaaaaaaaaaaaaaaaauugauuuucacugugaucaaaauggacaagcauuggagguuuuaauuuuuucauaaauaaacuuuauuuuugaauaguuuuagauuuucaaagaaguugugaagaugguauggaguuucuguauaugcuacacuguuucccccuuucauguuugguauaccuguguacaguugaugaaccaauauugauacguuauuaaaguccauacuuuauuuagauuuacuuaguuuuugccaaauguccuuuugcuauuccaggaucccauccaggauaccacauuacauuuaauggucaugacuucuuccuuaggcuccucuuaacugugacaguuucucagacuuuccuuguuuuugauaucauugacaguuuugaggcaguuagguguuugggaagauacuggaagagaguaccuacauaaauuauuuggaauucuucugaaugggauauuuguucuuucucauuaacuuauucaccuauuuauauuaguaugaauuuaggguuauuuauuuauuuauuuugguuuggauuauaagccaguaauacuuuguuacuuauuuuguugcugaaauuguuccagcuuuggguacaguugacugcagugucacuuugacauaccccaucguuauguuuuuuccaguaguuccuuucuagcauuacaaagugcuccagacauaaucagccauuucucaaaggagcacugguuccuuuuauuaaagaaugcagccaagaucugggcacugggugugcuccuugccacugagugcuagugcuuuaaguccucucagcuaacagagcuagcccauguauauaugcauaucuguaauuacuucuauaucccucaauagcuauauuaagcuaaacaugaguuccauuuccaaucuaguauauaaggaucauuguagccuuccccucuugcuuauauguaaccucccacuucaacagugagaauccuggcucucuggaagauuuuugagcagagugacaugaucuaagauuuaaugagaugauuuauugcugauauacaaaaaagauauuaggggaauuggaauggaagcagaaguccaguuaggauuuuguugagaucuaagugaucagaaagauuuuuuaaagugugaagcuaaguauguuggauuaaguaccuaaccuugauacgaggaagucugguaaaauaauuuagcauuagauagguucaguugcugaggaauguuucugaggucuggcugucuucaggagaugucuugcguugauucucacaguuccguugcuuuauccacaucacaggaaagacuugcagaacuugaaugagcuagaaucugcgggacacugaauuacaacacuuagccuauuuuaguguguuagagcagaggucuccaaaccccaggccuuagacccagaccauuugcuggcccauuaggaaccagauggcacagcaggaggugagcugugguugagugagcauuaccaccugagcuccaccaccugucagagcaguccaacauuagauucucauaggagcgugaacgcuacugugaacugugcaugcaagggaucuagauugcaugcuccuuauaagaaucuaaugccugaugaucugaggugaacaguuucauccggaaaccuucccuuccaccccucccuaucuguggaaaaauugucuuccaugaaacugguccagugucagaaagguuggggacugcaguuuuaagaguauucuuauuagcuuuguaguaauuuaauaauaauaaaagcuacuauuuauugagggcuucccacaugccagguacuguuuuaggugcuuuguagaauaacucauuugcaagacagguauuuucuuucuuuucugggggaaaaauuguaacgcacgaauuaaguaaccuguccgagauauacauguaguucaugaacuuaaucuuucugcuaucaguauaagucaguauaguaggcuacaguuguuuuguguguaauuaaauaaauaugaccuuuuuagguuauagaagcaaugcgugugcauugagaauaguuuaaaaaguacaaacaagcaaaaaaaauucuacuuuuuaacagaaagguguuaugauuuagugaaaaugcacuugccuaggaauuaggagaaugggguuccagaccacaaacuuuauugauagcuggaugcacuuggauaaguuauugaacuuucuggaauucaugauccucauucauaaaguaaggaugugggcagucaguucuaauuauaggaguuggaauuucuucagucccuucuagcucuuuaauuuucugugauucuauggcaaagcauucuuuaucugccuucauuguugaagaagacacuuuaaaugauaguaauuuuguggaaucaaucuaggacugacucauuugaugaaagugggauguggcuaauguguauaauuacuaccugugguugaauaaaacauuuauaaauuaauucgugcccuuauuauauuaaaauaaccaauaauuuuacuguuaaguuuacaauuaauuugcugcuuaguuuuuuaauacuagagaaggggaaaccuguucauuuccaagacauaguugacugaugggucuacuuccuacuucccacagccucuaaagagagcaaucacuacacuuauggcugggauuuugcgcuuaguaguucaauggcccccaggcagacuacagguaaguguuucuuuucaagaauuugucuuuucuaccccuuaugaauuuuuuuuuuaaucauuacaaggcaagcuaaguucuuuuuuuuauuuuuuugagacgaagucucucucugucacccaggcuggagugcaguggcacaaucugggcucacuguagucucugccucccugauucaagcaauucuccugccucagccuccugaguagcugggacuacaggugucugccacuaugccuggcuaauuuuuguauuuuucauauagucggggguuucaccauauuggccaggcuggucuccaacuccugaccuugugauccaccugccccggccacccaaaauuaaguuauuucaccaguuccuuuucgaaaugguuuagauauugagaguuaaucuuguuuauguaugguuuuucugcuguuuuaucccuaaagaucuagaaucaaaaaagaucuuuuucuggaaaacaugccaauaaaaaauggcugucauugauuccccuuggucugucuuaaucuuaaaguuuuagguuguuuuuccccuuagauuauggaaggagugcauuuucaauaauaaaauauuagaaaaauauagaaaaucagaaggaagagaaauaaucuguaagagacccucaguguuaguauuuucaugugucuccuucuaggcuugcuuuuagaaagugcaguggugcugccuaaucugcucauaagggccagagccuagaugagccuauugaccugcuccuggcugcagaggacaacaauguaaggggcuuuguauauauuaccuuaaccucagauuaauccugugaggucaauaugaguuccuuuuuagagcugaggaaacugacccucugagagaguaagugucucaugucucacagcugguaggcagcagaacucagcccagugccugucuucuagugguuuaugccaucucugcaaugcaggaaaugcugggagggaaugaugggaaugacuguugcccauucccacagcaguauccugguaugaaagguuggcagugaauccuuuuucuucagcagccugagagaaaugggauuggaggaauguagagcaggaacaagagguaggaacuaggagugaugacauuguuagaacuaggagggaaacuagaaacucauuuuggauuucuuuuguauugucuuguuaaaugugaguuauugcacauugucuagagcaagaguugauaaacuauggccuuuaggccaaauucagccucccaccuauuuuuguaaauaacaguuuuauugaaaaauauccacacccggcugggcgcgguggcucacgcuuguaaucccagcacguugggaggccaagguggacggaucacgaggucaggagaucgagaccauccuggcuaacacggugaaacccuaucucuacuaaaaauacaaaaaaaaauuagcuggacgugguggugggcgccuguagucccagcuauucagaaggcugaggcaagagaauggcgugaacccaggaggcagagguugcagugagccgagauugcgccagugcaguccagccugggugacagagcgagacuccgucucaaaaaaaaaaaaagaaaaguuugcauauugucugacugcuuuuacccugugauggccaagcugaguuuuggcaauggagacuacauagcucuagagcuggaaauguuuacuaucugguccuuuacagaaaacgguuaccaauccguggucuaaaaguauauuuauaugcuuuuagcuuuauauuauguuagugcuuagaugggaugcguucacucagcuagggagcuaagauauaccuuuaauaauuauaggguagguuggaacagacuucuguuaccuaaagauugguggguauggauuucucuacugacagaauucuaaaaaacaaaugauuuauaucauauuuuagacugugacaaaagguguggagucucuuauuuguacagauuggauucgucacaaauucaccagaucaagaauuccagaaaaaguaagaacaaaguuugauuuuuuuaauguuaguguuguuuuaaaaaauguuuuaagugguacccguuuuuguaauauuggaagauuuuauguuaaauuauauguggauguaggugaugguacagaguuuaaagcauagugggauuuaugugaauggugaucauaaaaauaaaacuguucugucacuugugucacuggccuucacaguaauggguuuuuauuauuucagucuacuuauuccugcuugugguuuguacauguguguugguaucaccauuguccugagaaagcagugggucuuccuacucaggcucucacugugucacucuucauuuucacuuuccguaucgaucauuguuacuuuggaucuuucagcuuuuucuauuucauuucuguguaccuaucauucuuuuagauaauauugacuaagcccgccauugauuuuuguuuaaaauuuuuuuuuaaagagaguuuugcuuuguugcccaggcuggagugcaguggugcaaucucaucucacugcaaccuccgucucccggguucaaacaguuuuugugccucagccuccagaguaucugggaccacaggcccgugccaccacacccggcuaauuuuuguauuuuuaguagagaugggguuucaucauguugcccaggcuggucuugcacuacugaucucaagugauccacccgccuuggccucccaaagugcugggauuacaggcgccuggccuguuuuuauuuguuuuuuaauuaauagucuuuauuucuuaaagcaguuuuagguuugcagaaacauugauugggaaguauggagaguuccuaugugcucccuccgcccagcauauacagugucccccacaacugaugaaccaacgggacacaguauuauuaacuaaauaccauaguuuacacuaguguucagucuucauguugugaaguucuauggguuuugacaaaugcauaaugucauguauccacuauuacaguauuauacagaauaguuucacugcccuaaguaucaccugugguucaccuauuuauccuucccaacuccuaaccccuggcaagcacugaucuuuuuauuaucuccauaguuuugccuuuucuagaauguaauauagcugaaaucauaugguauguagcccuuucaaacuggcuucuuucucuuagcaauauaccuguaagguuccuccaugucuuuuuguggcuugcuugcuuauuuuuuauugcugaauaauaucccauugcauagacauacacaguuuaugugugcauucaucuauggaaaaacaucuugguugcuucuaguuuuggacaguaaugaacaaagcugcuauaaacauucauguauagauuuuuguguggacauaaauuuccaacucaugaguuaaauaccuggagcauaauugcuggauuguaugguaaagacuacauuuagcuuuguaaagccuggguuuuuuguuuauuuguuuugggugggggguuccuaauauuuuuuauugugguaaaauacacauauaacauuuaccaucuuaaccacuuuuaagugugcuauucaauggcauuaaguacauugacacuguugugcaacuauuacaaccauccaucuccagaacucuuuucaucuugcaaaacugaaacucuauauccacuaaauaauaacugccaaccuaggcaacauaaggagacccagucucuaccaaaaaaaaaaaaaaaauuagauggguguugugguacacaccuguaguccuagcuacucaggaggcugagcggggaggauugcucaaucucaagagguuaaggcugcagugaccuauaauugugccacugcacuccagccuggacaacagagcaagauccugucucaaaaauuaauaauaauaguaacuccccauuuuccccucucccuagcuucuggugacuaccauucuccauugauuuucuuaaaagauaaaacaguauuaccauugacuacuuugauaccuuuaaugugcuugguguucuuuuaucagaaaucucauccagguacaaugguucacaccuguauuccuagcauuuugggaggcugaggcaggaggaucuuuugaguccaggaauucaagaccagccugggcaacauagugagacucuguaucuacaaaaaauuuaaaaauuagcuaggugugguggugcaugccugcaggcccaacugcucaggaggcugagaugagaggaucacuuuagcaagaggucaaggguguagugagccaugaucggaucagugcacuccagccugggcaacagagugagaccuugucucaaaacaaaauaaagaaaucuuuuuuauuuuucaagucauugucuuuccacugcuauucuuuccacaacuauauugucuuauaucuuuccauguuucuuacucuguauuucuggaaggauagauacaaauguuggcauucauuuaaaauaugcaaggcuaggcacaggcaggagaauaacacacacuggggccuguagggggcgaguggagggagaccaccaggaaaaauagcuaaugcauacugggcuucauaccuaggugauggguugauaaguguagcaaauagugcagcagauugccauggcacauguuuaccuauguaacaaaccugcacauccuauauuugugcccuggaacuuuaaauaaaauaaaugugcaaggcagugguuuugaucaucaacugugauaaauaugaaaaccuuuaaaccucaugaaaauagccccugacuaucuuuuuuuuuuuuuuuggagacggagucucgcucugucuccaggcuggagugugguggcguggucucggcucacugcaaccuccaucucccggguucaagcaauucuccugccucagccucccaaguagcugggauuacaggcaugugccaccacacccagcuaauuuuuguauuuuuaguagagacaggguuucaccaugcuggccaggauggucuugaucuccugaccucgugauccaccccccuuggccucccaaagugcuggaauuacaggcgugagcaaccacgccuggccccugccuaucgucugaacuuauuccuguauucuccuguauucucaacugguuucuagacauugcuacuuggauaacuuauagguauuucaaguucauauccaaaauucaacucaucuuacuuucccuccaaacaaccaaauaaaaaagagggugcgucucuuguauuaguuaugucaguuaaugcuaccauccucuaucuaauuucccagacuaaagacaucugaaucaagcucagccucccucuucuucacccaacacaaauccaucuauauuacugcccagaguucccauaucaguccuuuuucuguuacagcuacuguaguucaggcucuuaaaccauggucauaagugccuccuaacuggguuuccuuguaucagucucuauccccaguugguuuuauucuuagguaagaguuuucuuugcaaaucucauagaaacaugguccuauugguucuaaccuucauuaacucuguauccccagcgguaauuucuaaaggcucaacauagucgcgcauaguuuaacuucauccucugcauuacuuuucgugcuuuuuucuauauuagccacccugaaccacuugccuuuccaaaauauuuugugcuccuucauacuguuccuuuaaauauucucaccuuucuuuagugcaccuaccccuuccucugaucuccaccauccuucucauccuaaucucuucaaaaucucuagaaaaauauaaacaagcaaaacucaccaaaaaauacucuuaaucuuacccaccccgagauaacugcugccaacuccuuccacauccuucuuuguuguauguuuuauuuuuuucuuuuagacuagucaagugcaguaaugaggaggaaagaguagaauacggaguucaaucuguguuguguguuuuaagaugugauucaucucauaugaaucaaugcuucucuagcugcucucucuguuuaguaauauaauaugaaccucucacuguauacauuuuuuuuuaaguuccgguauacacgugcagauuugucacauagguauauaugugccauggugguuugcugcaccuaucaacccgucaucuagguuuuaagcccuacaugcauuagguguuuguccuaauggucucccuuugcccccgacuccccguguguucucauugcucaacucccacuuaugagugagaacaugcgguauuugguuuucuguuccuguauuaguuugcugaggaugauggcauccagcuucauccaugucccugcaaaggacaugacaucauuccuuuuuauggcugcauaguauuccaugguguauauguaccacauuuucuuuauccagucuaucauugaugggcauuuggguugguuccaugucuuugcuauuguaaguacugcuucaauaaacauacaugugcaugugucuuuauaguagaaugauuuauauuccuuuggguauauacccaguaaugggauugcugaguccaaugguauuucugguucuagauccuugaggaaucaccacacugucuuccacaaugguugaacuaauuuacauucccaccaauagugcaaaaccauaaaaaccucagaagaaaaccuaggcaauaccauucaggacauaggcaugggcaaagccuucaugacuaaaacaccaaaagcaauugcaacaaaagccaaaauugacaaaugggaucuaauuaaacuaaagagcuucugcacagcaaaagaaacucgcaucagagugagcaggcaaccuacagaaugggagaaaaauuuugcaaucuacccaucugacaaaggucuaauauccagaaucuacaaggaacuuaaauuuacaagaaaaaaacaaacaaucccaucaaaaagugggcaaaggaaaugaacagacacuucucaaaagaagauauuuauguggccaagaaacauaugaaaaaaagcucaucaucacugaucauuagagaaaugcaaaucaaaaccacaaugagauacuaccucaugccagucagagugacgauuauuaaaaagucaagaaacaauagaugcuggcaaggcuguggagaaauaagaacgcuuuuacacuguuuacauuucuacaaaacuguuuuuaaucaugaaugauauucuuuuuuauuaaaauaccaucuuuuugggggucaauuuuuuuucuaaaucugcuuccccagagcuaugacucuugaucuaaugucuuugagaccuuuauauauauuuuauaugagucuuagaaacaguauuuauagaauauaucacauaugcacacucauguauuugguacagaugaugcacauaacagcuuacaacacauaauuguguggacauuucuuuuugguuuuuggcucaagaauauauuauggccaucauucaaugugaagaccugcaaagauaguaaaccucauucauuuuaaugguaguauuguauccuauaggauacaucagaauuuguguauuugcgccaggcguggugguucacaccuguaauccuagcacuuugggaggccaaggcgggcggaucacaaggucaggaguucgagaccagccuggccaacauggugagacccccaucucuaccaaaaauagaaaaauuagcugggcacgguggugugcgccuguaaucccagcuacucgugaggcugaagcaagagaaucgcuugaaccuugggggcagagguugcagugagccaagaucgugccauugcacuccagccugggcgauagagcaagacuccaucucaaaaaaaaaaaaaaagaauuuguguauuuguaucauuuuacuuaguuuuauuauuaaucauuuuauuuagaauggaugcaucauaauguaguuaucauggugaggaacacggguugccuuuaaacuuuucaguguuacacauaguguuagaauacacauccuuauucgguauauuuuguauacuuagaggaguguuucugugggauaguuucuuagaaccuuuugauucuuagauaauuaauucaaguauuagcucuguggagcuguuucugaucgcucauaggcagaguucauuagucauuugccuguauucucauaauacuuuguagauucuuuuuauaauacuuauguuuuauuuucauuuuuaauuuacauguuuguuuucccacuugauagucagcucuucaccugagaauagggagggaagaggaugcagcccagugcccagcucauagcagugcuuacagauucuccugacauuuaaauuauuuaguguugucugguugcuccugcuuuguucuacagguuaaacuccaucuaucugcauaaucagauugauagaaauguucaaucugagguugaggauuacaugaugauuaaggaugagguaauuauguaguuguguaugugugugugucuuuuaagaaaaaaugggagguacacagaaacuguguaaguuggaaauuuaccauuuauaauucuuuccuuucuagguguuucaggccucaccugaagaucaugaaaaauacgguggggauccacagaacccucauaaacugcauauuguuaccagaauaaaaaguacaagaagacguccauauugggaaaaagauauaauaaagaugcuuggauuagaaaaaguaugcaauuauuuuaaucaucuuuaguguuguuuacauugcuuuaaauuuuauacuuuuaaaacuuugcgguauacauuuauuauuuauuuuguauuacuuaggguaauuuauuuauaaauuuggcuuagaaugaaccuucaauuuaacauuuuacugaaacauggaacuaucugcuuuucagauugauaacguugcuuuguuguuguuguucacaggcacauaccccucaaguucacaagaauaucccuucagugaaugcaaaauugaaaguaguuaagcauuugauaagguuuguuguuucuucucagcucuuuuuaaaauguauugccuaguguaauucuaaaugcauuuuucuuuuuucguuaauguucugaaaaaaacuuuuuaaaaaacuaaaauuuuauuuuguuuuuuuuuaauugacacauaauaauuguacauauuuaugggguacauagugacguuucaauauauauaaaguauagugauccgaucaggguaauuggcauauccaucaucucagacauuuaccauuucuucauguugggaacauucaacauccuccuccuagcuauuugaaacuauguguuauuguuaacuguaguuauccugcggggauauagaacgcuagaacguauuccuccuaucuaaacgcauuuucuugugucacagaaucaagcccuugaaguugccacaaggacuuccagcagaggagaacaugucuaacacgugccucaaaagcacuggggaguuaguagugcaguggcaucugaaaccuguggagcagaaagcacaugaguccuaaugccccagcagcuuccgauuggaaaaugcaaauuguuuuuauuuaaagauggugagaaaguguuuucauuaaaauauguuuucaaaaccauuuucaggccgggcacgguggcucaccuguaaucccagcacuuugggaggccaaggcgggcagaucaccugaggucaagaguucgagaccagccugaccaacauggagaaacccccaucucuacugaaaauacagaauuagccaggcaugguggcacaugccuguaacccagcuacucgggaggcugaagcaggagaaucacuugaacccgggaggcagagguugcagugagcugagauggugccacuguacuccagccugggugauaggaugagacuccaucucaggggaaaaaaaaaaauuuuuuuuucacugacuaaaccugcugcagcucucuuuuacuacagacuuggagauuuuaguuuaauuugguuuaauucucuguccuuucccuuucacuguuucacuccaaaacauguaagaauggcaauguuugaacaucugcguuugggucuacugccaccuua

SEQ ID NO: 12688 - RNA, 5628 nt, Homo sapiens
cugcgguagaaccuuggaggcagaggcuaacauauuuuacaugcuuuggcaggaucaugugagcacagcuuuacuaaaauacacucugccaacagcagaaggcccucugaggugagcaggugggacgaggcugggaagcugucacuugacuucugccagcuacucggaaugucagaugaaucccagacugcagccccugcgguuuccaaggcccccaucacugcacagaaauaccaggcucacucagcgacaggagccaggcuuccuccugucgcuccuccccagccuccucacagccucaagaugcaauucucuugacaguagggagggagggcagauauuaagggcuuuuagggaaauaccagcccuuucuucagaaaugggguuucuuccuuaacaucucucccguuucaugugcccucugugccaggccgcguguggugucuccaagaggaucuggagcaggcggacccagucggaaucuuggcucugcggcucaugacugcaaaccccuccaggagccaacucacuucucugagaccucguuuuucucuucuguaauaugagauguaauaauguaauaauacaucucauuggauuguuaugaggauuaaaugagacaacauguccaguagacugccugguacaaaauaggcaucuaaggcaugccaaguaucuuuauggucccaggcugccugagaaggggucagcauuagaggcaugcgggugcaaagagaaccugcgaucuagggguggaaggugggcgggcuucagugugcaaauaugcaagcuuggcauuuaggagguuuuacaucucaacuagaauccaaggaagagggagaacaaauccagcugaugguauuucugaaagaagacgcacagcgaauguauguguuccagccauccuuuguaguauccugcauuccuucauuuauucauacuguacuugcuuauugaauaaguacuauguucucaaugcuagaaacacuucaacacaagagcaugaagauucauuaaagauaacauugggaggaagcacaggcagucuguuaaugucaggcaauauuuauugauugcuugcugcagucaauaaauaugguaauaccagccacaaucucccacagcccgggcgacuccucagaaaaacguuggcaccuguuaaagccacagugaguauggaguagcugaaguuucuuaacucaugucucuguggacugaagagcucauugcaaaagggccaaacucgcuuccagagacuguuccccaccuuaaucauaacugaaguaaaccauugcuuauguggucuaacuggagucacugaaaacuucccuucucccaugacauauauuccaaaugccuacuuguugaaccuaugaauggguccuaaaauauucuggguugucaguucuuuggguuaaaacuuuccuagguccuacuggaaugcucuuggguucuccaaggggaauacuucagggagccauauauucuagucgccucuuggcagcgugcaccagaggaaaggccuguguaggaagacacucacuggcugagcucuuucagccucaguuuccucaucuguaaauugaggaaagacgagcccagcuuucagagcuacugggaagacugaagagaucauuuacacaaagugacuaggccagggcuagaaacauggcaggggcccagugcaugccauuuccuucuccuuccucacuccuuuggcacaaagcaucucagaaguuggucaguaaccucuacuguguuuugugaacaggggcugacaaaagugaacaugugcaauugugaccugcauuuaaaaagaugaggaauagaaaaugucagaguaaugguaggugaucuuugcgacacuuuugcuucaguacacacauucacaaaggauacgguauaaaauguacuucugacuguguagguuauagucauaaaguuuugagguggguauauacccccaaaaauuaagaacaggggcucaaagagauaauguaaacccacguuccuggcagccuuauucacaauggccaaaagguggagccaacccaaguguccauugacggauaaauggauaaacaaaauguggucuguacauauaauggaauauuacucagccuuaaaaaggaagaaaauucugacacaugcugcaacauggaugaacccuguggacauuacacuuuggaaaauaagccagacacgcaaggacaaauacuguaugauuccacuuauaugagguccccagaguagucaaauguaaagagacagcaauggugauuaccagaaauggggaggagcagggaacagggaguuauuguuuaaugggcacagaguuucaguuugggaagauaaaaagaguucuaaggagaggguggugacggccgcucaacauguaaauguauuaauccuugaugccacugaacugcacacuugaaaaugguuaagaugguacauuuuauguuauguguauucugccagaguuaauuuuuuuuuuuuuuuuuuugagacagagucucgcucugucgcuaggcugcagugcaguggcacaaucucggcucacugcaaccucugacucccugguucaagcgauucuccugccucagccucccgaguagcugggauuacaggcacgugccaccacgcucagcuaauuuuuguauuuuuaguagagaugggguuucacccuguuggccagguuggucucaaucuccugaccucaugauccgcccgccucagccucccaaagugcuaggauuacagacaauuaaaauuuuaaaaaauuaaauuaaaaaauauuugaggaaccuugaccuagauaaccccccgaggaaagguacauuuggaaggagccuggguguagaagacaaagggugggcccugggcaauuaaacaggagacaggggaauauagacucccuauuuuuuuuuuuucuagagagagucuuguucuguugcucuggcuagaguggcaauggugugaccucagcucacugcagccucuaccucccagguucaagcaauucuccugccucagccuccugaguagcugggauuacaggcgcccgcuaccaugcccggcuaauuuucuuguauuuuuaguagagaugggguuucaccauguuggcgaggcuggucuugaacuccugaccucaggugaucugccugccucagccucccaaagugcugggauuacaggggugagccaccaugcccagccagacucccuaauuuuauaaacucucuuuuacgaccucugggaacccggaccuuccaaugucgugccagaacacagaaaaugggguucgcagucuuuuucuaugaugguaucauuuccaacagacauuccuguguuuuaguguuuuauucugagagcaaaacaaauacaacagcaaugccuaaucgcccucucaggugaaacugaccuuuccuccucaccucuucuccuucaguaacucuccccagcccaaagcugacuccuugguaggcaaaggcuggucagucuuccuuccuuauucacugaauaagccaugccccuuugcaggccuccagucuaauuugugauucuaacuaaugagguggggucugaggaacuugaagaggcccuuucuauuuuauuuuuuauucuugguuuccaauaguuggagaaacaggaucuggccaacuuucucuagacaaaggcuguaugcuagguuuuucauuuucuuagcugaaaugauuguggcaaaucacuuaaacagauacaaaaaggaggucucuguggacggacaccucauagacuaaaagaucagccacaguucaucauuuuagacauauauugcuagagccaaaauaaguaucaggaagguuucaaguuucucuggaaaagaaaaucuuuugguaacaauucucaaaucgaccuugaucucucaacuuccagacacuacucuaugaucaguuuguguaaccuuauuguuaaaugcacuugcauaaaugauagauuucuuuauauguuuagcacacaauuguuccucuguauuuuuucccuccauauuuaauguuuucuaagauagugcuacaaugagcuaauuaaaaaauuuuaaugaauauuauaucaaugcagggacacugacaugaacauguugcacuuugcauguuucuauaugacuccaaguugcacauuauguaccugaaagagccucugggcaucauccagaccugcuccaccaaucuguggugcucacgucuuccaagacauuuugaaauagaagucagugguggaggugaauucuucagccuccugcaggaccugcauccuucacucuggggagagguaaagccacacgcuucuugcugaugguccuacucuuggagaagguccuguccuuggagaagagcucacucuggcuggcaucucuggaguagaccacucagucuuucuccuccucagcccuagcuucaugagaucuuuuaaaacuuucuauuaauuuuuguuuuuaccacccuuaacaucuucuuaguuuuccacguuuuaguuuuaaaaaagaagagaaaaauucuaguaaagcucugaucaguaucaacugcagacacgaggcuguuuuauagcuuuuauaaguuaugaauauuguuauaacaggaggaacaaugauuuauuuagugccuauuacgaaacaggcacuuuccauauaugaauuccaacuaauauauuaauuuuugaagaaggaacauuucaugggucugagcuuauaacaguuauaagacuuauaaugcggucugagcuuauaauaguuuccaagucuuuuacuguacaccuggcuggaucauuuuccuucugccucauuuuguuuauuuuuuccuccgaggaguucaacacucucuguuuauuucugauuuauguaggucauuucaaaucuuuuuuuuuuuuuuugagauggagucucacugugucacccaggcuggagugcaguggugugauuucagcucacugcaagcuccgccucccagguucacgccguucuucugccucagccucccgaguagcugggacuacagguacaugccaccaugcccggcuaauuuuuuuguauuuuuaguagagacaggguuucaccguguuagccaggauggucucgaucuccugaccucgugauccgccugccucggccucccaaagugcugggauuacaggugugagccacugcgcucagccucaaaucuucauuuauucuuuaaggcuacaguuacuuuguacgauugaggguuaucuacaaauguagaaggauaugcucuugggaucugucuacaagccuguguaauugacccuugacuugagaguggauuuucaguggugguaaauguggauugagcaagcacagugauccugccaaauuguggccuucauggaaucuuggaaaucuucaucugcucauuauuccuagaauuuuucuaguauaggcaacagucuagcaggauguugaccuacugcuuuucaggcauuauuucaauuacuugaucuucuugagaugguuauugucucuagagaaacaauauaagagcucugggauaguagcagaaugggacagugguuaagagcuuggcuucuaggaucugaaucuuggguucaaaucuuggcuuugccacuuuaagu

SEQ ID NO: 12689 - RNA, 195134 nt, Homo sapiens
uaucuuugucucgcugccucgcgcucacucgcucaacucggcgccgccgcggccccacgcuccgggcccguccucgaggcgcgcggcgcggggcgcgggcgccggggccugaggcggcgggcgacgcccgggggccugacggccggccccgcgccauggugugagcgccgccgcccgugcacgcuccguccgcccuccgcgcggcccggccggcagagagccccgagcggcccgagagcgcagccgagcccgccgccgccgcccgcggccccgcgaggagaguaccgggccggcucggcugccgcgcgaggagcgcggucggcggccuggucugcggcugagauacacagagcgacagagacauuuauuguuauuuguuuuuugguggcaaaaagggaaaauggcgaacgacuccccugcaaaaagucugguggacaucgaccucuccucccugcgggugagugggcccgcgagcgggcgcgcggggagcgggcagccggcagccggcagccggggccgcgcccaggucggccgggcgcucgggcgccgccgugggcagagccgcggggcgcggcggccccuuugucuuccugugcgggcuggugcggggcgggcgcuacccucuaccgcccccacgccccgagcccgccgcgcgacccccgggcgcugggggaccgcgcggggcgaagcccaccucuuuugucaccgccuuuucucuccaacugccuugcuugauuuauucauuuuuuuggcuucuuuuaaaugauaaccccuccccuccuuccucuccaggauccugcugggauuuuugagcugguggaagugguuggaaauggcaccuauggacaagucuauaaggucggugugggcgccuucuuuguuucccguggcauguggaaacuucuuauugggggacgaggagagggugauaaacaugcugcugacuggaggccacgccgcuuggccaaaguugggagagggguuucuuucgccuugcagucccucuguuuuugcacaccgaguuuauauucagacuggccuuaaaagaccucauuuccuggcuuugagauaaggaaauaagcuacacucuuaggcaugcacuuuacuucgauaaaauggaaaagcauuuuuuaaaaauaagacaaccugaauuuuuucuuuuuuuccccaaauccggccuucugaguuuguguguaaauugaaauacaguggaggcgggccuugccucugacgauccuaaaccacugcuuuggccaucgugaaaauugucaucauguuucagccuccacucagugcuugccaguugcucaagguggggaguuuggcguuaccugggaauacuuuauaacugugguugucauccuuucuauugauggauacguauuuuggggaagcagggaggaguguguguuugggcaacagcagcaggaagaauuacaguguggggauuauaaaaucugaauuccaggaauaaccuguuugacagcuguguaauugaaacagaaaugacagagagcgaagagaauauagaggaugcccugguuuacacccacccaggucuuucucuuuuuucaaaauuuuaacacccacccuccaccccagcgauaaaugaaacuagcaaaucuggagacugagucugcgcugaguagcugacaccugaugugacuaacaguguucauuuuauacauuguacagucuagagauuaugaaagauguguagggaauggaggcgcaggccuugaaaauucagaacggaauguuaaauuuuuccugucuuaauuuguuucucaauacugaacguuuucuaaaaguuuaaucugcacugggggaguguucuguuagagucgguacaagguuagggaagcagggcucugugguucaccaugaagaauugucauugucucauuaaaaauggguggaguuggggggguuggaagccgacuguagaccuuuucuuaggcuagauuaaguguggaucuuauugucucuuuucugcguugugaguagaguuuaucuaucacuugaacgccucuccuuagccuagacuucuagccuggguaguguacuguacuggacugugguccgaacuugggucaguauucuuaggugaucucaaguguauuagcuuguguuuuguugguuaacuguucgggccggggccagauuuuugaauuugaaagagagccccguuaacucagcuugcccggcucaacugaauuuggaaggcuuuggaaaauuuuggaaaagauuguguugcaacucacugagugguugguaacuggcuaaaagacauucuccccggucuguuguuuguuuaagcaccagucauuuuuuuucuaacccaguuuuuucucgccaaauuaaauggugauuguagucuuccaagugaauuagccagagcuuguuuuugaccuggcuacacaguaguuggauuguuugugucuuacuuggucagcauggauguuaagggcagagaaguaagcuagaaggcgauauagucuuuaaaccuuaagagaaaggaaagaaugaaaccccaguuugucuuuauugguuuuaagaggugggagcuguuuaugguaagaguuuagucagguucauuguuauuuccccucauugccauuuugguuccauuccccgcaaccuucccgagcuuuugaacuagguuugcugagcgcuagcuacguuugguagguauuugggauacuggcaugacacagcucucugacuacaaagucgguacaguugagaauuucucuaauuaugcaaaccuagggaauuaaaucugugcaaaaguugccuacaguccagaacaaaauagugccugagauuuugcucauaagcaguuacauuuuuauauuauuauggaaaauuucaaacauaaagacuagagagcucaguuuaucagcagaugacuaaucuuuucucaucuguauucuucuuuuccuccuuuauuuuaauguaaaccccaaaugcuauuucagcuguaaauacuuuagaauguuucuuuuuuacacaaucacauuguuguuaucacacuuagaaaaaugucauauauucacuauuaacguuuucuugauugucucauacaucaguaaaauguguuuuuuuuuuuuuuuacuauaacaaguucuuuaauguuuacaagcggguacugggaacuucaaucuuagaaguggugaaaauagcagaacaucucuuuuuuuccucuuuuuaacuauuuaauuucuagaaccauuuacaauuauguguaggaguuaauuuaggauuuuuguugguaugauuugcuugugguagauuugggauuacauuauuaacacuuuagaguuuguuuauugcugcuaaacauccuuuaggaugaauagcauuaaaguuugagaaauacuuguugcugaauuguuauuuauaaaaaggucuuuauuuuuaaacauaauuucagguaaaaaaaaucuguaagcugaacaacuuguccuaauuuauuuuagugucauauuuucuauuuuucauuagcgcagauguugcuuauuuugaggcaacuauauuuacaugaagugagugaguugaaaagagggaguuuucugagauuugauaugucguaugaaauagcuucuuuuggggcgaacgacucuccugcaaaacugugcuaaugguagaccccucauuuauggaagaaagggagggggagggguguguguggcaguagggcuaagagugaccuuugggaaugguagaaagguuagggaguagugggaauuucaaggagauguuauuuggacuugaggagagacaucuucuuuaagcauugaggagccacugaaagguuuuguuggaauuggggaucccugagaguaggggacuugauccaguuuuuuggggauaacuucuaauuuucugugucucugacaacagugguaaauggucugguauaguugaacaguauguaacuucaucuuaaaagaaggaggugaaaaacgggguguauucuguuuagagaaauuuauuuucacccuuagguuuuugagagacggauacucauaaacuuaaaauuguaaauuucucuucacaagguuacauucagaguaccauauauuuauaagagaagugucugguaugaucagugaggagaaugauagugugaaaaauuaaaaccagaaauaaaucaaguuuguuuccauguuauuuuggauuuuauuguuauuuuguuuugagacggagguuugcucuguugcccaggcuggagugcaguggcaccaucucuacucacuguaaccuccgucucccggguucaagugauucuccugccucagccuccugaguaguugggauuacaagugcgugccaucacguccagcuaauuuuuguauauagagauggguuuucaccauguuggcuaggcuggucuugaacuccuggccucaagugaucugcacgccuuggccucccaaaaugcugggauuguauacaggcaugagccacugcacccggccuuauuguuauuuuaaauauuuauuugaccauuuuuguguucuugggguaacuacuguuauuuugcauuuugugagcaugugauggcugguguuccaaaugucuugaauaaaagauugucaaccggacgcgguggcuuacgcuuguaaaucccagcacuuugagaggcgcaggugggcggaucacuugaggucaggaguucgagaccagccuggccaacauggugaaaccccguuucuacuaaaaauaccgaaaaauuagccggguguaguggggggugccuguaaucccggcuacucaggaggcugagacaggagagucacuugaaccugggaagugaaaguugcagugagccgagauugugccauugcacuccagccugggcaacaagagugaaacucugucucaaaaaaaagaaaagaaaagaagauugccagccugaggacaauucugagucuuggaaggacugacagaggggaaauccgguaacaguaacguggaagucagggaguuuagaauccagcagguaaaaugucugaaaucaagguucacucaaaggagggaccauagauuuuguggaagacugacccauucugaucuugucauuggaggaaggguacaauguggaccuuggagauugaggacaaggguacccuaggcccaaagaccuugaugguaaggggagcuaacgcuaagaguuugcucauucgaugcccauuugacacugugcucauguuagaccccucauuuauugaagaaagggaggggagaggugagguguuuguguguggcaguagggcuaagagugaccuuugggaaugguagaaagguuagggaguagugggaauuucaaggagguauuauuuggacuugaggagagacaucuucuuuaagcauugaggagucacugaaagauuuuguuggaauuggggaucccuuagaguaggggacuugauccagauguguguugggaaggagcugguaaaaugguuggccuugggcagugguccagugacaggaggugaaggccgaggcgggauaguggcaguggugguagagaggaggagagguugggguggauacuugggcauuacucuuugcuagguuuaacauguugaauucacucguucucugcaggcuuugguaugucccuuuaaguggguacacgguuugcccacaguauuaggaggagcuuugggauucccagcacuuugggaggcugagacgggcggaucaccugaggucaggaguuggagaccagccuagccaacauggcaaaaccccaucucuacuaaaaauauaaaaaguagccaggcguggugguguacgccuguaaucccagccacuugggaggcugaggugggagaaucgcuugaaccuaggagguggagguugcagagaacugagaucauggcacugcacuccagccugggcaacagaaugagacucugucucaaaaaaaaaaaaaaaaaaaaaggcggggguggggugguuaaagugcuaaaauugcuuucgauugcucagugguaaagugccauauagauugucuggcuuuuaaaaaucauuaggggccgggcacgguggcucacaccuguaaucccagcauuuugggaggccgaggcggguggauaacaaagucaggaguucaagaccagccugucaacauggugaaaccccaucucuacuaaaaauagaaaaauuagccgggcgugguggcgcgugccucuagucccagcuacccaggaggcugaggcagaagaauugcuugaacuuccccaggagguggagguugaagugagccgagauagcaccacugcacucuagccugggugacagagccagacuccuccaaaaagaaaaaauaaaauaaaaaaauuugcauuuuggagcaaguacuuaaacuuuugugagggauucucuaaguguuaucuuuuaaguguagcaucucucguucuuaauuggagguaaagacauccacuggggcaaaaugaauuuuguagaaccagauguuuucauuaggaggagauugugucagcugaucugccacugagaggcauguucaggcuuguucugagacauagauuuccuucauguggaagauucuggacuuggacaaggugggaggaagccagcccuguugagcaagcccugcucucaaagaguuucaacccuuacuuucaaaaacuguuuuacuaacucaaacaucaaaagcucuacagaaaagccaaccaccaaacaaaacccugcugaugauggguuuuuaacuccuuacugcuugaaacuuugugauaaauguacauuuauuugccuagcugcaaacucaacucguauuuugccuuuuuucuuaaccaauauuuuauguguguguguguguguguguauauauauauauauauauauauauauuuuuuuuuuuuuuuuuuuuuuugagauggugucucgcucugucgcccaggcuggagugcaguggugugaucucggcccacugcaagcucugccucccagguucaagcgacucuccugaguagcugggacuacaggugcaugccaccaagccuggcuaauuuuuguauuuuuaguagagaugggguuucaccauauuggccaggcuggucucgaacucgagucaggguaaaguuuuuagacauacagggaaagaugacuaggaagaaaauggagaaggccaagguaaucuuauauuuauuaccagugaccauuguggcagcaaugguuguuagguuuuauaauguuauaucacugcucaccaaacagaauuuguucuuuuguuauggagcagguucaguaauaagaguuggugaguauuauucagaagagaagcugccucuuggguugaguaauuaauaaagugauucauugggagguaguuuuugucuguaagaaucucuaaggaaugaucacaaugauaaguuuuaggacaucccguuuuaaaaacuggacucuuacaaacuuuguuaucuagauagcauuagguauaacuaaauuggggagacaaaagugaaaaacgauuaaccauauaagggugguuucaugcagguacuguggaugugugcugggcccuguucugagaguuagauacacagugguaaaugaagccgaugauauaucuacccuuauggaacucaagaaaaacagggggauggacacaaaaugccagcugugggaugucagucauacauucuguguugucugcaucucccuggguucccugcccagcacacuuguguucagacacaaugaaugcacugacacauggaaacagcacauacugcaauguguucauuuuaaguggcucaaccucaucagcagggcuucucugugcuuuaaauuacaguaaaaacaaaugaaaagugaaaugaaaagguagacauauagaauaucagucuacuuuuuuuacucguagaaucaaaagacauuuucccaugucaaauugcuguaaaaguuuuuguuuuuguuuucuuuuuaaaaaaguauaagaaacucaggugauauaaaaguuuuuauauacuuuuaauuucagaaaugaucuugcuguggucagcagaccacacuuugaggaacacugaacuggcaggauugaauuuguagcagggcucuuaguaaacugugggugguugguguguuagugagcuggagaauugaggacuguuguuugugccuaguauuugguucucccacccuuugaacauuggggagcuacagcaggugcugcuuacagcuuuaugcuuuagugccaaaacgucuuugaccccugugcuuuggaacugucucagauauggcuaaauaugaacaaguuauccuauuaaauuuaaauaaaugaaagaaaaaccccacuuuuacauuauaacuuuaaaaaauccuucauaugauaaauagggccuuaacuuaccaguuaugaaucgauaguuauaaucaaaugauacuaaagcgcucauaccaaaagucagagucauccuguucuccagaagcauguuuucagugcuuuuagcugcuacaucugaaauuuauugcuauauuuguaaauuauguacuuauguggcuaguucauuuaucaguuuuauacauuuauugacguccucuagcaguaguuguaguuauugaacuaguuaguucaauaguaguugaauauuuaacuccuauacuugcugccucccuuaagugggcauaccauaauuuuggguuaaagugauaguuguuucuuuuaucaugacuauguaaauaccauuuauaugugagcuaaacagucucauacgauuacauuuccuuuuuuaaacaacaccccugcccccacaucgcuuuuaguuuuucauuugcuuaguuuucuuuguaccuaucaucaccuuccuccucagauacccuaaaagguauaacaaaugccuaacaaaguuuagucuuuaucacauuuuccaaaugcuuaauuuaacaccacacgucagauaauuuauuguugcaagauaaccuguugauuucaauuuuuucucccuggaguuuccucauagcuaugcagguaugguugccccuggaccuggcauguagcuauuauuguccuggaaugucuguuuccuggauacugcagucuuccuuuuugguuuacuaucuuacuuuccugaagcacauccucuaguaguuuuaaaagaaaggguauauggguauuaagguuuuaaguccuuguauggcugaaaaucccuuuuucuuaucacugccucaucuucucuugucuggaacauaacugcuuucgauuucuuuagggacuaaaucucugguuuccuguggguauggagugaugugaggcaguuaccagacuguguaaggcagagaaaggggaccuggggcuuucaaccacuaaauaugcaaacuuucaucaguucugauuuuggccuugcaccucacuugguauugguuuauuccaaaugaugaccuugucaggguuuuguagguccaacugucucacuucuuuuugguauccuuuaguaggcacuuagguuguaauuuuuaccucuuaguuacuacuccauccacuuuuuauuuuaucuuuuuuuuuuuuuuuuuugagacagucucacuguugcuuaggcuggagugcaguggcgccaucuuggcuuacuguagccuccgccuuguggguacaagcaauucucuugccucagccucccaaguagcugggacugcaggugcggaccaccaugcucggcuaauauuuguacguuuaguagaaaugggguuugacuauguuggccaggcuguuaucgaacuccugaccucaggugaucccccugccugggccucucaaagugcugggauuacaggcaugaaccacugccccuggucugccugucugucugugucuuuugagacagaguuuugcucugucccccaggcugcaguacaguggugugaucacagcucacugcagccucaaccuccugggcucaagcaaacuucccacaucagccucuugaauagcugggacuacaggugugcaccaccauguccagcuaaguuuuuuuuuuuuguuuuuuuuuuuuuuugagacggagucucgcuuugucgcccaggcuggagugcaguggugcaaucucggcucacugcaaguucugccucccggguucacgccauucuccugccucagcuucccgguuagaugggacuauaggugucugccaccacgccuggcuaauuuuuuuuuuuuuuuuguauuuuuaguagagaugggguuucaccguguuagccaggauagucucuuaucuccugaccuggugauccgcccaccucggccucucuaagugcugggauuacaggugugagccaucgcgcccagcccacguccagcuaauuuuuaaaauuuuuaguagagaugguauuugaccaucuugcccagguuacuggacuaaaguggucugccuaccucggccucugaccauccacuuuuuagcugucaaaaccugauagaaaugaucucuacuaccucuuuuccccuuuauaucuuuauucuuuuguuuacuuuaaaaucauuuuuaugggaauuaauucuuaauaacucaugugaucaguccaccauguuuaaccaaaaguugugucuuugauuuuggacuuaggguuuugcucagguguuuguuucuuuucauccagaacaauaacaauaccaacagaacaauaacaauaccaaugaaacaauaacaauaacaacaaauaaaaaaugaaaacaaggguaagcagugcguaaccucugugaccuuacugugugaccucugucagagauacuuaauuugggaggugcaagccgagggagaugaggaugaggaauaaggaaagugaggcaggaugccaagcagugccaugguacguauuaauuaccaugcuggcugcugcuuugaacaaaccuuugagagauagaggaguuuguucagcaguauuuuuuuuuuaaagcagcuuuauugaaguauguuuucuguauuaugaaauuaacccaauucaagcuuacauuucagugauauuuaguaaauuuacugaguggcacaaccaucaccacaaaucaauauuggaacacuuugaucaugccaguuagauuccucguagugauuuacaguuaaucccuguuccaacccagagccccaggcaaccaauaaucugccaguauuaauuugccuuuuuugaacauuucauuuaaauggaauccuacaacguauggucgccuguguuuaauguuuuugagguucgaccauguagcagugugguucuuuguuccuuuuuauugcugaauuuuaggcuaugguuguaccacauuuguuaccuguucaccaauugauaggcaugauguugauggaacugcaccuuaagucauccacagaagggagaaaggagggggaauuuaucuguuugggucuucuuguuucccuuuaguguaaccaaacacuugguucugaugacccugagugacugucuggaugagggaaaagcaguugaaguuuugugucccugaauccuuuaucuuccccagucuuauuauuagucauuacugugaguuuauuuauuuauauuuugagauggagccucacucugucgcccaggcuggagugcaguggcacaaucuuggcucacugcagccuccaccuccuggguucaagugauucuccugcuucagacucccaaguagcugagauuacaagugugagcuaccacgcccagcuaauuuuugcauuuuuaguagagaugggguuucgcccuguuggcaaggcuagucucgaacuccucaccucaggugaucugcccgccucggccucccaaagugcugggauuacaggcgugagccacugugccuggcuuuaagucauuuuuaaaaacaagaauacaguuucuuucuuaucgcuaugaagacaaacuauucacuaucagcgaggucacugguaguaggaacuaggccaaacuaguuuuuccuucuauuuuugggaggaauucccuuguauaauagccagcuauuuaccaugugaugcuagacugcaguuuuccuuuaucucaagcagaagcuauugucuugccuggauuuugaaaaaacaaagcaaaauauguuaucuuuggucagaaggauguaucccaaguuaaauaaaugauuugcuauguguuuugggcgaauaaguuugcucauuuguuucaaguguauuuuucagaguauuuuucuuauauuuuauucuuaaguuuuuuugugauaccuuuuguuagggccuuacugcauucagauuacauaaaauuaaguuaaguaauaguuuauuuuuugaaaauucuuauacugcagagcuuucguucuuacuugcugugacagugacagaauacuguugacuaccagagcccuucucccccugaguuuuucugagacucuuuauguguaauugguguguaguuuuaugacuucaauuuugagagguaugucaaagacugaauauuaucugaguuagggcugugcaucaagguacuuaauaauuuguuggagaucccgguugaauauugccugagguugaguguguacauuuaagugacacaauucacuggguguauucauucaccugcuagggcaugacucagauucuagggccauuccaguuugaacuuggcauauuagagcaucuuaguucucuauauguacacauuuucucauuuauucuuguugccuuccuugauucccagaaaaaucugacagguguucagcucuuuacucuucagugauuucaaggcuugguuucuguuucuuguuucacugucuacagauauuuugagccuacucugcuagucaagauuuccuuuauuuauuuaucuaguacuuaauguguuuauaauaugugccaggcaccaugcgaggcuugcucacuggugacaauggacaagaaaggcagucagcuuaugcccuuguguagcguauagccuaauguguaaggcagaaaaugaacacacaguuaaagaggaugauauugcagauggggaauagcaggggccuaugggagugugugacaugacagcuaaguuagagcugauaaaacagauacggugguaugcacagugaagcuuuaugauuucaauucagaugcucuagaugaggcauagauauauguggagcagugaacagucugcuaggaguuaaaacccacugagcugaugauucaucaucuugguuaauacuacuuugaauaaagauaggagggguguguuccauugauuaugguaauugacugucuucauucaguuugccuugagccagcugucucucaggaagccuugccuccuacaucugcacuguuuggugcuccuugcauuugaaucuccuguaucaguuagaaguuagcauccugaacauucucauaugggugaaggaggggccuucgucaggcuucagauugucuuaugagcaauaucuggaauaauauuugguaaacagcuggccugaaguaggccacauucugcccuacauuacacauggggagacugcuuuguucagcugcugguccccacgacguuagggcugaaagggaccucuguaaaaugggaacaaugguguacagguuugugauauucacauaguuuuuaauaaguuucuguaguuccgguuauauaacaaaauaauuaaaagauaaaguuuuuuugcuuuuuuuuuuaagacagagcugcaaccucugccuccaggguucaagcaauucuccugccucagccugucauguagcugggauuacaggcaugcagcaccaugccuggcuaauuuuuguauuuuuaguagagauggguuuucaccguguugaugaggcuggucuccaaauccugaccucaagugaucuaccugccuuggccucccaaagugcugggauuacaggcgugagccauugggccuggccuugcucuuugauaauauggacaaaagagaauuuuauuuuucuaauccgauuagguaaaaugauguugugguuuuuuuuugauguugagugagauauuucuaaccauucucuaaucauacuggaaaaugggacuuuguagucccauuaguaugcuggcuuucaaagugugaaauucuuuuugcauuauuuuguauaagcaagggcuuugucagucaucaacuccaagauuguauuagacguuucauuaguuuucuaguuaauuagcugaaaauauauucuuauuguuauaugaaaaaagcaacuuaaauguugaauuuuaaauaggaugcuuauuuauuuuuuucuugucuuuauacuguuuauuuucuugcuggcucuaucagcuaaggacuugaucucauugguagucugucuugcccuuuuuuuuuuuuuuuuugcuuuuuaaugauuccuuuugcugacuuauuaccuauaacuucuacuuagguuguuuuauagguugcuuuagguuuguagcacauguuuuuaacuuaccacagucuaccuucaaaugauauuauaccuuacuaugguauaccuccauuucuacccacuuggccuuauaguuuuuuaguauacauuucacuuuuauuuauuauuuauuuauuuuuauuuuuuugagauggagugucgcucugucacucaggcuggaguacaguggugcgaucucggcucacugcaaccucugccucccggguucaagugauucuccugccucagccucccgaguagcugggacuacaggcgcaggccaccaugcccggcgaauuuuuuguauuuuuaguagagacgggguuucaccguguuagccaggauggucuugaucuccugaccucgugaucugccugccuuggccucccaaagugcugggauuauaggcgugagccacugugccuggcccuauuuuuuauuuuauuuuuuuuugagacaguaucucccucugucacccaggcuggagugcaguagcaugaucuuggcucacugcaaccuccaucucccagguucaagugauucuugugccucaaccuccugaguagcugggauuacagguguguaccaccaugccuggcuaauuuauuuuuaguagagauggauuuucaccauguuggccaggcuggucucaaacuccugaucucaggugauacacccaucucggccucuccacgugcagggauuacaggugugagccacugcgccaggccgagaaauuuguuuguugaggaauaucaaagauccuggccuuggaacauugauaguucacuuugaacuucaaggguugauuaauuaaaaguuucuguuaaaccaaaaucuuuuuuuuuuuuuuuuugagacagagucucacucugucacccaaguuggagugcagugggcaccaucuuggcucacugcaaccuccaccucccagauucaggcaguucucgugccucagccuccugaguagcuggaauuacagguaccugccaccacaccuuggcuaauuuuuguauuuuuaguagagacgggguuucaucauguuggccagacugaucucaaacuccugaccucaggugauccacccaccuccucggccucccaaagugcugggauuacaggugugaaccacugcgccuggccuuaaaccaaaaucuugauugugcuuaaaauauuuaaguaaaaagguacuuugcuaugccaguguuccaguuugacagugaucaauuaaaaaauuuuuaaucccucugcugagugcaguggcucauuccuguagucccagcacuuugggaggcuuaggugggcggaucuuuugaggucaggaguucaagaccaggcuggccaaauggugaaacucaucucuacuaaaaguacaaaaaaaaugagcugggcacgguggcgcaugccuguaaucccagcuacuugggaggcugaggcaugagaauugcuugaacucaggaggcagagguugcagugagcugagaucacgccacugcacuccagccuggggugacagagugagaccuugucuaaaaaaaaaaaaaaaaaugcugggugcgauggcucaggccuguaaucccagcacuuugggaggcuggggcagguggauugcuugaggucaggaauucaagacuagccucaccagcauggcgaaaccccgucucuacuaaaaauacaaaaauuagaugggcauggugggugugccuguaaucccagcuacuugggaggcugaggcaggagaauugcuggaacccgggagacggagguagcagugagcugaggucgcgccacugcacuccagccugggugacagagcgagacuccaucucaaaaaaaaaauuuucuaauuucccaucaucugauccuaccaaaaauaacaaauaccuaggggguuuuucauuucauuuacaaucuggaaccucauauggccuuaugacaagagccaauauuuuaauaucuuugucuuagaaccucacucauacaauagagacaaaccucaaauccaauccagagagcauugcuucaaggaacaguggugacuuaagauagguuggaagucuaauggugcugcggaaugcuaaacaaucaagccuuuucagguuuaguuuaauaguuguuauucuuauacuuucaaaaccauuuucauguaauuuuuuucaacuauuuauuaaauguuaguaaaagaggaacuaccugaacacagauuuuguccaagcaaccuguuuagaauaaauuauagggaaggaaguuuucgcuaaaaugcauuuccuguacuugugaagaaacuuguugagaaauuaacuuugagaaaguuaugccaucuuuaugcaacauauuuauauaguuaagaaacauaauuuucuuacauuucaaaagaggcuguuugacaaaaacggcuagaagaccccucccuacacagugagaaauaacauucuacaauuauguuauauaacuaaucauaauaauuuuacuuucuccaaauaacuauaagcaccuuaucuuccccguuaucaaaaaaccgugagaaaaugagccuuccuaagaaguuugacacugauaccagccaacucuaaaucaaaauggaaauuaacauuccuuucuaaaucaugugcagaauucauuugaacauucugauaauuucccuauaaacucugauacguaaauguuggggcuaggaggaggcuugaagauuaucuuguucaaacucucugguaaaagaauguaucuaagauuuguuccauaggcugcaguccacuucgggaaucauggaacucaucagucacauaaauggaacuaagauaccuucucauaguuaaaaaaaccagcuuaagaaauucuugccacccaacuuuucuucuaugaaucucucaauaauuuuucacuauucagagaaugugguaaaaauaagaggcuucaagacccaaaagaacaaauguaugggaacuccauaccugcauuagucuguuagggcugccauaacaaaaggucacaggcugggggcuucaguaauauaagucauuuucucauaguucuagaggacagaaguccaagauugagguguuggcagaguugguuuuuccugaggcuccuuuuucuaauuugcaaauggccaccuucuuagccuugccuuuugugcaccccucccuggugucuguguccagauuucuucuuacaaggacagcagucagauuggauuaagguucacucuaacagccuuauuuuaauucagucacuucuucaaaaggccuuguuucuaagucucaaucacuuucugagguacuggagaugagaguuucaacaugucaguaauuuuugggggaucacgguuucagcccauaacaauacuguaaaguuuuucuuguacugaagacacagaaaauaacuuuacucuaaagugcuaaugauuuauuaacuaacacagguagaauaucccuuaucugaaaugcuugggaccagaaguaguucagauuuuuuuggauuuuggaauguucauauuauauuucaugguauaauaucucuaauccaaaagucugaaauccaaaaugcuccagugaacauuuaguuugagagucauguugaugcucaaaugguuuaaaauuuuggauuagggauacucaaccugaaaauuuugaaccuuguuuuuuuaaacuaaaaaauacauagggucuucuaauccagggguccccgacuucugaguuucagacaaguacugguccuugaccuaauaggagccaguccccacagcaggagguaagcagugggaaagcaauugaagcuuuaucuguauuuauagccgcuccccauugguugcauuacugccugagcuccaccuccugucagaucagugguggcauuagauucucaaaggagcaugaaccccauugugaacugugcauaugaaggaucuagguuguacacucuuucugaggaucuaaugccugaugaucugucacugucucccaccacugccacccccugccuaccuucauggaaaaaguuucuucaugaaacuggucccugugccaaaaagauugggacugcuguucuaaucagauaaauagcauauucauuaguauauucauucaacacaaaaauacuacagauggccguggcucacgccuguaaucccaacacuuugggaggccgaggugggcggaucacgaggucaggagauugagaccauccuggcuaacacggugaaacgccgucucuacuaaaaauacaaaaaauuagccgggcgugguggcaggugccuguagucccagcuacuugggaggcugaggcagaagaauggcgugaaccugggaggcagagcuugcggugagccaagauugugucauugcacuccagccugggcgacagagcgagacucugucucaaaacaaaaacagaaacaaacaaaaaaaacuacagaugcuauuuuagaugauggagauaaaggauggcaaaaaaaaaaaaagauacaguucguguuuucaugggguuuaaagaaggcaguaaacccaucagauggugguacuauaucaguuagccuuugcuggguagcaaaccaugccugaaacuugcuggcuucguguuguauaagcaucaucaucuuuguucauacuuuuguaggucaguaauuuggacuggggcauacucagugugguagugugguggcucuucuauccaucucuucuaggaucucuccggaagcugaagucagcuggcaguuaacugggggcugcauggugugacuuggguuggccgacuuuuuaagcacccuggccuuuuguuucccauaucucaguuuucuuuuugucuccuuucuuccuuuuguuguucacuaaggaauauuuaaaaaguuucgaguauuauaaaacauucaacuuuuggggaaugagauggagauauaauaaauggagauaaauauguacauuuaauaucuucauuuuacaaaagaaucuaaucaccauuaauuacaguguuacaguaugcccuguuacagcugagaguuaggguuuugcauccacuaauuuggguagggugacaauagcaaaaugauaaauaagucaugaauuuagccugggcuuuuggugcucaaauaccuuaauucauggauggcaacaccaacacucuaccugcuuuucuuagcucaacaggaaaugagaguagggcuugggcaggaggaagucaugcauacccagcugucagcgugcggccuucucauugguuguuuaggagagcaaacgaagcuuaucuccuuccccaaauuguugauaaugaaggcgaaaagagauauagcuacagguaaacuagauugaaucugcuguuuauguguuggaagaugacguuugaagaugaguuuuaguucuuagcaccaauacaacaaaugaugggauuugagguuuaagugccuaaguuuaaggcucucauauaauaacucuuaauuucuuuuugugucgggaaaagaacaaacucuugccuugaauuaaccaguuauuuuaaaaaaucauagacuucugucauuagaggaaacggccugaacuccauuaccaggugacuuuuuagcuuuaguggguggcacaugggacugucuguggugugccaucugcagugcgcaagccauuuguuucuggaaacagucucacaagcaaugauucuggugaguuuagaaaugaaucaggaugugcuaagcucaaugaggacucauuagccuuggauaaugugauucuauaaaugaacagaauggagacggugaagacucaggaguauagagaaaauaggaugacacuggaagcuaggcugauuggugggaguuuuggaaucaaugugcuucaacuauuaguugauuaagcauauaguugaauuaguaaagagugggagacuugccccuugacuguguguuauuaaaaaaaaaaaagcuaucuuggccaggcaugguggcuuaugccuguaaucccagcacuuugggaggccaaggugggcagaucaccugaggucaggaguucgagaccagccugaccaacauggagaaaccccaucucuacuaaaaauacaaaauuagccgggcaugauggcacaugccuguaaucccagcuacuagggaggcugaggcaggagaaucacuugaaccugggaggcagagguugcggugagccaagaucgcgccauugcacuccagccugggcaacaugagcuagacuccgucucaaaaaaaaaaaaaaaagcuaucuugaguacugacaugguccaccaucuccuuuauguacauuuccucaccuuaauuuuuauuuugcaugugcauggagagguuaaguaacuugccuaaagacacauagcuaggaagcaauuggagaaaccaaguguuaaggcauuucaguccugacuucuaaguuuagcucuuaaccuuuuugccagauuuguuucccaggguuucgacagguuugguugguagguaagaugugguuuggcagagagaaccugugaggguuuagggccagggcugacagugggaaggugggggugggggggugggggggaguggaagggugggggaugggggguggggugguggugggguggauggguuaagggugggauugagaggcaaaggaggugcugagaggagcagaaguugccaguccugaagcuuuccuuuuucucuacuuuccugugucuuccucagagccucucauacucuaaugugcacucagucaucuugggagcuugugaaaaugcagauucugauuucagugcaucugggaaucugcauuucuaauaugcuuccccagugaugcuacuguaauuccauacuuucaauaguaaggaguaguagggcaaagaaguuagcaugggaaauguugguaguucacuggaacacagcugcuaggguggguucuuuggacuaggguuaugucuuauccaugugguguaaaguguauuggguaucuguacauucaaaucaaugauuuugugaacagauuacaacuuucaguugggacuguagucuuucugaggcucacaggauguugauguaggaagagguguuagagaauguguagcucaaccccuuagcuuacagagagugagggacuuuguggccuagucagagcuaggguugcagaucuggccucuuuuaugcucuucaucugucuggguuggguuggaaggcagugcagugaagugcuacugucuuccccccuacuauuugaugauuuggugacaugacaaggucauaaauggauuaugauucucaaauuccauuucaguuuguaguacauuuccugaacaaaaguaaguguuugagacagugaaugaauaaaagggcugguuucugggugagguggcucacagaguuggucagaggccgggacugccccuaagccauggcaguaaguuucuagugaaaauagaugacaaccauuuugguguuuuggagaaggcagcagacccagacaguggcaggcuuuuaggcaacagcuguguuuugaggccccaggaaagagggggaaagugggcagguguaaguacaaucagggagaaacuggggaaagacuuuuaggcaagcuuuuugguucuugauuauguggucucucuugcaccuaggaaagcagacaguaaaaugcgucguguuggaauagaaaauucaagcgccugauugugagaauaagaguucaaaaagggggccaggcgugguggcucacgccuguaaucccagugcacuuggggaggcugagguggguggaucacaaggucaggaguucaagaccagucuggccaauauggugaaaccccgucucuacuaaaaauacaaaaauuagccgggcgugguggcgggcgccuguagucccagcuacuugggaggcugaggcaggagaauugcuuguaccugggaggcggagguugcagugagcugagaucaugccacugcacuccagccugggcgacaagagugagacuaggucucaaaaagaguucaaaaaggggagaacaguggauggaagguagaaagaguuugaagcuuuaaaaugcuguugagaaagaaacaaggaaaaaaaaugucuggacagagauuuguacagcacaguuguacuuaaguguuuguguuuuuuggggcagugguggguaaggucagugguguuuuuuuuuuuuuuugagaccccugucgcccaggcuagagugcaguggcaugaccucggcuugcugcaacuuccaccucccagguucaagccauucuccucccucagcuuccugagucgccaggauuacaggcgcccgccgccacaccuggcuaauuuuuuuguauuuuuaguagagacaggguuucaccauguuggccaggcuggauuugaacucccuaaggucagugguuuuuacauugaaguccuggacuauagaaugauaguucuggaaggagcuucagagagccucuaugcaucucccucguuuuuccuggagaaaccuccaaggacccagugagguggagggacugacuggcuaaaagaucugucagcauauaguagacugccagauggaccuucauauuuuugccucagaugauuagaggacacucuggguuucucucaucuuacucguuaaaacaaaauacaacacuuuuacugagugcccuuuaugagcgggcacugaucuuuuuaucauuuuucuuugauuuuuagauugugcuuucugaaaauucagauauucaaguuaaguaaucuuuuguuacuguuuucuugauggggaauaauuacuagaucuagcucuuguaggucuuaauuuggaaaaacaaguugaauuauugcugaauuuuugguuuaggcauaguugaucacauauuuugcauuuuguugcaucaggucagucuuuagagaauaacauuuuuaauacuucauuuuuccuaugagucacauuaauaaaaaccacauuuaaaauuuuguccuuucaaagcacuguacuguggcugaauugcauuuagcgcuacucauaggauuuuuacuagcauuaauucagaucuuccaguuauuugaaaguagagaaaaaacauucccauuuugcaaauaagcuuuuacaauugaguuuccacuauagaacaugucaguagacuaugagguuuaaaaaagagaauaaaaacugauacuagaaauugucaauacaucauacaauacauugauacagagauaaucccuuaaggcagacuugagaauucaaaauccacuucugaauggcuuuggagaggugcauuuuuuuuuucucuagggcagugugaaaaaccauuuccaaagaggagauugcccguuuuguaaaggagggauagcugauugggcaggacaagaaagagccugucugaaauaucuuugaguagcguguuaagggguuggguaguauauugcuuuuuuuuuuuuuuuuuugagauggaguguugcucuguugcccaggcuggagugcgguggcgcgaucucggcucacugcagccuccgccucccggguucaagcgauucuccugccucggcuuccugaguagcugaguuuacaggcucacgccaccaugccuggcuaauuuuuguauuuuuaguagagacaggguuucaccauuauugguuaggcuggucuugaacuccugaccucgugauccgcccaccucggccacccaaagugcugggauuacaggcaugagucacuggugcccagcccuugcuuuuuguuuuuacuaaagccuuucgacccaccugcucagaaggaggugguaauugguugagaauucaagaauuguuaaaaagcaaggguguguuuucuucagcuuucccuagcaaauauaauauuuagagcagagccagccccugcaaauccccuaaacccaauaaaagccagcaagacaauaagcccaucuucagcugauagcaacuucuuuggcuaguuguauucccuaacuccugcugcagcugaugaacagagugccugcugagaccuuccugugggccuugaaccucaccuugguuuacaauagaggaagauaguaggagagagaaaucugaaggaaaaguaugguagaggcucucagcucugguacaucuugguauaucuuggggagcuuuaaagucucacuauaaagcagagaguccuaaccaugucuguaauuugcagucacuugaggaggcaagaaaaagauugaugccuuugcugcaaccccaggauuggguauugggguuuucguaaccucauggauuauucugaugugccuuugagcuuuuaaaccauugaauuuggacauuaucugucuacuggaauuggccaauuuuggcccugcaacucugaugaagggugaauuugaaaguuuuugugaauuuuucucucguuuuguuucuuuuaccuucauuuaugauagcccaauuuugggaagcagauucaguucacuguagaaauuugcuucuuagcuaguuuuauauuugagagaaagagguaaauaaaggucugcauuuuuauuuucuuucccucguucucccaucccugcgauggaaagaucaugaguuacaguugauuuucugauuagcuuaaaguuuucaacuaggauuauguuggaaguccuuccuuugagaguguauuguuuucacaguuuguaaagcccuuaucucauaaauacaacuuuauauguaacuuuacuagaggucacuuucuaaaggauaccuguguuguuuuuggaggaagaggcuucagaaggcuaaggacuaaaauuuugguuucagaauuuauuuccuauccauguucucuacguuguacauaaucacucauaguugaguugaacuugcauacaucaaacauuggcacuguaguagcaguauacagcaucuguauuaguccauucucacacugcuauagagaacucccugagacugggcaguuuagaaaggaaagagguugaauugacucacaguuccacauggcuggggaggccucaggaaacuuaaaaucauggcggaaggcaaaggggaagccagacaucuccuucacaaggcgucaggagggaaaaugaaugcaggaggaacugccaaacacuuacaaaaccgccagaucuugugagaacucacucacuaucacgagaacagcaugugggaaacacccucaugauucaguuaccucuaccuggucucuuccuugaaauuuauggggauuacaauucaagaugagguuuuggauggggacacagccaaaccauaucagcaucuuauugaggauguuccccuccuuuuugcauauaaugcagacaucucacuguauaaacuaauacgcuaguaacauauuguaaauauuuguacuaaguguaggagagaguugcugaagauguuuagaugcauaucuuacaugguaaggguaagaaaaauaggcuuuggauaagcagagacgguagauaaaguagguucuaauuugcuuuuugcccaaccucuggagaacugugagagucacuguuugucuucuguuggguuuggcuugagaaagccucucuccuuguguagcuugugugccuugaguggcugagcuccugggccagaauccaggugaguucucaguaaggguaagucuagaguuuucacauuaagaagcuuagaaaugaucuuuugaagguuugaaguauuaacugcuuguuuuuaaguacuuuuuguugcuagccuugcuuuguuuucuacacuuugagagagauugagaagaaaccauaaacugguuugauggaguugaguaagcucuugacccuagaauuggaggaggagauuuuagguuaacuagugaaacuucuuguuucgguucgggaaacccucucacagcauuucaugucaguccuuugcccuuuucucuugcagacuccuagggacaggggcuccuggccaccauuguuuacuauaucacucacaauuaggaaggucggcugacauuuucuucccuguaacuucugcucuaguaaaugaugacuagccagauagugaaaaccucaaucauguuucccuaaggcuucuuagcuguagacugagcaucuuuaguucuauguuugacaugucuuuuuuucugucuuacaugauacuuauggaugugcuuuaguuugaugaugacuuauuuaaaaacgguggugcuuggggauggacccagcauuccagccaaccaaucagugugcaauguccugugcacuugcuugccagguucuggacacuggaacaaccuaagaugacaggcaaacaggcaaagcugugagguuagugaguggcaguuucucaaggggccaggaggaauuucccucaguaguaguacacuggcaggauuaguuaucuugagccagaucgugucaucuauuugggccucagguuccuuuuauacaaaaggagggaugggucaguaugggcugucauuccucuuuaaaauguugagugcuuucaaaaggcagccguuucugaaaccucuaauacagggauuuaacagaaggugauugggauuuauugggcuccugguuccacucaaaggcuaaugccaguguuuuaggucuucauuugucacuugguuugguauuucugccacacuuugcacauucugauuucucucuuaggagggaaugaaaacaggaucagcuuugccuuuagaacuuaaggaauauguaguucucuuccaccugugggugauucgccuugagagauuacaaaacaaaacauucuaguacuacuccuacauagcucuauggaugaggcccagaaaucuguauuuuuuuaaagcuggcaagugacugcauagccagguuugggaaguauaguuaugugcacauaaggauguuuuaauccaugauguaccuaaaugauggugguccuauaagauuauaauauuguuuuuuacucuauguuuucuguguuuagauauguguagauacacaaauuauaaauaguacucaguauauugacauacugugcagguuuguagccuaggagcaauagcuagaccauguagccuugguguagaguaggccauaccauugaggauuguggaaaugcacucugugaugugauguuucucacauggaugacauugccuuucacagaacguguccucaucaucaagcaacacgugacuguacuaauuuuaaaaguauuugcuucuuacaaauagugaaguguuugcagauagcaugguuuauaccuagaauuugcuucagaauagcucaguacaaggaagagguguggguaggaauaaagaugaaauagauguagccaugcuuucauaauuagucaagcuauagcgauaggugcacaggguucauucuucuaaugucuacuuuuguuguaugcuugaacuuuuccagacuaaaagauaagcaaaaaaaaaaaaacaaaaacaaaaaaaaaccaaaaaacaaaacauauguuuuguuuucugaaaucauuuacucuugucuguuuuguuuauucuauaaucacaaaagguaaaugguaagguauguaccauacucaucucauuuaagacugacgugaauuacaucccuugcauaaucaagccuuuucccuuggccucugccuuggcucugugugguacacuugaacuguggggugaguggaaugucaugauggccaucaccauuuuggcuucaagucuguaagaugacaugaagcuagacauucucucacacagugcccugugccacagucagcaucucaucaacacuuuugaggugugacaggaaugcucugguuggugcauguguggcuggugacuugaggaggagccaggagguccaugggcacaucauggucucacauggcauucuguccucuucagggcaggcucuguaguugaugugguggguuccgucucuuccacauaaaccuaccuugucuuccccuuacaaccuauuuuuuuguggccacuucacguuuauuuuggcagaaaucuggauaaaagcugaguguucuuaugagucuccugcauaucuagugcccccugucggggauccuuuauuuggagugucuuuuagcuucaccgcuuccucagguuggguauugcugcuagaaugaauguggacuuuggcuugggauaacucauuuagccauuucaucucuuacucuuuacugugaagauaaaccaaucaaauugaugucuguguuaguugcaaauuuaagaguuuugaagcugcuugcagcuauucacuuugagaguucagaauuaaaaagggucuuugcacuuauuucuagugauucaaggacuuuugcagaauuuugaugacugcuucugaauuaagguggauuuaaaaacugauguaagcaucacuguccucacaggcuaaguggucugucaugggugguuagacagguaaauguggacacugugccacagagaacugccagcaauuaauuuaugagccuucuuucuuccuuaguauuuuaguuuugauuuuauuguugacuaaagguccauuauuacuaguuaaguaucagcuaauauucaugaauuaucugaguuaguugcaggccucugaugguuaguaaguggcccucaguuuacuuuucucuccugaaguuggccuaguuuagccgaugcuuuguauuucauuaucaagaccucaaauuuuacuuagaacuaacuuuauuuuggacuuaaagagccuuaauggacaggaguauagaauauauuccuuaaacuacaugggaaagagcaaaauguuuugugguuuguuuggcuggauuguuugacaugagguagaagaggaauucauuuugacccucucaguccuuuuucuguugcucauaauagaauaccugaaacuggguaauuuaugaagaaaagggauuuguaucuuacacuuguggaaacugagaaguucaagaauaagggaccaaaucuggugggggacuuucuuguugauggaggcucucugcagaguccuggugcaggguaucaccuggcgaggggggugagcaugcuaacucaugucucuuuuccucuugaccaccagucccacucccaugauaaccuauuaguccaugaauggaugaacccauuuaugaagacagaguccucauggcccagucaucucuuaaaggccccaccucaauauugccacauuggggauuaaauuucaauaugaauuuugaaggagacaaauauugaagccauuacacccucucauagcuuucugaugaguuuucuaacauguuuggaugguguagauggucuguagaaaugcaaacagugaaaacacuuagcauuuacucauguaguaccaucuucaaaaagaaaaggauuugcuucugcaaaacucaguggacuguauuuuaaagccgcuaugagaguuuacaaaaaauguuauuuccacaaauacuauuaauauaaucucaaaauacccagaaguauaaagaaccuuguauagucagugagguugucuuuugauuguaauugcagaacucccuaaagauaaagccaauaauaucugaaauaaaaugguuuuuguccaacauagauuaccaaguaaauggccugugagucuguguuuuagacucuuaaaauuuuggggggaaguauauacagguuaauauaaaaugaaagagaaauaggcaauugccucuuuauuuggcauuuagcucucauguuaaaaacugugaaacagaaagaaggugguaauggucgggcacaguggcucaugccuguaaucccagcacacugggaggcugaggcaggcggaucaccugaggucagguguucaagaccagccuggccaacauggugaaacccugucucuacuaaaaauacaaaaaucagccgggcaugguggcaugagcuuauaguuccagcuacucgggagguugaggcaggaggaucacuugaacccaggaggcggagguugcagugagccgagaucacgccaccgcacuccagccugggugacagagcgagacuccgucuugaaagaagguggcaagaccaaauaaggagcacacuaagggcuccagggagaaaacguguagcaucagaaaguuagaagguugucauggcuugcucucauuaaauaacugaggaaacacccagguuaccucuuuaaguacaggcuaaguaaguaaucucccuauuucccagucuagaaugcucuugaagcguggaucccaaaguacagauugucauagcauauuucucugcagcaugcuagcaagauuuuuaucagugguuccucuccccuggggggcuuguuagacauagauuacugggccccaucccacaguuuuugguccaguaguucugagguaagacugagaaucugcauuucuaacaaauuaugaagcacugcugaggcuacuuacuggucuggagaccacacuuugagauaaaauuauuugagauaauuuuaaucaccugggaagcuuuccucucaacauuuuauuaugaaaaauuucaaaccuauaguaaaguugagagguguaaaaugaauacccaccuccuagauuuuauaguaacacuuuuuuuuucuuuugagauggagucucgcucugucacccaggcuggggugcaguggugcaguggugugaccacagcucagugcaacucugccucacagguucgagcaguucuucugccucagccucccgaguagcugggacuacaggcgugcaccaccaugccugguuaauuuuuguauuuuuagugcagacgggguuucaccagguuguccaggcuagucucaaacuccugaccucaagugauccacccaccgcugcuucccaaagugcugggauuacaggcgugagccaccgugcccgacagauccccuaguugauuuuaaugugcaacauguuuggagacuagcucuagcugcuccuauaucuuguaguaugugagagaaacugauuuauauucagaaaccuggcaaaauuaagaauaaaaucaaucuguugacaugaagaaaaauuggugaguguugcacaaauguucaguuucaggaaauugugaagauguaaugaaugaaacagaugaaagcagaagcaacuuaagaguuauggcucagaaaaugauuagagagaggagagagagagagagagagagagaguguguguguguguguguguguguguguguccuguucccacucucccucccuauccuuuuuuccuguaaggccuucccuggaaaucugcucgauguuguagaagacauuauacucagaaaauauaguuuuuauuuaauauuaugcuuacagucucuuuuauuuuugccagcuuuucacaaagugacagaguggacagugcuccguaguacaaucuauuugugugcaguacagccaguuuauuuggucaagacuagcaucuuuuaauugaauagaaaauagagugcaucacauaugcuaagaguguuuugugaaaccuuuauuuugguuaaaaauacauguuauaggugucuuggguggugguuuuaacuguauuuuuuauuauaggcugcagucaagauaguuugaaagcuacuguacugggagaugcuagguuccuuuuagcaaaagugaagaaugguuuuaaaaaauacacuuugaaacaacugaauaaacauuuauuuugaaaugagauccagcuacauugccgacuguuaccugcagugugauccucuuuuuguuuuguucugguuuggcucagggccucacuaugucuacaccccuccagguagcuccucuugcccacaugugucuaacugaggacccacaccacccgcuccuugauuuggcauuccuugucuccaagccaaagguccuucucuggugaaaucuuguuacagcuccugucuucuccaucugacauacucuguugguucucuggguguuuuccucucuugaggguuaucuugacuagcuuugagggcagguuuguguuuccugcaacccucagcacaacaucagaugguguguaaagaugccaggaaccugucuuugugucuccucccgcagcuccguggggccuucaugagugcuccagcaugagacggaacaucuuccguggcagcuagaguuaguccaggggcccucuccuuaagaugcgucaguggaccuaggacgggggaaaguaaaggcuuauuauaagguuucgauucugcuucguucauguacuuuguaugugaaaccuuuuuucauauucuuagucuuccuucuuugaaauggcuauauggcuuucugucaggauucuggaauaguugguagauggucuuugggauuauauucaugauuuaaaacuccuuuccugcuuugugauaugaucaugagucugggguggagaaguuuguaaaugggggccagcuccccacgacuggaaacugaagggcacaccuucugucuugccccgcucuccuuuuugggguugugguagggacaguuuuucagaucauauguugguuauagcaaaagaaggcagagguuaaacucauggcuagcuaguggcagagacacccguguuuaagaagguugggugggggaaggagcuggugcccuauugucccgugggucucuauuacagacaccaggucacuaacuccagagcucuggugggaugaaugcccagcagcacuggacagguguucaguacggggguauuucugucaccuccagagcacauucacauggcuucaguaggguuaagcauacguuuuugaauuuuuccccuuaagacuauuacaaauccuuaaaacuuaauuccugugaaucacuuugacuuagaaauauguugaauaguggccgggugugguggcucaugccuguaaucccagcacuuugggaggccgaggcaggcggaucaugagaucaggagaucaagaccauccuggcuaacacagugaaaccccaucucuacaaaaaacgcagaaaauuagccgggcacgauggcgggcaccuguagucccaacuacucgggagccugcgcaggagaauagugugaacccgggaggcggagcuugcagugagcugagauugcgccacugcacucuagccugggcgacagagggagacugucucaaaaaaaaaaccaaacaguugaauaguauauauuuauauugauuugaaugugacaguaauuuaauuuuuauuuuuauuauuacuauuuuuugagacacaguuucauucugcugcccaggcuggagugcaguggcgcgaucucggcucacugcaaccuccgccccccagauucaagugauucuauugccucaaccuuccgaguagcugggauuacgggugugugccaccaugccuggcucauuuuuguauuuuuaguagagaugggguuucaccauguuggccaggcuggccucgaacuccugaccuaggugauccgccugccuuggccauccaaagugcugggauuacaggugugagccacugccccuggccgacaguaauuuuuuaaaaauuauuaagcaaagagcagagaaugaucuuaaaaaaugaaaugggcugggggugguggcucacgccuguaauccaagcacuuugggaggccaaggugggcagauugccagagcuuagaaguuugagaccaaccugggcaacaugaugaaaccccaucucuaaaaauaaauacaaaaauuacccaggcgucaugguguacaccagcuacuggagggacugaggugggaggauagcuugagcucaggaggucaaggcuacagugagucguguuggugccacugcauuccagacugggugacaaagggagacccugucugaaaaggaaaaaaaaaaaaagauggaggggagggguaggggaaaauaaagggaauuuugaaaauaaaccagaauaaugcacccuguuccuguuuuucauucacucaggauuccuuuuaaaugaaaaaguuuugguuccuggauaccuuuugguuaguggauacguuucuuuucucuuuucagaaauaacuaggaaaauuguuaaaagucccauaauuuuguguggauuuaccaauauugugaacccuucccuuaauuuugaauuauucuucagaauuggggaggugaagcugguucugcaaguuuuuaugguaacauguauguaaaacaacacugaaggaguagggacggauuuuaauauaauuuaguauuauuuauaaacucugugggagaugaaaugggcuuagaaaacccacagaaguagcugguguguaauuuaccauggcccuggggcugaaguaacccauacaaccuucccucauaaacuuuccagaauuuauuuagguuauguugauuuuauuccuuugagaacugauuaccccucaggaguguaaucaagaugggcuugugugggguggggccaaagggagaauggcaggcaaccauucagagaaagugguuuuaccaucucgaggugaguaauguuuaaaguuuuagcugcugugaagugggaugcuauaaaauucgggggaguuuuccuucuacccgguuucauuccccgcuccccuagccccaugcaacugcauuuccccucuucugugcugagggaaagaaaagcugccucuccuuucuugguuuuguagcauggcuuccaguaccuguuagucaucuccuugcuccuuuuuuauuuuuuuugagacagagucuugcucuguugccaggcuggagugcagugcaguggcaccaucucggcucacugcaaucuccgccuccugaauucaagcuaucuccugccucagccuccugaguagcugggacuacaggcucacaccaccaugcccagcuaauuuuuguauuuuuaguagagacaggguuucaccauguuggacaggauggucucgaucucuugaccucgugauccgccugccucggccucccgaaguguugggauuacaggcgugagccaccgcauccagcccuccuugcucccauuuuaagugccgguggauuuggaaagauggauauguagucucugggaucauugucuuugauguauuuagagcuuagcagcuguccugucagcccgagcccugugucacucggcaucucugccaauguuacuacgucccaagaagcuuuucagguggcuuccaggucuguauuggaagcaaugaccuaccuguguugugagauaucccaggagccagccucugucacucacaggcuuccagauugcucugcccuggccuggggucucugucugaaguagagcaugaaagcagccggccccaacccugcaggguacaccugagccuuugacuccgaggaaggaaauggcgauggggggaugcagggaugaugaggaaaggccucacucuuugagugugugaugaaagggaaaggaugucaggaaggcacugagcaaaaggcuguuacagcugaccuugagaggucagccaauccauuagcugcauggggcccagagagggugaaguucuuucaugagaucaugcagcaaguuagugucaagucuagaauuagaacuugggugucuuugacccugacagcgggagaugagcaguggccauuaggugugauggugguuguaggagcagccacaggcacucugaaauugaaggagaagagaagaggcaggggaaguguagcugguuggcuugucagcucccugaggcucucaccuugucacaccaaagggcaaaauguauggagcgugcaugggacaguagaaagaauggaggauucagggccagacaaacccaucaagccuuacucucagaggaacugcucugugugcagguagccucguguagugccagccagugguucccuucuccagggcucucuggcuccagggcagcuguucugugagaggagugucaggucccguuacaggaagagcacagaucaggagucugauguuucugagccaguucuuucacauacuagcugugugaccuugaaaaagucagccugcuggagccuuuguucccugaaccacagccuggccacagcaguccugaccucagagguuaggggaugaaacuagggaccuaucacacuauguggcaccuguguauguuucauaaauucgaccgagcuuggugcuccccacaccccccaagugucugguaauaauucuucaucuuuuuucccauuauuacugacacuauugauagaaaauaaaucccaugagugaguugauugcuuauccauuauacaggguaucauacuacaauuucuuuaauaauagaaaagguuaaaguuuuggaauuacucuuacuugaaaaucuguacagaguuaaaauauuaaggaaaauguaaaauaauauaauaacuugauaaaaugugcaccuccccucauuuugucuuuuacuguguagaagcugauuauguguacagaacuuacuauuauauuuaaaacaaaacugaaaagucucacagauaaauccaaggcacauaauuauguuaugacuguugugcugagugguaauuuaguauggauaucagguaguuuacuuaaaagauuguaauuauccuuauuacacugcaagucaaagauuuuaaaauuuacauucuuucguaucagcagauacauaccaguucagccaucauuaguuugucaaaagcuagugcuuggucguuacccauuuacccgcgcacacaaucagagccaauuccugcauauugcucugugagaacuggccuguccucuccacacucuagccugugcaccgcuugguggccagugggcugguugcuuugucucugugagccaauccuuuuugccugccuucuguugcuucuucuugagagagagauugcggcaguagaaauccugggucugugcucuuggccugcuguucagggaauagcaugaucuccaugcuggcauuuggcuggagccuuagccuggggugauuguggaggagagaaggcucuugggaaaauggacucagaaguccucagcaucuaagacucuuagaacagaauauugcagaggcuaggagucaaaggggcuaggcccaguuaacuaacguuuugacuuguucaugagcaggguguuguucagaagacaaugaaaaugcaccagacugaaauuguacuaccucgccucucacugguuagaacuuaacauuuauuuguccagcacgaaagcccuuuauuuucccuugauuaagaggcuuaauaugcaaauguacaguguagugacugaguuucaguggugguaugaaugagaccacuguuaccauaccauggcaaggaggauuuaggccagaaaagcaggaagguucuggugcuagggcagaaaggggguguagaaaguaugugggggcuuucuuacaggggcaaauggucaccuacaguaaacuucugacuaaucauuuucaccaaugcuagcccuauuuaucuucaucucuguacuagacagcuggaaguugucagagggccaaaggucuuuauuucuuggacaguguuugagcagaaguuuucuucuguucaaugcccaaucaggguaccaaguaggggccaccugcuuuauuuuuuuauuaggguuuccugguaagaucauaugaaaaaaucuguagguuuuggaguaaacaccucccagaauacucuaagucacucuucuuagucauuuguuggguggccaaggucaaggcaaaaaggugggcuggggccugcccaugggaggccgucuuugucaaaccaaggaauucaggcuucaaucugaagccucaggaugaagaauuugaagcagaagagggagaccacuccaguaauaguagggugggucccauggaacagaauaugauugagucaaggagaccaguuuggauguuguuggauuaggagcuagaaaagaaaauagaaauggaaguagauagaaggguauaaaugaguucuggcugacaggucaaauugugauggggacgcagaagucucagaauggcuuugaaugguugcugacagauacucucaggaugaaugaugugagugauacuuuuccacagggaagaagucuguuuccuacagccuucuauuuacugaugguguuuucccuguuaaacuuuccagaugccuacuaguuacagguguuuuauuccaccagaagcaaauucacaucaaauauuuugaauguuaaaaauugcagagcugcuggagcugcugcugcagucagaauugcuucccacuuguuuuuacacaguccccugugauaaccuccauccuaacuggccccuacaucugaucugcucccuaacuuucagcuguccaaaucaguucgaucuguccaacaguucccuuccuucagugguugcccauugcugacaguauaaagaccaagcucuuuaaugcgacucuaggcccaccuaaugcguggcccuccuuauuuccuuguugcugccacacuggccucugccauccccugcuucuugcccaucuccugccugccaggcacuucuguaugccucucucugccuuacccagcuggguccuggucaugaauacaggcauuuuuagcacugugucucuugcugucauagcacuuggcacaguuguguuuuuacauuuguuugugccaucuuugguuaguaauggagagggaucacuugcuuauugcagcagugccuggcauguagcugauccuuauguguuuugaguauaauaacucguucuauugcugacccucugucauucaaaaauguuauauucaguauauuuuuuucugauuguccuguacaaguaagccccuuugcagugugcccuuuaggacccuguucuaacuuuguaacaccccucacugcuugugaguaauuguugauucuuccugccagaauguaaguucuggguugcagaguuagugcuccugacacuugguaccugguggauacuuaauaacgguuuguugacugaaagaacaguuuagacaguugucuauuaaauuuaaagcaguuaaagcccuggcagcacaaguguucaucaaucuccuuccucccucauuccuuccuuucucucuuugacaacucauuuguacuaucacaguauuacauacuugcucuguuaugagcuguccauguacaggaaaaaggggcuauugggcaaucggaguuuugauuaugaaaaguuagucauuaugacaaaaccaugaaacacagaugauaaaccuucuaguaaaauuuaaucuuuugaaauuauuugucaccugggagagcugccauucugacacuuagugcuuuuuaaaaucagucagguguguauguacuucuguuggucagagauggugagugggugugugguuucugggagaccugaaaauggggccagagcuguggguuuucugcagcucuaacaagcugccacccuuauuuuggugaugaggcuugugcccacuuuuuaauuuuuugauuaaauugugcugauuacaugguuccaaagaacuuagggaaugcacaguauugcuccagauuacuugucaguuaggauuuaccuauugugagauauauauauauauauauauauauauauauauauauuuuuuuuuuuuuuuuuuuuuuuuuugcuguuagucauuguugucucauuugauggaucagagugugagauugggaaauguuacguauuaauaucaggaaaagagacaggccuggaguaggucuggagguagggcugcuuaguguuuuauuaaccaugcugaugaaugcacacauucaagauaaucuguucccuuuccauucucugccacuccuuuugaauugcucaaggcugggauucuaugucuggaacaggugacucagaugaaauaaaguuugaaaaggaaaaaaacccugucaauuucugguuacucauuaucauucaggguccagauucugccuuuucucucuacucucuccccccucuuucucccucacuuaggcuccugucaccuuuaacuuucucaccacacuuuuuaaaaguuggccaggaaugaauggaaauggugaggaaugccaugaauuaauauuuauugauccucuguucuguggcaggcucuggaaguauuuugagauucggagagguuaccuaacaugcuagcaucauauggcuuguagguggcagggcugugcuugaauccaagauugacucaggaccuauuucuggaccauguugccuccagugcuuucucauccugguuggacagggagaaacugucuuaaaagucacccgcuacauccccaagaagagaaagccccuuguacuuuuuuuucuucucugaagucacaaaaauacauuccuagguaaagacugggauauuuccaacaccaaagaguaccauauaugauuucugucuuaguccauugaacaaaagaaguuagguaaacagcuucugaucagaaacugacuuggauucuuaaugaacauuagggccaaccugagggguaaaacaguuuuaggcaggauauguugagaaagaaaggccuucagucaauacuagaaguaacuuacaugcagauuuuuaaaaaaagcaguaggaugccuuuuuaaauuuuuuuaauauggggcaguugaagucaguuuggguugaacagaauugauaguuacugccuuugggagucgauuuguagagugaaagaaaucgacuuguagagugaaagaaauagaauagugaucugcagaagguuuuuuuuggcccagugauuuuuuaaagacaucuugcaccugucuuauucucucacuauucuccuaugcuuuggauugcuguaaggaccuugacucagguguugcuuccuugaagaucugaugaccacucuuuucuuuucuugcccucugcuugcuuucuggguuccuguccuugugcuuaugcaguuuaagggaaguacagugguggaaagaucacugucugccuggcugccaccauauuguuggugaccuugggaaagagacugaacccaagaacccauuuuuguaguuucaaauuaggguugauuguaauaguccuauuucaugaggugguugugaggauuaaaugaaacagcauucauaaagugacacauauauaauggugcagugaauacaguuacugcuggccgucauuauuccuugguaccucugguaaggcauucguuuuauucuuuuuagcaugguugucuacuguuacacauaauaucuagaagguagaaucugugacuuacgaauaguacagggcaugguaggcaggauaggaggcgaaccugcuuaguccacaagcgucuuugcaguugacucaaauaaaucuggcagucaacacagugcuuuucuuucuugcacacaucugauguucagaaaacaaaucuuuaaauguggacaguaguucccaaagguguuacuucuguugccuucagguuacagcauggaugacccaaaaguaaaaacauuuaugaagucaucuuaguguauaaauggaaacauuuauuuucuucauggauaggaguccuaaagucuuuuuuuucccuaaaauaucauuuaauucuaaagcuucuauuuacuuuucuuacaauuuaagaaauacaggcagagcauuaccucuguaauacuuggugugcugugcuauggguuuuuagugguuguaauuuaaguucucuggagguugucagcuaccuucucagaaaaaucugagugcuuagugccuuauugaacuagggcuuauuggauauauuuacuuuuugaauucuauugacuaaauaaagaauuaaaaaaccccuauccuuaacucugaaaacuuguuuccuuuacaacugguagauagaagaauuuccagugaaucuuuaaauucaacuccagaaaugaauuuagaauucacuuggauuagaguuguuaauuaccucuuuguucagccaacauuauuugaguagucagcuauagagguauuaagagaaccaaccuugggaccaucagaauggcuucugucuguuaaccuauaaaugagacggacuuuauaaaucuuuuguuaguagggcagucacucucucaucucaccuuaugucugagauucuggcccuuccuaugcuuuggggagguccauuauuuuacacuaaagggaggaagggugauggagaauuguugacacguuugcuuuuggacauguugaccacaggucauaggccccagggaugcagauguugaguauccugggaggauggaaaguacuacugaaccuucaacacaacaucugucgcuuucuuggcuucaaaguugcuuuauaucaucuuuuuuuuuuuuuuuuuuuugagacggagucucgcucugucgcccaggcuggagugcaguggcgggaucucggcucacugcaagcuccgccucccggguucacgcuauucuccugccucagccucccaaguagcugggacuacaggcgcccgccacuacgcccggcuaauuuuuuguauuuuuaguagagacgggguuucaccguuuuuagccgggauggucucgaucuccugaccucgugauccgcccgccucggccucccaaagugcugggauuacaggcgugagccaccgcgcccggccgcuuuauaucaucuugauauuuuccccucaaucaucauaauuuaaagccugcauugcuguauugugccucuaauuuauuauauaaaucuggaauccuacacuaauaaggucauuugcuguuuccaguagaauaaaaacuugaagccaugcuuuuugaccuugaugucugcaguaacuguucuuuucaagcuugcugagaagacagaaagcaauguugacuuucaagggggaaaauaaauauuugaagauaggguuuaguugucucaguuugcacugucagcauaagcaaagaccuucccuuauucgcuuugaaaaaaaaaccuuauuuuuagaguaagggaaggaaacaugucuguugagaaaaccuugcuaaauuuuguggaagugcaaaauucucuccuuaguccucuccuuuucuguagcuaacaauaguaacagugauuacagucagcauuugaauguguaugagccagacccugaacuguuuacccuuaaaauaccuccauuaguuguuacucucauugcuacaaaugaugagacugagguuuagagagguuauuuaucacuuaaagccauaaagaguuaaaaaguggaucugagaaucaaauucaacuuugaugcuugaggacucuuggagcacuacuguauuauaaacuuugaaauuuugacccucuuuugcuguacauggggaaguguggaggguaguagguauuuuuuuuuuuuuuuuuuuuugagacagagucucgcucuguugcccaggcuggagugcaguggcgugaucuuggcucacugcaagcuccgccuccuggguucacgccauucuccugccucagccucccgaguagcugggacuacaggcgcccgccaccaugccuggcuaauuuuuuuguauuuuuaguagagacgggguuucaccguguuagccaggauggucucaaucuccugaccucgugaucugccugccucagccucccaaagugcugggauuacaggcgugaaccaccgcacccggccaguaguagguguuuuucuuaaggauaucgcagacuccauguuaaugaagaggaguucccugcccacuugcuaaauuagaucaaggacauuuuacucuacccacccccgcuccagcccccaaccuuaaucuuucaguuuuaauuucuaaugugguaaauauugauauaauccagcuaaacauaaaguuauuugaaguuuucaauuuucaugagugcaaaaaaguccugaggcuaaaaacuuugaggacgacugguuuaguuuuuaaaacauaggcuuugggccagcaggcccuggguuugagucccuuuucuagcauuuaccagcuaugggccuuugugaaaguuauuuuucugauucucaguguacuuauuugaaaaauaaaaaaaauugaaaaauugguuacacgggguugugagaacuaaauaguacaugccaaguguuucacuucaggcugggugcucuuaggaaugccacgcugcugugcuagauagugcggcugaaaggugaguguguguuuguagaugguuuagugaggggucuaagugaagagcacacccuuuguaucucuuugguugugaagaagcuguugucaagagcacaggagggcugugugaccugguuccagggucccugggcucuagugggucaucugggcuggaggaagaauugcagaggacccuucagagucccgcacucuuggguugggcucagccugacucaggaggcagagugcuguccaggagagaaucugagcgcugaaauuuccuuuggaggcuucccaggcagguacaggcagguucugaccuugauuucuuuaggcagacugaggaggcagcaaagcuguacugaaagcucauugguaaccuacggugugucuuuugucuucaguggccucuuaggacuggcgcuguuuuccuuaagccuuuagaauaaauugccucuuuccugcuccuuggcuuccugagccacgcugccugugugcccgcccuuagcuugcuucucucucagccucuuuuugccugccugacuucucccucuaggauguuuacaauaaaugugugccagagagugaagccccuguaacacaguguuaacuucggcuugaguaaaaugagugaggacuaaagcuagcacugcuuucccacuuccucuggccccacuuucuuuuuauggaaaaaguccucucccugauuguuuuucagcuggaggucuugcucacaagccuucuuucugcaguaguuucauugcagggucaagcagguaaaggagagagaauauugacuacuuaggaugacauauuacuccuaacuguauuuccuggaaugggagaaagaagaguaaugaguuauuaauaucuccauaaauagaguagcaauaacuagcucuaccuuucugccuaagcaugucaguuauaguuuagaagucugaaagagcaaacccauggcuuuucagauuuuaaauucuaaagggagaggcuuuuuaucaggcccacguccugcucuuuuugaaagagguuuuauuuacuuuaaauaaauuacuaaaauuauaaaucuguuuauauucaguucuaacuugucuucaaguuuucugcuugggaagacuggugagacuggagcaagaugaacucaguuuuccccaugaaagauuguuagggaugugugagcagaagguagguuaaccacauguuaacauaccuuggggaguguggcaagguggcugccuuaauuuucagggcaacucagaugcuuccgucuaucugaccugagcaugagcagauagauguugauuaaugcucuuuugccuuguuuuuuggcuuuuuugggggguuuacauuugguaagcaauauuucuaacacagugaaaguaacaaaacgacagaguucucuguaacagaacugugacccuagacucaauaauaaggaagagcguugauuugaccguucauuuuuggauccaguguuuguuaaggcccugacugucaguaacagccauccuuuucaguuaguguguugucuguucccuauucaugugacagggccuuguugagcuuuucaugggcacuugccuuucacugacaggaugcuguuguccuuuauuuccauucugcccuccccacuucagacaugauaacauguuuacuagggggaaaauaccucuacauuuuaaaccacucccaggagcagauaacacuuucuuuuuuucuuuuuugagauggagucuugcucugucacccaggcuggagugcaguggcaugaucuuaggucacugcaaccucuuccuuccagguucaagcaauucuccugccucagccuccugaauagcugggacuacagccacgcaccaccacaccuggcuaauuuuuguauuuguaguagagacagaguuucaccuuguuggccaggcuggucucaaacuccugaccucaggugauccgcccuccuuggucucccaaagugcugugauuacaggugugagccaccaugcccagcccagauaauacuuucaagaagaaaaaugugauaaagguaggacugccuguuuucuuaaguuguuucuagcaccucucuuuacucucuauggcgaugaggaaucuggcuguuaaagacugaguggaagauuagcgugaaacuugucuuaggcuuguaaaacaaaaugucagggaagucuucaagccuccagagcagcacugcccacuagaacugacgugagccacagagagacuuuuccaguguaugcauaaaaaccuaaaaagagaggcgaaauuaauuuuaagaguagauuuuauuuaaccuauuuuagccauacugcuaucacuucaacacaucauuuaacaaauacauuaauuaggcaauuuacauucuuuguugaaaugcaguguguaguauacguuuacagcacaucucaguugagacccaucauuguccaagugcccacuagccacauguggcuuaauggcucucgaaguccgacagagcagauuaagagacauugcuugcucuuuuuacuacuuaaugaacuuuaguuuucuuuuuuucugguuacugaauucuagauguuagauuuguagagccuaccuuuugaccagcacaagagaggccugagccagucuguggucuucuccuuggguuggggggugugugaggaguggauggggccagcguaccucacuggcagguccuaggcgaguugggcuuuaccuucucuccaagagaccugccagccucuucccucgcuugaagacaccaggggugcagaaggcauuuucuggccaacuguucuuugcugaucuguucauccuaagaacaaaauugaguggcuuaaaacaaaauguagcuagccuauaguuccaaaccuuuaaagccucuguuauuuaauaaaggcuggaaaugaguuauucugaauagccagaguuucucagagagcaacucuuuaagcaccaggaguuuaguaacuuucauggugggaagaguucuaaguguugaagguacuuuugucaucuauaugggguggaaauuuuaauuucacuuuguugauggugcagcaucaccuuuuuaguaugcugcuucacuuacuggaugaguagcuaguguagcagauuuaaaagugugagaucaaaagcugaauauagauagaaugaugacguugggacuugauuuuuugacaaguauuugaugguguguuucuuugguguauuugaugguguguuucuuugguuuauuugcaucuuuuucaaaggugaaauagagcauauguagccauaaaggugugugguucuagauuaauuuucacaagcuuucuucuguaaaauuucauauuauaaaauaaauugaaucagaaauauggaaaaaagugaaaauaucacccccccccccccaauacugcuguccucccuccucccaaauaauacuguuuaagcauagugucuggucucuggugauuuccuacauacaauucaagauuugcccccagguaaaaaaaaaaaaaaaaaaaaguauuagaaucuacaucuucugauuauaaguccuaaauuucuauauuuuauauagcuaccuuugggccaugaguucuaagcuuuuucuuauuguauguguaacucugauauguccaaauuugaaaugccacggucauacuuaccugcacacuuuugggggcccauuuagagcauugagucugaagcgccuucuauuuauuagcauagaauguaugcaaacagccauccauaagccguuaagugccuagcugaauaucaggguuuaaagaugugguuaaaacugcuugucugguugugcauuacuaaauuauuucuggauccacuagcuuguaaaacacugcccuagaauguaaauaaaccccuuacaaaguuuguugccuacuuuuuuuuuuuuuuccuuugagugagucugcuacugagcuucuuacuuguauuggcccccauuugguucucugccgugguugauaucugucagucuacacucagaucaaauuauuugaaauccuguuuccuuuguguguguguguguguguguguguguguguguguuuuaaauaaguuucacuuugucacacaagcuggaauacagugaugugaucauaacucacugcagccuugaacuccagggcucaagugaucucccacuucacccuccuggguaguugggaccgcaggugcauaccaccacacccagcuaauuuuuacuuuuaguagagacacgcucuuguuguguugcccaagcuggucuucaacuccugggcucaagugauccucagucuuagccucccaaagcacugugauugcaagugugagccacugugccuggcccugauuuuuuuuuuuuuuuuuaauguaaguauauacugauuuuuaaauuuugguauggugaauaaacaugguuuuuauuggcuuagggcaccuguuacugagaaacuuaauuuuuucauguuuuguaaguuuaauaaauggcuuuuuuugugcuggauuuggauuuguuguucugccaugguaauacauauuauauucaggagaacugacuaccucucacagcugagucacagacaggaagcugacucuccauguuguccucuagcauuuuaauuuugugggauuacuuuucuuauuguagaaugagaccuugcuauaaaaauguugucuuugggaucuugcacauuuuuggacuguguguuuaacuguaaauauugauuuaaggagauuuuaagcucacguuaaaacuaaauuacauuucgcuucugagaaaagcccuuugggaaaaaagauuuuuaggccaaauguggagcuguuuccuuaaguuuguuuuuuuuuccucccuugacuuagguagguagguuuugucuucgccgccccuucccucaacaaguucuuuauagaaaccugugauuucuagcccaguguauauuguugcuuaaacauauagaauauugaggaacccaaguuuuacugguaggguucuuaauaacugccuuagguagacaaaacauuuugcccuugugucccccuacucuuucgcucagaugcagguugagguuggcauccugacauccugaggguagaguggacuaugagaguuuaggacaagaccaggagagacaucuaagggcuucuccugugacugcuuuuguguccauauucuuuuuuuuuguuuguuuuguuuuuugagauggagucucacucuguugcccaggcuggagugcaguggugcgauuuuggcucagcgcaaccuccgccuccuggguucaugcgauccuccugccucagccucuugaguggcugggauuauaggcaccugauaccaggcccggcuaauuuuuguauuuuuaauagagacgggguuucaccauguuggccaggcugguguugaacuccugaccucaggugguaggcccgccuaggccuccaaagugcugggauuacaugcgugagucaccaugcccggccuuguguccguauucuuagucaagaaugguguauauuucuuuuagguuugggaaggggagagugauguaucugguccccauagcagggguaggaauuuucaaggguggaguaauuaaagacugcuuuaaaggaacagauauucccaccuucuaauuagagaagaucugcacugcaagugaccacaaauuaaaacagcucaguggggacagaagauuggaugucaugucccaacagccuuauuuaucucuuuuuccuuccaagguuuuuuucccugcccccccuucuuagcuuuggauagagauuagaaaagcucucugaggaaaaaauuaaccagcaaacaaacaaaacagaucccaaauaucauuuuaauacuaugucuaguuugguccaagaaauaggcuugguuaaucuuuacagcagccuuugaaaaugaauggaaauacuaaggagguaaacugcuuauacuuuuuggcaccucuucugcuuccagugaagaaaugcucuguaggugcuugaggaacuggugucgugaugaaugucaccaucaaaagugaagggucgagcucuuuuuuucugauaagcaaaaugacuuuuaaugucuguagcacauugaugugcuauaucaguuguauacauuguagucuguuuucuauauccucuuauucagaggaguagccacaacuccagucucugguguaaaacagcauguuaguauuucauagaauuuuugagagaauguuggcuggcucuguuuguaaauacuguaccuugcuuuuuggcuucugaagaauagucuaaaguuuaccgagugaagcugauuaagcaaggaagcacccuaaauagauuuccauuugcacaucuucaaaaaaguguguguggguaugugccucuguguauauggaaguaacaaaugcuucugguauuugccuuuuaaaagcaagaaaacaaaacaaaacaacagcuucuacuguucugcuuugggaaagcaggauuuucugucagaugacaaauuuauugaagaacuuucaugcguccauguaauuucuauuucccauuucuugacucugaauuuggaauacaacaagacugcuuucagaaauaaggaaugaggccaggugcguugucugucaucuguaaucccagcacuuugggaggcugagguggauggaucucuugagcccaggaguucgagacuagcgugagugacauggcaaaaccccaucucuacaaaaauacaaaaguuagcuaggacaagagaaggaaauaaaggguauucaguuaggaaaagaggaagucaaauugucccuguuugcagaugacaugauuguauaucuagaaaaccccguugucucagcccaaaaucuccuuaagcugauaagcaacuucagcaaagucucaggauacaaaaucaauguacaaaaaucacaagcauucuuauacaccaacaacagacaaacagagagccaaaucaugagugaacucccauucacaauugcuucaaagagaauaaaauaccuaggaauccaacuuacaagggaugugaaggaccucuucaaggagaacuacaaaccacugcucaaggaaauaaaagaggauacaaacaaauggaagaacauuccaugcucauggguaggaagaaucaauaucaugaaaauggccauacugcccaagguaauuuacagauucaaugccauccccaucaagcuaccaaugccuuucuucacagaauuggaaaaaacuacuuuaaaguucauauggaaccaaaaaagagccugcauugccaagucaauccuaagccaaaagaacaaagcuggaggcaucacgcuaccugacuucaaacuguacuacaaggcuacaguaaccaaaacagcaugguacugguaccaaaacagagauauagaucaauggaacagaacagagcccucagaaauaacgcugcauaucuacaaccaucugaucuuugacaaaccugagaaaaacaagcaauggggaaaggauucccuauuuaauaaauggugcugggaaaacuggcuagccauauguagaaagcugaaacuggaucccuuccuuacaccuuacacaaaaaucaauucaagauggauuaaagacuuaaacguuagaccuaaaaccauaaaaacccuagaagaaaaccuaggcauuaccauucaggacauaggcaugggcaaggacuucaugucuaaaacaccaaaagcaauggcaacaaaagccaaaauugacaaaugggaucuaauuaaacuaaagagcuucugcacagcaaaagaaacuacuaucagagugaacaggcaaccuacaaaaugggagaaaauuuucgcaaccuacucaucugacaaagggcuaauauccagaaucuacaaugaacucaaacaaauuuacaagaaaaaaacaaacaaccccaucaaaaagugggcgaaggacaugaacagacacuucucaaaagaggacauuuaugcagccaaaaaacaaaugaaaaaugcucaucaucacuggccaucagagaaaugcaaaucaaaaccacaaugagauaccaucucacaccaguuagaauggcaaucauuaaaaagucuggaaacaacaggugcuggagaggauguggagaaauaggaacacuuuuacacuguuggugggacuguaaauuaguucaaccauuguggaagucaguguggcgauuccucagggaucuagaacuagaaauaccauuugacccagccaucccauuacuggguauauacccaauggacuauaaaucaugcugcuauaaagacacaugcacacauauguuuauugcggcauuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaucaucauucucaguaaacuaucgcaagaacaaaaaaccaaacaccgcauauucucacucauaggugggaauagaacaaugagaucacauggacacaggaaggggacuaucacacucuggggacuguggugggguugggggaggggggagggauagcauugggagauauaccuaaugcuagaugacgaguuagugggugcagcgcaccaacauggaacauguauacauauguaacuaaccugcacaaugugcacauguacccuaaaacuuaaaguauauauauaaaaaaaaaaaguuagccaggcgugguggugcaggccuguaauccuagcuacucaggaggcugagaugggagaauugccugagccugggagguggagguuguaaugagccaagauugcaccacuugcacuccagccugggugacagaguaagacccugucuaaaaaaaaaaaaaagaaggaacaaagagacauaccuaggaucagcaggaugaucucacagaggaauggggggucaucaagauuguguauucagauaauguuugcuucugcuguaaguccucuaccuuuuuaucuuuucacuuccuucuguuuugaauuuggggaccaguccaggcuccacagccugggcacaacacugauaccugccacugggaagggacguaaccuuucuuguuucguugggggguguaugugccgcuuccaucccucuguugguguguuggaaaguaugaugggguuuuaauaacagcuuuucagcuaugcauuggcauuuuuguaaagaauucaguguucaacaguuguacauacacacauucuuaucaggugaagaagcaugaaguuaacuaaaaggaaaggagaaaacacacugaagaaacugguaaacguucgguggaacauauucacuaggauaccgccuuuguagaaaugaucuuucuccuccccuuuuacuuuuauacaacagagaggcagaauacucugccaugagacugauccucuccugcuucccagugcugcuuucaagucccagcuugugguugggaacacaauagcuuaaccccuggagucucaaugucucaucuguaaaaugggacucagacaaaaggccagagggggugaaacuuuaaggugccuuucuucauucagcacauuauuggguacauacugaauacuaggcacugcuguuuccauguauuuaaaauggaaagaaaugcauggccucugccugaccucauggagcagagagagaagacaggcauuaagcagacaacuccuaaaucagugguuacaugacauguaaguuaaggaacuguuaggaggugcugaaacuaaacuggcuuucauuuaaaaccaggugaguugguaggggcucgacuacagacaccuguagguaggguagacugggcauucuaucugccuucaagguaugaaucuucgcuguggucuggacagugugucccauuuacguauacacuggcauugcuuucuuuuauacuguuuuguuucaguuuggucccaaaggagccagcacaguguucaucauucauggggaggugucagcugucauucuacuguuuccuuaucaauguuuuacauuuugguuuugagcauucugauccucauagagcaggugaccucuguguuuguagggugagccaugugaacguccucuggggcuggugggggagagcagugcuuuccaaagcuuaacgguguuucaguucccuauuuguuuuuuguuaucuuuuucuucugaaccucccuguuuuuccaggguuguaaaguggauuaaaacuaauuuuauauugaaauggaaacuuuuauaacaugcccaaggguaaaugaagucacaacaagguagugaaugaaagauuucuugaaaguugaugaaaauaaaguagcaugggaaucacacuuggucauacaguuuuaaauuccucagguuguauucacagugcaccagcuugucucuuacggagugcuuaguuucucagcaguucauauucuuguaugaaggguggcauuaucucaauagaauugguucauucuuagcucaggagaaaaugccacugcuuauauccaucugcauuuucucauauccuuauucauauagugccuagccuauuuucugccaaucauagcuaagcucacccuguguaccagaagucacauaguacugggaaguuccaggguaaaggagggaaagaaagaggaugacauugauggugcacucagcugggcacugugcuagugcuuucaccuaugaggaugaauuugagguaaugcuauucccauuuagcugaagaaaaaaccgaaggcuuagcaagguuaauuuaccugucuguggucauaaauuggagguacugaguuagaauccaagcuuauuccauaaaacugcaccaggaguuuuacuggccguguccacauuccacaucauuauugcuacuggccacuguccacgucuguguaugaaaccgugucaggcucaggagaccuguuucuguuucuacuggugccaggcuccgacuguagggagcauuggcaguucacgcagauagucauggcauucaaggcaaaagcagacugcaggacaaugccaguucuguguuuauugcacaguaaaugaugacaguaacaauagccagcauuuauuguguguuuuauucacuccaggaguuguggagcauacuuguacaugcaauaucucauuuaaucucucaaauuaaugcuauaaagcaggcacuguuuuuauuuccauuuuuuagaugaugaaacugaagcuuagagguauuugugcaguuugccugauguauagguacagagcuacuaaguagcagagcugugauuugacuuccuugccaagcuuaaaugccuccccagauuugccuuugauuuaaagaguuaaucaguuucuacagcucacccuccccaccugcccuuuucccuugccuaccccauaacaugcauuuucaaagaaaaucuuuguuugaaauaguuuuugaaaugugccuuuggcauuuugaacauaaacauucucauugugcugcuugcaggcaagaggcuguggaaaugcauucccuggaggauuuagcaaaauaggguagauauccaucuuuuuuuguugagguucuggacucugaaaaaucaagucaguggcauucuaagaucucaucuagcuaugauuuaugaaacacagugagauauggauuucagcaaguaugggaaccacuuuuagcauuuuaugaauuaccuuucagacauuuuuguccgcaaguauacaguuuuuuuuuuuuuuccuuagcccagcaaaaaccuuuccaggcuuuagucuggaagacagucuguuugucucaaggaguguucauuauagaaacuaccaagggauuuuggugacuguuuuggauuuaaccaguaaugcacuuuuaggaaaguaccucagucuuugguggcuugaagaguuaaacuaccuugguguaaauggcucuuucagguugacugucucugugggguuugcaggaaccacuaaaguucaacacccaccauggcccuuguccagaaggguggacagcuagcgccuggggucuuuauuauuaguaguggcuauuuccaguuaaaggaagagaaggggaugauugacaagccgaauauggcauuugguuuucuuucuuucuguuaacugcaaaggcucaaucaaauaaugacauugcuuuuguuuuucaguguuagacacuaguuaauauuaaucuagcccugucugcaucuuauauuauaugugaaugugaaaugccuucaaggggagagauaaucugcaggucaucucuuacuagucaguauguuuucaugucuucauagugccacccgauucugccaacucugggaaaucacuuucaagguauggauuaugacaucauucuauucacgguauauuagaggcuuugaguugggaagcuuuuuugcuguuuuuuuuuuuuuuuuuuuuuuuuuugagagauggaaucuugcucugucacccaggcuggagugcaguggcgugaucucagcucacugcaaucuccaccuccugaguucaagcaaaucuccugccucaguuucccagguagcugggacuacagguguguaccaccgugcccagcugauuuuuguauuuuuaguagagacaggauaucacuauauguuggccaggcuggucuugaacucaugaccuuaggugaucugccugccuuggccucccaaagugcugggauuacaggcaugagccaccacguccagccuaguuggaaggcauuguugauguaaguuuucaucaagcagaguuaauucaaacacagccuugggaauaugcccagagaauguaagguggcuuacuggcugucaauaaaagaaaugccaacuccucaguccucagcagcuccauguuggagcgagaaaggcuuuuuuugcuuuaugaguuguuaggagagaaagcccuggaauggaaggcaggcaagugugaagaugaggggaaggaaggaguccagaauauuguuagucauggccacaaaaacccagugaguuguaugaggucucacaauggugaaguaacaugauaugaugaaauguaaauauuuguuuuuauuuauuuaugccuugcuccagaaauaauuuaaggucuauaugggcagcugcuucauuuauauuagcuaggaaaaguuauaggaauucacuuuguuugcuagauuugguaaucacuaaugacugagaaugacaguguuugucaaauacuuaaaaaaaaaauuaguuuguuguuuugaugcccccuccucgcuuuuuuuuuuuucuuucuucccuugaaagcagagugaaaaauuuuuguauucugggcuaaaauucuuaaagguuuucuuguggacuuccuaguaaaggcccuuugucuguuaugcagaguccgaauucacaugaccacugcuggggaauaaauaacugcuuaaauacagcaaaggaaaaggcuggcuggucuucuugcuccuuucauacuuguuuauuucccaccccgaguuccugaccccaagagaaacucuuguggaagaaaaaagcuuuacugaaauuggugggcggccugagacaacuguugaaggaacagaaacuccagaaagugauacucugaguaucaucuuacaucuuuaugucugacagaugaaaaguuuuuggucucuuuaugucugucugucugucccucucuccucccugcuagcugcacacucuuuucuucuucuuucuuuauuuuugcauuaauccgcucucccucuguuccucaucugccucuuaaguuucuccauuuaacagaguagauuguugugaacucgaaaucaauagcugauuuaggccuaccccuugccuuguuacauggacuugucuuggacagaguacuuugugcaaacagguacuuguauuuacugccugucuuuucuuucacuaggugacguuaguaggugcacaucugucuauaguagcuguuacuguguuuugaugcaugcggggaaacuuuauuuauaguaugaguucuuuuucuuuuuuuuuuuuuuuuuuuuuuuuuuuuugagacagcgucuugcccugucgcccaggcuggagugcaguggugcgaugucggcucacugcaagcuccgccucccagguuuacaccauucucccgccucagccuccugaguagaugggacugcaggcaaccgccaccacgucuggcuaauuuaguuuuuguauuuuuaguagagaugggguuuuacugugcuagccaggauggucuggaucuccugaccucgugauccgccugccucggccucccaaagugcugggauuaacaggcgugagccacugugcccggcugacaccuugaucuuaaugaagucauaggauccaagugcugcugucagacccuccugcaaaauuuuacugugggugcuaauacaaauugaauuaagccaagagggaaucuggaagcugaguagaugccaucuacuccagcccguuuccuauuuugcagcuaggacuaucagugccugcucgguaguaguugaaaaauacuguugacauauuauggaaggucagaggugcauacaggucauuagugacaggacuggaaucugaccuguguccucuggggucugguucaucuuuacuacagguaugucuuuucuguuguuguuucuuauuuuugagacagcuucacuuuguugcuuaugcuggagugcuguggcuugaucacagcucgcuacagcuuggaccuccuggguucaggugauccucccaccucagcuuccugaguagcugggacugcaggcgcgcaucaccaugcccagcuaauuuuuguauuuuuuuuuuuuuuuuuuguagaaacagggucucaacauguuguccaggguggucaugaacuccugggcucaagugaucugccuggcucagccucccaaagugcuaggauuauaggcgugagcugcugcaccaagccauuacagggguauuuuauuagcaaaaugaccuccaucacuuauaaauaaauuacucugcuaugaaaagguuucaccugaguauuuauugggaguuguguuugggaaagaucuuuaacaccguuauugauucuucauuuaacuucaugcagagcacagugguacaggguuuguuggacuucuaaggucucauucaccucuugagauggcuucacaacuaucuguguguaccuuuggaguaagggauaagaaggagggggaugucuuucaugugggaggcuuggggcauaaagagccuugggacuuuguuuuauacaauuacaaugucaucagaaacucauugaaauaauuauaguuugacagaugcuuuuuggaauaaugauauguuaauacuuuuauguaauucucuguuaguaauuccagauuacuuguuacagguuuuagaaauagcauauauaaucuguauuucugcauuuaucucuuuuucuacaaaauuugagaacaccuuccuagcaaaucauugguaaauacuauaagugaauagacuagaucuacagaaaaccagucaaaucuguagcucacaaaugguagaagucaagaccugaacccagaucacauuuuaaaaaauaaaucagauauacaguaauaaugacagauuacuuaauacagacucaauagauacauaaaauuuuaaaaauaacacaguccccccuuauccacgggggauacauuccaagacccccaguggaugccugaaacugaggauaguacugaaccccaugguuuuccuauacauacauagcuaaaauuuaauuuguaaguuaggcacaguaagagauuaacaacaaaagcuaauaauaaaauacaaaaauaggcuggaugugguggcucacgccuguaaugccagcacuuugggaggccgaggcgaguggaucgcuuggggccaggaguucaagaccaaccugaccaacauggugaaaucccgucucuacuaaaaauagaaaaaauuauuuuuacaggcguggugguacacgccuguaaucccagcuacuugagaggcugaggcacaagaauagcuugaaccugggagauggagguugcagugaggcgagauugcaccacugcacuccagccugagugacaagagagacuccaucucaaaaaacaaacaaacaaaagcaauaacaauacauuguaagaaaaguuaugugaauaugggcucucucaaaauaucuuacuguauauaauacuuuuagacugugguugacugugcauaacugaaaccauggaaaaugaaaccucggguaauggggguacuacuguugucugucuuauaguaaugaacauagucacagaacccucuauucuuggaagaugacagagcaaaaguaucugaaauuugugguuacaguagcuguuuuacauuuuuuaugugagaagagaugcuacagaaggauuuaaggacacaucgugagcguuguguuacucucuguuuggcaguauaguauaguucaccuuugaacaacauggauuugaacuguguggguccacuuagauauacucggauguuuuucagccaaaugcauauugaaaauauaugcaggaugugaaaccuguguauaaggaggagcaguuuuuccuauaggcaaguuccacagagcaucugugggaauugacuaagugcggauuugguuauacuugggggucuuggaaccauuccccagagucuaccgagggaggacuguguaugaaauuuaggcuucccagcuguguccuuugauaaccauaacccugacugaucccguagcuuuccuuuuaggaggaacuacguggucuaaagaaaggaaagaaaauaugagaaauuuggcaaaggucaggaauauaggcauuagaaauaaucacacucacaucccagguggcacacuuucuuggaguuaaaaugaaagugaucucuuauggauguucgccacuauaaagaaggguugcuggccgggcgcgguggcucacgccuguaaucccagcacuuugggaggcugaggcaggcggaucacgagaucaggagaucgagaccauccuggcuaacauggugaaaccgcgucucuacuaaaaauacaaaaaauuagccgggcgugguggcaggcgccuguagucccagcuacucgggaggcugaggcaggagaauggcguaaacccgggaggcggagcuugcagugagccgagaucgcgucacugcacuccagccugggugacagagcaagacuccaucucaaaaaaaaagaaaaaaaaaaaagaaggguugccauuucguuuugggguucuuguuucaguagacuauaaggggucauucaguuagguuaggcuuuucucucugugaacaaaguuugcuuccuuugcuuuccuuggucauuuuucuccuagaaagagcucuuaucuguuuucuuuuaaggagucuuucaugacaccaucuccuuggcauuuccucugaguuggcgguccugaauuucccagccaugaggaaggguuuguuugugaaggggagcuguaacaucagugaaaugagcuuuuucuuucccuuuucuuuucccuuugccauuucccuuucccuuucccucuccccuccccuccccucuccuccccucuccccuccccuccccauuccccuccccuccccauuccacuccccuccccucuccccuccccauuccccuccucucuccccuccccauucaccuccccauuccccuucccucccuuccccauuccccuucccuccccuccccauuccccucccauccccccuccccucccccuccccauuccccucccccuccccuccccauuccucuccccuccccuuuaccauccccuuccccccucccccuuuucucucccccaccuccccuucccccauccucucccccucccuucucccuucccuucccuccccuucccaucccccuucccuucccuuuucccuuuccauccgucuccucugucuugacagggucucacuuugucagccaggcuggagugcaauggcacagucucaccucacugcagcuugugacuccugggcccaagugauucuccuaccucggccuccugaguugcugggaauacaggugcacgccaccacaccuggcuaauuuuuuguauuuuuuuguagagaugggguuucacuauguuggccaggcugguccugaacuccugaccucaggugauuuucuggccuuggccucccaaaguguugggaucacaggcaugagccacugugucagccagcuuuuucuuuuucuuuuuuuuuagauuuagacaauauuuuaaguuuccaaaauauuuuuauaggccgggugugggggcucaccccuguaaucccagcacuuuaggaggccaaggcaggaggaucacgaggucaagagauugagaccgucuuggccaacaugguaaaacccugucucuacuaaaaauacaaaaauuagccagaugugguggugugagccuguagucccagcuacuugggaggcugaggcaggagaauugcuugaaccugggaggcagagguuguagugagcugagauugugccacugcacuccagccuggcaacacagcaagacuccaucucaaaaaaaaaaaacaaaauauauauauauauauauauguauauauguguguguguguguguguguguguguguauauguauuuauauucucacacuauuuugguucuuaaaguggcucccauacacauugagacuuuuguauuugaaguagauaagauguucuucuauuuaaaaaauaaaguuuggagaggcagagguaaaauacucucuguuagaauaauauaagaaaauuguuggcccggcgcaguggcucacgccuguaaucccaccacuuugggaggccgaggugggcggaucaccugagguugggaguuggcgaccaggcugaccaacauggagaagccccaucucuacuaaaaauacuaaauuagcugggcgugguggcgcaugccuguaaucccagcuacuggggaggcugaggcagcagaaucgcuugaaucugggaggcggagguugccgugaacugagaucgcgccauugcacuccagugugggcaacaagagcaaaacucugucucaaaaaaaauuguuuaaaguggaauguuuaacauguuggcaauuuagauaaaaaagacuagauugaauccaaagaaccaacuuaaaaaaauguggaauuauacuucuuccuagaacagaaugucaaggcuauaauaaucgcaguuuuaaagugaaacauuuguguuuugugaaguugcuauagaaguuaaagauacuaucauuguaaugugauuuucuuuucuuuugguuuugguauaaaugaaguauuucauauuuaaaauuauguaaauuaaaguuuugagguuugcuguuauuagauguauuuuuucuuaaaaaaauuuuuuuuuaugauaguguagauuguuuagcuaauguugcuugaucuuuuccagugaauugugugagguuuugcuugggcccagucaucuagcauacaucaguuugguguguuuugugugucuggcaucacacuagguccuggggauauauagagaggagaguccuugccuucaggauucucucacuuuacaggcagguaauucaguuauggggaguaugggagcauucuuuuuuuuuuuuuuuuucuuuugagacgaagucucucucacucuuguugccgggcuggagugcaauggcaugaucucggaucacugcaacuuccgccucccagguucaagcaauucugucuuagccuccugaguagcugggauuacaggugcacgccaccacaccuggcuaauuuuuuguauuuuuaauagagacaggguuucaccauguuggccaggcuggucucgaacuccugacugcaagugauccaccugccucggucucccaaaguguugggauuacaggcaucagccaccacaccccgcugaguaugggagcauuuuaaucccuauccugccccaucugccacccucaccgagcuacauucagcgcuggugcugagucagggcagacauaauuggagaacaguggguuaggcugugugauuguguagaccuggguggacugagauaggucuguaagcuugggcaacucacguaaccccucucaguccauuucccugucugaaaaaauagaaccgggagucuauuccaaguaggguuguuuucaggauuagaagguauauggguggaaagugaauugacuuuuaguuaagcauucaguaggugguguuucugugaucuuggugaugaccucuggcaucagaaauuguguaucccacauuuaaaggcaccucauuuaaaaugucuggaagaaauccucaguaagagaauauggagucuggcaaauugccacaccuagguaagaugcuuaaucgacccuuaaucuucgcuguggugacaaauccaugccuggcauagguagcccaguuggucuuguccccugcauccuugucccccugggcagugaagauuuuuccuugcagugacuugaauuccugggauuuggaacaccagaggaguuuucaaaggaggccauucugaauagaagcucuguccgguccaggcccucauacucccauucaacccugaguacagaaguacuuuugauaccaucugcugaguugucagcucuuguagagguaaaacggcuaaguggcacaggggaagauuauuaagggcauggccaucuaaaugggagcucuuuaacaaaagucuggcaguaaauggaauuuccucauucuaaauugcugugaagaaaccccccaagcauguguugcacaaagcuguacuguugucucacuggggcuagcagagggcugugaagcucucucugacuugauaaaaucccuccuccuaggcuuuucagugcuuggcucucccuguguggguguaauuggaacugggagaggaaaggauuauggaaagcaauagucugcuuucugcuaguuuccagcagcuguuuugggcuggugggggcugggguguuaugugugugguggugaauuugaguggccgccauuuguggaaaugugacaacaugucaucaacugauagguagcuagaccugaggaaugugaggccagaagauucuagcugcaaagggccccagcucugcagccccagaugcagggucagaccucugcucuacugcuccuagccccugcugugaccucgggcaaugcaccugggugggguaggauguguaaguccacucugucauuagcacagucuuccaggaaagaauccugugagacagaagaauccggugagacugagagacacaagaaggagaaguuguguagcacuuauacuuaccuaccacaccagccaguggauaaaggcgcuguucucaggguugcuguagagcuagacaggaguuaguucaugacagaaucacauugcaaagagaaagaaaacacaguuaaguuauuaauauauacccacuuuacaagucgugaccaggucagaugacuuuggauacaguauauacauaucauuuucuuuugagcuuuaucuugaugauugugauuuuucuaggguuuugguggccaaguuauugggcuuauaaguuuuaaauuaauuuuuuauugauuaaagaauuaaccagaguuguuaugcaaauguccacaaaugugcacaaguccuccuugcaucuucuagcaaaaggaagugugagugaagcaacaauuuccagaagguuuuaaauaugccaggagugcuggcacagaaggcccuggcauucauggacucuagacuuaauagaagcucagggagaugaacuaacuugaagagugucuuaccacaaucucuaugagaaacaaaggugaggaauucauagaauucugaucugaauguugcugugaaauacaguuauuuuguaauuucggaaaugccuuuaacuuaaaaagcucucuccaggugcauuuacaacauaaucugacuuaaaaaaaaaucaguguuucaucacaaggcuguggcuggagagggggcuggagaggacccugagaggucagggugcaugcaguguggcuguaugauuuugccugagaaauaggaauguaugauggcauugugucacauuuuuucaucuuugucacguggggcuauagugacacaacuguauuuacagggaagucuguggguuugguguucccuaaggaggguuuauuuaacauacuuacaacauuguuuacucagauaaggaaacaccgagaugcuaaaaaaaugauugugcauguauguaugugauaugcguaagggucuagcuuccuuuuauaaaauaugagugucaaacauauguagcauugcacuguaaugucauacguaaaguucuuucugaaaaauuauacccaaauugaaccuugcuguuaaauucauaguucauuuuguuagaaaggccauuauacugagugaaaaaugacuuggaauuuaaccuuaguuuugacacuguguuccuggcugaaucuuugccuugagcucaaauucccauugguaaaauuaaguugagaacauucucauucugccuaccucuuugagguugauuuaugaugauccagugugugaauauauuaauaugugcaaggacauguuugaaaaguauguaaugacuuaggagaugguaugccauauguauugcauuuuaaaccuuuauuuuaaugauaccuaaggaauuaguuguagggauaguuuugcauuguuauuaaucaucuaauaauugugucugcuuuuaaagcucuuagauuucuguaaagcagauuauacuugaauuaauauaagcccugcaccuucuugccacucauaaccuagaguaauauaaccaagacccugaccucuuugauauuuuggcucaucuccuucuuuuugugaauauuucccuuuucuccugcauucucucuuguuuauaaacauaucccuugaaauccuagaugcuuuuaagugaaauaaucucagauuaaaauauuuauuucacuauuuaagugaugaaauuuaugagcauuauuaguuggacaaacuaacauuauguaauucccuugcaauacuguagguaauauaccauuaucagaugguccaaaaaauguuaaucagaauuuaaguaagcaagguaaacuugaggauaaaggaacaaauuaacaacacaaauaaugcaagggaauaaucagauaauuucaaaaugugagaccuuccauaaggcaacuggccaguuucuuuaaaaagucaaucccauggaaucaaagggggauuugaagaaacaagcuaaaaaaaaaaaaguauguagggaggaagggguauugggaauauuugaauguagacuggauauuguggauauuggguaauacaaggauuguuguuuuucuuagcugugcuaauggcaugugauaauggcaagauacucguaacuguuuuuagagaugaaguauuuuuuguuuguguguuuguuuugagccuggagugcaggggcgcaaucacggcucucugcagccaccaucucccgggcucaggugacccccuugccucagccucccaaguagcugggaggugcgcgccaccaugugcagcuaauuuuuguauuuuuuguagagaugggguuucaugauguugcccaggcuggugucaaacuccugagcucaagcaguccacccgucucagccucccaaagugcugggauuacagguguaaaucacacugccuguacuuagaaaugaaguaucuugaucucuguauuuuauuuuugaaaugauucaaugaggaaaucuaucuuacuaggagaaagauaaauuugucaaaauauuaacaaguguugaaucuagguauuaaguaaucagauauucauuauauuugggaacauuccuuuuacuuuucuguauguuuagaaauuucacaauuaaaaguagacaaaauaguauuucaauuucugagacaauuacucugugaggcguauuuuaaaguguagacccgguugaauuucucuaaagguguuucuuugccuuagugaacuuuugccucuuuucagcuugcuuguuucaucuuuaaaaaaaauuaaaaaaauuaaauggaaauuuaaaaagguuacauacccuauucggagacauggguggauggaaaguguggacacuuucauuggcccuggcugucucacagacccaguuuuaccuucaccaaaguuaagggacccuuuuuaucuuugacugcuucugagaaaacuuuaucccuugccugaugaauugaacuaauguggguacccacuauguaugcacgcacauauaagaauuuguagaucuuaugaauuucugaaauuacagaaaaaugaacuggucugauuuuuccucuucuuuaugagugcugggggcuggacaggagguaagcuggugguggucaccugggcuuagugggaaggaugucacugcuuuagaaguuaugucaaucaaauaaguugauuggauuucugcuuuaugauaagcguuaucauaaaugucuuauagguggucugugggaggacucuggagaccuggagcagucccuggcucccagucuuugggggugugucuuggaucuuuuaaaagugacuucaugcaauauaaauacaguucaugugauuuguauugguuggguaauuuuggaggaaguaaacccuaagccaccaauuuccagcuuuauucagauuuagagccuuuugucuugauuuuuuuuuuuuucauuucaaaguuuucuuuaacaaaaguuaaacacuggauguuuuuuccuaacuuguuuccggcuuuggcaucucuaagcucauuucccuuuauguuuccuguucuaggaaauaauuauuucaaacuuugucuuuugcauagguugagguaccuucuuuauguuacugguggacgguguccagguucuuggcacuuugaacaaagauuuggacaaaaugcacaaacaaagcaaggaaagaaugaaacaacaaaagcagagacuuacugaaaaugaaagcacacuccacagggugggagcgggcucuagcaagcagcucaaaggccugguuacagaauuuucugggguuuaaauacccucuagagguuuuccauuggcuacuugguguacacccuauguaaaugaaguaguggccugcagucagucuuauuggucccuuuccguaacuaaucagaguuugaagugaaguuacaaaguuauacccuaugcagacaucuaauugguuguggaaggcaaccaauucuccugccucacuucccacuggagggauuuguugacuaugaaaaggggauagcuaagugaaacaaugggcaagugacucaaucuggugagaaaaagccacaguggcauguuugguauccuccuuuaggaagagcaaaccgagagccacacauacuugcaaauauguuaucucacugggaguuggguggagaggcccuaugauuuaaccuggcuuuuauuagaauuuuuuuuuauuagcucacaauugugaagaguuugucucuucuccccuaaauguguggucuuuugaaagcucuucaguuaggaauuucagagggagcuuuugaacacaaagacucuuccuucuguaugacagcuugcuuuggcgugucuuuggcuuuuguuugcacugugaucuauuuaucuccagaguggccuugccuuuuaacucugagaccucagaaaguacaccagugcuaaucauuuggugugaaccaaugucucaccuuuagagaugggucugccucuguuuuuaucuagcucaggguccucagcaggcagaguucaugcacugcuggcuccagacugaucuccucgcagagagagaugcuccuucuaacugacacccaaguggaguauaugacagguugucauagccuuuaauuaggcagaaaauucacuuuaauaauugcuaugacagcugggccugcuaauaacugggcuagaaugagcuguaauauucuauugcuuguguucagaucuguuucuccccucacccccccuuacuuuuccacaaaugaaauggccuuuuggauuugguggacuuacuauaaaucaaaacuuguuguuguuccaauaaaagauugguauucaggaguguuuuggaguagguaauugaaacacagauuuucuuuauuuuuucuucauuguacuuauuuguauacuuccuuuuuacacauggcuuauuagcugcaguuacuuaagcugccucucuaagaauaugauuaucuuguaucauaacguuaguaauauuuuaauauauaaugaauugggggcacuaaagugacuuaaaaauuugcauuucugcauccaauuaagggguauaccaugccccuuucgguaaaauuuugaucuguuuccucuuuaauuaaccccagugggcuugggaaguaacugagcaucgugauauuuaauauauauugcuuuucuuuugauacuauuaacugcuuuuaacaaagaauacauuguuggauuagagaagacaaagcucucaaggagcaaaugaguccugcaugcuguucuaaaacaccacauugcugucgucagcguugauuaagguuuugcuuagguauuguaugcuuuugauuauaguccugacauuuuaguuuuguaugcuuuuucuuaauauuaaccccacagucuacuuuuuuuucuguugcagaccuuaagacaauguaguaauacgucuuuuacccaucccccaaauaacaguguacacaguguguuuuuuccccuuaguggagugagcaguauguuagugagguuaggugagcaucuagauuuguuccacagaaaaggguguuuccagccaguaucagugauguugguacuucuccaacagucuaaaucuaaggguuuuaggagccuguuugauuaagugauaagaagauacccucgucugguguuucuuucagugcugccucuucaucuuuuagcagaaggcacaaaugccuuuuauuugcuccguggugaaaagcuuccaguucucaauaggcacaggaugucaguggccacaguugguguaagccuguucagagucuucuaauuugaaacuguagugguguuuaguuuauaaagcuaaaagaagaaucugugagggucuggaauuguauuugugugugaauuuugugacuuuuagaugagaaagaaaaccuuugcuuuugccaaaaucuugugcaagauguuuguuauauguuuguuuguuuguuauaucacuuccuggaaauaacugcaguucacuauuaaaguuucguuaagugacuuggcuuuuuuaaaaugugaaaauuaacugauucauuauuguggucucauuuguucuugugucauuauuauuuaaauaaaaagguagaaugaguuucagcucguuuucaugaauauuuaccauuagccgguucuagaucuguaauagugaauauucagcaagguaaggucccuggccuccuggugcuuacagacaugaaaguuuguucuuaaguggagggauggaaguggucauaacagauagaauuuugagaagaaauaagguaaggauaaguuaacgggagugggggagaaugggaaaauuacucaagauuuuugcaguauguaccucuacaguuuauuugaagugaauucaauucucauguuuggaugcuaagccauaaugagauuguguucuuaugaugcucauccagaaaugucuuuuucuuuuuuuuuuuugagguggagucuugcucuguugcccaggcuggagugcaguggugcgaucuuggcucacugcaaccucugccuccuggguucaaguaauucuccugccucagccuccugaguagcugggauuacaggugcccaccaccacacccagcuaauuuuuguuuuuaguagagacgagguuucaccauguuggccaggcuggucucaaacuccugaccucaggugauccacccaccuuggccuccuagagugcugggauuacaggcaugagccacugugcccggcccagaaaugucuugagucaugguuuugagccauuuguuggggauuauguauuuaaaggaaagucuggagggaaaucggagacaaccaccaacccuaacagcugagauauaucagugagguaaaacauucuggcuuuuacuaauuaaucagcaaaauuauauuucauaaacauuuacuaggaggaugagcucacuucauucauaucucuucaguuacucugaguuuaucauaucccuuguucuuuuucaacaaauaaguuuuguagauaucauuaacauguaguuuucaccuucaaagaugaacauuuaaaaacagucuuaggucugaauuucaaaaaaguuacacuuuuguucauucugauuuuuuuuuuuuuuuuuuuuuuuuugagacggaguuucgcucuugucgcccgggcuggagugcaggggcacgaucuuggcucacugcagucucugccucccgaguucaagugauucuccugccucagccucccgaguaggugggauuacaggugccugccaccacacccggcuaauuuuuuguauguuaguagacccagcuaauuuuuuguauguuaguagagacggcauuuugccauguugggcaggcuggucuugaacuccugaccucaggugauccacccacaucggccucccaaaguguugggauuacaggugugaaccacugcgcccccuggccuguucauucuaauuuuuauagaauaaaaauauuacaguaugaagcucaguaaugcaaauaauaugacuggcaauggcuugucuuccacauagccucauuucuuaaauagagaguaggucuucauguccccaguauucuugccuacugcccauggauugaacugagaagccuuaccugggauucuuggaauugcuguuggcugucuuguguggcagccagccacaagacccauaauugucccaguggacauuuaaacuggaguagacaacugucaccagauggcgcuaaauugugaccagaaucuagaugaaugugguucacacaaauagccccacaguuacaugcuucucgaguguccugucuaccagcuguguaggcucuaccugauugauucauucaguaaccauccaaguugaauauuuuggaucccacuuaacagccucauggcaggaauuuacacaacuaaaacaguaucugcuuuuaaaaaguaauaaaauaguuggauauaucaccauguucacauaaauagcacaccuugauuuuaucauacugagcucuccauguuguuuuccugcucucagccuguccuaagguugggggaugguggaggggagcuauuuauaaaacccagaaagccuggaucuuugguagggaggaaaugcugaugcugaauugggugagcauaaugggaaaaggaaggaacaagagcaaaccuucuuguaccuuuugguguccugauuaacauuccagggagaaauuugcuuagaccgccaggaucuaaagugagaugagaagauggcaguggaacggugccauuuuaguuaguugcauuccccuuuucugugcuuaugcuuuugucuuuaagcauaccagcaccuccccuuuuguuccacccaguuauguaagcauauucuucuuucauguguuuuccucugaaccagcugcucagucuucacugagauuuuucagguuccuuuuggagagaagggggaggauuuuuucacuuaacaucuuccuaacccucaacuucccuaguugaauuuuguuaaauccacucuauucuuaagugcacggaggccgcgcaaugugcagacaugcaguuuaguuguacaaugacuccagcaauuaaugaggccagauugaucuuugcuguucccucauuuacaugaggaguugagcugccuagugcuccaggauggacacaucauuugaagaauugaaaacuauaaugagaagacucccaauugacccuacucccuguccuucuuuaaauggaagcaaaaucccuacauaauuugcuagaguaccaagagugaaacacaauagcuugaugacuggugauugaugauuuggaaaucugauugcuggcgguccugugcuguggucuauggugggucagcaggguuucucugugggccucugaagucucccucagccuggcaaggccaggccucuaguaagcccuauugucccugugcugugugauuguucugccaggguucaaaagucuguuggcucaguguguguugaaaggacauugcccaaauaaacauuuuuguccuuggacucaacuugggcauggccccugauggagaauacuggaggcccagauuuguacucaacgucucagccaccugaaaaucauucagaaauaaauuccuugguucuuauuuccuggaagggccaauugucuccccaggugucccccauuuuaaacccuaccuaugucugaaguugcaguugacacagcugaaaaaggauauccaacaaaauuucuuuaaacuugguuaacuuuagugaauguugcaaacaauucuuugaucuaaguaacagcuuaggcacacaccugcugauugaaaagaggcauaucuauagaaauauuuguuuccaugugaauuuuguucuuuuuaaauuguggacuauuaugacucccuuuccaaagaccuaaaugaaauuauuuuauguaucuucacccaagaaaggaugagaaagaaaaguuaucgcugauuuucuguuauccacuuaguuuugaauaguagugugcuucacuuucugugccagacuggaaaagugugcauaacacaaaacuaaaugaagucuuuuuuggcauucacauugcaaaguguuucaucaguuucauguaauauaaagaauugcuuagguguuaugguaauuaacauuucuuuaucuugccccgcgccugggcacugugcuaaaccucacacacaugaggaugucagucuucaucuucacuccuugauauggguacagaugaggggacugggcucuggaaguugguaauguuauucacugccucccugucugaacccaugcugcucacuugcuuuuagguguaacccuuccuugauuuaucuggguugacaaagucgguuucuuugcauuggguuuucagaaaguggaguacaccaucuucacauugguguaggguagugccuuguaaaugcugcugacugcaagacccccuuccuugggcuucucugugcccuaguugacccucggcacuucuccuuggaccuaauggaccccagcacuucuuccuugauuguagcacuagaggcaggaauuauaccuguucugguuuugauguuuucccaacucaagacccuaaaucaguagagacucugaaucaaccuuuuugcuugacaaugugguaagaauaggaaaagggagggcagcaagggggagggaacaaagacaaugccaacaaagcaaaaucccuaagcggaugugucugucuguugaggggccucucacugagcagacaggaaaauaggccgaaggcccagaggcgaccuggguuccccaccccgcaauugccuucaauuuuuuucuugugaguacacaguagaaaagauuuuauggauacauaguagguguauauauuuauguguuacaugagaugauguucugauacaggcaugcaaugcguaauagucacaucauggaaaauaggguauccauccccucaugcauuuauccuuuguguuagaaacaauccaguuauacuguuuuaguuauuuaaaauguacaauuaaauuauuauugacuauaggcacccuguugugcuguuaaauacuaggucuuauuuauucuuucuaacuaucuuuuuuguacccacuaaccccccuccccaaccacacuuaccuucccagccucugguaaccauccuucuacuauaucuccaugaguucaauugguuugauuuuuagcuccuagaaguaaaugaacgugcaaugucugucuuuccgugcuuggcuucuuucgcuuaacauagugaucuccaguuccauccguauuguugcaaaugacaggaucuuauacuccauuguguauaaguacauuuucuuuauccauucgucuauuaauggacacuuagguugcuuccaaaucuuagcuauugugaacagugcagcaacaaacgugggagugcagauaucucuuugauauacugauuuccuuucuuguguguauauaccuagcagugggauuacuggaucauaugguagcucuauuuauagauuuuuaaggaaccuccaaaugguucuccauaguaguuguacuaguuuacguuaccaccaacaguguaugguucccuuuucuccucauccucgccagcauuuuugauugccugucuuuuggauaugagccauuuuaacuggggugagaugauaucucauuguaguuuugauuugcauuucucugaugaucagugauguugagcaccuuuucauauacuugugugccauuuguaugucuucuuuugagaaacgucuguugaagucuuuugcccauuuuaaaaucagauuauuagauuuuuuuccuauagcguuguuugagcucuguacauauuuugguuaucaaucccuugucagaugguuaguuugcaaauauugucucucauucuguggguugucucuucacuuuguugauuguuacauuagcagugcaagaagcuuauuaacuuuauguuauccuguuuuguccauuuuuccuuugggugccugugcuugugagguaaccugaauuuugaaucacugcugccucucuucaguuuuuuauuugauuaaaaacuaucauaaaguuaaauugacuuaguuuucuuuugauauacaagucuguauaguuuuaacauguauagauuuauguaaccacaaucagaaugcagaacagucucaucaccccaaaagccccucucaugcaguuccuuuugguucugauuuuaaaggcaugucuuagugcugaagagacuugcgcuccuagguaggcucuugggugugguggaauuugggcagcccccgaaggacuucuccagaggccuggaguucacucucagguaggguggaggccucuccaccuaggucgucuugcuuauuuuaucacuuccccccauuuuguuuaucaaucucacaaaaaccuaggguuuccuauccccucuuuuuuuuuuuuuuuuuuuuaaaggggcugagugaugguuguaggcauucguggauuuuguagcaguauuucaggacaaccccggaucaaucuuaaccuucacgcuuccugcauguuguugcugaguggcuuuguggggccauuauugguacaguuuaggaggaugaguuucuggggacagcuggccuauauccacaaagaacaacaugggguguuuggcccuagagagagaagccuuauccaucacagaggcuguugagucagcucuuaggucauauuuagccuccucugcuuguauuuccugugaaaaauuuguaucuuaccaaguuuauuucugaauggccuauucaagugggguaacugcugugguggacuugccaggaacccuucuuaaaggagagaucaucugagagguuugaagguuguaccuccuauuugagauuguuuguaaaggucuguguuuacaaauuacugaauauguuugucauauaacaccuguuagccucuugauuauucuuugaaaaaccauuuacugagggccugcugugugcaggcccugggcuagugcugggggugagaacuuagaauccaguaauuagugauuugccaucuguuuuauuuuuccucggaaaaaaauucuucaaauucucgaagcccaggaaaaggugggugaccauaaccuucugugugccccgaggcagcccugguucacaccugguuuccuggaguacuuacucucagugccccguucacgcucacgugcccuguugggaugauagcuuaauguggucaggccagugaagggggaacagagucagggugcuuguguggucacucacugugggucaguguuuuuguuggaguguuauguggugucugcuacuugggcuucucccaugcugucagggccaaaccuguuuguuuucacaugucggggagauagacaugcaauuaaugagcugccuuaugcuuaacguggugguguuuuggagggcuuucaauuucuuauugggaaugugaguuuuggugguccauauagacuggagccuuucugacauuauuccccaucaagccguaguggcaguuacucugaauuauuuagaaguugauuacagauucucaggccccucaccuagggauuuugauccaguagaucugggugaggcccaggcauauuuaauuaaaaguaaaacaaaaaacucccagcaacaacaacaaaaagcccucccagggacugauggucagcuaagguggaagagccauugcuguucugcacucaagaauaucgggcccgggcuuuucagguucacgugugagcauucugagcgauaaggccuguagggacgcuggagagcuccugcuggucuaacggggcaguucccacuggacuccagacauuguuuucuugggccuagucuagaggcucagcuuuaacaaaucuguuuuucaagagaagcuagaaaucuggguuuaaaaaaaaauauacagcuuucuaauuuuuggaauguucaauuaaaaagacaaaaaaugcacccccacccccccacccccccaaaaaaaaacacuauggaaaauguuagguacaauuuagucaaugaauuacuagggaggauuuauugccagggagaagaacccugcuauuagcaccuagagaguaguuucuggcuguaaacucagagccaauugccuuaaucagaugccaggguaauuugaaguggaagaagugcaaccguaagaggacacacagaggcuauuuuuaauauggcuauguuaauuggcuuuuguuaauuuauuccacaauugaauuucgcaaucucauaacccaaauaaccacauaccaaauaauaauaagcaauguuacggaccuaaauuuaggauuuuguuuuuaaauuaaaaauauauauuuuucuuuuucugacuauuguccuuauagaaaggcgggagacuuugcuuucagugcuuaauuagaaagucauagccaggcuuugccaauauaggccuuagacuuuaacaaugaguagaaagucauagccaggcucugccaauauaggccucagaccuuaacccugagugugaguuccgcuugaaaagugacugaagaagguguguggucagguggugaauggagaaaucuuguagcauuuuuaagcgaaagccucucauggcccuuucucuauaauccaagcaugagcuuugugugaggaaguagcuggcuauugggaauggcuggacaugcccacagagaguccugcucugugcagugccuguuuucauagcggcacacagcagugggugugcuuugggcacugugucugcuauugacaagaaggaguggagaaccugaagcuugagcagagccaccacauuaccuucaaacaguauggguaguggagcuagcguaucccaccuucggugccggcucaugguuuucuguguagauuaauuccggcucacaaggucccgcagggcgaguggcaagacaaagucauucaucgccuccaucugcucucuacccaaaugacaagguaucagagaaaccucccugaccacgcaguguaaaugcaaccuccccaucucucgcauuccguuuccucagugcucugccaggguuuucccuguagcuuauuuccauccuuuuucuuuuaacuaugagaacguauucagaagagcagaagguguauugcuugauuuugcuuauauaccccuucaagaacuagagcacagauuuugcacacuuuuguucacuguuguaucccuagcaucuagaccagugucuuguauaucagaauguuggccucagaaucaugaccguuuuauaguaagauggccacacuugcaagaagugaagagacuuguucagguucuucaguuuaguggcagagcaguugacucagaugaucagaauuucuuuuuacuuuuaauauuacggauuuaucuuaggaagacagauuuugguguacuuguugcuggaagaguuucaauucaguguucuauuucuaccaguaauuccguagggguaauuuuggaugcuugugggcuguagguucaguggaaugacuucccuggagcagcaagucagacagauguccucucaucaaagguugaugaaggggaccugugggucuggggggacccacaaggcagagcucugaaucccggggaagaagcuguacuggcauuucucccuccauugcaaguuaaauaugcugaaaccaccuuaggcaguuccguagggcugugagugcugggcugugagugcucaccucugcgugucucugauucguguguccagcacagugugcgggguccccaccuaaucuccaggcaguugugaaaucgcuuuuguaucuuuuuuguagucauuuccuuuacacugauagcccaggcuuuacauugauagcccaggcuuugcccacaccacacacaggguggacagcaugcagaagguaucuugugggggaggggguggcgcuuuggggggauaccuuggcagcuggcaggcuucucaaggugccuugauuggucgaggcuguggaccaagucagggguugagugaaaagcaggggcaggguuaagaggagucggagaggaucuucagaaaacagccaccgaagauucuggcugccugaagggcacccagggaagggcagggagucguaugaagggacauaccaaucccugacugcccgggugcuuuuuacuccucaggguuuacauccugaccuucaccuacaggcugcuguuggugccuuagugggguggaagcagguucuggaacacagaccuuugauuuuaaaucucuguggccgguaaggaaaagugcugauccaaaucagugaucugguaccuggagcuuugaagccagacacaccugagucggaauuccaccucaccccucuuucuagcugugugaccuucggcucguuuuucuaauuucauggagccucuacuuucuuucuguaaaauagggauguuuuucuucauuguaacuugguugcaaugacuugcuguauuauguauuaaaguauuuguacacuucugugugccaggcacaauaaauaaauggauauuuauuaaauauauuuguugagagaaugaacacacagugagugcuucuuuaucggcccuuccuuuguggagugagagaggagguuuguuuauugauagggaggaggaggaggagaggaggaugcugaaaaauagagggaagcauaaagcucaucaaaauuuucccuuugccuguucuuuuaguuauguaaugugauuauugcauggccucauuaugcagaguagucagggaaggugguuagagcacugacuuuaucaacuccacuagaucuauuuaagccuuaguaaagcuauaaaacugcccuuuuguuuacuuauucauggucuuucauugugaaucuuauacugagaaagcgaugauggguugaguguacaacucaaaaagaaaugguuauauaacacugaggaaaacucaucuguuuuaauaauaugguuacuuguaacugaugauuuuuaacaaaagaugaugcuuugaggagagaauuuucuguuucacaugccgagacaagagcucuuucuaucuccauuuuuuuuucuuuuaauuuugucaagauaaauuuuagauggacaugguaugaguuugcaugagagugcucuggcuuuggaaaccugaguugauggcaugggugcauuauuucugguaagggauacuaucacauguaaccucaaaagaaaacuugaaaggugggguuucucuuucaccucucuuuuuuuuuuuuuuaaaggagggacaauacaguuaugcguagugaguaaaauaugaauauacagcauaggcaaauuaagagcuguguacagacuuugaauaccagaaggaaaacaaaugcuguugucagagaccacgugcaggaaaggaauaugucuucuaaaccgugcuacuggcugcaacacaacaacagaaguaguuuagguucacaaaccagauuauacuuguuuuuacaauaguucagggacacacaaagcugcuuacaguugacuuuauaugaauaguguacauauacguagguucacgggcaguguauuuuagaguuagcuucuugaagugcugagaaagaaguuaagaaucaguuugaaaccuuaauugaagguugaguugguagugaguggaagggaccauggguggaugaggagcccagaauggaaucugaaucccuuucaucccuuaaucucuugccuuuugauuuguguaugaaacuuucaauuuuuuucucuaagccaaugagaagaguucaguuugagugcuuuagugaugcuugaagugauauuucaauauugaaguuauacuguggauauaauuaugaggaaucaaguguacugugaagucacaugggagaaauguggagaaacuuauugggauugaggaaggggaccccacauaauucuguguuuugucuuuuguucuggauaaaugcuuagccauuauaauaaacaagcuuuuuauuaaaauccacucaguuauuuuguguaugaugucuucugaugucguaugaaaucauagacucuuggguuccagugcuacaucugcccuagcuuuacaagguguguuuuucuuguguaaccuggguuccccacuuggucacuaagaggcacaguccauuggauugccaccugggaggagcucccuuucucauuggucaguuaguaaucuuuuauuuagugcugaauuaaauuaucuucaacaguagaguauuuuuaacguaucuugacagagucauaugauugaauuucgugguuuguauuaccauauugacuaauuacuuggcuguugaauacuguauuuuuuuaguggcuaaaauaaaugaauaacuuuauauguaaguuugccuauaguaaaaaaugggaaauuuuucuugcuauuaaacaaaaauuacugggucuuuagccaguuggguuuuucaagugagcaaagagcagcugcguauguguaguaaauacuagugauagcugcuugcagaaucugaaaucuccauuguuuuagaugcucugacaugaagacuugccagugcccuuugacuguugaugaaagaaagcaugugcuaauccuuuuuucggacccuuuaguugaugauuuuuuauuugccagucucccucuucaaacuuaguuccucacacuugauguuguaguagcgacugcaaggcuguuaccacccuuggaaggggcgcuauccuuuguaaugcaucuucaccagaugucucuaaaacucuucugcccguuuuccccaccugacccacugcccagccagaucuucccucccccuuugucuuaguccauuuugugcugcuguaguagaccaccacagacugaguacuuuaaaugaacaggaauuuauuggcucaugacucuggaggcugagaagccaaaggucgaggggcuggcaucugaugucuggugaaggccuuuuugcugcaucauaacguggaaggcaucgcauggugagagggagggggaaggggacugaacuuccccuuuuauaauaaacuugcuuuggacauaacuaacccacucucuuagacuaaccuuuuuacuccucccuccuggccuuacaccucucaugaggccccagcucccaacacuguugcauugguaaucaaguuuucaacacgugaacuuuggggacauucaaaccauagcacccuuuuugaaagaauuacucguaaacucucaugaccggauuucuucucuugcacccuucauuaucugcucauuuaaauugucuccacuucucuaacauagaggugauuuuuacuacagugauagcuccucgaacuggaacugagcuugcugucugguccccccaccugccaucuguccuagaacacagcacacagcuguaaaugacugaacaagcaugcagagcccagaugacugggcccuuucuuuguuggagucagaauauuacugccugacguaauauucccggaggcuaucccuuaauugcaaagacuggauaguaauuagugaucauaaugauuucccugggccauuaagaaaaguaccuuuuaaugugcucaagaauucaggguuuagaaagauuuccauccagauuggcuccuuaaagaaaaaagaugcggugcauaauuuauuuuacuuucaguuaucugcuaacgcagcuaugcaaaaugacucauuuauuggggagugggugguggcauuagguaaagucuuaccauauugucuauuuugacuguuucauucuuaauagaagucuacacauugccugcaauugagguauaauuuucuuuaaagggaguguuguuucagauaagguagcugcgaccuaagaaaggaauaauucuauauugauuuuaaggucuuuagggaauggaagcacugucuuauuaauuggaaagucccaacugauagcacugacauauucaugugcuuucuuugccugccugcucaucugcagcccugaucacagaaggaagggagaaguagauaagaaauaguaguuaugaggaugaaacgugcacauauaggagcccucucacguuaggcuugguuuggugucuggaggcacgugaugagaacagcaguggaucugugggcucauguuuccuuacuccugcucuauuaggacuccagucugaagggaugaucuaguaccaaccaggagauguuuagaagaccgagauguuuccugaaguauucugagcugucucagguugauuacgugcuuucuuaucuuagauggcuccuggagagcugucuggguaauaugcucucccacuuugguaauuuuggauuuuuugcagaugcuuuuuguaaaagaacaccuaugagugaggccuaugguuuugggguuugcagugcccaaccagucaagcuggucuuugccuuuuuugugguuggauauggaaagaguggucaguagauuucccagugcuguacucaugccauucagcucauagucacauagguuuccauauuugcuaguaaaaauaagaaaauucggaaaggggaguagguuggaauugucaaguugaacugugaaugguguggaugagauauucuggggagagaauggacagaccagguuuggcuuagcuacuaguugaguguccuucuagcucucugggauuucuuucuaaucuguaaaaucaccauuuuguugaaguaggcuugccuguccuuucaauucuuggacauuucagaacauaagcuauguguuuuucuggaaaaaaaaaaggauauuuguuagaauuagaauuuacuuguuaugaaucuaaccuucacacaccaaacccccagcuaagacaguaaguugcauauauaauuguaauaaauacuauguaagucugaaaggggaaagagaacuugaguuugcgacuuuucuuauaaucuugaagaaguaauucccagacuucagaguguguaagaaaucacuagaaugcuaguuuaaaaaggcauggauuccuauaccccaguuacacaguucuuauggccugggauagagccuggaagucugcaugucacaggugaaaggcagugauuuuuguuacugaaauugacaugccuaauagaaaaacgcaacauacuuuacccccaguaaaucucuuaaauccaaaauauuaacacucccaagccaacagcacaccacuaaaaagucaacgaacaaauaucaagaaacaaagcuucccaguugguugggaaugagaagcagccaggucuucucucuucuguugcagguacacgucacaccaccauggaaucuucucuuuugauuuagugagggagacuggcgucuucuagaugugcaguguaugacaagcuucucucauccuugcaugucugcagaggugugacaugguuuugugacacagcuucuagucuuggggggauucauugugcucacccuuuuuuuccuggccaguugcuaacucaaaccuguccccuucugggauuuggaaaggauuguuugcagcucacaucuugagagauccauguucuguccuuugaugaucuucagugccauccaggcauccuugaaggcucagccgcagccaccaugguggguccaccucacuagccccauagugauguguccuuccugaacagcugcuuuugcacauccuaugaaagcagagcaauugguuucacacugucuucuuuccuaaguguuucuacucuagggcaugguauuucucugugaugcucuucguguguguguguguguguguguguauguguguguguguguguguguuuuuaaacaccucuuuaaauuauaagcucccugcaggcagauugcuguguuuuaucuccucagcaguguggggcauguccugagcacugguuaaagguagucuucagguuacugagaugugcauuaauaggcuucacuauuaagcaaauauaaagccaauuucagguaauuaaucucugaaauuuuuguuucagauuaaacucagcagauaaaaggaagcauuaauuuaugaugagauaaagaugggaacaaauaaaagccucuuacaguuucagaaagccauggaccacaguggcuugugaauguguguacacaugccuucauguucccuaaacaauuccugugggauguucuuucuuuauucaagaagaaaaaggccagggguugaaaauaaguuuuuauuauugguuacuguauugccauguuugauuauaucuauuaaaauguuauagaauaguauacuuggcaguuccuauguaaguugguuaauaggacauuuguggucauuuuuguuccagguccacagccugguauagagagccagucuaggugugacucuugagcuuguuaaccuagcccccucugagcuuuaguuucuccaucugugaguugaggauaaugauacuugcauuguguggggaguaaacaacaaugcauauaaaaugcuuguucacuaacugccccaagaguagggccaacaugguuccuguguccuguucuuacaguccaaccucaggacuguaaugcucuccggugucacaggauaugcuugcuggaguugaugcugugugugugcaccccucugggcuauuuagggacgaaggcauuuguuauuccuaacuucuguguuuauuuaccuuacauaguaucauaaacaucauaaauuuuccuucucuccuauucuuaggcuguaugaguacaaaaguuuuaugauucuggaaaaaggugaaauuuagggagaaagcacuaugaauggaaaaagugcuguugagucacgugcacuuucuugcuaagaugugaggugguggcaccauuuaauagcaaggcucugugacggaagguuggaggaugaguggugaaacuuuuugauagagugguugguauuagaccaucucuucagauuggagucuugaggugaaggcucuauuuuucauuucuugaauuuauucacuccucacaguuccucuuaauauggaugagacaauggaauuugccucucaacgaauauauuuaaucaucaaauguguuuuaaagggauaauuggaguuuagguaaagauuaugcagcaugaaguuaccuagccuuuagugauaguagaacauuugagaagauaggaacauugccaucuucuucuuucuuucuuucucccucucucucucucucucucucucucucucucucucucucucucucucucucucucucucucucucucucucucucucucucucucucucucucucucucucucucucucucucucucuucuuucuuucucuucuuucuuucuuucuuucuuucuuucccuuuuuugaguuggagucuugcucugucgcccaggcuggagugcaguggcacgaucuuggcucacugcaaccucugucucccagauucaagugauucucgugucucagccuccccgaguagcugggauuauaggcgcccgccaccaugccuggcugauuuuuguauuuuuaguagagaugggguuucaccauguuggccaggcugguuucgaacuccugaccugaagugaucgccugccuuggccucccaaagugcugagauuacaggugugagccauugcacccggccggcaucuuuuucuuuugggauuuaaaagccuccuuuugaaugcuguuucuucuaccucuaggcuccucucuaugggccaggggcagauuucauuagaggcagacaaauaggcugccauagugccccgcauuuaaaaccaugugggauggguuuucuagugugaugguuuuucgagugugagguggcaauuuugacuugguuagaaacauaaagaaaguugaaaaucaggccauuuucuucagcuuggaccucuauuaagaauaguuugaguuuucuucuuaaaaaaaaaacauacauuuuccugaaauuuaaagacuaaaaaugaaccagaaacuaagaagguugcucuaucaaaggggauaacgguucugguuauuugagccauucaagcuacgugaaaugauguugauuggaagaaaaauuuuaauucuaaaucaugcuaugucugcuaacccuuaaaagcauagaggggaaguaacuuaagcuguuucuuugaaaacaaaauauuuugauagaaauuugacgaguuaguagaaacaguaggagucccucucuugaaguauguauauaaaaucacuguggaagggggauccugcugccauuguaucgugggcagauaacugaagaaaauucaaaguuucucaucuguagaacaggcuagugaccugcuuuguugcccucauaggauuuuuuaggaucgguugagaaaauagaugugaauaguauuugggggcuuuuaaaucacuaauugucuuauaaacacauuaauguuuacgugguacuguguaaauaaagcaaaccaugaaucuuuaaucucugccaucuggcauuuuauauuuauuuuaucccuggaugagauacugugcccaagaaauguagauaauaggacaagagaguaacauucauaaauggaugcuagguauguauauuuaauacugaccaaguaauuuacuggcauauuuaaagaauggaugauacaagggaaaaaaaagacccuguuaaauauuaaguucagaaucucuccaugcacaaguuagguguuugagugacccaccaucagguggguccagagugauccaguaauccagaguuaggugaaggaacaugauguauugcucaucuucagugaguaggcuggaugaagcagcccuuaagaaacauuauagaggccaaaaugggaugauauaauagaugucuacccccaaacaucagugaguaaugccuuuuccuguguccuuaaguucccagcauaaugcaguccauuuauaguuacgugcauuuucauuuucucuuuaaauacccuucaggugguaugaaggagggucgugugucguagcuaaagagaugccaggagaggugugcuaagggucucccuugugaguugggccacccagcuagcgcaggcuuaagcuuguagcccacccugagcggagagucaguauauucccucuugggugguauugaauaaaucacaggcaaacuuuuguccuuuaaaaaacucuugguguagcuuccuuagcacacaauuauaugaauauuaacauucaguacaaguacauugagucccggcuuuaguuuuucucccaagacuauuuugcuggccauuuugguuccuuugcacaaaggugacccaucucagcagguagaugauuacuauuaguuucaaauuuagaaguuugcuuuuuuuuuuuuuuuuugagacagagucucgcucugucacccaggcuggagugcaguggcacgaucucagcucacugcaaccuccaccuccuggguucaagcaauucuccugccucagccuccugaguagcugggauuacaggugcacgccaccacacugggcuaauuuuuguauuuuuaguggauucgggguuucaccauguuggucaggcuggucuugaacuccugaccacaggugauccaccugccuuggccucccaaaguucugggauuauaggcaugagccacuucaccuggccuuuuuuuuuuuuaaauagagaaguacauuauuuuagcaccccauucccuccccuuauauuggccauuccuuucaaaaauuagaaaugggccuacauugacuacauuugagacaauugcagucuacaaggagaaaggagcaaggaaaucagcaugggccuuuguuggaguggaaugaggaugaaucccugccaagagcccacugggugucagggucagggcuagggccuuauagacucucugcacuuuaucuaccaccugccggacucuagaacgggggcgaagcaccugaacauggggucggaaacuccuagaacuuaagcaacuuuccugaggaaauagagugauggggugauggacaaggaaagagagcucaaagcugccugggucccagauuaauuuuucccgguacagugucuuguuuggaaggaggaaggcagaauucuuagaugauuuucugguuuaaauuuaaaauggaucuaauuuggagaccuaguaagugauaaugaagacugaugcugucacauggucuggccucaucacaaaaauaauugauuaguuuuuaguuccuuauacucuguucccuuaguaagggaaacucauguuuuuuauaaagcagaugcugagugaauucacaguucucagcuuuuaugccacuuucugacuaagucuugaggauacacacuuguggucuugaguucaggcauagagggaagcauagaccauuuucuguugcuccuuauggcuuuauuuauguuaagauuuguuugaaaaaagaaaaaaaaagauccuacucuauaaaugucugaggaggcuuuuucauagacccguggauuuucuugauuuguagggaucuuagguguuacccuaucagauacucagaagacccuuccauccccaacauuuuacuaacacauucccaaugcagcauacuaaauuacccucuugaaaagaaggaaagccaggacagugcaugugacauuuucccucaucauuugguuucugucagcgagaaauaugcuuuaguaauuuggaaauaaacucacugcagggggugaauaacagguuugaagguugguuaguugccaaggagaugaacuuuguacgcuuauguggaaaguaugagaggaucacuuaauacuauauccucugaaauucuacucuuucuccuuggguucaacaaaaucaucauuugguuuuagguuguguuggcagucacaacuauaggagcuaucauuaauuuaggaaacaggguuccaggguugugcuugaccacugaccaugugccacacaauguuccuugugccccauuuauuguacacagaagcccuaugaagugggcacuacuaugaucucacuuauauagauaggagccugaggcauaccaagcggugucuuacccagguacaguuacucagugucauaguuguaauacagugucauuuucauagaguugcuuuguccaaguuguaacuugaguuccuacacagacucuccucagauuuaaaguuucaaaguucacaacucuuuaagucaugagacacaagagggacaggcuuuuggaaaauauggggauguucuuucuguuuuacaucuguugcagaaggaccguuucucacaaaguuguuaaguagaucaugcucagcauaucuggaugcucuuugcuacuggccugagaaaugaccagcagggcauugcaaagaguggguagagaguaacaagacugacaguaauuaaacccaguacuccucaucugggugaaaggagaaugauaucaaguaugucugguaucuagugauauaaauggguuauaggauuuuagauuccaggugaggcauuauaauacaacuguaagaaaccugucucccucauccccccgacuucuuuauacacuuaaaaaaaaucccagaauuuuaaagaaguguauaaagaaguuggugggaggagggaaauaauuuuaaaaaaagaauuuguuugauaguuucgucauguuaugcuuuagcuuguuucuuucuugcagucccuacauugggacugcaggagagcuucaaagaagacuuucaguguaauucuugcgaaguaaaguaauggguauugggaauacacagggaaaaauuacaguuauccauuuuugacaauaaaaagucucuagaggguuuuuuggggaucauuuuuuuuuccuguagcaaguuaagaaggaaaggauggccaacaugauuuguagaaaaaaaaaguuucuuugagauaguguuauguaaauuaaaccugugaaggaaagaaguguaaaauauaggaaaauauaaagaaaaaguuaaauccuuagagaaaaaaaaaguuucuuugagauaguguuauguaaauuaaaccugugaaggaaagaaguaauugaugcuuuaucaaaaacucauuuguucaucgaauugucuugcuuauuaagugugguucauuauaaaccauauuguuguauuggagagcacaggacuauuucgucaucacuuuugguuagucagagauaaguauaguugagauacgauuuguuggaaacuucagccauuuuguucuaaugauugugcaaaaaaauuggugcugauuuuugaucuauuuuuucuguuuuucagggucgacauguuaaaacgggucaguuggcagccaucaaaguuauggaugucacugagguaagauugagucacacacauuuuuaaauaauguuagauggaagacaaagauucccccaacaacacagaguauuacucuguuuggaaaaucugauuacuugaacaaauugcccuccugugacauuguggguucauagguccaguggacuaguuggccuaaauuguaguacacggucuccaaguaacuaaaaggcaguagcauuuucucaaaacacacgcagugcacacacacaucugagugaugucauccuuggcaacguaaugggacauaauuggaaacaucuucucuaauggaaaagaaaaaguuugaaaagggaucauggaggucacaugaauagggagauugaggguuucgaguggagaaaagcuucucuaggguauuaggccacauuugugccauuucuuuuauuuuuaacaugggggaggaaaacagacccagccaaguucccagagguuggaaaacagaaacaucugcuagaaugcugagcagauuguuggcaaaauuuaguagcaaaaaauaguucuugaaauggucgcaugaggauuuacugugcagcuuuagaugggaaagaggagaacgugaccgagacagaaaguaaauguaugugugccugugugugugcauguaauauaugcacgagcccauauuuaaauucuuuaaaaauaguaauauauuauaaugaacuaaauccauuucauuuuaaauuauuuuuaucugaaauuuuacuuuaugcucauguuugccccuaacuugccuaguuaugaauaggauucaauaucauauuucacagauucuagaaagaguucacuagcagcauuggagauuuaggauaacuuuaaauccagccauaacuuccccaagucuggggucugucaagggagauaauggcuaaccugaucucuagugugcuauccagagagcaaaaucuccuccuuugccuugcucuuugcugggucucugacaacauggucaucuucagcauggguauuugucaguaagaauuggaaaacacuguugucucuggaccacaggacaacugauagagccuuccauaaguauuugaagaugugacauuuuaugaggugaccacucucuuuucucuguuaaagagaauaauggguacuuuaaaaugaaaauguaccguugcuuaguugaauggccaaaagauucuccuugacauacucugauguagacuauucuguuguauuauagugauccuaucuugguguacagcucagugggaaauuggaugcuuuccaauaaaauauuauuuuaaggugauuuuaaauuuuacugaaggaacaguaacuucuugcuuauuauaauuuaaauacaguaguugagcuauuuaugaaguacccucuuugugaauggaaugaucaauaccaccuuccuaccaaagucuccauuccgaaugcugugcaucuugccggugcuguguugggagugguguugcuggaaaauacggucuuugcauauuuauuaacacacuuuuugacuuguuuacuggcagacuuguagguacaauuuuaaauguaaucuuuuggaauuuuaugaacugagaguucacucuuguagugucauucaaccugugcugccuccccugacacagcuguuguggccggucaggauacguccucuuucacaucucuaauggaaucuaaaugugguuugccuucucuguagagcucuucuucaccgaagccuggcucugauuauaagugugcaauaugugaucacuguaaaaaaagaaguguaaaauauaggaaaauauaaagaaaaaguuaaauccuuauacuuacugccaccuucuccuccuucuccuccuccuccuccuccuccuccuccuccuucuucuuucuucuucuuauuuuuugagauggagucucacucugucacccaggcuggagugcuguggugcaaucucugcucauugcaaccuccaccuccuggguucaagcaauuuuccugccucagcgucuguaguagcugggauuacaggcucccacugccaccccuagcuaauuuuuguauuuuaguaagacaggguuucaccauauuggccaggcuggucuugaacuccugacuucaagcaauucacccgccucagccucccaaagugcugggauuacaggugugagccaccgcgucuggcccucugcuaccuuaugauagcuguuguuagugcuucaguguauuuccuuucaaucauguuucugugaacauagcuauaaaauacauaccgauauguguaauggaugcuuuuguaucccacuuuuguugaguuguguacaaaagguauuuucuugccugaaaaaucaggcaauguuggacacaugcaugauauaaguaguuuugggacuccuuuaaaagcaauuauugcaaaacccauguauucagguaaaaugaaaaccagauggugaguccucaaauaaguauuauacaaacacaauuaacuauuuaccauauuguccauguuucuugugugcuguuuucauacagugaccuuugcuauagcauggggcacagucauugcccauaguaaguguugcuuauggauagagggccaugcacagcaggcagccuggaaaacaagcccuugccaagccugcaugucaaagcuccucuuagcuccucuugugcaguuguaggcauuggccuggcugggaccugggagcaaguggggagcaggcugaaugagagagauuuugcagcaugugcuucugguuccaacuccagcaggaggggcuauuggagcggguucucuugaugagaacaggacucuucaugguuuuuuuuuuuuuuuuuuuuaccuccacuuaguuucaucucaggagcaaaaaggugcaaauacuuguuuuugggaaaaaucacagauugguucugacucuuuaggugaaagugagaggcaguuaccaggucacuaguuauuccucaggcccagaaggcaagaauugcagcaggugugggaaauugaaugguguggcugcucuucucccgagcugucagcuguuggcaggcugaaugaaucuagcucuagagcuggcugcagacaaugcaaagaugugggcccacuucacuugcuuuacuugauuaugugaaucuggaaaacaaaaccagcugagaauuacagauuucauccucgggugaggugacaagggacuauggaggaaaccaaggggucuggaaguggggaggcauuuauuugcaagagaugucaaguucucuucaaauuuugugugugaguacuucagcuguauuaagaauugacuauccuuaggauuuugaaaggcucuuuuuagggaaagcaugucuuuuaucugauugguuuugggaaggguuuaaggaacagauuaaggaugugcucaaaguggaugguauuaggauagcagaucuauaaugugguuuguuuuuguuuuuguuuuaaauaaugacagaggauuugcagaaaaauguauagggaggucucauguaccguucauucaguuuuccugauaaaaucuugcauaacuauaguacaauauuauaacuuaaguacaugcacaaaacaaagcaaggcaaaugauugcuuuuaccagugauugcucaacuuggaguucauaaacucuuugagugagguuugucucugagaacagaauuuuauuuugcauuuuaauaguguccccuaacuuuuuauuaugaaaaaguucauacauccacagcuguugaaagaaugaacacucucggcuguucacuuauauucaacauuuguuaacauuuuguuuguguguguguacuguuauugaaaauaauuacagcuaucaccaugacacuucaccugaaaauauuugagcaugcuugucuuaaagacagucuucuacguaucauaaaauuuuaccuaauguucagccuacauucauauaucuuugcuugugccaagaauguuuuuauaacucuuuuugaaucauaguccagguuuaugcacuauacguaguuaucuuauaucgcuuauuuuuaagcaguaaguuucucuuuacuuuccugccuccauuuuuauuuuuauuuuuauuuuuaaagaaaauugacuuuuguaagaauuuagccagauuguuuuguaaaguauccuguauucuggauuugaugguuuccucauguuaugcuuuaacuuguuccuuucucuccuauauuuccuguagacuggaaauauguugagagguuugauuagaugcagauuaaauauuuuuuggcaagaacaccucaguggugguauuggguacuucauauugccucacgucagggaguacgucaguucuaggugaagcccacuucacucauagccuucccauuauuagugaagccaaguugggucucuuggaggugacugccagcguucuccaccauaagggugcauuauuaguuuuacauuuccuaaguaaucuaucuccagggugauacuuuggcacugugugaauauucuguucaugagcaaccuuucaacuaauggcuuuggcauucauuuaaugauucuugcuuagguuaguuauuauugcaaaaugaugauuuuacguucuuccuuuuguauuuauuagucaacaacaaucuguagaagaguuuccuaccuaccccuucccuucucucuuugucuggauauuccuguggacaugagugguuuccaucaauuacagcuguuauuauuacauaaucaaguuguaccauauuugccagugagagccuuugacaugaacccaauggguccccauggagucuguggccuuuugacgugccacuauuaguuuuugaguacuuccuuguuuucuggaacaaguagauauuugaaacucaccuaccaagacauggaauacucuccucugaggagccuuaguucuguugagugggaaauauauuuggagacuaauaucuggaugcuaaguaugcucauugcuacugagguauuacugcuucuaggcccuuugaguagacagagcuaagaaguacauuuuuucaaaaaccagaauuucuuaauuucuugugucuuguauaucuuauguuucuuugucuuuucucuuauacugaaaauauugguuccugauaaaacaacacauuuuuauguucagugaauauaaaguucacaguauuauaauaauauuacuacuuaaaauagacauggaggggagaaguuuaagauuuuucugaaguuauuuuggcccuuugcuuuggauaaaucaaggacaaacauuucuuagguuaaugcacagagaacagaggcaaacuuauuaugugguguuuuaugucagauggggaugaaacggugcucuuuggagugaaugauguuugacugcauuucaucagcacugaguagcagagcuguauccaaucuagucuucuggccuguccaguggccuuuccaacaugugguccuuuuucucagccacucgggcauaggaugcuguuaaagcaggggauucucaaaauguagcuauuggaccagcagcugcugcgaguacuuggaaacuuguuagaaauguagccucugguuccaucccagauuacugcaucagaaacucaggacuggagcccuccaaaaaauucuaaugcaccuuuaaguuugaaacccccugcuuuaauggagccuugggaaagaaagagcccacucccuucugucugucggugaagaacugcagcucagagacgcuaauaacuucuugcucaggaguacauugcuaauuagacacugcaggaauuagaaccuggaucuuugauucccuacuuacuguacuugugaaaguauaaccauuucaaacaucagguuuuuaaguaagcucguugagugagcugguuggaucugaacuuuaaaggauagauggaucuugaccacacuucuccuuuuuaaaauuuguuuuuagcagauuugucagagcagacuuucuuuuaguuuuaagacuacagugucugugaaugguaauucugucauauuacuuagggguugggaagauauugggcaugaugucuuuugggagccaguauacuggaagagccaguauacuggaagauugagcaucuuccaguauuccuagcgccauguuccauggauauguggaaguaaaagcuguguaaaagcccuuccuagagcagccaaguaagaaucuggccucugccugucaucauauguggaaaggcaagagccauacaagaagcuaagcaauauaugucacuucugauggacagauuuuugaaugccuucugagcucugaccacgcaugggcaggacaccuugcuuucagggaguucaugcucugguacgagggaguaaaacaagcauauuccagugauaacacaaggccauauaacacugaacaauuuuacccuuuucauuuggaggggagcacaauguaaugaauguguuguucuugucuagacugaaaauaagaacaaaaggaagggaaggagagaucucuguggccugugggaccuauuguucuauucuguuauuccucagaggccagcuaaaugcuacaggccuuacagcuucguacuggcuucuucuguuuuaggguguugguggcacuuucucccugugcuuugcaugacucuggcagacuuaccacaggaucauucaacguugucagggugagccagaaauguaucaguuuuugacagucuguaucccccuccugcaccgcccccucccuccuuaucuucuuaucuucugcuuuucccuuagcuacugagagaaaaacuaaugugccauguuugugggaugcuaaauuuccucgucuuguauuuucuuaccuuagacaacuuuuaaccugauuugaaugaucuuugaucuuaaauuuuaacuucccaauuuggguugguuuccuuacucagccuuguguagauagauaaaaggccacaaguuuauuuauuuauuuauuuuuuaaauacugguauaagacaagaccuugaagaaaagcucuuaaaaucaguuaaaaucaacuacauuuuauuuaauuauugauuuauuuuaacaaguauagugauuuugagaacuaauaguuccacuguauccucauauauuacagcaguuuuuuucaaccuuccguuuuuuugacugucuccucccuaugaagcuuuuuaaaacauucuuuuaguuuuuuuuuuuuuuuuuuuuuggagaccaaggucuuacucuguugcccaagcuagagugcacaagucuagcugugcacaagucuagagugcacgagucuagcucaucguaccucaaauuccuagacucaaaugaucccccccaucucagccuccugaguagcugggacuacaggagugugccaccuacaauaauuuuuuuuuuuugagagauggggucuuauuguguugcccaggcuggucucaaacuccugggcccaagcaauccucaugucucagccucccaaagugcugggauuuacagguaugagccacagcacccgcccuucuaaucauucccugugaaauuuuaauaguacagauauacuguauaucuguauauaacuauauauguuuauguacuguauauaugucuuuacacuuaaaaguaguaaauuuucuugaggacaauaucagccccauugagaacacuugguguagaguaauauaaaaauacaaaauacgaaaauucucucuugcuguuuuaacccauuuaauaagucaguaagcagaggaagguuaagacuagguuagcuuuaugccugugauguuuuacauuuuucauguugaaaagucuucacuuuauuuauggaugacgacaguuggaauucagagaggugcuugaccugucuaaagucacaauagaguccuggacuugcuuuuauuacaccacaucucccaguucacuacaggaguauagcagugguauucuguauuuggguuuuaaaguagugguaccuaacaagaugcaaugcuauauaaguaguagacacucaaauauuugaugaauuaaauaggguguuccauuuuuggugguugcaugaguuccgugcacuuggagaaaacauaguagauacacacuacugguuucauuguccaagaaaacagucuucuauugcaauauuuauaauuuuccaugucauucucaucuuuuguaaucacaaauauuuacauuuuagaugcuaacauuaaucauaaauaacagcaagaccucuuacuuacuuucacacuuaaauuucaucccucuaggaaagaaaauuauuggagugguuaggagugaguacauuucuggguuucauuuuuagaauugucacugaacuaauaaaaaugauuuaaucuuuugcuccucuuucccaggaacauaaauuugaggcccauaaauaauuuucaaggugaauuuauaguguaugagccuccuaggcaguuaaccucauuauuuaguagucauauccugccuuuuuccccaagacagcaauacauacuuuuaagcaugauaaagcucaguuuccucaucuguaaaauggaauaaugccuacuucagaggcuuuugucagaauuaaaauuaauguaaaguauguagucuauuaguuuuuacauaguaaaugugaguuuccuuguuaccuucuccuuauuaaagacauuaaaguaucacuuuugcugaaggcuuuuaaacacucccaauacccuccucagccacuuacucaaaugauccacucuccaccugccucccuccaccuguggcaauccuuuucuccuugucuuucuuccuugcaggcuccuucuucagccccucugugguuacagccaucacuguuugguccuuugauaacuaccuuugcccugugaacugucuucuucugcuguauauguguguggguuuuuuuuuuuuguuucauuuuugauuuuuguuuuuucagauaggcuucacucuguugcccaggcuggagggcaguggcaucauccggguucacugcagccuggacuuccugggcucaagugauccuccuaccucagccuccugaguaggugggacuacagaugugugauaccaugcccagcuaauuuuuaaaauuuuucguagagacgaagucuuacuguguuacccaggcuggucucaaacuccuaggcacaagaugucuuccugccuuggccaucccaaagugcuaggacugcugaugugagccacugagcccugccgauucuucugcuauuuuaaucguuagcuagagaacaguggccacauguucauuuauguguauguuuuucuauucuagaucauacccucuuguaggauuaucucagcccuucuagguucaugacagcacccuucauucacguggguggugcuuagcauauauuugcucuuucuaaagaaugccccaagacaaaaggcaguucuuguuguucuucuccuuaaaaaaaaaaaaaauaauaauuuuuugagacaggaucuugcuucaucccccagguuggagugcaguggugugaucauggcuuacugcagcuucaacuucccaggcucaagagaucuucccaccucagcuucccgaguaacugggacuaaaauuuuuuguagagaccaggucucccuguguuucccagguuggucucaaaguccugggcucaagcaguccuccugccuuggcuucccaaaguggugggauuauaggcgugagggaccacaccuggccaaaaggcaguuuuaaaggagaauuuccgaaagugcuuugagcaguagcaaaaaauauauauagugucccuuuuaaaagauuacagacagccuuuauauuaauauuuaugugcuacuauauuuuaauaaucauacauuuacuaauuuguuggcuaguuuuaaauauaaaaaaggaauagagaaaaguaucauauucauucuuauugaaaauaugacuacuaauugcuuuguucagauauaauuuugguucguugggacuggaaauggcaaauguauaccaugguuuguagguuuuuuguuuuuguuuuuaaugcuguucauggaguugcacuaauucauuuauuuaaacaaguacugaacacuuagucuuaaaaacacuauucucagcucugggguggaauagaaagauuaauuaugcuuuaggaauaacuauucuugaucucuugguaaauuaaaacuugcugugaaaggaucaucuuuguaauuguuaaugagcauucuucaagcagauugaauauccacaguuucuuaguuuaauuucaucauuuugugaaccaaaggcauuuuuucuaaguaaaauaaaugguugaguaaaaaaaaucgcccaacaaauuuuguauaaucuaaauugcuguuuuuuuuaaaaaaauggauacuguccuuucaccaucccaucuccuuuccccagcugcugcugcugcuuucugcuuuccuccucuuucuuuauuccuuucagcuuugggcggcuguacaugcaaaguuuuguuuuuuaucuugacacuucccauucuugcuuccauucccuguaaauguauagaaaagaauguuguguuggagguccccaagaccauccucaauuucgauuccagcacauagauguacucuccgcugugauuuauagcacaaugacaggauccagagcaaauucagcaagagaacaggcauguagaaggaagucugaagggauucaggcacagacuucccagaguccuauccuagugcagucacauaggcccuguuuacuuccuccagcagagccguaauggcacguaugaaauauugucuaccaaagaagcuugcuagagacucagugcauugaauuuuuauuuggagauggcaguacaagcagccucugccuagcaugcacccaaaauuucagacuuccaaaaggaaaacagguguuuggcguaaacugcauucuagguacagugagccacucuuaccaguucugggagcgguggaaacccuacccagaucaaaaucccagaugccagccaaaggccaaccuuguaagcugcccuuuuuagggauggugucaggccucaggacuaaacagacaccucuccugagugcugcauugauguaucaccugccucaucagcaucucuacuuggaaguccgauagccuaaacucaacaugucucaugugaguuccuguucuucccccauaagcuuguugcacuuggagccuugucuuuucucaguugguggcaacuccacccuccucauugcucaggcccaaaaagauuuuguauccuggguggacuacuugcuuucuguccuguaccacuuggcucaucugucaggaaauccuauugguucugccuucaaacuaugucauuugugucagaauaaucuugguagauaguggguguggauagauugacuucaaguuaguaacugcugguuaguauuuuugaaaucauaauauguuuuaaugagucugauggucuccucauagucuaugagagucuguaagaacaaacagauacaaaucugacccuucucaccacagccucugugcugccacccuuggcuaccccucugguuuuggcugccacccucuguugcuuagauuucuaccauagccucuaucacgagccuccugccuccaugcuuguucuccagucacuucucacuguagcagcugacugaagcuugggaaacaaagucagaauagagucuuucauaggcugcuuucuuagcucagaguaaaaguacggguucuuacaguggcugacaugacagggcccuacuugauuggccucccagcccuccucuccuccuucuacacagucacuccaagcacacaggccuguucacuguuucuccacccugcucgccugaucccgcccagagaccugucacuugcuguuuguucauugugccuggaaugccacucccucacggcugcccagcucacucccacacuuucuucaugccuugacacagcaaauggccucuuccuacuccuaaagcucuugcccuguucuaugucaccguauauaacuggcauauuuauucuacuuaauguauaccagugccuccaccaugccacuaacugccugucucccaagaauauaaccuccauacauagugacaaugaucuuugucuguuuuuuuuuugagauggaguuuugcucuugucacccaggcuggcgugcaauggcgugaucucugcucacugcaaccucugccuccuggguucaagugauucuucagccucagccucccaaguagcugggauuacaggcgucugccaccaugcccagcuaauuuuuguauuuuuaguagagaugggguuucaccauguuggccaggcuggucucgaacuacugaccucaggugauccgcccaccucagccucccaaagugcugggguuacaggcgucagccacugagcauggccaguuuuuuuagugauguuucauccaaugugcaaauucaaugccuagcauauaguaggcauuuaguaaacacugucgaaugaacagugccuccccuucuuuuuauguaaaaaacccaaaacucaaguuaaguuacauaugcuugguugaugaugaugaugauguguguguguguguguguauguauguguguguguguuugugugugugucugucugugucugugucugucugugugcacaggccaugaaacuauuugaugauuaaacaguuuggauugucuuuuaauuguauagugacaugcccuuugagaugugguaaaaugaagcaauacaguuggaaagaagguuuuagauaaccuguguccauuccuuugaaacacuuaaaauggugaagucuuuuaaaaggaucacuuuagcaccccugcccuuuuuuuugccuccugaauuuaguuccaauaacugcuuuccaguuuacauucucuucauaggacugggguauaaauucuagccuaauuuguccauaugauaaagccuaauucuagccuaaccuguccauaugauaaagcuuucuggaauugcuuguuuuauuagucugucaacgucuugugaaaaucuauaguagcaacauacacaggaucuuaaacauuuauaugacaguggaaucauuuuuagaauaaaagcucugauuguuuaauuagagaaacggacccccccuucacuaccauuagcauaauacccugacagaaggaaagacauuuuuggugagacauuuuuaucuccuaguuauucugacuuuuuugcuaaccuuacagaaaagagaguugacuucuguggguuugaucuaaaaugggauuagggagccagcuaguugaugggcuggguuuuuagcauccaaacuugccacauuguagugcacuguuaauccauaaauggccucagcguugcgggaagccaggcucucucugcuccaagggcagaaaauccccuuagaaagcugccuucuggugaaugaacagcccgucuguucuauuguuccacguuagccugcaacaucugugccacaggucagacucucucccuugauuuuuaacucugugcacuaacagggaacccagauuauauuuuggcuguaauccugcucccaagcuugcagaucguuuugcaauuuguuuuaauugcaaaacaauugucccguugaaccuugggcauuauauguaguucaguaugugcuagagguuuuaggugauguuuagaacuaugaaaaugauuucaugguggggugaaagaauuuuauuucucacuccucucccugguauucuaaggugcugauuggucuccaagucugagugcaaauucugccuagauggaaacccgccucugaaacaggacugccacugucuuugucaguuaucugaugguuaucaugauguccuuggggcucugaaguccccagcauguccaggggucuuuucucugagcacaggaaccuugugccaguuuuccuuuacccguguuucuuuuaugucuagacauucccagacacuuuuuuucucuccuuaacauaccugugcuguagcaguguggcugacaggucuugggaaaccaguucucgaggguagcugcguuuacuugccuuugucuauaugagcacugaauucaggagaagugucuucauauaugcaacccucaguagcucuuauauuuuuauauuuugggccgggugcgguggcuuacgccuguaaucccagcaccuugggaagccaaggugguuggaucaugaagucaggaggccagccuggccaauguguugaaaaccugucucuacuaaagauacaaaaauuggccgagcgugguggcacgugacuguaaucccagcuacucgggaggcugaggcaggagaaucgcucgaacccaggaggcggagguugcagugagcugagaucgcaccaugcacuccagccugggugacagggcgagacuccagaucaaaaaaaaaaaaaaaaaaaaaaaguaauaauauuuugaccuuuuuauugaagugaagcaugcauacagaaaaguacacaaauuauaaacucaguaaauuuccaaaaacuguacauaacucuucaauggaccagcaccuagaucaagaaacagaacuuugccgguaccccaggagugcccugauaugccucuugcagucacuaacuguuccaugcaagggugacacuguccugacuucucucaccacauauuacuuuugccugugucuguucuugauauaaauggaaccauacgguacucugugucuggcuucuuucaguuagcauuauguuugugagguccacccauauggcugcuuauagggagagcucauuuauucucauugcuuuuaguauucuguggugucccacuaacauccaagugaauauauuccugccguugauauaauacugguuauguggcaggugcugaauugaauugcugcagagauagaagggaauuuaccuaguuuaggaaauucugugauggauaagagaugcugaggugcagguuauagggaaaauauucacgucuguauuucucauaguuugggcaugguuaaauauccacuuauuuucugacuuaauuguauuaucuuaacugcaggaguccugagaaagagcagaugacguugcuggcgugugaugacuugggaacuuuacucucugcuaucuuuguuggcuuacacagcuuucccagcugcuacaggucuucugcaaagaauuugugcagcacucuuugggauucuuguuuggccugugucucacugccgcuuccuucucacccuguuuccaagguugucuacuuuccuaccgacuuugcuacacuugcagcauguccucccccugcucccuuaagaugguguagguuugggguggaauaaagauagggagacacagccaaauaaauaaaauuccaagcaagccugcguucuugccccaccccacccaccauacccugcuccugucccuacuuugucucuuacagaucaugaagaaagaaaucucuuaaguucuacucauucuuauuuuuaaugagaaggauguuuuaaaaacaaggucuuugauaugacauuuugucauaccuaggaaagcaacaauaacagcaguaacugcuagguugagggaaucuguaguuaggugguauuuccuggugaugagucaucuuccccccaggccccuuggggaucuuucuuucgugaaugagugagggggaaggcauuuauacaagaaaagagugaaugccuucauuucagcuguuucacuuuuuuuuuuuuuuuuuuugagacggaaucucgcucugucacccaggcuggagugcaguggcacgaucacggcucacugcaaccuccaccucccagguucaagcauuucuucugccucagccucccuaggagcugggacuacaggcacgugccaccgugcccggcuuauuuuuauauauauuuuuaguagagacaggguuuuaucauauuggccaggcuggugucgaacuccugaccucgugauccgcccgccuuggccucccaaagugcugggauugcaggcgugagccacuguguccggccucagcuguuucacuuuuaaugugcccggugaacucacuuuuguucacucacugaagaugcuggauuuuucucccccugaagcuagaacugaagaagacucccugguuauuuuuuccuccuuaaguuguuuagaaagcagaagaaaacuguugauuuggaaagugacuguacagauguuuuuguucaaaagggaaaggaggaagaaggccauugagauagaagagauuaaaauuuggaacuacgguuaaagcagcacaucucccugggccuggcuggcccuggcgauucugugugguugggcacguguggaguaguguugguucauagcuucugcagccuuuuucaguucuuucuuuuacccuucuuuuuuuuuuuuuucuuuuuucugagaccagugucugucucacucuugucacccaggcuagagugcagugguuugauaacagcucacugcagccuggaacuccuggaaucacaguucucccacuucggccucuugauuagcugggguuauaggugugugccaccacaccuggcuaauuuuuuauuuuuuaauuuuuuuuagagacagggucucacuauauugcccaggcuagucucaaaacuccugggcucaagggcucacgcaguccuccugccucggccucccagagugcuaagauuauagguaugagccacugcuccuggacaugucaccuguauuuuagcccaacauggcacuccuguaugaugauuugaggaacugacuaccuucacagaaggugcuuuauaaugacaucauaguucauaggguggggugggggauguuaggguaagugccauuucugucucauuaguuccuagacugaugguaaccuacaugaccaaagaugcuuuucuguauuaguccuuucucacauugcuauaaagaaauaccugagacuggguaauuuauaaagagguuuaauugacucaugguucuacaggaugugcaggaaacauaguggcuucugcuuuuggagaggccucaggaagcuuccagucauguuggaggcaaaggggagcaagcaucuuacaugguagaagcaggagcaagauagagaaagaaagagugggggagggggagggaaggaaugagggaaccagggaaggagcgcucugcacacuucuaaacaaccagaucucuuuaaaugaccagaucucaugagaacuuccucacugucgcaagggcgguaucaagagagguggugcuaaaccauccgugagaaacccaccucaugaucuaguuaccuccaggcccuaccuccagcauuggggauuacaguuugaccugagauuugggcugggaagcauacccaaacuguaccaccaaagaugcuucuucacaguaaagcccaacaacggaaguuuucuucaggauaagcccauuuuucauugccuuacaaaugaccaucaguucugguuguuucccuuguuuuuauuuuauccauuaggaggauggggagaagaaugcccauggcuccuuaccuugcuggcagagcaggguaaccgaagaugagggcucugugguguggugcugccugugugcagcuugugcccagggcccuacacagaggaauugcugguuugugcaagugagggacccugcgucuuccuuauagcuacagagcccauggcugugggcagcuccuggcucuuaacaccgaagaauucauggauucuugcugcuucaagugaggucgugcuggguggugaauguuuucuuaacuguucucuuuaugcuaguuuaaaaguucaaggcuuuuuggcccuuugacuuuacugguuacuucugcuuaucaggaugauaagaaaauuaaaauguauucccccuguuacaccacccucacccccccccaccccguuuaguauaccuacgguggugaauuuuaugauuuauaaauuacagcucagugaagcugcuggaacaaaaaauuuaagugacguuuaaaauuauauuucuuaauuuuuacuuucuaugaaauauaauuauuccagggauaaaauauagagaaguaaaaagaugaaaaaaauuacacucauaauuccaucaccuuggcuuaacuccuguuaaagcauuaauguauauuuuuuuaguuucauuguguguguguguguguguaaaguuauuuuuuaaaugauggaaaggcuuuuuucucuaacaguaaaauaauguacucaucuagaaaacuggaaaguggaaaaauauuuucuuacagucucacccccccgacguucugguguauuuccagucuuugcggaguaaagcuauuucuuauggcugccagucacucaaggaaagcccccagucaaauguguuuauauguguggcugcguuuaguuuaaaaaugaguuuguauuuauuuauuuauuuuagaaagauuucuccugaauaauucagguggugaauuccuuaaucuuguuuagucucaacuacauacuucauguaacuuuuuucuagucaccacuucaugguacaccucuacaacuuugagcuuguauauagcgcguauauauguuauuuucauguagugauuuuuuuuccuguccauacacuuuggacaauguggcuuuuagauuguaaauuacugaagaacaggccacuguaaauaacuucauaauauugucugucugaacaagcacuuuuuauucuuaguuuuuuuuuuuguuguuguuagcuuacaagaucuugaaaaguggaugcuaaucaccaccauacauauggugguuuaaucgauauauuuucccugauagaugcuucuuaacugauaaaguauuugucauugucuuuauuauuuuaacucaucugaauauaaauaaaacugaaguuagggaaaggaagcagcauauuacuuagaaaaggccugaugacuuuagaaaaggccugaugacuuuuuaaaacuuaaguacuauuugaaaccucucaauaaacugcuuguuuuugauaacuugacucaaauauuccaucaguugcuuaguuaaagugguucagccccaguacuucuuuauuauaucaucuucagcaucuguugcuuuguuuguuugggaggaagauggcuggcugcuuagccucucucaaagcuggacugugacauugugucugugguugauggacacagcugugcaauuuuugugugugcuuggcagcaccaucuucaaaaacaucuggucuaaagauguaguucucucuccugcaacuguauguaaaucauuuagugcauaaugggauaaugccaaauauacuuacuugacaugaacacauaagugauuuaaaagcccaacaugauuuucuaugcugacccagaguucaguguauuggaagauucauugucuaauuggguguguacuuguaucacuuagucuggugcuaguacaucacaugccauggauaugcuaauuuucuucauuuuaagugaaggaaauggcugguuugguauaauagguagcaaaaacaggagggaacccuuuggcuaaaccauuggggugaauuugguuugaaucaaaucuuucaaagauugcugugucuaagauacauuccucagcaucuccuguauauuuuuuaagggauguuuauagagaagauuccauaguaccccuguggguuuuuuuuaaauacagguaaucacugugccuguuuuaaugauaauuuauaugaauuuauguauuauauuugcauuauauauuaugaauuuauguuauaauuaauuuguacccauaauuaauauauaaguaacaucauuagccucuugcauuggacuuggugagagucuuccuagauuggcucuuauuuuuauaauaucugaaaaaauucacaauaccauuuaaaagcacaaaggucuccaggauuuguuacuuacuguaucccucagguuuuaugauuuucccccccaaguaauuagagaugucuucagugaaauuuaccacugaaggaucuuagcucugaauagcaagccccaaauuaacccacuauuuacucugggcucucaagaggcauaucuuuuuuuccuuuuaguuuugagguuuucuuuuuaaaaguucuaagacuuacagaacuuuaaguuuuaaauucauuauuuuccccauucugugucuauuuuuaguuagaaaaacugauaaacccaauuaauucuacaagcauagguuacaguauucuucugugccaguuuuuuguccaaggcuuacuauugaguagaaacacuagcuguugaaugugcacaagucuauaagcauccauggacaagacggugccuuaugcacacugcugauagauucugaugugaggcugccaauuuauacugagccuggcaggaaacgagggcauuuucuugauuucuuuuaacagacuuauuuuauuuuacuaaguuuaguuagucuaggcucaagaaugugaaaguagggucgggcgagguggcucacaccuguaaucccagcacuuugggaggccgaggcggguggaucacgaggucaagagaucgaggccauccugcccaacauggugaaacccggucucuacaaaaauacaaaaauuagcugggcuugguggcgggugccuguagucccagcuacucgggaagcugaggcaggagaaucacuugagcccaggaggcagagguugcagugagccgagauuugcgccacugcauuccagcauggcgacagagugagacugcgucucaaaaaaaaaaaaaaaaaaaaagaauguggaaguaguuuugcuggccuguggcuucccuggcuucauucuguauagugucauuccuugucugguuucuuuuaugcuggcucuacggcucuacccagguuuguuggcugcuccuugacagcugcccaagcucacccucccagguguugacgccccuucucucugcauuuccuugucccugugcucugccugccucuguaucugcauugguccaugugucucuuugacgagccaucucucucccuguccugccccugcuugcucuugccggugccccacaugguguuugcuaugaagugggcccacaguucgugcuuacugaaugcauuuauaccaauggaugggcaugugguuggggcacuuguuaaaaucugccaaggaaaguggcauggcaacuuacugaccuucauuuuuuuggguaacagcagaugguaaauuuggcaguugguauuguugguuggagcuggauaaguugggcagguuccaacaugguaauauccuuugugcuugugaauuuggguuggugaauggccuuucagggucuucacuggagacauuuauuuguguaauuuuuacugauuuaaguuuuugucuuuaucucuguaagucaauacacacucuuggaggaggagguaccuaccacuugagagacuuuguauguguuuucaugacaacaauacguuuacuuuuucuuuugugcagaaauuuaguucccucauuauauucaagauaggugugugguaguuuaugguccuccuuuauucugacaacuccguucuuuuuccugccaccccaugagaguucuaguuuuaaaacaauugcuucaaguuagccagacugacucaggggacuccaugcagacuuugcauguguuuugcuucauagccauucagaguacagggagaugaugaucacaagacagggaggacuguguuguucuuuagggagugauguuguuugacucuucgcagacggaggacaucagcagugucucgaggccuucuuuucaugucuuucguucagccacuccugcagccuccaguccaccuccucacagcacgcgugcgugucccuggguacuugcagauagauggaguaaagauuaaggaacacaauggcaaguuaaugaacuguuuuaagaccaaaaugacuuacuacagcuuuaugaaauguguagguaguagacugccuuaaaguucuauauaaaaugauuaauagcaaaaaaaaaaauugcuaaugacuuagaguaucuuucuggugauuguuuuuaaaaaugugcaucuuugcuguagauaauugccauacagugugcuuauggugcuggaugggguggugggaugcuaggggacgcuacuuaaguaaaagagguuaagugcgagauaaaauagcaccaacuugucuucuaaauuugaggaaacuguguuugccuauuuaaauuggauuacguuggccaggcgugguggcucacgccuguaaucccagcacuuugggaggccgaggugggcggaucacgaagucaggagaucgagaccauccuggcuaacacauggugaaaccccgucucuacuaaaaauacaaaaaauuagcugggcacgguggcgggugccuguagucccagcuacucgggaggcugaggcaggagaauggcgugaacccaggaggcggagcuugcagugagccaagauagugccggccugggugaaagagcaagauuucgucucaaaauaaauaaauaaauaaauuggauuacauuaauccuauauuauugacuuccacuaugaaguuagagguuuauguaauggaaacacuuuuuuuccuguauauaauaaaauuuguauuuucaacaauaaucuuuuaaaauuacauucaagagaaaaauuauuuucugauaaaauacaaauaguacucaaugucaguaguaauauguauuguguucagagcaugucucagagcgaaaacacuaaaaaaggagcuguagccgggaccugcagcagugugagugcccuugguggucacucuccucagugcucugggacacaguugagcagugccagucuuagcagcuguucguauuauuuccaauuuaaucacauauugaagaucauugguugucuucucccucagucuuuuugguaucugugaauuuuuggcaucuuuucacauuuuuccaagagaggcacuugcaguuuaucauuaucuuguaugaacacagguaaugacguacauaguuaggacauacauugcugauuguuguuuggaagagaggauaugggacacauuuuuaugaguuucuguggugguggaguauaaagcauccaacaagauuuuccccauaaggaccacuuacaucgugggcuagaaaugaauauacugguuugguucagagcagaacuucuccuuggguuuaguuaaggucgguuugaguaacuaguauaaugcagaugguagcccuguagagucagauuuccucagaucuuggucaaguguaguaguuuuuccauugggacuuugaagcuuuugauuuuguguuucucucacuggcucccauuagaugguuugauaucuuucuaagaaguagagaaaauugagagggagagacaucaaauuauuuuccuaguuaggauugaaaaguagggaggugauauuuaauuauugaaggcaugaugacuggugccauccuauaguuuucuuccacaccccaguauuaggaaaugauucacuuaggugagaagcugugagaaguguugagugaccuccagauacaugcuaucacauuuucugcagagaaugugaguagaugcaguacgacauagccaaauguaugcuuaucccugaauuuugucaccuaaauuuuuuuaaaugaaaggugucuguuaggaauuaaaauaccuugauucuauuuucuauuuuacccaagucugugacacuuauucauggucuuuuugaguaacuucuguggaaagcaucuuugaauucuuagagcuaagggaaugauucuucauaugugguucccaugaggcucuuccagagacuucuccaggcaugugagcugugauacagaggucacuuaguuguauuugaaguggaaaaugccauuucauaauaaagacaggaucccuuuccagauuugcaaaugauccacaaugaagagaauuauuugaaaguaacaaaaugguaguguacacacauggaaacuaaggcuuuuuuccuuguuaccauauuggcagacuauagcaaauuuccauuuuccagggagcaucaagagccaaggugauuuugguuuaauaucaugacauuugaaagauagcuuuccaaggaaagaguucacugcuuuucuccaggugaucauuguuuuuauuuuaucuuccuuuuuucuacucguguacuguggugauucaugaaacauaugaaaauaauacauaagcaggaguugggguagcuuaagaagcgaaaguggaggagacaggaagaaugagggaaaagguaagguaaaccaugaaacauaucagaaauuggggcuuugcuucuaauguccucaaggucaaaguuagaaagucacugagcuguguaaauacuagccauuggccuugcccucugaagucagugcuucuccaaguagggucuguggaauaguuacuagccucauuuugacagccaauacuuugauuaacacauaaaccaauaaguuguuuauagcaauugagaucaaacaaaaauuacuuaaaugauuggaucaaaaguaaguugauuucaaacaucauuuuuguagacaguuuuucguaugcgugacuuaauuuuuuuuuuaaauuaugauuauauucuucuauuggugggaaaguaggaacagaugaccuguaugauaaugugggucuuuuacucugccacucugguugaaggauggaaacaucuguaauuccaaguuguugcuuuuuaaaugcacuggguucuaauuuaauggaccauaaaaagcaaauugggugucagguuccuucauggguagaugcccaacagacguaauaguuuauaccaauagagguguagguuguagcuuuuguuaaguuuuuuuuaaaucugugaauucugugaucaguguuauuccuggguuaguuucagauaauuuucuuucccccccucucucauauguguaugguccagcuucuuugcaugccugguaauuuuuaguuagauuccacacauuguuaauuuuaccuuauuggguacuggauauuuuauauuuuuuauaacauacuugaccuuuguucugggaugaagguaguucuugggaacaauuagauccuucgaagauuugauuuugggauugucacaucauguagucuaggcuuauuuggccccacuaucgaggccagagucuucugaguccugugaaugacgaguuuuuccaaucuagccaacggcaggaggcacugcuucccaacccuuugagcacuggguaguauuccgaggaauccuuugggaucaggcucuuucccuuaccucaggugguuuccgcacggggacguguugauagugugcuacugagucuucuagggggaauugcuugcucucugugcagcugucuccuuucugguauucuguccugcgacugcagcugcagcggcuguggccuccccagacucaguucugucuccucaacucagagacuccucugggcgccguuuggguuuccuuucccuuugcugcagcuuggagucuuucucagggcaguaagcuggagucugcauguguuucccaacucucagggucacugcccuuauggccugaagucucuucuaagcgcuuucguauauuuuggcuaauuuuaguuguucaggugggaggauaaaucaucuguccuugauacuuuauuuuggccaggagccaaaguucccuucauucuuuuuuauugaagacacauuuugucaaauauguaagcacgagcucuggugccugugagugcauggaugaauccagcaugaaguacagaaacacuguugcuuaucacacccuccuuuagagcuguacuccuuguugccauuccuuucuuggaccuguuuuuaagguuuuagacaacacucuauucaauguguauuguauucuuucuccccuuguguuaugggaagcuucauggaguuugccacuggguuagggagagguaugaauagacugaggcaagauucuccucaagggaccuuuggcaggucaggaaagugaagacaguggaugaugagugcuccaccuaccuucuccuuuugcuccgggaaugacuuaagucuggaaagagccgauacuaagaaguugagggucuggauugguacaucauaguaaacaggaagaaaugaccaugaggcuaaggucagaguggugccacugacccaguugaaggcaguuuaaacagccagccucuaguucuucaggcucuccuaggccucccugcacaacugaccauugguuucaguggcccaagcagggaaacuggcagugacccucgagcagcaaggaggggagaggacccucaguccaaggacagaggagauggacugugugaguugccggaaagcucauuuugaauucuuugggggccaaacuuuucuauccuaaacucuuauuuuuuuuuuuuuccaaauuaggaaaauaguauaugacaauuguagaaaauugggcuauaaucuagagguaauauuugguagcauuucuccccuccuccucaaugcauucauuuaaacuaaguacuaauaugaacuauuucaaguauauuauugaagacacuuguacccaugguauuuugucuauagauuggggcucgacgaggucaacugucaggauuccuggguguugaugacaugaagcuuuggaaagaucuaauaguuucuuuuagauccuggaggaaauagugaucuuauuugcauuuauuguuugaguaagaucaccauguucguuauuugucauguggugcuuuuugguggggguuugucagacauguauuuuguccuccuugugggucauucaggcaagcaucagucucccaaaguuguugaugggcaacugauguagaagaaaauagaaugaacuauauucaccaucugaaguccuccccacccccauccauccaggugaauggugucauuguguaguugucuucuauaucacauuauuuuuagauaccagcugaguagugcagucucauugaaagauucagcagguggcacuuuguagaagauggaggggauccagagggcgcgcugggggcuuugcuguguguaguaaaaguucuauguugugcuuuccauggagaagagggcggguccagggcuucaggccauugcaugcuggguuuggaaucccagaacuagcucauugguucaguagcagaacuagaaagaggaugcguugcguuuuuguuugaaaugugcugaagacaguguuuuuuuauugagcaggcuguuguuaaauuuguaauuuuuccgucaguuuuuauugagacugauugaucuuggggggugcggauuaauuuuaaggaacauguaauuucuuccuuuugaucagauccuauagccuuaauuuuguucuggaaucuuuccuguguaguuauauucaucuguguuuaguugacuaguuagugaauuuaaguuguaaugugaugugccuauuugaggccaaaaaauaaaaaauaaauuugauuaauucugugcugguuucauuggugugguacugaaugauacucuuagauguagugggauuuaccagguaaaaaguagucaguucucauuuuucuacccguucacagucacauaaagaaaagguucaguaguaguugacaaaaacuuguaaacuguuuuuuaaaaacagauauuuucauucuaaauguauauucauuuguacauuuuggugccgaagucuuccagagauauuuguauaucucauuuuauccguccucucuccaacuaacaaagauagaguuaacagucagucgccuuuuucuuuuauccagcugucgccgagucuccauuuaauucuguaaagaggguaugccaggugaaaggcuucauuucaccuggcaaaugcucagaacauuuuccaguccucuuggauuccaguuagcuuaucugaagucugcccaucucuccucaccacauaguuacuaccauugauggaaugggaaaaaauuuagguaacaaguuugaacagcauuuuaaggggucauuaaaaaacaaacaacaaaacacucauaccaugcacuccugugugcucagaugguggagugggcagggcuugucauaugacaaacccaucgcuaccugugaaaauuacuacuaugcagauguucuccacccccacccucugacagccugcaaggcaacuaaaaacucaucuccuagucagguccuggccugagacaaaggccuuuucugugaggauuugcuuccacugguuaaaguccaaaaugcuaauuggcaucagcugcauuaaaucacuaagugggggcuagcagcugccacaccauuugaguaaccaggagggggaccuuuuuuuccuuacuaaaaaggccucucucuccucuucaaguuacucuugauuuuguuuuucauuuguuuauacuugugaccugcuaaagaagggcauggaggacacaguaguuuggacucugccuggacacauggaauauauaaacuuccucuauguaguuuugccaacucaacuuucuuuuuguauaugggauuuguuguuguuacuaaacuucaguuuuagcuggccccuagucuguuuucugcuguaucuucccaggccacaugaaguguuuguuuuugguggugcuaguggugguggugguauguguguauguacuuaagugcugggaugcaaccaccaaacauauguuuaauaaccaaagggagacugaaacucagaaguugauucauuauuacccuacucuaaagacaacauaaaauacuguauaauaagcauuagucauaauuagauuuccaguuguagcuggcucaaagccauggcagauucuguauuucuaguguuuuuuccuucaagugggcacucauaauuggacaguaaaugacaauuaguggugcuaacugccuuuuuauuuuauaagauguguaauagucgucuauuuuaaaaucauaaaaucaagagaggaaauguucaaaguauauauaaacuuuauccuaaaacaguaauuugaggggagaauauaauuuccuugcaauauauuuuguaguuauuuuuguaugcuuccaggauuugacuauuucagaccugggaaauauucuggcaggugacauugaugugaucacuguauuucuggaugauauuucgguguuuccgucauauuagaaaagcuauugccagacuugauuauauuuuaguuguucuucuaaaucauugauucugagaugcaacucaguuuugaagauguuaagaguguguacuuuauggucgacagugcuucaugguuucaugacauaaaauaguguugggcuccauucaggggcacuucagauucagugaaauacauggugccauggugaucugccaacaguauuuaccaaugugccaauucgggaguuuucacaccgguggacaauauggaauuuaagaguauaagaacuaaaaugugugcuugauuuuuaacucagugaacugugaaaauaucgagugcucuugacucuuucuuguacaguggugaacagguuagauccuagaagacauugguuugugucacuaaaagaaaaaaauauaaauggaaccuagucgaauuauuuuauaauucuuaauuauugcucaggaagccuuucaugggagaaucauagguagcauuucuuucuuucaagaagugaaagcuacuggcagagugugauagggaacaaugacccuggaaauaguuuagccacugcagggaguggagguaggcaaagguaagggugggauugaugaaacaagucuggacaguccaguaaaguucacuaguguaugaaguucuuacuacaggaacaaaauuaaaauaaauauuuugauuuuccccuauucauuguuguuuuguuuuuguguaguuuuuauaccccaaauccuuacagauuuacugacuuuuggauaaaaggagaaaaaccauuaguucacuuucuggucacccagcugcaguucaguauaaggaaagugggauguuuggcuuuuuagagcacauguuuaauuaaccauggaccuuauuuugggagugacaccacaugccuuuucaauggggccuguuuauggccacuaccgugugcuaagucuuuucaggagccugccugucuugacaagccucacuagggcugucccaggccacucacugcuuggucaggaggccucucagaaacccucagauaccacugggagugaguuguggugagucaggagggagcaggcucgaugugccccaugacagcaagcccuggucgcuacugcucguuacacugugcauguugaugugugugugcagagagcacaagauaaaacuuuugaggcauuagguuuccuacuuuuauuugggggcaugcuuccucauguuuuauguaguaaaaauuguuacccuuuucuguuuuagaauaaaguuccuuugaagcaaggucucaaauagaaguguuuuguuuuacuggcuagucuaaacacugguuuuguuuagaauuaagaugguuaucuaguauugaguaccuaauuuuucauugcugcuuucaacauggccacauuuaaaucucagauagaaauuauaccuauuugguaggacuuuccuauaugcaggguuugaaugagaauuauuguaucaacuguauugggucaugugacuguugccguauuuguagucaucugucaaagucacaugacaaguguucuuguagaauauauaguugugcaucacuuaaccaugaggauacguucucagaaaugcaucauucauuaggcaguuuugcuguuguccaucaucagaguguguuuauguaaaccuagaugguacacaugggcuaucugguauggccuagugcuccuaggcugcagacauguacaauaugcuacuguacugaauaguguaggcaauuguaaaauaauagcaaguaguuguguaucuaaacauagaaaagagauugucaaaauauguuauaaaagauaaaaagugguauuuccgcauagagcucugaccauuaauggagcuuacagggcuggagguugcucugggugaaucagugagugaguggugagugaaugugaaggccuaggacauuacuguacacuucuguauucuguacugacauuacugguauacuucauaaacaugguacacuuaggauacacuaaauuuguaaaaaauaugcuuucuucaauaauuaacuagguuacuguaacucuuacuuuauaaaacuuuuagguucuuuuguaauaacagcuuaaaaaacugcauagcuguacuaaaauauuuucuuuuuaaauaucuuuguaagcuuuuuucuuuuuuaacuuuuuaaacauuuugguaaaaaacgaagacagaaacacacacguuaucuuaggccuacacauggucaggcucaucaguaucccugucuuccacuuccacaucuugucccaguagaaggucuucaagggcagucaugcacagagcugucaucuccuauaauaacaaugccuucuuagggauaccucuugaaggaucugccugaggcuauuguaaguugacuuuuuuuuguuuaaauaaauaggaguacacuuuaauaaacaauaaaaguauuguaaacaaaccacuaacauagucauuuauuauuauguacuauacauaacuauaugugcaauaauuuuauacagcuggcugugcggcagguuaguuuacaguagccuuaaccacaaacaaugucacuaggugaugggaauuuuucagcuucauuuauaauuuuauggguucacuguuguauuugcaguccuuuguugacuaaaacguuauguagugcaugacuguaguauaauacuccaauguuuauauuucggaaccaagcuguaaagccgccaucuugagaauuacuauucuaagaugacuacaugucuuguuauacauuuguuuucuaaagcaguaauguauaacugaaguucguauuuuaaaaauuauuuuucccaucugaucuuaucauuuauaucuaauuaaugauguugcagcuuuuauuuuaaaguauaauauuugcaaaucaaacuuccuuuaggcuuguaaggccuuaagagugguucuagaggugcuagacugaagcaguaaguagguuucuuccaaguugugugugugaguaugugcguacacacacgucuaggcuacucagagccccuacucuucccuggauagagaaggacaucaguugugaguggaaugauugugucaguguagaaaaguaaggacauuuuaggggacuagucaucuuuuccuuuugaaaauguaugcaguauaggggauucuagagaucuggucaucagauuucucuugaucuuacacugugcuuuucugaucaaggaugauuuucccuuuccugcacaguuucucuucuuucucacuuuaacucugcuuuccccucauucuguacuaacuacaaaucuuccuuaaccugacucuuugcagguaguaugucauguauauauaacaaggaacagaaugccuaccuggcuggugugcacagcgucuucuccagguuuauaugagagagagagguggagauaacagacuucucagacuuugucauucacaagggcaacuuauuuuuauuuuccagacuugugucacuaucuguuuccuucauuccccacccugaucuucucacacaaacucuggguuucuuccucugcucaucuuauuucaauaaaccaagaugcuaggagaggagccaagucugaaaccacauucucagugauguuuuguuacuggggcccacuggacguagcugaaccucuuuucggguuaguggauucucgcugagcacaccgucacagacuacaccuccagccugcguucauguauucaguacuuugccuuggcuucacuagagggugcugucgugcaggguuguuagagguaaacguuuucuggacuuaaauggaccagaugaucuguauuugcaaaggaaacagauuuuccaagugauaaguucaaauaguaucagucauuuuccuuuuguggucccauuuuuacagcugaacaaaccgaggcucagagaaguggagugcauugcccgaggucacaguuagugggagagcuggccgggcaguccccucgcacuaucccugcggcucuccgugucugccuuuaccuccuaugcaucacguccuauaaucacacuucaaaggaugaguccucuaagguuccuguucuuggcacaaggauaaagugaauguauaugugccucugcuccuggaggauggagaacuuguguuccuuucauuauuguauguagugugggggaaguaaagucauucacaucguucaguagccacacauuuuauuuuuauuuuuucauaaggaugaagaggaagaaaucaaacuggagauaaauaugcuaaagaaauacucucaucacagaaacauugcaacauauuauggugcuuucaucaaaaagagcccuccaggacaugaugaccaacucuggguagguggauguuuccugagcauuugugggcauuccauuugcuugaauuguaagggcauggcgggggugggggcgggggaaagagggggggaagaaaaacaauaaagaggggcaguaaguagcuggcagguucuaaaggcuuccuuggcuuguaucuguggguugacuauaugcugguuguuuauuuugaugucgauuucacauugcguggaaaaaaguuaacuuuguguuucgggaauaaaauggcagcaucuagaaggaauguaaccaaauagcaaggaaauuaggagcuugaaagcaauacaauaaaaacuuuauuuaugggaacaaaauuaauuugaaagcucaguaaauugagcuuaccacuuggaaaugagagacagaucucaagaaacaaacuucugucaguagcuuauuaauaauauuaaugauaauaguuaaaacaaauuccagggaaauuucuggaauugacacauucaaccuuaccucuuuuugaacacauuuauauucaagauaaugacuuggagauaccaucagaucuguggcuaucacauuauuuaaacuuauaaagcaggaagauagguuaauacuuuuuguaucaguauuuuuaaaaggcuauuacagaaaacauuugcaaaauuaaguagaaggcaaaaaauuuacuguuacuauugcccaagucagaucauaguuaaaauuuuagaauaguucaauucaguuuauuuucuggguacuuuaaacauaccauugugaucauauuguucaaacuuuuagauacuguaaauauugcauuaaaaauuguauaacugcuuaaaaauaccauuuuuuauucacauuagacccaguuaauauaaaauauaauaguuugaggaucauaaugugaaaaguagaauguuuuugagguaaaaugaaaaagaauguuagggaauauuugagucagauauuugauaauuggguagugaugaagagcaaagugguccuccugugcccaugugcuucugagagagaaugagcacuucagaauugcugcacuugggugugccguagaauaccagacacugucagucuucuggaccaaauauauggagcgaauacacuggacuaugaaaugagcuuucaguuauuuaggugccuccaaauuauuaugaauuauugaggagcaucacguuucuaggucuuuagaaaagagagggcauggcgguuaaacugguuuucccaauuucuccaagauauguugcucaccuugugucuugucugcccuauagcuuguuauggaguucuguggggcuggguccauuacagaccuugugaagaacaccaaagggaacacacucaaagaagacuggaucgcuuacaucuccagagaaauccugaggguaaggaaaguggguggcuacagugcuccaacucaugauccugugcuuccguuuucauuuucccagccccaaguacuucuuugcauuacuuauaucuauauagauuauucucuuugacagccaaggguucuguauaucuagcuagcuuugauaauuuuaagcuacaucaugauuugacucuggcaaguauguaaagaagguagacuuaaauaaaaaaagcauuucugaauuuacuuuccauggcaucaugacauaccuauuggcagcuuuccuuugaguuaaaaggaaaucagaguggaagggaagagaaauaaucuccaacuauuguuuuuaaaggaauucuguguuuaagcuuauaaaucaauacuaauggugcugaaugcugguuuucaaaaucaccuugaagucuuuggcauuagcuacuagagucuguuacaauauuuaugaagaaaaguucgaauguuuaauauuauuuacagccauuugaaaagcuggcuaaugaucuuagaguaaguuucugaacugcuauuuuagcagcuuuuaaaugguucuuuugaguaguaaagccauauugacagcacaggcagaggguuucuaggauuucguauuugagcagugcauguaggauauuaccagugagucucuucauuuggcuaucacaguuuuucucucuacuucaucccugaauuacacacagacauuacuugguugcauuucauuuaccuaccacauuuaaaaaaaaagauuaugaaguuaaauugaagcccaauucuuaggcuucccccacuaauaaaaaaacuuaaaguaacuaauaaguuauuuuaauuuuuuuaauaaguaaaguuaucccacuuuuuauauuuaagauucauagaggauugcagguuuaaaaacugccaucuagacuuccuagagaaauguuuaauuuuuuuuuauuuagauauuuauguagucuuugaaaauaggcaauuccccuaagaagacuaguugugaagggugggguagggugacaggagaaccaucuuuuuauaaacacuugcaaaugucauuaaaaugucaggaucuuuuaugacuauuauagaaagcagagccuaaaugugggaaacuaagcuuccugcccuauacuacuguaaaggaagucagguacugggccagaugcauuuauucuauuaauaacuaaaacuguuuagcaugguaggcaggauagaacauugguugagugguuggagacuagcauaagucagaccuggguuugaguccuaccucugcugcuuaccuauauagcacacccuauguuauucaacuuucaggacuuacuuucuccucaucuauacauaccaacccuuugaaauuacuuuuguuaggagaauucaaugaguuaguguauauuaaucaucuaauguaacguggauacauagcuaccuaucaguaaauaugaauuguugucauuguucuuuguuuuaaacacccacucccuggccauacacauccccacccacgcacccacaccccuacuuugcuuguauguaauuccaguaugugauaucucaagcagagaacuagcuuuuagcauaauguccuaggcaucaaauguauuucagccuucaaagacaucaaagacaacuuacauguguuucuauacccaggcaagcauuguuuaccuaucauauguaauauguaccuuuagccauuuuaccaucaguaaucuccaguaacauuuaaaagaagcccaaguuguuugacgucucuaagccaacuugagugugguacgugaaugaacaucuuuuugagacguagcaaaucuuuuucaccucacugggcaucugaaacacaagcuuccuuugccuacaugucaucuagaaugggaguuuuuccuugugacaaaaguuuaaauuaacuaaaaacaagcaaaugccucagggagaguuccugugucaugcaguaaguaguguguguucauuauagggguuacuaagagucggcuuugguaaagagaaagcagcaugauaaacuggagguaaggucucaugagaaaggaaugcagccacccccagacagauaagcuguguucucaaagacaguugggguuaaacaauuucugugguggcaaaaccuuuccucauuucucacuagauguuggauuuagacaucuugaucauuaugaucagacccuucgaauggggaggguccugagcagguaggccucagccaauagagaagugcuuuuuggagccugcacacuguuacccuguggaccacaaggcuuagcagcaggccagcguguucuuuucagcccacuuccauguucacauuccacauggcaguaucuucauauugaacaugggaacugagagcuuucuauaaccaauacuguaugacaaccuuugccugcucuuuuauucugugaccaugcaugauacagaguuaagggaaaaauguuuccuaguucagaaacacugaugcauuugcucgaggauagguccuucacugaguauuuggacuuggcaucucugcuaaggaaggauaauuguggccuaauuucuggugugggauuagcugaacacacauacacucccagguacuucauggaagaaaaauguacuuauuuuucagaauaaucauauaacauuguuucagagcugcuagacacaccuuaauucccuguagaagcagugauccuguagcaguauagacaggaaaacaggcauuguuccauacauuuacugcuaguaaugaacaagagugcaugcaagccacauuuguuggacaagaugugggugcuuauguuuguuguuaagauaguccuguaaaaguuuaagaagagguugugcaaguuagagagcaaaaaugaacugaaauaauagaaauaggaauuacgaagaauugggaaguuagcuuuugugucucuccuuucgcuguuugaaguuauaccaagcugagaggaggugcuuuguuccuaacuauagcaauaagguaccauauauuuuuagugcuuuuuucucuagucagugcuuugcgguauaauaccgcacauccuguguugugaaaaauaaacagagcugucgaauaagcucugcucuguuucauagacagaccaguaaaugaauguuuugaaacccccuauguuagaaaaauuaguauucuagaggagcuguuguauuuaauucauaucuuacaaaguaaugauaacaauaaaaccccaugaaaaaagaauaaacaggaaaaaucaaauaacccuuacuuauaaucugcccuuuuggauugagacauuuuagaguaaauagguugcuuguaucuuaaggaggcgagcuguauauuuggcuucucuagcuaaggacagaauaaguaaaugaguugugagaaugaugcauugcugucucuuggaccauauuuggaggcaacauguguuuuuguucuuccaccaccucucguaagagacaagcuuuugggccucauuccagauacaaggucaucaaaaaguguuauaugcccaguagguuuguuuccuugggaaagaaagauacuuuauuugaacacaaggcucuuuugacagcacaaucguuuuaugcuugggauggaggugggauugaucagcacuuagcaguuugucacugugcagugggaaggcuagccaguguuaaagagccagauuucaaagcccucucuugcccuuugcuuuuccccugagaugugucuaguucaaauaugcccacggggucacccucuagacauuuagcgugggaaaggaaccacccuguacacaaauagcacaaauuauagcacagaaacugcagaugguaaucugcaguguaucuuaaaggcacagcuagaagugaucacguugcucacacggggaaccuaacccacugggaauguggaggguggggaggacuucuuucugugugugugguaguauuggugcugucuuccugggaaugcacuaagacgaaguuaauguucaugagcucacaaacaccuuugguccacaugugcacuuucuuauaaaagguguguuccuggcuguuuacuuauagucacagaaaacuaaaauucaggucugucuuuccuauucagggacuggcacaucuucacauucaucaugugauucaccgggauaucaagggccagaauguguugcugacugagaaugcagaggugaaacuugguauguaauggaugugcggcgugaucucauaauugcaccuggcacaagccagcugcacucccaguucugcuuccaucuagcuaaaaguucagucuuacccauguuuucuauuucuguucuucuuaagaaugugggaacugagcauauuacuuagcuuggcuccagccuccccacuuccauguuugugccccccugcccccugguucucuauacagcagccagacugaucuucaaaucagaccaugccacuuuccugcuuaaagaaccuuaauggcuuccuauuuuacuuuggauaaaaccuacauuucucacccuugcccauaaaaagccauguaggaucugacccgugcuacuuuucccuccucauuuuaugucccucuuuacuucucucuucaucagucacugucuuuuuuuucuuuucuuaaacuuuuugggucuugccuuugggccuuugcaugacuauuucccauugggaacacuugacuucaguuuugaagucacaguuuuuuuucucauguuacgggccuuuuccaaccucuaaucugucuugggccuugcugcuuguuucuuucauaguauuguucacaauguauaguuaugugauuguuuuuuacuucuguuacugucuccuuugccagaauguaaauucugggaaugcagcaaauaguguauuacccagcaucuagcauugugacuucauuguaguaggugcuugauaaauuucugcgugguuagauaauuacagcccaugguguuuuccuggaguuacucacaaggguucuuuuauauuucuuguuuccuuuagcugggucugaacucauuccacuuucaucuaaguguuguaucaaaauuuuaaauagaguuuguauuaauuuuucuuccacuaacacaucacaacaaaauucuuuauguuuauaugggucuggucaaccuuucuuuuagaaaucauaggcacagcuguuguacuguaaaaguaagaucuucauaguuacuuucuugccugugguuguguuuguugguuuucuauggaggaaucugcccaauuggaaacuccccucagagcuaacauaggaagcacuugagcaguucucauaccaaaugacucagugaguuguguguucccugcucuggucuccugguaccagccugugauagucccugagcgaucacuuagugauugguuaccauugccuuccaaguugcugugaugcucgcuuaggcuuccugcacuggcuggccugugugucccugguuccugcacugccuggcccgugugucucugucucuaaaggaguacucagugagugaguccacacccuggacgagccauuuucugagcguguucugugcaugaaucuaugaucccuuuaagucaucucagcauuucguaggccuuuuugcaugggcuccuccaccuuugcagguuccugcuggguuaauggcagugugcguagugauaguguuggcagggagugaugggaggcauucuguuagaggucauggucuuccugccagcucugccucccguccuugaacuuuccucuagaccaccaccaccauccaauugggugggaugcagaagucacugaaaaaucagcagaaguuccaagugcuuuaggguguguuguuugugaauaugugauuuagcuugauuuucuuuauuugauucaguacuguguuuuuuuucaagaaaacuuucgugaaauucuuaucuuuaugguuauuagugcuguuuaagaagguaagucaagugcaucucagucaguucuccugaaccuggggcucucugugacuugaucuuguuuguggcaguucucugaaagcacugaagguugugguucauucaaaaggcccucugcuggucacuguuggagaagcuggggaggcagccagauccaggccucacagaagcuuccagacugguagaggaucucacagucucgguggcuuuacuguggaggggcacuccugaccaguggugccugccuugagcaggaucgcauauucaugaagcacugcuguuucaguuuacuaugaagacauuuccuccuuguguuuuuucccaaguauaucugguuuguaguuguguuuaucuuucuuuaucugccuuuuucuuccucccacaguugacuuuggugugagugcucagcuggacaggacuguggggcggagaaauacguucauaggcacucccuacuggauggcuccugaggucaucgccugugaugagaacccagaugccaccuaugauuacagaguaagaggcaccugcuccguaggccuuugcagggccacuggcauacccgagggaugggggcuuugcuuauaaauugcacaccccuugucugccugccuuuucagggaggaagaccuucagugaggaaaauugcaggugcaaauuuuccaggacaguauucagaugcugucuuuuuuguccauuugcaucacaugacuguguucucacuaaggaauacacugguuucaaagcagucuggagcacuuuguugugccuagaacuuuuuguuccuauuugcuauccauuuuuuaacuugaagaauauauuagaaucaaauauuuauucuuuuaaaaauauugccaauauaaaguaauagcuucauuugagugaaauuuuauauucuuguuaaaccacuuuacagcuuuuauuugguacacaaauuuauuuaaauuauuagagugaccucuagggacuugagucaguaacacacuuuaaaaaaaucuagauguaaacccauauuugauaucaaacucagguuacuauguuuacaaaaacuauuuuuaaaaauccaugccuuaauuagaugagccagacuaguuaauauacccguuaaugauaugcaaaauggaauucaugucuuaacaguuucccauguauuuuaguauuuauuacaaauauccaauuaaugagacuuaauuuaagacuguagugcagaauguuuuauuuuuuauauacugaaguaucuuaaaauagauaaccgacuuugugacuuuccacucuuuacugugucauuacuugucucuaaaauuugaaaauguuuuccggcauuccccaaauaauuauuauaccuaaguaaauacaaauaauuaauacaaaguugguaauuagaccugacugguaugcagaacaaggcaauguauuugguuauuuagucucuuuuaaucuggauccccccacccccacccgauguuuuuguuuuuguuuuuccauaaaacugacuuucugaagagccugggccuguugucuaauguucuacccucuagauuugucucauuacuucuuuaugucauuuaguuuguuuccuguaaacuggaaagguguaauuuguaucaaggaaaaccuucuuagcaaaaucacugcuggggagguggagguagaggugcuucauguugccucacagcaggggacaugcagaacuguucauccccaacucauguugccaggaguggccacuggguuaggguaaugagccccuuuguguacccugauaguauagaaagcuuaaugaaaauaagggaggaaugauaggucucuccuuuuuguuguauucggauauaugugucugaacuuuguaauguaaguguagauuauuuagaaaaccuuuaaauugagcaacuuuaauuccuugguuaagauagcauauaaacaaauacauaguaaugauaauaacuauccucaucuacuuuucaaaaauccuuuuuuuuggauuuuaagaaauaccaucugauggccgggcaugguggcucacgccuguaaucccagcacuuugggaggccgaggcggguggaucacgaggucaagagaucgagaccauccuggcuaacccggugaaaccccaucuuuacuaaaaauacaaaaaauuagccgggcaugguggcgggcgccuguagucccagcuacucaggaggcugaggcaggagaauggcgugaacccgggagguggagcuugcggugagcugagaucgcgccacugcauuccagccugggugacagaaugagacuccaucucaaaaaaaaaaaaaaaagaaauaucaucugauaagacuuuaguauaucaggcaauguuuagugaguacccgccauuacaaaaguaaauaaaacuggcaaaaaugacugcuuucauggaacuuauauuugaguagaaaguaaaguuuaauucaaauuuuaaauuuaguauuucaggggaaucagaaaaaagauuccauguacagaaaaccagcugacuuguuugguuugcagguaggguggggaugcuuaguggcaugauuucaauuagugaaccacauuagguuuuaugaauucaguggugaacacuuuguaaaaaaugguuucuggccuuuaaacuuuaaaaucuuaauuaaauuugaguuacuaacaauaaacauaaaucugggccagaagucuuaaguauuaaaugcuuaugaagaaaugaagaaacauacaguaguucacaguagacaauucagagagaugcuuuuaaguggaccagcucugguucauucauagaugugagugguuuuaauuaaaucaauuuucuccuuccuuccuuuccuuccuuuccuucccucccuucccucccuccccucccuccaucccuccaucccuccaucccuccaucccucccuuccuccccuccccuccccuccgcuccguaaguucuacaaaugugcuuguacuuuuaauuuucuggcaaauuuccuuuugguuuauauagcaaaguugugugaauacccagacauguaaguuaguggcuuuguaucuacuccaguaucuguaacguacuguuuuauuuuugcagagugaucuuuggucuuguggcauuacagccauugagauggcagaaggugcuccccguaaguaacuuucuuuucuuuuuagcucacuuguuacaugugacuuaaaccccucccaagacuucaaaaagaacagcucagcuccauggauaaaggcauuucugguggacuguuuagaugaaggcaacauaaauauagucaaguuuuagauguagaaggaauucuuggcaaccacuauuacuauuccuuuugaauaucucuaggaggccuauaggcuacauuuucuuuuauuuaaguuguacucacaugugugaccugaaguagugcugagaucagauaauaaguaguaaguuuucuuuuuacauuuuaaauugaguaauucagugaaacuaguccuaacacaugaaauuuuaguauuaaguuuugacuuuacaaauggaggcaaaacuuuauugauagaauaauuuuuugugcguguuaacugaaauuuugugaguguuugcuucuccauuggauuaaugagaacuucauauaauucauuguugaucacggaugagguagaauugcagagaacaaaggaaaaaaaacacugcauuuucugcugguccccauuaaaaaagguauacacaaagaauguauaacugucuggcacggcacauaguugcugcugaauaaauauuuguugaaugaaugaaaauaauuaucgacagcuaaaaauuaguuuucaguauagaaauagagaucugccucaaacaccauacauuccccugugcuucccucuaagaaaguaaggcagggaaguaccaccucauccuuucucucaguuuuuguucacaaggggaauaguauugucugccucuccucauugcccagaugccuuguaagggucuucugaagguaaagaaacacaugaaaaugcacauugcauauggugauguaguaaugccuacaugugugccuaacacaccuuuauugggugagucauaggaguacaaagaguaauugcacagaauuaaauccauuucaugcucaauuuuugcucuuucuaguauuuuuagcuauaacaacaaacagcauuucuggagggccuaacugugcucauucuguuccaggcauuguaugaaggccuuugcaagccauaucuuauuuaaucuugacaacaacccuaugaaaauacaaucauuuucauuguaaucuaacagauaguuuaacaacuuagguguuaguuccuauaagacuuagauuuaugaaaacuuuccaaugucuuuuugaaaauguauauucuucuuguugcucuuguccucccacuuugcuauuuuuaaaugggaaauucaagauaugcccuggaguucauaacuagaugucuagacugcuugguaugaagccugucagucagacgaugggccagagcauuucauguuauuuaugacugaacccuagaaaucaagaaugagugaaauaagugccauacugacacgaccgucuccucuccccagcucucugugacaugcauccaaugagagcacuguuucucauucccagaaacccuccuccccggcugaagucaaaaaaaugguaagcuauauaugguuuuuuguuguucuuuucccuuuuuuuuaaauugcuucuuuuuaguuauacuuuccucugagauaaaauucuggcccuucuaauucuggggaacccaagagccaguucuccaaaacaccaauuaaaagaugcguugauuuuuuuuaaaugagauuuuucuuguuaaauucucucugaauuacaaaacggugacaaaugaccacaugaaacacuauaacaugucuaaagacaaauguuccauuuuaguauuuaggcauucuuuuaaguguaauauacuucuaaacaucuucccauuaaagaaagaaagcgaccgggcgcgguggcucgcaccuguaaucccagcguuuugggaggccaaggcggggaggaucaccugaggucaggaguucaagaccagccugaccaacauggagaaaccccgucucuacuauaaaacaacacaaaauuagccgggcgugguggcacaugccucuaaucccagcuacucgggaggcugaggcaggagaaucgcuggaacccagaaggcagagguuguggugagccgagaucacgccauugcacuccagccuggguaacaagagcgaaacucugucucaaaaaaaaaaagaacgaaagaaagcuguguugacuugcauuuccucacauguaguaggauuuuaaaauuaauggaggcuuuuacuguaauuauuauuauuuuaaaaauugaaguuagacauaccagcuuuaaucgcagaauagcauauuaaacagaaugguuuuauauucuuaggcugucacuuuuccuucuccuuguaacucucauacauuugucaaacagaguacugauacccgcagagagagaggaggaugacuuucccugagaaaagcuguuaggauugcagcauugugggaacaugguguuggguuaguuguaaaaucuugaagaaagagagcaguguuucugguucuccugagaauuuugcccccucuuucccuccugaauuucuuucuggguccuuucuuguuuguucuggucuguacucuggcucuucaugcauggucuccccuccuuuuuguguucuucuuucuguuuuucugggcucauugauucccaccuacuauauggcuuuuuuuuuuuuuuuugaaacaguucuuacuaguuuuccaauugaugcugccuccucuuagguucuugacucuccuucugaaauaugcaggacaucucagaguuaagcuuccauucugaguuuggccuucagcuguuccuguuuaugcuuuuuuuucuuguuuacucaccuucuggugauuugcaguucucuuuccccuauauuguugcacgcugacacccaucuucauaccaguuuucuucaugcuucucccuguagcucacuguccuugcccccaacacauuucacuguucuuugcccucugucuucugcuggcaggauuuuucucauuuuuuauacagucuuuaaccacauuugucuccauguggcuaauuccauuuaccccguguuuagaaugguuuuuauugccacagaguuguaaggauuuuaaccccagucagucuucuguauuaagacauaauaacucuggacauccacggguggccacgccuagggaaaccaucaguguauauagcugaugucaccaaggaaucagcuguggagcuggaguaacucuacccaguucaugcuuuaauuaaguaguacucauuuuccccuuuucuuuaucucucucagauuuuguugacagaagucuauacuggaaggauugcuaaguuaaugcugucuucaggguaccucauacucugauuuuucugcccauuagcuacaguucuguauuaaccacuguguccaacauauagugauacaaagauacagugguagacagcaaugaaugcuuccuguauucuuuucuuacaccaaacuuucuuuaaacuggguuagacggcauauuucauccauuuuauaucccuguucuaauguuacccaaguguucuaaaaggaugagaaaauuauggacguaaaguccuucuuccuuugugauugcuguccaccgucuacccgauguaaauucuacuguuuuuuugagaaauagcuuucaaaagaugaucaguguccuucugccagcagaacuugauucuugacuuuaggaaauacguuguagaucauugauuccgagauguuagucuguggacacaaugcuuaggaauccuuuuggaaucuuuuaacugauggcuccaaccucaaaguuucuggucuggggagugacucagguauuuguaucuucaauaaacuccccaaaaugaucuuuguggacauugggucuuagaacuaucucuguguuaaagcauuucacuguacuguguagaaucuuccauguuccucauuaaacguagaauaaaguaacagcuacuuugaaugacuucaaggacuuuucucugagcugacccuaaccuauuuuuccauucuuuuucacuuuuaauacuagccucagaaaauaacucauuauucucuaacacuucccuacuuuuguucauaucauuccuucacucuggaauguugucuucucuguccuaccuuaugaauaucaaguaucccacuuuuucuucuuguccagucuacuguaacagguuuuuucuuccucuguaaguuugauauauguccgcuguuguguauaccuaaauuucuccacuuuauuucccauguguauguguuauagaaccugacauaaacaaaugcaaauaguugauacguaaauauuuguugaauugaaaaaaaguaaguuuuaauggaaauaccagacaauagaagugauucuuaaaagcagugaaguggaaagagugaacuaauuuucuaacucacauuuuuaaagaccgaagaauaccucauucauucaacaaaaauuuauuccauaccuauuguggcaugcaugccuaguguugagcauugccugcagguugagauguaggaaccaguuuuugacguguaccauuucaaccuuucagugggacagaaacaaaaagcaugcagucuguuaaaagcagauaaccccagaagaaaggcuccuaaauuggggacacauaggacagaguguugccaggaagauuuaccagaaguggugauucuugagaugagucucaaaaaauaggauaggugauagguaagagugucuugaccaaggcuagggccaugguccucaugagcugggcauggagaaacaggaagaaguaaaaguggcuaguauggcaaauguaggugacagauuaaucucuucccuccaucccuccaaaagaaccaacaacuguaauuuccaccuuuguagguuaaacagagggaacugacaaaucaaccaguuuggaacuccgguugaaaugucaaauuaacagguucaagagacccagcauuucgucauggauucugcuccuuuucuuaucucauugucuguccuugucuucuagguaccagacaucuguccugucugccuucauuuuaucaaagaccucccuuuacccccuugcugccaccacuccuguuaauuaagugauuaaugugcaauauuagauuuaaacccaguucauuuaaaucugaccuccuuguuagcucccuguuugugguguguuguuagugauaggaugcaccacuuaaacugugcuaaauuaaugcuccugauccucaacaguccugaguuccuauuuauguuucauacauuauuccuaugcauuugcagaauguucacagugaauucugaagcucuucuuuauguugaggcuuguaaguuacugauauuuucgaucuuuacucuuugugguggaaauuugaugaucuuuuucacuucuuacaggucgaagaaguuuuuuaguuuuauagaagggugccuggugaagaauuacaugcagcggcccucuacagagcagcuuuugaaacauccuuuuauaagggaucagccaaaugaaaggcaaguuagaauccagcuuaaggaucauauagaucguaccaggaagaagagaggcgagaaagguacuaagccuguuuuuguuuucauccuuuaaaauuuuuauguuuaguuucuugccaacuagaguaggucccucccuucccagcugugagagugcucacuuggccagugcuugcaugguuucucugcuugcgguucagugcuuaggccugggguccagucuggcuccagguggaguuggcuggagcuuuguguugugucaccaagcuuacagcaaauagaucggcauugcgaugggaugcuuuucuuguucccgagggucacguuguugcugcccauuuuacuuccuuacggauguguucaugguauauuucacugggguguauugagcaucugcugugagcaucaccaucaguguguuucuguauaauucuccugcccaagaacccccgcucaggggauuuuuacugcucuacucuauuacaagcggugugguagcaugggccacaugcauagucagaugacuuugcuuuaaguagcaugcauaacacaagcaugcuguugugcuaaauaaugaagguucuuuucuguucccaguaacuuuguuuuaugucuuugcacauacuuugcccaccuuccuggaauguucuccguuuuccuucuguccagcgaggugcaguucaaacaucgucaccgucuuuacuaaaccaucuucucugaggcugcuagcucacauugauccuucucuuuuguggguccuuauaauaacuuuauagaacaacacuugguuaaguggcauccuauuacuuuuugguucaaauuucaaggucagagaagaaaccaagaagagcagguucaaggcaguaaaagaauuggucaaagucuggaggccuuucugccuguacugguauucauaguuaagucaucauugauguucagaauaaccuuuuuccuucugauauacuuaguuauaaaaguaauuaggcuuuguacauuaagcuaugcacuuguaacacaguuaauuaaaguuugaaaacaagacuuuuuuuccuuaacucaauugacauggaagcgcuguucaggaaaaaaauuauuugcauauuggaucauuuucccaugacuugacuuaguaauaauagcuaauguucauggaacauuugccagauaccuuggaucaucucauguuuuccucaucacccacauuuugcagauggaaacagcagagcaccuucccuuccuuucucuucaagucacagugaccucuucauuuucuuuuuggguuuaccuuccagauaccauuagccucuugucaauaauuaguaauuuguaguguaaaauuacaaacauagcagaguaccuauuuuaaggauucugaagauuauuuaagcuggaauuucccuuugaagcuagcauaaucuauuaaaauagcuuugauggucuagcauacagaagagcuuauauguguagacugacaaauuuguacggaaccauauuuuaauugcccaggcacuuaaaaaccaggaaacugauuuucaucuuuuuuuuuuuuuggagacagagucuugcugcucugucacccaggcuggaguacaguggugcguucuuggcucacugcagccuccgccucccagguucaagugauuguccugccucagccuguugaguagcugggauuauaggcauguaccaccacacccggcugguuuuuguauuuuuaauagagacaggcuuucaccauguuggucaggcuggucuugaaccccugaucucgugaucugcccgccucagucucccaaagugcugggauuacaggcgggagccaccacacccagccugauuuucaucuuguauaucuuugaaaaaaauagaggugugugugucuagacugcuuuuaaaucucuucaaccugucugguuuuuugauugauuucuggagugaaacugcucacugaaaguuggauauugacauuaagugaagggaccaauaaauggccuuuugggaaaacugucuaaaaccuguagaacugaaaaugaguuauugauguugaaacuuuuguuuguuugaagucuggccuaaguagagcaaauuuuagucucauucuuuugcuauaugguuuaauuaguuuucccugguuuugccagguuuguuuguggguacauuuggcuuauuuuuccuguaccuaguuaauguuucacuuuguguccaucucccaggcuuuucucucugcugcacucuccguggaucccuaauugcaaaaaaucaccaaguaaauucucuugguugccuuaguuucagcaguuacauaucuuuuugaauuuugccaucaaaguggauuuuggugaauuugcuagugcccucggguucuuuucucauguaucaggggcucuggauccccucucgugguccugcacguccucagcaguacauccccauacaagguuggcucgaaugccguggaaucagcuuuucuguggggaguaaggcugaccagggaauagaugcugucacuaugagaauguggugucuugccccuccuccccaaauccucuauacaaguugcuguuuucacagggaacuuguuuauuuucugccaaggugcuccugcagaugcuugucugaacaggcgugugucaggacuugugaacugucccauuuaucuuguccuuuucuucauagaugaaacugaguaugaguacagugggagugaggaagaagaggaggaagugccugaacaggaaggagagccaagguaaccacaaagccacuguucaguauccugcuuuaugaagggauuaaguuuuauguugugccaggacugcagaagacuccugugugguacaaagaaucuuaaauuacuuagacagcaucuuacuaucuccauucuucucuauucuugacagauuccuguaaacauuuuucuucccuggauccucuuacccagugauucuuuaccaaggguuguauuguguccccuucuccagucacugaaaaaugugugggccugggcaggggagagugccccagcauuuauuguuccagaagccacggauggugaaggugccauugaacaccauuucuugugguauauagaacauggcuacacaaaaagaauugucccgcccauggaccagcaggacuguguuguguccugauuuauuuuacagucuguguuuuaguuuaucucuggcuccccaaaguucaguaaagcagaagguuaaggagucagauggguuacaugaaccucauaauaacugaugaaucagagaauagaggauuuuuggauugugauguugggugugccuggcaguuguccaugcugcaguauguggcugaugaagugaacaaagggaggguggaagggcaucucaagugaccuguggggagccgugugccagagaaugggacuuggaacagagagaagagaauuuauugaagcuacugcauaaucucucuuucuucuuauguaggagagauuuuaauccauuuuagacuaagaauuucagaggaauuugaacugauuucauaagcaauguaauuguuuuugaauaggaggagcacuguaugacgaaaaaggcaauuuaaggagauauguuugccaugcugcucuggaugcuguggcaguggagaaguaacucgguggggaggucagcuaggaaggguguguuuaauugaucuguguaguggcuaauucguaggacccgcuugggcucagcugcugaccuggaaauaagaaagugggagggaauuaugacagggcuuggugguugaccagacaaagacaaaggaaugguguaaacacugaagaguggucugaugguucuguuugcugaagaaaaaaaaagugguuaaaggacuagugaaaucaaagaaggugauuucaaccuuuccuuuuacugaguuugaauuguuacgcgaauccuaaauagaaaugucuugucaagcaaacaucuaggacagcauuuuaagauauuuacuaaauaaguaaaagaagauaugggacuauugaauuguagauauagucauuucuguggauguauuaguugucucccuggagucagaggaacucagagaaugaauguagaaaugggauaauaugcuggugcuauugacucacuuauaggacagugugaucggugcacaccccugaaagcccugcuuuuuccaacaguuccauugugaacgugccuggugagucuacucuucgccgagauuuccugagacugcagcaggagaacaaggaacguuccgaggcucuucggagacaacaguuacuacaggagcaacagcuccgggagcaggaagaauauaaaaggcaacugcuggcagagagacagaagcggauugagcagcagaaagaacagaggcgacggcuagaagagguagcaaaaggaaaauguccaaguugguuggucuuuucucuuucugcauuuacacugguaguuagccacucagaggaauauccucuguagcuuccugggguaauacuuauccccuggcacagcuguuuacauaacuugugaaagaaagcuuacgcuuuggacuggcaggccuucacauuccuugaggccuuagaaauguuuuccuuccuugugaaaacuuuaaggaucugccccacaguuacucaucaacauacuguguuagaugcagagcaagugucccaaagauggcaucagaccaguuuugugaagucuuuuugcauuaugguuuaaguuggcuugcucaggauugaccugauugcuuuucuacucucagccucugggucccaguuuguaugugcauauuuuucugaaacuucagacuuuuucacaugaaaguuuuuuuuuuucuaaaugccuuaaccuuggguauacucaagaguaggggaugcagaugaggacaaauggcuaaugcagggcuuaauaccuaggugacggguugacaggugcagcaaaccaccauggcacacguuuaccuauguaacaaaccacguucugcaguguaucccagaacuuaaaguaaaauaaaauaaaauaaaaaagauaagauuuggacauagaggcggaaacacgggaagagugccgcguggcaagggaggcaagaugggaaugauggucuacaagucaaggaaggaccaauauugccugcaaccaccuaagcuaggaagaggcaaagaaggacccuucccuagagccuucacaccuugauaucagaguuccagcauccagaacugucagaaaauaaauuuuuacugguuuaagccaaaaaaaaaauaaaaauaaaaaaaaaaaccgaacacacacgcacacacgguaagggaugcagaaaacaauuugaaccuggaaguuguaguguccucugguggagaaguacauuuuacaccaccugcucauuuaacucauuaauauugcuaacauugguaaugugguuaccuuacagcuuucacguuuuuaaugcacagaaauauauuauuucccuauacagucaugggucgcuuaaugacggggauacauucugagaaaugcaucauuaggugauccgucauugugggaacaucauagaguguaccuacacagaccuagaugguacagccuacugcgcaccuagacuaugugguguggccucuugcuucuaggcuacaaaccuguacagcauguuacugugccuuauacuguaggcaguuguaacacaaugguaaguauuuguauauguaaacauagaaaaaguaugguaaaaauaugauauuauaauuuuaugggaccaccauuguauaugcaguucaucauugaccaaaacauggcuauuucacuuggggaucagaagagucuuuugauuuucuuuuuuugacuggcuucugcugcauaccucacagguccaaauuucucauucauuaucauuucuguuuuuauuuaauucacagacauuauuguuuuaccuuuuuucccccagaaaaaugggccaacaacaguaaagcccuguauugauauuauccaguggaauuuaaccuauuaaguagcaacacaugcuauuaaauauuauccuacuaauuuaacagcacacuuuggcauggaaucuuucauucacuuuguguauuuguagucuggauucugaaaacucuuuauaauuugccgcuuguuuagaaaaaucagugccugcugaacuaaggagccugcaaauauucagcuaggacuuuuagaagaaaacaggacguacguuccccuguaguagggacaacuucgcugcuuuuauaaugcuuuuuguagcuaauuugcaaauuccuugugguauuuuuguuaagacucuuuucaguguucuuugaacguaauaaaucuugaaugaguucagagaucuguucaaguugcauauugacuguacuuacuauauuagaaugcuugaguuuugagacucuggcuguuucuaguuguuucuugaagugguguuuuccacuaucuuuuuuugaucccggccuguacuuuccuuaagcagguggcauagacuacuuuggugguuuauaacuugaagugccaaggaccagaucaaguuagcacucauuuguaacacaggcacuggaaaugucuuucaggcugucacuagugagacgaguauccauuauccagccucugcaugugguagguggugaaggugagcgaugguagaaggugaaggugagcgauggcucacagggaagagcugaaauuuuaaagucauuuuguuuuauaagcuaaguagaugcuggugaaugucugugaaaacaacaauuuugugcuugucauguuuuaauuagcccauuauggauuuucaguguaaguucaaacucagggucaucucuuugagcuucuuaauuaggaaagauuaagaaaauauuggaaugggaaaagucacaugaguagaauuccacugguuuggauuuuuggucagcuagcugcuuguuacuagccuggguaauuaagcuuuauuuacacuccaggucugaggaagauaauuugggaauagagugaucccguauuuggggguuugguucuaggacuucccauggauaccagaacugcagaugcccaagccccugauauaaaguggccuacuauuugcauauaaccugugcacucccuuccauauauagucauauguugcauaacaacguuuuggucaacaacugaguacauguaugaugguggucccauaagauuaucauggagcugaaaaauuccuguugccuagugacaucauagccauuguaacguguaauggguuguagcgcaaccuguuacucaugauuguggugaugcugguguaaacucauguauugcccugcugguuguauaaaaguauagcacauacaauuauauacaguauauguuacuggguuuauguauuuacuauauuauacuuuuuaaucauuauuuuagaguguacuccuucuacauauuaaaaaccaaguuaacugcaaaagagccuuaggcagguccuucaggaggauuccagaagaaggcauugugaucauaggagaugacagcugacagcuccauguguguuauuugcccuugaagacucuccaaugggacaagauguagagggagaagauagugauauugaggaaccugaccuuguguaggccuaggcuaauguguauguuugugugucacuuuuuaacaaaaacauuuuuaaagcuaaaacauuuuaauuaggaaaaaguuuauaggacagaaauuuaaagaaagaaaauauuuucuacagauuuauaugaaguguuuguguauuaaacacaaaagaauaaaauuuaaaaguuaaaguaagaaaaaauuacauuaagauuaauuuaauauugaagaaagaaaaacauuuuaaaauaaauuuaguauggccugaaugcacaguguuuaugaagucuacaguaguguacgcuaauguucaaggucuucauauucacucaccacucacucacugacucacccagagcaaccuccagccccucaagcucuauucauggugagauagcauuuguaaucuuuuauagcauguuuuuacuguacuuuuuuuguguuuagauucacaacuacuuaccauuguauugcaguuacuuagcauauucaguauaguaccauccugugcagguuuguagccuaggagcaauaggcuacaccauauggccuagguguguaauaggcuguaccaucuagguuugugugugcacacuauaugauguucauacaaugaagaaaucaccuaacgacgcauuucuaggaacauaucccuguuguuaagcaacacaugacuguacuuuauaucaucucuggauuacuuaauaccaaguacaguguaaaugccaugcaaauaccuguuacacuauauuauuuagggaauaaugaccaaaaaagucuguacagaugcagugcuuucaaauauuuuuugacccaagguuggucgaauccauguggauguggaaccuguggguacagaggcugacuauuugagccauaauugguucguagcccuuuauuggcauuaaggauuuagucagaacuguuugaggaacagagauuauuuuaugaauaaaguaaguaaagauggucagccucacucauaagauauuaaaacugaaaggagauaacuguuaucuaucagcagacuggcaaaacaugauccagaaaguaaaggcugugggcaaacacagugcagaugccacaaaaccaggcccacugggguuggggauuucuccugccauccacacacuccugucucugcacccuuuuugcaggugagggagggugcuuuugcccuucauagguccuucaucuuuaagaaauauguacacucccacccuccaucucccuuggugcucucugauaacugcugcugcugguaucgcccuccuuugcuucucugccuccuccuugucucuugugugaacuggaucuucuuuggaaguccuugcaacucuuuuggaguuugucucccgguuuugcugaaaaugagguuuuuguuuucucuucuuguuuuguuuggaugguuccaggaggaaaaggggagaaugcugagcucaugcagccgaguucguacugagagucucagcauuucuucccugccccuccccgcugcucuucaugugugugacugugcucccuggguccuucucuucuggguacacucauauuuugucaguuuacucuaagugaauuacccagauucagaaaaggauaauuuucuuccucccucaaaaagguguuuuguuuuggagacaggguuuugcugugucacccaggcuggagugcaguggugcaaucucagcucacugcacccucugccaccugggcucaagugauccuccuggcucuaccucucuaguagcugggucuacaggcaugcaccagcauacuaggcuaauuuuuguauuuuuuguuuuguagagaugggguuucaccauuguuggccaggcuuguuucuaacuccugggcucaagcaauccacccgccucagccucccaaagugcuggaauuacaggcaugagccacugugcccagccaaaaaguuuuaauacuacuuuuccuauuuagagcaucaucacaucuuuggcucauacaagacuuugggucuaguuaaauuuuuuuuugcauuuuguucacaagccaaccuuuucuuccaucuaguauuuauuugcuuuuuaggaaaaaugaagcuuacuuaauuguggugucauuuuaucucaauaguuuugugcucuuuuuuuuuuuuuaaauugaaucaugguuuggcaucguuuaucuguuccucuguacuuucaugacacucacacauuugguuagcauguuuucuuuguucuuugucuaaguuuaauaaaaauagucugggcaugauggcuuacaucuguaaucccagccacuuugggaggucgagaugggaugcucacuuaagcccaggaguuugagaucagcuugggaauauagcaauaccccaucucuauuuaauaaaaaaauaaagaguaaaagaaaauaaaaauauuaaacaagaugguguccuggagaaaaccugauuaguuuucugcuacuuguaauuugaacaguacugauaggauauucaggucuuuccugucucagagucuuuuagcugguauuuaaaaaaauuucuuacaucuuuccuuucaaagccuuuaccccuggacucucaguugucacuuugugauuuuggaaagucugcuuccucaacuaaggguaaauguuagugugagcaucagcaguuucuuuuugccuuucuuccaccaagaggacacagaguaacauuuauuucugucauuccuacaaaaucccaaagggauuucuacaaaucucaaaguuaaauuuuagaggggcgguggaaguagaagacauugaaaacaaagggaagcaagaggaaaaaaaacucugugugaaaugggauuaguauugauauuaaauuguaacacuaggaaaacauaaaaguuucucaguaaaaaauuaauaaacugugccaugcaugcauuauguguuucuugguuccgaaauuuagaaggaaggcagugaacuccuuuauucugaagcacuuuccagcaguugcuguguauuuuaaagaaauaacaaccauuuucucacuccuccuuuccuacagaaaaggucuuuguuuugcaagccauuaguaucuaacauuaggaguacauguuagcacaugcuaccuuucuuaaaaaaauaguuccagcuuuaauacacacaguaaucauaguguccuggcaugccagugccccuacagcuaaggccuugcuuccugucaagcuagcagcucaguugguaugcagaagguggcuggcuugcauuuaagaacuccucauaaguucuuaaauauucucuuggcaucccagucuggcauuugguuauauuugcaguuaaauuuuguagcgaguuuaauuccucauacgugauuuauuaccuaaagauggggaagaaaugaauaguucuccacuguagcuucaucagaacuuacaaauaaaaaaacucagggguugaugguauaucuguguaguaacaugaccgcagaaguucuuggaaauagcaguccaaagaauuaacuaguuuaucaaaauauguuaguuuccacugaagccaguaaauccaguggaguauauuuaacuagaucucacuauuacuaguguaauuuuauuuagaaaaguuuuuagaauugugagaugaaagcuuugcuuuuaaauaccaaacuagaauaggaacuuagauaauuaaagcuuaguuggacaaguacauauuuacuuaggcacgcuugggaaaauuuaaguaauaaaaucucuguaguuugagagauuugaugaucacguuaggacaucacacaguuuuucugucuguuugauuuuauuuuuaaagaaaggauaauuuaagaaaauaaauuacaucaguuuguaaaagcuucaaaagauuguaucauguuuaucauucuuaguuggguaagccugaagaagcauguucauuaaaauucccugggcuuuguuauuugcaaucauaggcauaagguuaacaguacagacugauguuauuuuguugaugguguguauguuucaguuuuugauauuuucuuuugaaguucuaaugcaagaggccagcuuuucacauuaccuauuaagauauuaaggacuuucuuaauuuuuuaaugauuccucuuagugcccccagcuaccuccaaauugagggccuauucugaauguagugguuuuuaugguugguaguuuaaauucuugcucucgaucuaguuuaccacuucaacuauuagaauauaauguggaagagaaguugguaacuguccucuuuuuuuuuuuuuuuuuuuuuuuuuuuuuuuugccuuagcuauuguucuuaacuauuuggucccacuaaccaggacuugcuuagugggauagucuugggagauuuaccacuuuccacauugucuucuacguuuuuuuaaagguaugugacucaccuaaccugcaagauuuggaggaaaggagcuguuucuaauucaucuuuguauaucuguggugcuuaauaaguauuucucaaauagauggauuaguuguuuguagucuuguguguaucucuggaaaggaagggcucauucaaauuuaagccuaugugaaaaugaacccuugggcuugagagcucuaauuugaguaccagagguaccuuagagugaguacuuuagaggaccuuauacaauaucuggaggcauaaaggagguguuuuuuuuuuuuguuuuuauuaguaugaggcacuacccagaguaauaauuaaaucucaagacuucgugcucuuacuuggugaucuugaaaagauugccuuaggauuugauuggauuucguaggaccuagagaccuaaauggauuccugagucugucaucacucuaaaugcuaagcguuggguaaauucacagcaguuucuguuaagaugucauaugcuagguauaaagguuagauucaaauaaaaaaguauugaauuucucuucugaagguaaugugugauauuuacuauagggggaaaaaaggagauaagacaugguuccugcuuucaagacguuuggagucucuuuuguguugaucuaguaaccaaagguauaguaguaucaccugaaauuaaaaaagaaaaacccucucagaagguuucgguugaaguugaacuuuuuauauagcguauccuguuuguaagauguuguuugcuugcuauuuuuucuuugauaguguauuuugaauuaaauuuauacauuuuuauuaguugaauaaaauguaauuauguugacauuauauguacauauauacagagagaguaugcacacgugugaacaugcacaguuagacuacccugucuugugcagcuuguguacugagcauccccugcccccagcaggugcagauauaugcuaccugggaaaagugaacaacagagacaggggaaaaaacugaguauguggugaaagaugaacuaaaacaagggcauuaagugaaaauguaaauacuaaucagugugacugcaagcaugcucacuucacucagcucccaaaaugguggcagacacacuuauuacaaaugcuguaucuuuuucaugcacccuuuccucaaccccguaggauauuggaaggauucccagaauauugugacgauuucucucuggagauaacugaucagcccaaaggaaauaaggccccaagugaaaugaucagggugaaucauaaucaccuuacucuguugcuaaguaguugccaggugcuguuugucuauacaguccuuauaguuugcauuuuagaaucuuaaauguaaauggacagccaagauuaccagacacugagaaaaaucucuaccaugaaagauuuuggaaacaaauaggaaaaagaacucgaaggauauagagacagugggggaacagagcaaagcaucuccuacauauauacauauacacacgaacagacacaagaccuuauccuuggaaagagaagauacuguauuuauggaacaagaauacucagaaauuaagaaggaauuuuugaguuuuuuucuuuuaaugaacacuccuagacaguggggaagaaaagacaaguugguggauaauaggacacaaggaaaacuuacagaaucaauccaggauguccaacuucuauuuaauagaugcucuaggaagugaauacuacagaaagaacauacaggaauaauuuaagcaaaauuucuggaacuaagaaguacgaguuucuggauugaaagccucgcugaauacccagcacaugaaugagaaagggcucacacaaaggcacauacauuaucguguaugugcacauacauacauauauacauacaucaucaucuuuagaauauugaggaugaaaagaggauccuagaagcugaaguugggagcagguagaagaguguggaauggguccuguacuaaguaucaagaaucugaauggucucagaaucucuaggagcaacaucagaaacuagaagaugacauagcacugccuucaaaacuuggagggaauguuaauuuucuucagcggaaauuguguguaacauguuaggguaaauaacaauuuugcaaaguucccagagauuuuuuuguuugauuuuguuucguuuugccucuucuucucucuuccucaagaagcugcuggaggauguguuccagcaaaguaagaaagaagaugacaaggauucccgggaaguuuguggacagaaauauaggaugacuggaaaacagucagucuccaaaaauaaagaaagaauaccugauuucuucaacuguguugaaaggaguguuaugguagugcaagagacuuuauagauuauuugugauagguccauagaaacccgguggaacaaacaaaaagugagaugaguaauaacaccuugauaaauaaagauggcauagccauuaaaguuguaguuuuuagauacuagagcaggagcaucauucauuuuaugaccccaucuccacccaugggaagcugaugaguuuuguguauugaauucgaagagcagagaaugggggaaaaggagauucccccauugaaaaccuagauaaugagagaggcggaaccaaaagcagacucagaacuucacugagaauaauggggguguaguagucaggugagagagacuggacuaccaaaucaucguugcuauccaguuauuccagaugaaagauacuacuuuacauuucuuagggcaucauuuuuaaguguuggcuuucagauuaaauacuaguugagaguggugggaagacccagaaggaauacuuaaacuauaauaaauauguacuuuguguauccauuauaaauaugucuaacaucccugauagcuuuacccuaagcuuucuuguuuaaugguuaauuuuagugucacaaauaaaguuuguguuaauauuauuggcucucugugucugggaaauuugauggcugugcauccccuagaguugcugcuacccaguagccacuagccacauuuggccauuuaaauuaaaauuaacuucagugcaacaaaauuaaaaacucaguuuuucauucaugcuagcuauauuucaggugcucauuagcaacacgugacuagugacuacggagcagugcagagacagaacauuuuuauuaucccagagaguccagagucuagcuugugcuuuacuggcagacagccuugagcuagaagagugaguugucaucacgugccuggcaugucaucuugcucuguucuguaggguuacauagaacagucuggauuuagaaaggcugagugagucuggugauucaguagcaccuuuuacaccuguugaugggaugcaggguagagggugguuaagaguauguaugggccguagaggcagagcagcucuuccagcugggggcuugcuggcugugugacuuugggcaagucacuuaccuuuucugaaccugcuuucgcaucuguaaagcagggaugaaauaaugacuuccuuggguuguuaggagaauuauauuagguaaaguaaguggaauagaaauaucaaauacuuagcauagugccaggcacauaguaguaagcauuugcucaguagcaguuucugaaauacuuauauuaauaauaaugguccugguuauucuuguugacgucaguuccucuuuuccugaugugugcuucuuuuuuuccuuuuuuaaauucuuugucugucuuugcuguauuucuauuucccuuuauuucuuucucuuaauguauuuuucuucugacuuaaggguccugcauaacccuguuaaugauauccacgaauaaagaauuuucuguccccuaauugcuguggugcagugagcaguggggaauaauuguuaucaaaaugaaacuaaacccuauaaggauucacagagucacaauacuuuugaccagcauucaugaagaagcccuuacuuauggguccgaggggcaguguggaaauaauuggccaguagauauggggcccaugaaccucaccucauuaguguccaccuggcacugacugaucagcacacuauaacaucaugagaaagauggcgggaagaucccugguaauuauacauuuuuacuuacguagcaacaaaggagagagcgggaagcuagaaggcagcaggaacgugaacagcgaaggagagaacaagaagaaaagaggcgucuagaggaguuggagagaaggcgcaaagaagaagaggagaggagacgggcagaagaagaaaagaggagaguugaaagagaacagguuaguucacagauaacauagcaggcauacacuugugaaguuuguuacuuugcagagcugggggauuuuuagaaaguauacacacaugugaugcauacacacauguacacacauacacauauacuuagaacuucagauguaugaacguggugaaacacaguuggaaugacaccaauaaauucagucucuugucuuaaaaaggguuuauaaaucauuacacuuuaggaaccuguugaaaccaguuaaguggucucuaaauaguauaauaccugaaagaugucugcauguaucuucucaggcuuggcuuaaaugcuguagaccccaaauauaugggugauaauuaacuuuuaaaaaaaaaaugaaauuaaaaaccaacaguaagaaauuucuuaggagaaauauuugaauauccaguggcuaagugaauacuguaauauauaucagcauguaauucuguauauacacagcacauuaaaaaaacuaacauugaugaguucaaccaaaaaagaucagguuuuaauaauauuugcagcauuuuauuaaugucagguaugauuuuauuuagaauuauuuuuuuguuuccugaaccaccuguacaaauacaauuugcccuuagccccuuugccuuucuugucuuugaauugaucucuuuguuaugagcuuggaauaaagaaaaaaaugauaugugaggaccaauuuaaauagcacuugguaucuguauuuuaaacuuauaaaccaugguguuaacuuucaaaugugacuguucagcugccguccuuuaugcuuaucaugugucuugggcuuucuaagcuugggucugcaugcuccucgguguuuucccaggaauuucagugacgcuuuuuauguuaccuaauugacguugucaaccauuuaacuguguagcgcgugugcuuuaacauuccacuuauguuuauaccuggggucugcaaagaggaaaacauucaagcuuuuaagaauuaaaucaccuagaaauaaugauuacaguucgaucaugagaggagggugugaugguagcaauucaucuuuaaugcucuaguggcagucauuaaauuuugugaauagcaaguauuuggcaccacuuuuaaaaaaaaaaauucuaaaaucgguuuuauucuguuuuucccuguucuauugugaaauaguaauucccauguuaacagugcuguaggacgcauuucauuucagcauaaguguguauguuuguguagaugcguguuguguauuguuuguucauugacuauguguuaggaccuuugugguuuggagaggacaugauuuuuccagcugucccuguguugagggcagaaaacaaaugaguguacugacuugaucuuucgaguuaagauuuaauucuguuuuguucaaaaaagaaaaugaguugaaagucagguuccuuugcuccgucacaguuggguuaaggccacaagccuugcuaggguagguauugcuguagcauguaccauggagggucagacauagacacaagagacguagaucccaggucagaaccagauauguuugucaguagccuucugacuaaguccgccccaccccucugcccacacccccccaguuggcuuuuuuggcucaguuuucuuuguaaaguaagguuuucuaaggauuuuuauaugcuguaauuucaauauucucccagagauauugguuaacuaaaacuucuguucagcccauauugauggcuauuuuuguuucaaggugugcaccaugacacaaggggauggucagcaguagacacucuuaaaagggaaucugaauuucaggauaaaaugucuccucguaguccuucuuagucuauuccucuucuagagcuuuuuucccuguccaaaaaaaggaagccucuuuggcuuguaaaauguuuuaugcuuuucaagguuauuucauaucaaucucaugucugaaccuuacaaaaauuccugaggguugggagaggagauuuuggaugcucauuucucaaaugaggagacugagaaaaggggagcuuuagagcaugcuagggaucauagagccaguccucaguggaacagggacugaggccuccugguaucccuguccuuuauaauacgcaugcagcuuugaaguaggguuuuaccccucucuauaacauauuugggauguguuuacuuguuuucauuguuauaaugacuaaucauucucuucucauugaaaagaaaaaccaccccauccucacuuccugcugucuuucucuccccuuguccuugucugucucugucugucacacacacacaagcucaucauggagccugggucuguucauuugaggagaguugcccaagucuggaauguagucauuccaggugccuuuggaauuguuagugaaagcaugaaucauguuuguuguauuuuauuauuaagcagguuuugguuuuagguuucaaaaauuggugaucugugcuuguuacaaauaaugacuaauaagcagauguuuacuaaucagaacccucugauacuuuuuaauuaaaaucuugauuucucugggguuuaccaaccuuaagaggaauggcauacuguuuuaaaauucuguauuuguuuacaacagcuguguucuaacagaaguacucuuagaucccuucguguauauuaugggaaugcauaucaucauuuguuagacuccuuaggucuuacuggccaauuugaaguucuuggagaaaucuuuagcaauagauuuucuucagguauuuaccacuaagugaauugucacuaaaggugauuggagcaaaugguucuuggugcuccauucaggugguucugaugcuuuucuuugggauaauuugauugcugggugauuucugugugacaggaguauaucaggcgacagcuagaagaggagcagcggcacuuggaaguccuucagcagcagcugcuccaggagcaggccauguuacugguaaagccccgccucuguuucauucuguagcaucagggcuccuucauccguccccaaaguugagcaagcugugguggucaccagaccauuuugguuuugcugugggcagccaggcugaaauagugaugcccauuuugugguccuauugcuagcacauugcaacauggucuuuauuuauuuauaucucuuuaauaaguuaauuguucuuguuugguagaccaacaagguuuugaacagaacuuggcacucagugaacacacuagaaugcugagggcaguagguugaaagcacaugucacaggauuuuuaccuaguaucuauaccacuaaaacucacauuuaauugaauuaucucuuacucuguccaaugauaauuaugguuagcaacagcugugagauuuuuccacagguaaugugcuauuuaaaaucccagccauuuugcuuucuuacaaaacacagagggaaaauauauggucacuuuuuuuaaaagccgaacaaauccagagaagaggcgagcucuccagugucccauagauuuaguguuauccucucccucuccaaggagugccgauggcgggagauggaggagcaccggcaggcagagaggcuccagaggcaguugcaacaagaacaagcauaucuccugucucuacagcaugaccauaggaggccgcacccgcagcacucgcagcagccgccaccaccgcagcaggaaaggagcaagccaagcuuccaugcucccgagcccaaagcccacuacgagccugcugaccgagcgcgagagguauccucuuuccuuugucacuuagacauugcccuggaaagucguauaacgacucuucagaacugugucauaugaguucuagaacgggccauagaguuuagcuaauuaucugguuucuucauuuucuaacuaggaaauugaauuucagaggaguggagggccuugcccaagguuucauauucagucagugcuuuuuccauaaaggaccagagugccucaguuaacauaucccagaagaacuugaaacugaacuaaacuaaaagauuacaugacacagucacucuuaaaaauguggaugagggaaagaguggucugaugaacuauucugccaagcuaguauaaagcuaaagugugccuguggcucaacuuucugacuuugcagaugucaagaugcccugcuagauuggugcauuaggguuacccagagccucagaguaggcugcggcagggacugcucgggggugcaagaugggcgacaggugugccuccagagguguugaaucccggcccacagguggcagcagccuucuauugugucugcccucacaggcaguagauucuagaaacaaguguucuguuuguucuggagugcuuuuauauuugguggagugaaaugcauuccggauuucugaugauaguuuuuuagucuguugguuuaguugcuugugacagauuaauuuuuuucuacuucaucaucauauacagucuuagaauucugagcaaggaggagagcuuagagacugccuugcuaauuuuuaucuucauaaauauuuucuuuuuccugaaucuaauccuagcacugcuuuauguaccuucuuuuuuccagcuaccccucucuuuucugguagcagaagaaaacagaaaacuuaccuuuagauuucuuccacuuuuagacuuucuuugauauuucugcuuuuccccuacuaacacugaguuaugucuucuaauucucugaugcagguggaagauagauuuaggaaaacuaaccacagcuccccugaagcccagucuaagcagacaggcagaguauuggagccaccagugccuucccgaucagagucuuuuuccaauggcaacuccgagucugugcaucccgcccugcagagaccagcggagccacagguagcgacagccagcuuugcugugguugaggagacucaugcaacggcucgcugagccgcaggccugcuguaauaucacaguuuaguuugucaccacacugaaaaagaggagagauuagcaggagugaguuuagacuaaaagaaggcauagacucaguugauagggaaauaucuuuuucuuucuuuuugagauuucuauguacucauuaagaguaucuagagugagugauuucuucuaacuuuuugccuucccuaacucagguguuaagugccuccuuuuucugauacaaagaucuuuuaguuuaguuuuuagagaacugggauuauaaauacauagagggagagccaggaauuuucuuugaaguauuuuaaaaguaagcgcuuuacugugugagcccuggcucuuggccaguccuaugaaugggccuuagaugaugccccugaaauugcaugcaaaaugucuuuauuugcucaaauguguauuuuuuguggggguggggggaaugaccuuuuaucagauucucacaggguucaagauccaaaaaaguuuagaucuaguggguuagguguggauuucucugaaauaggccagggaaaaggcugugaccucuccuugggucugcugcagcguucuagccuuggcuaggugaggggaacuguugggccgaugcuguguggcuggagcagaacccacagugcuguccauagaggagaacaagcaacgaagaucauggcuaaagaucuuagagauccuuaaaaugccgauuccuaaucucuugcugaaaacuacugacuuuuagauauuuucccgcuugccacucuguaauccagaauauuaggaacaaguucuuaaacucgaguuuacuuuucacugguguuugcaugugugggggacaaaaguuuauguucuuguggcaggaaacugugggaucugcagcauggaggaguuaaaaaaaaaaaaaaaagggcuggggcacaguggcacgugccugaaaucccagcacuuugggaggccgaggcaggcagaucaccugaggucaggaguucgagaccagccuggccaaccuggcaaaaccccauuucugcuaaaaauauaaaaaucagccgggugugguggcaggcaccuguaaucccagcuacucaggaggcugaggcaggagaauaacuugaacccaggaguggaguuugcagcuugcagugagcugagauagugcuacugcaugccagccugagugacagagugagacuccaucuuaaaaaaaaaaaaaaaaaaaaaaaaaaaaggaacagcuaggacugaggccagggcugugugagggugaguggguauuuccaugggaccagcaguuuuuugagucccaggagagcuagcagauggguagcuccagagaggagaggauagaaaggaaagaggaaagcaggagaggguaacuggacacaauuaaaagaggaugagaagagagacuacuagaauaggucugaggacucguguucuuuagcaacuuugcacugcuugaagauuaaaaguuuucacacugcaaguuaaacuucgcauaaauggacaaucuuuggccacuaauaguuuagaaaauaggaguuucugaauuaucuaauuuuugcauuuguuaugaauuuguguaguaacuagaaagagucucccauuuccuccuccuguucauucuuugggggagacuuuucucguguaggacucuauuuuaaaacucauuuuugauuauaauuucagguaauacuuugaauuacaugcuuuaucucugaaaaucuuaaacauuuuagaagucuaggauuauaccaauaucugguauuauacaaaucucaccuguauauuguagaaaucauacaauagaacuaauuucacaucuuguauuuggaaagguugaacaaauugauucaguauuuucaguuuaugucaaguacauugauguaauagauauguagcuaucauuuuuucaguugccauauugaacaaucauuuuagaacaguaaaacauaauuuaaugaaaauauuuuauggauuuuuucagagaucauuuucccaauuuagaagcaaccagauaaacucaguugacaaguaauugucauauuuuuguaauuucccaaguggaaggaauaccccaacaauagucaauucagggaauccaugguacugaauauuuuuaaagaaaucacaauucuuuauuuucaucacuaauaugaaaguauauggagauaccuggguuauggguguuuguagacuugggaaaaauaagaaaaauuguugguauauuugaaaaauuagcuguucuugagauauuauagucucaaaacgugggguuugucuuugcucguugaacgugccauuuuguuacucgcucugguguaaaaugugacacugcagguaaugugaggauggcuagguagguuugcacauuuggcagugcgcuuuaucuuacaauuuuucugccucucucugccuuuccagucucugcuuugacauggaugugcaugcaacacaucauaaccccuuugggcucugagagccucuuuguggggaaaaaaaaaauaaaaaucuucacauuaacugcuaucuguaauguuugucuggauauuaaaaagaguuuuccuuguaaauguacauuuguucuuuucuacauacuguguucccagaccacuucuucacuuugaaguguaacuguuucacugcguggcugaccuaacacuguaccaccccgguguguauuccgccucugccaguuccugcuuuggauuugguauugaccagaaaagccaguuuuaugcagaacgcauugaauguuuuguguuuuguuuucuuguaagguacaguggucccaccuggcaucucucaagaacaauguuuccccugucucgcgaucccauuccuucagugacccuucucccaaauuugcacaccaccaucuucguucucaggacccauguccaccuucccgcagugaggugcucagucagagcucugacucuaagucagaggcgccugacccuacccaaaaggcuuggucuagaucagacagugacgaggugccuccaaggguaaggagcagaaagacagaugugugcugcuuuuuuccuuuuuguuauuuuuuuuuaaagauuauuuauuuuaauuauggguaugcaacuugaccaaauuuaaaggggcauugaaauuucaaagggacuuuuuacuggugaggauaaaguuccauaguuaggcaauucuguuuagccaguggucaguuagcguuuuauuuuuguuaacccuaaauaagguagcaaaaugauguaagaguaagucuacaaagaauaggcuucuuaaacaaauucauaaucuauuuuagcaguuuuuuauauguuuauacagaagcuaugcaguuuugcaauauuaaugucaaaauuuuuagaaaaaguccuauaagaaaaauuuuauuuucuuuuuaaauguaggggauuuuguuuuguuuuuguguuuacauaauagugaaauuaaacaaaggagcccaugucaauuuauuuuuccucauuuggaauuugcuuccucugaauauuuucuugcuuccugcuagucuuugcuuccugcugauccauuuauagaccauuguuugguuucuuugagcuuauuuuccugauucucacauuaucucagcaaaugcuuuguaugucccugcuaccaagcuucaguccaaacaucauuuaaauguuacaggagcauagaaagccuguuuguacuggcuucuuggaugcuugugacuaaauuuucucuccgauuguaucaguguaggaccagggaaggaguugggguggggaguggaggugauaggaaggacugcuuuuaaauauuaggacugcuuuaaaaauauauuuugguagggaaguauuuuuuuuccuuuucauguuuucaauaauuuaauugcuauauuuucuacuuaaagguuccugugagaacaacaucucgcuccccuguucugucccgucgagauuccccacugcagggcagugggcagcagaauagccaggcaggacagagaaacuccaccagguaaaagacaagugagcacugagaacaggccuucugugcagucuaccacagccuuacauugucuguuucauaaaaaugcucuuaaacacagacguucuggggcuaagagauuaucaguuauaaaaggaaaagcugccauaaaauccaucaacguggauggcaucaaguugauguguaguaaaaaguggguuugaauccggauguguauuauagcaacucugaaauuuaaacuacuuuucucuguaagaguaaauggagggagcagcaaggaagggggagaaguucuaagagaauugugaucggggggagcuuuucaucuaagggauguuguaaggccuguggcauaaaacagaaaucacaaacagguuacuaaagaagucacugguugacuucacagucugcaguaaacaagugaauucaccaaauacuauccuuuuuagguucuagagcugcucuguccaguacgauuagcuacagaagcuuccuuauauuuaaauuaaaguuuaaguuuaguuaaaaugaaauacaguggaaacuucauuccuuagugcacuggguauauucaugagcucuauagccacauauagcuaguggcuaugauauuauccagcucaaauauagaacauuuucaucauaacagaacgcuucauugaccagcacuaucauagggaagaaaagaugauuauguugaauguuuuauaucuugaucaucacugaaccucuaaaguuagccuucugcgcauggaaccuuggucugacuugaggugucagauggaugauagcccaaaagcugcacagaauccucagcacugcuaauggcagggggacugugguguucuucccugaccaagucugugucauuaauucuuaccuagcacaugugugcuuuggguccauccauggcaggaaauccaucccagcucaugcuuucuguaccguuuccaacagcccauacaaaggacuauucuuuguaagugucaguuuuugagaacaguaacaggcaggugagagcagcagccuagaaacagaauauaguuuuguguauaauuauacaaauacggaguguuuuccuaauauuaagaacugacuuguagcugugacagaaauggugcugcuucuacacugaacaguagcauuguaucucacaccugaugauuuuagaucuacuaaugguaggauaucauuuagcauacaaacuaaaaaucgauaaaaauccaugaacaaugucauuauaucuuuuggugaauuuaauguugagugcuguuuauagacuguuuuuugucucccuacacuuuaaagacauuggaugggcacaccaugcacauguugguaauuuggugcugcaucuagagaugacacauuagcuguucucucuucuucuuuucuaacagcaguauugagcccaggcuucugugggagagaguggagaagcuggugcccagaccuggcaguggcagcuccucaggguccagcaacucaggaucccagcccgggucucacccugggucucagaguggcuccggggaacgcuucagagugagauguaagcugccuuuccuuuccuuuuucccugcuaauguuuugagcugugauccauaucuuggaaguuugucuuaaucuguaguuugcguguagccacacgucacaaaacaauguuuuagcauagguugcuagugacaauaauagucauccugauuuuaaucauaaaggagcuaaauuuugagagcuuuauauauaccuagcacugugagcgcuuuacaauuuagugggauuaacuaacuuucccaagguaauuggcuaaugugugagcuaggauuugaacccauuucuuucggucugggcuccagagccuauacugucaucaauauugguuauuuuaauguacucauaauagaugagugaauauucccucuacuguauuauugacauaccaugacaagguauauauugugaacacgugucaaagugagugugaugauggaggguuuaaguaaagagucaggaaggcugcuggagcccuccuugggcccccucugcucuguaauucagaccugcagguggagagccuaccaugagugggcagacaggagugggcggggugggcagggcagcuucauaauacacauccauauguugauaugugucuguccaucuugucccuuuugaacccaacagcaucauccaagucugaaggcucuccaucucagcgccuggaaaaugcagugaaaaaaccugaagauaaaaaggaaguuuucagaccccucaagccugcuguaaggauugugcaggaucaguuuuacuuauuucagacuugaaugagaucuuucuauuaaaaauaugugguugagaggccugcagucuuuucugcgagggccccucacagauuugaggaauuauaaggaaugaccuaaaccccagacauacuuguucccuuccauugguaucgucugcuuucccuguauaaagucucaagugaguaaaaccuuuuuucuguuguuccagccauacacuugguguacagucagccuuacaaaauuaugcagaacaaaguauaguucuuauuuaaugaaauuuccuucuaaggaaacugaugcuuuaaaaaaaauacaaaagaaagaaaagccuuuuuaucucuuucuuggcauuaaccuuuacuuauucuucgugaguucagcauuuacaauacuggcuuuuagacuaaguuuuuaaaaaucaccuucuuaaacucacugguugccuaccuucugcuuuuugguaccuggggugauaguugugacugcuucucacccuucucuuuuaaucccucugauguuaccugaccauguaauugugcacgcuuuguggaauuuuaagccugucagaguuuucauuuccugcuugaacugauuucuguacuucucccucuccccuucuuucucccgcgcuuccuuguacugugcauuccucaucaacgauggcuucucggacuccacgaaacugcgcuguacugaagggcgaagugguaagcgccaucucugaaaaguuccacuucagagcagcacuccgaccgccugucagcucagcuuguauucgagcugcgguccugcuccuuccucaacuugacuucuuguucuuuucuagaauuuaaaaaccucaaacuuuacuccaguuuucuuaacauaacauuugcuguauuuauuguuauuaaauguagcuuuuuugaguaacuguuuaaaaagcuucagcuauaaccacgaaauacuaauagcaagacucagagcccaucacuguuauuucaguggcucaagcucaaagaaaagaaacauucucaacuaugaagaaaauagaaaaccaaguuggaacugcuagaaauuaaagacagaaagagcuacauagacugcguuuuuaaaaagugauuacuuuuacauaaaauuccccaaaaaagaugaauuuggaguuuuauaugaaaauguggaguauaaauaguaaucacucuugaaaauuauauuugguggauugauugagucuuagaguaucucaguguggaagaguaaagggaaacuaagccuuuugaacaaauuccacuauugauuucuuucugauguucccuuuuauacguggugucacagggugauguggguaaggcuugaaggagggcguuagggacgcccacagccuccugcccccagcacucagggucgcagugucucuucaugugucacagacuuguccaugaauguggcagguugugaacagucggugaagugagaugucaguggcauccuagugcucacuucacuccuuucauuuuaauguagguuugaaguuuuuuuuuuuucaguaugagguaaaauucuagaucaacaaauguauauacacagauccuugagcuuugguguaaagacacaugucuauaugacaaagucuucuuuaaaggggucaguccagaaagcaagccucuaguuaaauaagccugauuuaaagaguuuugggagggaaguuauguuucuacaacuuuuauuaauaaaauauuaaaccuaaaauguugauuuuaguaaaauauuaauauuuauuacuaaaauuucauaaauauccuauaacuaguaaauaaaaacauuaaauauuaaaccuuagcgcuuugaaguuuuuaauaauaaaaguugaaguaaaauaaaaaugugucucucaaaaccuuuuuuaugagucuaaagaagacuuugucauguagggagaucuccuuacaacaaaguccaagagucuguguauauacauuuguugaucuagaauuuuaccucauauuaaaaaacaacaguaauacuaucagcuuaacauaagcagaucuuuuuuuuauugucaugggauuugaacuguauaugacaucuuugacuuuuuuuuggugucuucuauuuuuuuuuuuuaaucucucucuugacuuuauuuggucuuuucuaucaaaagccauaggagcucacuuucucaugaaacuggguaacuauaaaagucuuacaaaacugacauuguggcaauuuaugguuaaagaacuucucaucuucuccugucccugcuccugcuugccuuacucucucuuuucuguccuuugcuuuaggaucugaccgcacuggccaaagagcuucgagcaguggaagauguacggccaccucacaaaguaacggacuacuccucauccagugaggagucggggacgacggaugaggaggacgacgauguggagcaggaaggggcugacgaguccaccucaggaccagaggacaccagagcagcgucaguccccggucucuuuuagagcggaugagaguauucucucagagccugcuuuccacugggaccuaguuguuccuagacuauuccgugaccccaugagcacuuacuauguaguucucguggauucagcagcaggucgccuuguguuuccccuucucuucguuggugugugcauaugucagugcuucccccagcaccccagcguguacuuuauuuuuuccuuuugauuugaggauauaugauccaggggaaauuucaguuugguauaacuacuuuaauuagccauaauuauucauucuaaguuuuugcucagaaacaaauggcacuggaaagaaauucuuuguuaaagggagaaagcuaagcaguugcuuuuuuggaggaggcuuuauaucgguagccucaucucauguuuugauuuugagaaggcgaaaagccuaaacaggaucuccuugacuccagagauuaaggccuuucacgucuggauuuuuucuccauaggucaucucugaauuugagcaauggugaaacggaaucugugaaaaccaugauuguccaugaugauguagaaagugagccggccaugaccccauccaaggagggcacucuaaucguccgccagguacccgugucuucucuguugucagaggcugagcuucuccuguggucauuaacccacuugcucauucacucacucaugcuguuucuccaucaucaucuguuuucauguuaacaagucccagagggucaagugucgagugucgggggcuagggaggcagguguguacugcaugcccagaagguagcgaguagucuccaccccacaucgcugcuccucugcaugucugcggcagcccucauucaagcaccgcgcugagucucacagucuaugucugagcgggagagaagccacagggaguccuuaaacaggcucacagagugaggaagcaggucuggagucuggcagagcagccaccauggcucugcagagcacgcugggcucugagugucugcagugccacagugggagcgggugaggcaggcaggacgagccucaucacaggcccagagacucggagagcagaaggguucgggagguuucucuucuauguuccaaaauguuaguuuucucacuuguugaauaauuaaaugugugccacccagauaugcucaguuuggaucacuaagcuuuauaacugucuguucauuucuuagcuuagacuuaauuaaagugauacgcuucucauuuaaauagaacagggcaccuauuuaguauuuuggacuuugcccuaaguguguuucaugcuauggcaaugcauucggauggaaaguaggaagaauguggaaaagaccaggauucagagaauccacagguacuuucuggagcuuugcaaagaaagauuuaaaaagaaaaaaaaaaggauacugguuuugguaacagaagcuagcgcaacagauaaaccagauuaaacacucacugcucgagccgugcagccaccagauuagguacuuugaauucuguuggcacaaguuaggcauuuggugaggaagugugagcaguucaggcuaauuucuuugguuuuuccuugguaauuuagcagaguuuauaagucacacagcaccuuaaagcaguuaucaauagggccauaggcaauuuuagcagcgcuugagcgagacaagugugccuguuuuuucuacagaguacaguugaccaaaagcgugccagccaucaugagagcaauggcuuugccggucgcauucaccucuugccagaucucuuacagcaaagccauuccuccuccacuuccuccaccuccuccuccccauccuccagccagccgacacccaccauguccccacagacaccccaggacaagcucacugcuaaugagguaugucucgcaccacagcuggcugcuuuccugggguuagaccagcacugccuaggaguuaguuugcaaaggagaccuuuccaacacccucaccccuucccuucccacccugcuuucucugucaccuacccuucuccccaaccccaaguaacauguuucagaucugcauauaaaccccuuaacccuagaucagcucccccaaacuugccaguucacuguuuacuguucuguagauaaguauaguugcauggcuuuaucuaguuuauuuuuuaaaaaucuaaauaaaaugauugcucuguccucagaccgguauuauguauuuggcaugaaauucuuauagucauuuguggaaucugccuuuuucauucuuuuuauccaauaaauaaaauauaggaagauucgguucagcaggcuuggccuuaucuggacaaacuuauuauccuguacaggaaucucuuucaaacagaacugauuuuuuuuuuuuuucuuguuugggggguggguuguuggcugauuacucuuacuuguuuucaccaacccuguuaaggaguuuguucuuugacauuuacaaucacucagagguuuagaagccaaauuauuuuugggaaaccuagaaaaaauuaggauguuaagcaagaaggacaaagguuugagcuuguuuuuaauuuaaaauuuugugugggaaaucugugugcuccuuugaaggcuugguuguggugcucggucuggguguuagcucagucugggugauucuuugcucuuugaacaggguuauacuccagguguagugacauagcccacuugagcacccguauugaauuaaacaagugauuugauuccacagaagauuugguuuaagugucuuuaucuaccaguugagggagguuagaaagaaucagaaaaauccucuccuccggaggagcaguggcaagucaacugcuuccuagacaggcuuggcaucggcuagacuggcuccugacucaugggacagggagggaagcugccaggggacagauguucaggugggaagcuuaggggagggcaugggcucuaggacauggugacccucagguguccauggaggggguccaaugguacaggacaaaagcacuugaucagacauguuccuuuuuucuccugagguauauaucccaccuacacucacauucuuccuuauauuuauauuuuaaacuuugcuccauuucgcucuaaugugcaguauuuuacuauaacccuuaacucacuaaaccggcaaauuuauuuuucuguuuguuuuguuuuuaauugucauuacauuuccacuuaacaauuuguuucacuuccuuuguguuuuuuugucuuaaguuacauuauuaaccaaaacacuagugcuccuaaaagaucaaaaagauacgccuucuuuugucauuugcaccuuucacuaaugaguccucauuugguauggguuuaauggugaugcaccuaaaacaacaguagccaaagcuucuguagcuuucuggcaagaggcucaauuuaaaauaacuacaauuauuaacaauugccaauauuccagcauagauuauuuggacucuuggguaggagaauaaauucagaaguuggugaauugagaucaagacauuucagaccuccuuuaggaguuucauuauaaguauuuacuuaauuuuuuuuuaaagcuaggcacaugaagucuagauuucauugguagcuugcagcacugcuuuguaagugagcaaugucucugguagagauacggcuccugcagugguuccagguaaagcugcccugaggggugcuaugccacguggaagcuccccgcagagcauuuuuugggggaaugaugcaaggcaaauagagcaaaguauugggaaauagugcaauauagaagugaauugaaauguguauuuuuaauguucauuuuuaaaaugccaguuguauuaauaacauugaaauuuacauugcagacucaguccgcuaguagcacacuccagaaacacaaaucuuccuccuccuuuacaccuuuuauagaccccagauuacuacagauuucuccaucuagcggaacaacagugacaucuguggguaaguacaguagcaacaagaaagcagcugacaaaugggacuuuaucuuugaguugcucuuuuggguggcuuagguguagcugguuguucacaggcacagaccucggguacagaaacuucccaucccaguuguaugccuuauuugcaaugagaugcagaguccauuuccuuuuuccauauacauugcuuacagauuucuucucuuugacaaaguguugguuauaccacaugaauauuuacuugaaguauacuggggaagggaggcaggcauaguguguguguguacagaaaauaauuucaaauauauuguguuucagugggauuuuccugugaugggaugagaccagaagccauaaggcaagauccuacccggaaaggcucaguggucaaugugaauccuaccaacacuaggccacagagugacaccccggagauucguaaauacaagaagagguuuaacucugagauucugugugcugccuuaugggguaggugucuagccacuacuccaacacuuucauuuuuguucugagugguggcuggucuucuagagaaguacugcauugaauaguuuguggauagacaggauggaagacuucuaugauguccaucuccuguuauaugcagagugguauauuagcagacugguguggcacauguauaugauugcacucauuuuaacugucaaauauuggcaugauuaaucuccauuuuauuuuuauuaaacaaauuuuuguaguaguuuuguuacguggauauauuguauaguggugaagucuggguuuuuaguguaaccaucagcccauuauacucaauaguguacauuguaccccugaacccugagguugacuguucucacuauaaaauucaaucauaucuagcaguggaaauguuggagaaguauauuuauaaaaacuuacugcaacaugcaacccaguguuuuucauuuuucaugcuuguaauuuccaaguacuuuacagugacuauucuuuugacuauuagcauucaguacuuuauaaaauuauacaacuguacaauuauacaacuuggaaauauaucauggagaaguagaagauagaguguaagugccacaauaccugcagcuuuuguguuuugaaaagagucuucagcuuuaucuuguuacucccucauucuuucucacuguaaaaucuugagguugauguuuauauguuaguuuuuagaaacacacauaauaggauuucuucacaaggcccauauuuuguguaguuauuaccagauucuugacauaggaguuuaaaaaaaucuacuugauacugaagauugaccaggaaaauaucaaaauauuguguaaaauagaaccuuugaaaugguaucugucuggcagcaguucuaucaauaaauaucugucuuuucuaccaauaauuucuaagcuguuuuagaucaacuugccuagauauaugcagggaaaccuaagcauaauauucaaauaaguuccaccuugacaaggauauagucagggcagaauggccaaccucaagaauaaaauuauaugaaaaugaaucacauauuacauauuuaaauauuuuucuuauacugauaaucuuuuuaguuguacagcauuuuuuuuuuuuuaaucucuaaggguuaagucacuaugcccacaagcauugcuuggguagauacuguccuccaaauguugggauaaucccaacucaaucaacucuauaaggaccaggcaugaacagagagagggcuguaggagcguuguucucucaaugccgucacaauuauuuauuucagauuaucuggaaauagggugugggugggugugggcauacauguaugugccaugauauucuuccgccucacucccucuacacaaauacuuuauuccuugucuuggugaguuuaugacugaggaaaucaguacacacagauaugugcccaauucccuaggaauguagggucaucugugcuacauguuacaaaggugauucugacagugaagguucuaggucaaggaacaagagcauuuggggaaauacaugaaugaucaagagggagaagugcuuuggccaaggggcaggcagucuuagaugccaguccaaggcuuuuggaacaauuucuacauggaauguguaguuuuugaagauagucaugacgugaguauuuuagcaagauuaggauugauuggauguacaucaugagaaaguggagagaagcuccuuuaacaaccuuaauuaaggucucuauccgucacuuaaaagguugccaaaggcugaacaauugugagagcagaggaaagggaaaggagggacagagaagggguuuucucuggcucuaguggccaguuuuagcuaguuuggcagagcagcuugggagcuguugauagaagcagccaagucgcgaggcuaguuucaguagagaucugcaguggguggaaagcaggaggcaaaguagcagcguggaauuaggaguuacugguucugaggcacacucaugcacaggugggugggugucaccagauggacagcaguggaaaugucuccacugaggaagcagagggcagguguggaaauaaggaaggaggcagcagaagaguguggagacugugacgguacaagguuagagaaguagggugagucaaauaucaaaucacaauauuuugauaguccuaagaaauggaaggacaagagaacugacuacaguuguuucuugaugaugguggaaagugaucuuuaagaaaagcuuaaaugugagugauggaagccgaaucauaagcuguuaaggauuugagggcugcauuuauauggcccauuccagagauuugccaaugaaagaugaggaagcacaaagagaucaugguaucagaugaagguuuguucaaaugugugauguggcuaauuagacauagaaucuguaaagauaggaaauaaucagcauauaacauucucgaggaacugaggaagaacuagaaacuaauggauuauuaaggaaauugaugggaugaggguuucuuguucuuucccuuauccuuucuuauguuuaaauaugucagcaucauugcuacauggugauguauugcaggauugguuacuuuaacuguuuaaccuuugacuauuuuaaggauuucugcuucugggugaauuaaggaagcuacacuuuuuuccaaauagaugauguuauccuuucuauacaaccuggggauuugccaagcacagcauaaaauugaggccuuucugugucccugaaacaggagugaauuugcuaguggguacagagaguggccugaugcugcuggacagaaguggccaagggaaggucuauccucuuaucaaccgaagacgauuucaacaaauggacguacuugagggcuugaaugucuuggugacaauaucuggugaguguuuguuuuguaaaccagaauaugugacaccaucuuaacaauauuguagcuuuacacacuaaacuucaguuagcucauucacugauguacuggcuaaauaagguacaaccacauugagacuugacaauaaugugagcugaagacguauucagaggugacacacacgcccauuugaucucuggcuccuccgaaagcagucuugagaagcguaugaaugugcucuuucucacuggcaucucucacugcccucucugcccaguugcuuguuagauuucauuugccuuguccaauauguaggucuguguccacuccuuuccaccagacuuuuuuuuuuuuuuuuuugagacggagucuugcugugucgccaggcuggagugcaguggcgcgaucuuggcucacugcgagcuccgccucccagguucaagcaauucuccugccucagccucccgaguagcugggacuacaggcaagugccaccaagcccagcuaauuuuuguacuugcaaaaggaaguauucuuugccauuauuguaaaaguauuguauuaugguuuuuauuaugugaauuaacacaauuaugucucuuuuuuacuuauuuauuuauuuauuuauuuuuugagacggagucucacucugucacccaggcuggagugcaauggcacaaucuccgcucacugcaagcuccgucucccagguucacaccauucuccugccucagccucccgaguagcugggacuacaggcacuucccaccaugcccggcugauuuuuuguauuuuuaguagagacaggguuucaccauguuagccaggauggucuugaucuccugaccucaugauccacccaccuuggccucccagagugcugggauuauaggcaugagccacugcgcccggccaauuaugucucuuuuuaagaagagcauuuuucuuaguauaaauuguguaauauaaacuaguacaggaaaacaacuacaagaaauaaaaaguagaaucauccagagaucauaucuuuuaacuuuuauaaguuuuuaaauuccaguuuuuuaagcauacaccacacucacuguauacuuaagggaaaaaaucugcauaaaaaugguuauacaauauuucaaacauaggauaauggcacccaaguacuaacuauaacuagccaguuugaacaguuguugcaguacacuguuguacauacagucagcaucccuguuccucccauaucuaccuguccauggcaaccucuuuccugaaguuaggguguaugccauccaggccugauuguccaaaacacguagucugcuuucuccaugccauugaacauccuuccauggccuccauuuuauauggcuagaggauguuuccuugcauagauguauuaaaauguauuuaguuaucuucucuugcugcccuuuagguguauucccuuuuuucucucaugugaacauuuuucacagauauccuuguagcuuacuuaaccuucaggcacauaccauguugcauagaucauaauuuccuaauaauuaguguuauuccuuggucagauggcaugcaaaauuauaagacuuuaaaugagucuuauauaccacuacuuacagucacuuaugauauuauaaucacuuaugauaccaccagugauuuuuauuuaauuaucugcuuguuaguacaagcuuguuauguaacauauuugcuugaaguuauuuuacuucuaauauaugcuuugguuguuaaguaaaggaguuucuugaaaugcaaaaauuucacuauuuauacuuaaaugaggaaacagccauuuaaaacuagagugcugauggaugguaguuuuuuaaguuggagaaaacaaaucugcauuuagugauccagugaaacaagacaguucauggggaucaauacucagcugagaccaggugcgguggcguaugccuguaaucccagcaaucugagaggccaaggcaggaggauugcuuuugccugggauaucgaggcugcagugagcugugauagcaccacugcacuccagccugggugacagagugagagccugucuccaaaaaaaaaaaaaaaaaaaaaaaauuaauaauuauaaucagcugauaccaguaaucauuuuuuggucuacuuuucuguuuuuuuuuuuuuuccuuccuuauuaacuuucagugguuuucacaaucauaaauguaguacaugucaauuguaggaagcuucaaaaauagaagaaacuuaggaagaauaaaacaaaaugucacccccaucucagagauaacucuuguuaacauuuuauauuucccucuccuuuucucuguaaguauaucucacaagauggaaacaaaacauuauauauaaaacuguguggucuuuuucuucucuuaacauauauugaauauuuuccugcaaacaauuccccaaaaguuaaaaggauuauacugaaguaugauauacagagaaaguacagauaagcauacagcucaaugagcugucacaugcagaauccauccagauagccccacccuggugaagacauggaacauugccagcaccccaaaacugcccugugaagccacccugggacugcccccagaggcaagcacuguccagacuuugaacauguuagguugauuuugccuucauugaacugauuuuauauaaugguaaaacaguauguguucuagugucagcugcugcuuuuuuuuuuuuuuuuuuaaguagacuuuuucuaaacguuuuuucaguauuuugcaguuuagccauucugaagggguguaggaauuaauagguguaucucauuuuaauuugcaauuuccuaaugauguaugguacaucuuuucuuauguuuguauaucuucuggugaaguauuucuucuaucuuuaauccauuuuguaauuggauuguugcuugcuuauuguugaguuuuaagaguucuucguguauuuuggaucuaaguuucugaugagauauguguuuugcggauauuuucugccaguuuguggcuuguuuguucaugcuguggaaugaugucuuuugcagaagagaaguuuuuauuuuagugaaguccaacuuacuaguuuuuucuuucaugaauugugcuucugguauuguaucuaaaaagucauugccaaauccagagucacuuggauuuucuucuguuaccuucuagaaucugcuuuacagcuuuguguuucacauuuagguccacaauccauuuugaauugauauuugugaaaguuucaaaguuuguguagauuuauuuucuuuugccuauggauaucuaguuguugcagcagcauucauuaaaaagacuaaccuuucuccauugaauugcuugugcuccuuuguagauuacugcuauauuuguauaguucuauuuuuuuuuuuuuuugacacggagucucaaucugucauccaggcuggagugcaguggugagaucucagcucacuacaaccucugccuuccggguucaagcaauucuccugccucagccucccgaguagcugggauuauaggcaugugccaccaugccuggcugauuuuucuauuuuuaguggagacaggguuucaccauguuggucaggcugaucucaagcuccugaccucaugauccgcccaucucugccccauaaaguacugggauuacaggcgugagccaccgcgccugguguauaguucuauuucugggcucuauuuuuucccauuuaucuauuugucucuuuuugugcuaauaaccacacuguuuugauuacuguagauuuauaguaaaucuugaagucagguacugucagucuuucaacuuuguucuuuuuuaauguuauguggacuguguugggucuuuugccucuagagucagcuuauugauauguacaaaauaacuugggauuuugauuagaauugcauugacucuguggaucaaguuggaaaguacugaugucuugacaguauugacuguucuguccauuaacauggaaaucucucuccauuuauuuaguucuucuuugauuucaucagaauuuguaguuuuccuuaaguaaaacuagcaaagggcuaauuuuauuagauuuauuauacccauuuuguuuuuuuaaguacuaguauaaaugguguuguagucuuaauuucaaauucuaaugauuuguugcugguauacaggaaauacaggaaagugacucacuuuuauuuuauuaggcuuguauccugcaaccuugcuauaauucuugcuauaauugcuuauuaguuccagcaggguuuuugguugguugguugguuuuggauuuuuuuugguugauucuucaggauuuucuaccuagacagucaugucuucugugaagaaagacaguuuuauuucuuccuccccaguccuuguaccuuuuauuucccuuuuuugucuaauugcauuagcuaggacacccaauauaacauuuacuaggaguuaugagaagggaaauccuucacuuguucucuaucuuaugaggaaagcaucuaguuucuugccauuauguaugacguuagcuguaagguuuuaugguagauguuucuugucaaauugaggcaguucccccucuauuccuauuucccugaaaguuuuuauuauaaguagguauuggguuuugucaaauguuuuucugcaucuguugauaugaucauaugauuuuucuucuuagcuuguugauguguguggcugacguugccccccaucauuuuuguuguuguugcuuguagcuguagucucuuuguuccuuuagaugacuacaccacaauguauuuacucauuuuacuauccauucagacauuauuguuuccuguuuggagcuauuaggaaccaugcugcuaugaacauuccuguuguuguacuugggggcauacauauacauuuauauuaggagagagauuaccagaccauauguaagauaugcacauauccuacuuuaauagauagugccaaacuuacaaaaacaguucuaacaguuuacaacacuaguuucugaaguuucuaguuguuccacaucuugccuaccuuugauauugucagucuuuugaauucuagacauacugauagguguaugaaaucaucuuauuacuguuuuaacacacguuauuacuggugagaaugagcaucuuuuugugugucugugagaucacuucuuuuccaaaguuccaguuauaguggcacguccaguuuuucuauuguuaucuccuguucuauuugauuuauaggaguuuuuuuacauauucuggauuaugacucccuugucagcuguuucugugguacacaucuccaacuugugacuugccuuucacuagguuuaagugcuggccuuaagugauugauuucuuuugguuacuauuguuauuaaugaugagaccuacuucuggauaugcauguaaaauauuuauauuuauuuugcuaggcaaaaaggauaaguuacgugucuacuauuuguccugguuaagaaauaaaauacuucacaaugauccagaaguugagaagaagcagggauggacaaccguaggggauuuggaaggauguguacauuauaaaguugguaaguucuagaagcgucauauuuuguuuuuccagaguuugauuagaguuugaauuuuaaacuuuaaauuuucacagguuuuuugaaguuuguaauaauaaacuuguuucugaaacacguggaucauuucugguguucuuucuguuuccaaggcacauucuaaucuugaagucucaucuagacauugucuuacucccucugugcaccuauaugcauaacagaguucgucccugcaacucacuccgcccucagucucccccacgcugugcaucuugugagagucuuuccacuccuccucuuugacaguccacauucuucuccucuguaagaugugguucacaguaaccucuuuaaggaaaucuugucaguggaagccagcugacuugaguccuuuuuuacaugccaggcuuauucuccacuuagaggucuggagguccuuggcaggcacugauaagaguguuugagaguuugacucaagggcuuauggccugccauuuugaauuaagugccugugcacagcuacuaugcuccuuacuaguaagugagcccagcuggccagucaguguuuuauggcaauuguauuguuuuuucuccuuggcaugaagcagugauucucaugaaguaaaaucucacaggaacaaaaccaaaacucuuuuuuuuuuugagauggaguuuugcucuuguuacccaggcuggagcgcaauggugcgaucucagcucacugcaaccuccaccucccggguucaagcaauucuccugccucagccuccugaauaguugggauuacaggcaccuugccaccacgcccagcuaaucaaaacaauuuuuuuuuaaacaugaaaaaaccaaaauacuggcacuaauguuagacauacgggagaaauaauggaccuuagccaaauuaaaguuuuauaggaaagauguuauagucuaacagaauuuaaacaggaaguuuuucuauauaccuaaaacugauuaauguuacgggccuauugaauguuuguuucugcuuguguguuuucuuuuuucuauguuuaugaaaauauauacaucaucaguuccucuguuccgagggauguugucaugcuuggcauugucuuguugguguaguuugucugcaccccucagcucguggguuaauggugauugugggagcugccucaguaucucugacaguucuaaugauacgggaaaguagaacuaucugcuuaggauagauuuuaggauuaggguuuucuguguuuaugugaaguauuuuuauguguugagguauaacuaaaaucaucuaaggcuaaauguaaugaaacagcucauaacagaugaaauguacaugaauagauuauccugcagggggagcaagaggcagacggguuaaaagucuguugggcuuuuccccagaacaaaacaguaggccuucaggccugucacucauacagaaugaaucacaaguauuuucaggagauaaguguggguaauaucauucauucguugucauuaugguugccaccaagaauagggagcuauuuaaauguauauuaaauuaauaaaaauuaaggaaaccuuaaaauuuagcuccucaauggcacuaguacauucuaagugugcaauagccccauguguguggugguuauauuagcaauacagauacggagaguuucuaucaucgcagaagucuaugaaacaguaccgguuuugucagacuguuauaaaccuuugugucuuaauguucguuuauugauuuauuuaaacagugguaauauauagaguuuaacaaggggaguuaucaguuaacaaguuccugcucaugcacaaagaagaaaucaaguagcggugugauguuagcuuguaaagaaaucauggaucugcauuaguaagucacagguacucaaggaccccugggaguacuuguuuuggcagaguugccuggcaguaagggcaccaaaauagcuaugggaaggaggcaguuuuacuacuucuguagaucaggaaauggucuuagugauacuuggacuuguucacagauacuucuguugguagaauucaggacucaugaauauuuuaguauaagccuuuuuucuuccucagucugugugagccccaugcaggacuagggaaaguuguaaggaggaccucggucucuguguguuucaggagucucuuggcugauuaaucauguuguuacucauuuggaguaauacuaagcccuugaagacuucagggugguauaccuggcauuguccuugauuuuaaaauaucuuggaaucuauuauaagaagauuaggaucauuagcgaaaguacucauugauggucaaaauacauuaaagagcuggaaaaggaaacugugaggugugaucucucucucugaauuuuuccccugcuuguuuggaugaaugaauagaaggcauauuuauaaaguuugcagaagacaacuaaaacaguuuagagggcuauguugauacugaccugugcuucucuugcuuuuuuauuugcugcuuuucaguaaaauaugaaagaaucaaauuucuggugauugcuuugaagaguucuguggaagucuaugcgugggcaccaaagccauaucacaaauuuauggccuuuaagguaacaacaucaagugaauuuaaaaguaguauuggccauucaagcugcaaccaagagucagggaauauguuuaaaaagucugaauguuaaaauugcuaauauaaaagcuaugugcuaauauagcauauaacuuuaucauaaaccauuucuaauguaauaagcuuaguuaagcugcuuucuaagcccacagugagaaggagagagagauaaauguuggguagacacuuuaaucgauguggcaauguguucacagaggaaaagagaacaguacuuccacccuucaguuaaaaaggugaccuucaccugagucauggaagcguguaaagauuuagauguguuuuugauaacaaaacugugucuaucgggcaguuuuaagauauaucuguucauaaaauacuaauuaaaaauuaaauuacagaaauucugaugacaacauuauauacuaagugaaaaaaguuaaaauauuucauaugauuccauuuuuguuucaauaaaaaacucagcuauaacaucugaacuaauguacaaauuaagauguuuuugccauuuugcauguauacaguuuuaggaaaguaaaugauggaguacuuagucuuaaaauuaggacuguuuucauuugugaguucacaaaaauacucaugaaauuuacaaauauaccucacauugccuggugauuggcuuuuuagaauaguuuuuuuauauuuuauugaagggguagguuucauuuauuugcaaaauuuguguuuuuggauugcuuacugcuugauuucccagugaagcaggauagauggagucacaauauucgcuuaaaaaauaauauucacuuaaaaaauaaauccaaguguuacugaauaaagagaauugguuauacaguuauauuaucuucugagaucuggccuuaauauccuuuauauaccagguaccguacuaguugguuuuauacauauuaccuuauuuaaagcugcuguuucauuaucguagucucgugaacuguggguagugaugucagugaaaaauggagaccaccagcacaauccaggcuguuguagcacauacagccuuuucaccauuuuagucuagucagaaaauuagagaccuuaugcuacuaguaugauaauagugauacaauuuucagugugugacuccuacaacuccucucgcucuacugugcauuugaauaguugaguagcauuuuuaggaaaguccucacuauuuuacuuugcaugauuuucugaucaaggcagccaaaagcacaguaaaugacagagcagaaaucuugaucuggaaagggagauuuggaacauaucuucuggaagaagugucuucuagaugcuaauuaacaggcaaaaacguaauaaagacuaauuuuguagaguauuguugccuuacgguuguugccaguguggcucaguaauugcauaacugaguauguugggucuucucuaguuugaucuauuagaaguaaguucuccggccgggcgugguggcucacgccuguaauuccagcacuuugggaggucgaggucaggagaucaagaccauccuggcuaacauggugaaaccccgucucuacuaaaaauacaaaaaauuagcugagugugguggcgggcaccuguagucccagcuacucgggaggcugaggcaggagaauggugcgaaccugggaggcggagcuugcagugagccgagauggcgccacugcacuccagccugggugacagagcgagacuccgucucaaaaaaaaaaaaaaaaaaaauguucuccuucaucuucucacuucucuuauggcuucuuugcagucauuuggagaauugguacauaagccauuacugguggaucucacuguugaggaaggccagagguugaaagugaucuauggauccugugcuggauuccaugcuguugauguggauucaggaucagucuaugacauuuaucuaccaacacauguaagaaagaacccacacucuaugguugguugacuggcuucauuuuguuuugacuuucuucuuuacucugcuuagugaacuaacacaagcagggauucauuuccccuuggugugggggugaguauuuaaaugauacgcaauuuucaauagcuccaugcucuuagacaaguggaaauccgccuuccuggcucuguggagcccuugugaaaaccucuuagcucuugcuuugacuaacaugggauggauuuggggcaguugcugccaggccagaauaucccuggguugggagugguucucaauuggagcccagcauccaauguuucaugggccucaggagauaugagucaguagaguauauuacugggaaaaagcagaguuggggauauauauugcaugacuauucuaaaauguuaaucuaauugcuguauuuaucuucagagauaugguaccagugcauucacuaagagucuuacugagcacuugcacagggcuggaaauaaccacagacguucuucccuguacuuuguuccuguucucuagauccaguguagcaucaaaccccaugcaaucaucauccuccccaauacagauggaauggagcuucuggugugcuaugaagaugaggggguuuauguaaacacauauggaaggaucaccaaggauguaguucuacaguggggagagaugccuacaucaguagguauggagaacuuggggaaaggcagcauuugugaaaauggagccgugucugagacuccauuuauuuaucaugcugauuuuguauguccuucagaccuuuugacuaccauugaacagaguaguuggcaguagaugguggaaaguuagauuguaggccguggaaauagucauaggucuauuuuagaacaaaauccaaguaauuauuuucuacuuuaaaaacucuauuaucauaaucucucauuuaauccuuaaaacauccagaggaauaucggacauguuuuuguugaccacuuuguaaagggagacagagaauugguaaagagacagagaauugguaacgaauugguaaagggagacagaaagggaaguuauuugcacagaaugcuagagccauaacuacaaacagccuugugcauacuuuucuaguuugcauucaguaauaaagaccgauauuugacauuuucauggguuucuauuccaaaacuauuuugguuuuauuguaauuaggucacugucucugaucacucaugauuucucuucccugccgucucucaugacuggauugauaaaaaucugugcacuaaacucuaaacucaguggguaauuuuucuagauaggcgugaaaggccuaaggaaaaugaaauagaucaaccacugaugcaaguaacuacuucacaggauaggcaaggugguuacaaaggcagaguuccuugaaaacaaauccuuaaaugcuaggcauuuaaauuuuaaauuuuaaaaagauuuagaaguauaaaaauauauuuuuauuaaguaagcaacaucuuuucagggcuguuuccucaucuuuaacgguuugcaauuuuucccuccccaaaagcauauauucgauccaaucagacaaugggcuggggagagaaggccauagagauccgaucuguggaaacuggucacuuggaugguguguucaugcacaaaagggcucaaagacuaaaauucuugugugaacgcaaugacaagguaauaguucccuuauggauucuuuuuaguugcucuaucuuuuaauaauggcuuguuuuccauggaguuugaugauuaauuuccuuggaguuuugauaaaaauaaucaaggaacuuuuuaaacguugcuuuuuagucauguuugugaggauuggggaauguuuugcuuuuugcuaugaggggauagagauauuuuucucuguagaaauuaacauauuuggguuuugcuuuguauauguauuuuuaacucuauuagaugaccagucuaggcuauaauuagagauagggaagauaaaagcugccaguucaguuggcuggaauucuuuugugaguggaaggaaccgccgugccauuuggguacaucaaaagguuccucugaccuaaugugugucaagaagaugccccuuguuagucugugaguggugaaauugcuuccuagguuugcaugacagaaauguugcacaguaaaaaucaucuuaugcagacauaacauaccuccugcaccagagaccccauggcaugacacccccuuugcuuuucaaaacuggccauaucacuccagggacgauuccuguggcaccuuccucccaggaagucccuuuuaaacuggcuuuggaguugagcagauagauggccaggggcguugacccaucccuguuugccaagggagaaggcaucgaggguggaacugauuuuuacuaagccuacccuuucuuucuucugcccagucagacaaaggcaugucugacuaccuaaggcaagacaccacgaccuuugaaacuuggcccugaagaacguuuccaccuuuugcgucacauugacagacuagcagucagcccaguucucagauuuaaacauuuagucauuuaaugcaagaaagaagaagcuacacauauguccuuggcagcugguccugcuugcccgauacaucccaaacacaaagucacuucaccucuacccacugucuucugcaacccuacaacucaguuucaaguggaguuuugccuacagauuaucucccaaaucugugaccuugaaaaucucuacagcucagaccuaauccaggauuuugucagcuuguuggcuuauacuuuccuaaguauguuuaccauagcugcaacuauagcauucuuugaauuucaggcauuuaaauauuuuuaucaugcaugucauguccuuuaagauuuauuaauaaauggcacaaaaauucuauuuauggguuauaugaaguaauuaauacauuuuuuguugauuuuuaaaaagaaauuagguuguuaaggagucuuccgugaugcucauuguguuuuuuaaagacauuuauuuauuagaagguguuaacaguagaaguggaaagaaauaacuucagaaacauccauuuuuuuccuuuguugucucacaauaugccaacguguaaggaguuaguaguaacaagccugaguuguaauaaaaauuggcugcagauggucacuccuuacaaauuauaaauugauaauugccccagagguuuuuguggguuguuuuuguuuguuuguuuguuuuggugacggagucuugcucugucgcccaggauggagugcaguggcgugaucucggcucacugcaaccugaaccuccugggugcaagcaauucucuuccucagccuccugaguagcugggauuacaggagcccaccaccaugcccagcuaauuuuuuguguuuuuaguagagaugcgguuucacuaucuuggccaggcuggucuugaacuccugaccucaugguccgccuacgucggccucccaaagugcugggauuacaggcaugagccaccaugcccagccuuuuuauuuauuuauuuauuuuuugagacagagucuugcucuguugcccaggcuggaaugcaguggugugaccuuggcucacugcagccuccaccucccggguucaagugauucucaugccucagccuccugaguagcugggauuacaggugugugccaccacaugguauuuuuaguagagauggguuuugucauguuggccagacuggucuggaacuccuggccucccaaagugcugggauuacaggugugagccacugcaccuggccucagaguuucuuuugaaaaggcucuuugggagucuaagcuucucguacuugacaguguugaggaugaugguggcuuagauucccuggcuggaagugcuucaugaccaugguaaccauucccucucuuuucuugcuuuugcagguguucuuugccucuguucggucugguggcagcagucagguuuauuucaugaccuuaggcaggacuucucuucugagcugguagaagcagugugauccagggauuacuggccuccagagucuucaagauccugagaacuuggaauuccuuguaacuggagcucggagcugcaccgagggcaaccaggacagcugugugugcagaccucauguguuggguucucuccccuccuuccuguuccucuuauauaccaguuuauccccauucuuuuuuuuuuucuuacuccaaaauaaaucaaggcugcaaugcagcuggugcuguucagauucuaccaucaggugcuauaaguguuugggauugagcaucauacuggaaagcaaacaccuuuccuccagcuccagaauuccuugucucugaaugacucugucuugugggugucugacaguggcgacgaugaacaugccguugguuuuauuggcagugggcacaaggaggugagaaguggugguaaaaggagcggagugcugaagcagagagcagauuuaauauaguaacauuaacaguguauuuaauugacauuucuuuuuuguaaugugacgauauguggacaaagaagaagaugcagguuuaagaaguuaauauuuauaaaaugugaaagacacaguuacuaggauaacuuuuuuguggguggggcuugggagauggggugggguggguuaaggggucccauuuuguuucuuuggauuugggguggggguccuggccaagaacucagucauuuuucuguguaccagguugccuaaaucaugugcagaugguucuaaaaaaaaaaaaaaaaaaaaaaaaaaaaggaaaaaaaaaaagaaaaagaaaacgugugcauuuuguauaauggccagaacuuugucgugugacaguauuagcacugccucaguuaaagguuuaauuuuuguuuaaaccuagacgugcaacaaaaguuuuaccacagucugcacuugcagaagaaagaaaaaaauucaaaccacauguuuauuuuuuuuuugccuaccucauuguucuuaaugcauugagaggugauuuaguuuauauguuuuuggaagaaaccauuaauguuuaauuuaaucuuaauaccaaaacgaccagauugaaguuugacuuuuauugucacaaaucagcaggcacaagaacuguccaugaagaugggaaauagccuuaaggcugaugcaguuuacuuacaaguuuagaaaccagaaugcuuuguuuuuaccagauucaccauuagagguugauggggcaacugcagcccaugacacaagaucucauuguucucgauguagagggguugguagcagacaggugguuacauuagaauagucacacaaacuguucaguguugcaggaaccuuuucuugggggugggggaguuucccuuuucuaaaaaugcaaugcacuaaaacuauuuuaagaauguaguuaauucugcuuauucauaaagugggcaucuucuguguuuuagguguaauaucgaaguccuggcuuuucucguuuucucacuugcucucuuguucucuguuuuuuuaaaccaauuuuacuuuaugaauauauucaugacauuuguaauaaaugucuugagaaagaauuuguuucau

SEQ ID NO: 12690 - RNA, 3314 nt, Homo sapiens
auucauagauccauauuauagaacauauaaguguucuauaaauauuuacuuuauaaaauacacaauauaaauguugcgugcuuaacauauaaacacacaauucuaaauacauacagaugcauacacacguauacaucuucaaggcugccaggaauucuaagguuuuuaucucagugacagcauauggagcuggagguuggaacuggguuccugucuucacucuaccauuaacuaacuaugugaucuuaggcaaacacauagucauuugcucaaucucugagucacaguuucuucaccucuaaaauacagagguugggcuggugagaccucccaggucucuugcaggucuaaaacccuggaacucuaagucaaucuggauuugagcuuaggccuccucaguccuagauacagcuucaguuucuaaagcaucgagucauagcagacaaccacugaacucagucaacucucuugccgaaguccccauggccaccaacggcagagccacaacucgggacuucugaggucuccugggaacuggacuuccagcucugcugggcuaccugcuggauaaaguuaauuaguaacuggaagcucuggcauuagagcagcgguugguuguuaacagacauacacccuuaaaacaaauuuugcuuucugucuuauaaucugagugugggaaacaccuaaaauauuugaguaaucagucauccagaaaaccugcccaucuaaaauaagacaaagacagaagaaacaaggacaggaagaucugaguaggggaaagacagccaaucagauccugguacaaaggcauguagcauauuucacucacagaagcagcuuuaaagucuuccuucagaagcucuuucuguugauuuguaugagcgucacuaguuuuuaagaguagcagaauguauuuuccagaggugaccacaacaguaucucccaucccacauggucuucuagaaugugacugugccacucugccaccaagagguggagucuaacucaccucccuugaaugugggcuggccuguaacuugguguaaccaauacaaugcagcagaagugaugcugugugaacucuugagcuagaucagaaaaauccaugcagccuccaccugguuuccaaggggugcuugcuucugccuggcuuccuuggaaagucagccaccacgaagacaguccaacugcccugagaccaccuugcuagggaggccacauguagggcauugguugacaauccuagcuaugcucagccucccaggaacccugcaaaggcaccagccauguaagugaagccaucguggacccuccagaugaguccauucaccagcugagcaccacuguuugaacucaaucagacacauggagcagaagaaucaccuaguugagcccucaaauucgugacauacagaaacuaggaguuaucauaaaauaguugucauuuuuaagccacuaaguuuugggauaguuuuucaugcaacaacaggugaacagaaugcucaaucaaaagcagauuccagauggcaaauuggaaagagggagaaggcuaggagaagaaaacacacacugaaaaaagcggcagcugauugcccaguaacagaggagacaggaaaaccauuaaggcaggugcgagaaccaaagcacacagccauuucgggauuuuaagcgcagacaccagcagucccuuccauguuacugugcccuacugaguauaucaggacauuaaagcacaaaacaauugaugcuccuaaugauuuccuugaaucacaaagaacaguuuaaauuuuguucaaacuccucuuucucuaggaugggacaguacaugcaacacagacgcaaugaagguaauauugcaauuaccucccaauguguuuuccuccuugauauucuggauucuucugccacuacagccccaggaaagggagagagcaaaggccuccucagaaagaggaaaggaagugaauaugaugcaggggaaguuccuuccugguaggaagugucaguagaagaaaaagacccuuugggcuccagggcuaaaggagggaagguacaagaggaaucaggcaggcaguccugcuucuuauucuggguuugaaaccugaaggcaaagggacaagagguaaaagagagagggcuggaugcagaagaauuuuugcucugcuuccaaguugcaucucuggaggaaucccaccuuggugaaguaaggggcacuaaagaagaauggaaauaaugguguggcuguuagguaaaggggugcuucacugaugggagagauucagaccuuccccugcacucccaggagagaauggaagguaaacugagaucugggcugagauggggcugccaugaugaaagacaagaugaccuguagccacagcuucaggauauucagugaguaaggagcagugaggccaagugggggaagacugccccaccucuugguagauaaccacuuccccaaggcccugagcucuccaccuucugcucccuuggcuuuccuggugcuccucggagcucuucaggugcagcaacaggugcuguagcaucuuuucugaugggcugguacucaugcccugcugguugcuaaacauuuugaguaucaccuggacagucuaagccacagaagaaacaaggucauggccaagaugcagagaaccuguggagccagggagaggcacagcggggugaccucggauggagcacuggcucugacaacugaggcaccagaccucggguuuucccagucacagacgccagcaguagauuccacaggacaccucaugaccaggaagguccagggacaucuccacagaagccagugccuaccccaggucagcacguguggaucagcugcccaccacucccuggggacacaaugucccccucuucucaggcuucuuccuggcuagaagaaggugcuggugagaaacuggaagagugaacaucuccccaaaagaaacaaaaugaaagcaagagagguagauuugagccgacucagacagcaauacauguagcagcaggcuuaauuccccugcccuagugggaaagggccuuuagagccaaaugagauuccuccuggcaaagcuuuaaagguaucuuuuuggcgucaauuuguagugaguauauauauuauagcaguauauauuauauauguguauauacugggucugaguauauaauacauauaaucaguauauauauacacauauauauauacucacuacuauauauacauauguauguuuuggaaauauuuucuuccaaaguuuuuaagaugucaaaacagaugggauuuucuuuguaugcuuuga

SEQ ID NO: 12691 - RNA, 502 nt, Homo sapiens
acaacugaaccauagucaucaccucucauccaggucagauugucaagcauggagauaucaaguguguaauaaaugaaggaaugccaauuuauccuaggccauaugaaaagggucgccuaaucauugaauucaagguaaacuugccugagaaugacuuucucucuccugauaaacugucuuugcuggaaaaacuccuacccaagaggaaggaaguggaagaaacugaugagauggaucaaguagaacugguggacuuugauccaaaucaggaaagauggcaccauuacaauggagaagcauaugaggaugaugaacaucaucccagaggugguguucggugucagaccucuuaaugggccagugaauaacacccacugguggcauuuuaugugcaguaguaaaugagugaaggacugugaucauaacaugcucacuacuugcucuuguuuuuguuuaauauucaacuauaguaguguuuuaaaaaguuaaaugaagaauaaau

SEQ ID NO: 12692 - RNA, 3254 nt, Homo sapiens
cauguccaccaugagagaguagcagccaccacacagucccucuacauucguucauccugacuccaaccaagccaacacacacaacgcaguaggaucuucccugcacaccuucucagugccuuaacuugccaccacaaucacacccgcagcugccuuccuuccugauagacaaggugcuugcccaugagcacuucaucagugauuaaacucugcucagacauguuuugaccacagcugcgcgugcaguccacgugcaguaaggccugcugugugaucugugagcccccauuuuuagcagccagguaggaggcuuccugagggucacucaacaguccuuggguagaagccacggcaggugcagacaaccggacagcuuccguguuuaaggauaucaacacuuaacacagggaggcaggcggacuaacuugcaccugcaccuccagaaggcaauggaaagaaaacaauuccacagggaugacagcuuccagcccuugaccuggugcuaaaaacaggggccaggaagcccagcacagcacuuuucccuacuccccaacacaccccugccuacucuccagaucaggacaauucaggccugagugugacccgaauuugagcucucaaauccaaagagcucccagaaaccucaaucacagcgccaaaaccauuccauaccagggauggaggugcaaguccuuccuggcccuucuccccggaaaacccaaaucaaggacgaggucucucaggucuucccuugcccuaaacacacacgcacuccucacacacaacauacacacuugaccccacacccgugcacacuucaucccacacacacgugaacacuuauuugcucaccccagcaggcuagccggcccccacaagggacagcuaccaagucgcacacccgcacaccugcccccaaguguauagccacuugcuccccccaccccgcguuccagcccccacuacaccugccccagcgcacacgcacgggcucgcccuccaccccgccccgccgccuaccccccacuccugcuccccgcccuccugccccacgcgccccgcgcccugagccccgcaccccgcgccccgccgcccuccucacucaccggcgccggcgcccgccgucccgcgccgccccgcggccuggggccccgccgccccgcuccggcccgcggcuccugggcuggcccgaccccgcagccgccgcuucccgucacguggggcggccgccaggcgcuggcggagggcgggagcgcagccgucuccgcgccgcccgccggcccgcgggcccugccgccuggcuccgagcacaggccgagacgggcccugcuccgggccucggcgucccccuccgugcaccggggccacgacacggcccgccucgcggggcggccagcgggcggaagguguucauucggggggcgcugaggccgccggccccgggcgagagcgugguccgcgccagcugugcgagcccgcggggcugaggucucuucuccgcccccgccgcugcggggagcuucagggaagccgggcuuugccuggcucgcucgccacccaguuucugucaccuacacaggaggagggcgcccgggaaauaccugcugcgugaaugaauaaaugaaugaaaugcuugggcccugggaaaugcuugggcccgcggccgccugaccacgcgggcuggaggaucggacguaccgccggugccccaccaggagacgaaggcaugguugggaugcgcagcccucccacgaggcccauggcgccccagggcccuagggauugaccgggacccccgacuggcagaguccaccugcuugauacacuuauuugagaagggaggccugggacuaucuuacuccuuuuaggaaaacccaacuguagcugcuauuccuuugguucaggccgcaaggaagaauuguagguuaccaugaauccaugaaccccucuuuaguauacaaaguccacuuucaugacggaagaauuggaaagcucccuccagaguugucaguacucaauuauuagcauauaaaaagucaaauuuucccagggauuuucagacuuuagaaccugcuagugaccuguggccucagcuuucuuccagccacucugaguauuguaaaacaaagauauuaucccaacccugaaggcagauaccagauuguacgccauggucuucuguuucaaagggauaaaaaaagaaagaaaagaaacuggccaaaaaaaaaaaaaaaaaaaaaaaacccaacaaucuuccugugacuugcccucuaccccuacccuagugugacucauggccacauaaaugccccauccccaguggugcuucagcugugacccaguggaaccagugucaccggcucagccuccagguaggggacuggcuucccaggaguguaaagcucugaccagcaauugagcuucaagggcaagcagcagugaauggaccuucaagucuaagguggccaacagcuaguggagccagggauugggaagguacaagagcaaauccagucucuucauuuuacccaggcucacagagacuaugugacuugucaucaacuaaucacuggcucaggugguccuagaauucacccuugugcuuuuguaucuuaguccucuaccagaucacaucacagagagcugcacaagacuaguuacagaggugauaucuacugacugccagacagugacuucagaaacugcuagugacugagcaaugaaguagacgcuauuaauuuacuuaauagcgucaaagaauaaauuuaauucuuugaggcaaagaaaggugaaugacuuccuguguuaauucacuuaggaaaauauaaauaaaaaaauuuaaaaaggugacuugucccaaaccccaugcuaguaagaaagagcaacaauaagaauccagaauucagcaacaguaauucuuuuuauauaaaguuguuuugaaugaauaguuuaugaacaaucuuuguguucuacuuuagaugauccaggagugaaaauguauaacaagagauaauucagauauauuuauuuuaugaaaggauuuauuacaggauucuuacaauggcaagcuccauauuauuccaucuagaaacaucuguuccuucugaaacuugaugagaagucugugucacaaaugacaggcaccuccauguaaaugccuguaccauaaaugugcaaauauaugcacaggccaaauuccuuauguuguuucuauugguuacauuuaagaagaaauaucaaccauauggcuuuca

SEQ ID NO: 12693 - RNA, 3254 nt, Homo sapiens
ugaaagccauaugguugauauuucuucuuaaauguaaccaauagaaacaacauaaggaauuuggccugugcauauauuugcacauuuaugguacaggcauuuacauggaggugccugucauuugugacacagacuucucaucaaguuucagaaggaacagauguuucuagauggaauaauauggagcuugccauuguaagaauccuguaauaaauccuuucauaaaauaaauauaucugaauuaucucuuguuauacauuuucacuccuggaucaucuaaaguagaacacaaagauuguucauaaacuauucauucaaaacaacuuuauauaaaaagaauuacuguugcugaauucuggauucuuauuguugcucuuucuuacuagcaugggguuugggacaagucaccuuuuuaaauuuuuuuauuuauauuuuccuaagugaauuaacacaggaagucauucaccuuucuuugccucaaagaauuaaauuuauucuuugacgcuauuaaguaaauuaauagcgucuacuucauugcucagucacuagcaguuucugaagucacugucuggcagucaguagauaucaccucuguaacuagucuugugcagcucucugugaugugaucugguagaggacuaagauacaaaagcacaagggugaauucuaggaccaccugagccagugauuaguugaugacaagucacauagucucugugagccuggguaaaaugaagagacuggauuugcucuuguaccuucccaaucccuggcuccacuagcuguuggccaccuuagacuugaagguccauucacugcugcuugcccuugaagcucaauugcuggucagagcuuuacacuccugggaagccaguccccuaccuggaggcugagccggugacacugguuccacugggucacagcugaagcaccacuggggauggggcauuuauguggccaugagucacacuaggguagggguagagggcaagucacaggaagauuguuggguuuuuuuuuuuuuuuuuuuuuuuuggccaguuucuuuucuuucuuuuuuuaucccuuugaaacagaagaccauggcguacaaucugguaucugccuucaggguugggauaauaucuuuguuuuacaauacucagaguggcuggaagaaagcugaggccacaggucacuagcagguucuaaagucugaaaaucccugggaaaauuugacuuuuuauaugcuaauaauugaguacugacaacucuggagggagcuuuccaauucuuccgucaugaaaguggacuuuguauacuaaagagggguucauggauucaugguaaccuacaauucuuccuugcggccugaaccaaaggaauagcagcuacaguuggguuuuccuaaaaggaguaagauagucccaggccucccuucucaaauaaguguaucaagcagguggacucugccagucgggggucccggucaaucccuagggcccuggggcgccaugggccucgugggagggcugcgcaucccaaccaugccuucgucuccugguggggcaccggcgguacguccgauccuccagcccgcguggucaggcggccgcgggcccaagcauuucccagggcccaagcauuucauucauuuauucauucacgcagcagguauuucccgggcgcccuccuccuguguaggugacagaaacuggguggcgagcgagccaggcaaagcccggcuucccugaagcuccccgcagcggcgggggcggagaagagaccucagccccgcgggcucgcacagcuggcgcggaccacgcucucgcccggggccggcggccucagcgccccccgaaugaacaccuuccgcccgcuggccgccccgcgaggcgggccgugucguggccccggugcacggagggggacgccgaggcccggagcagggcccgucucggccugugcucggagccaggcggcagggcccgcgggccggcgggcggcgcggagacggcugcgcucccgcccuccgccagcgccuggcggccgccccacgugacgggaagcggcggcugcggggucgggccagcccaggagccgcgggccggagcggggcggcggggccccaggccgcggggcggcgcgggacggcgggcgccggcgccggugagugaggagggcggcggggcgcggggugcggggcucagggcgcggggcgcguggggcaggagggcggggagcaggagugggggguaggcggcggggcgggguggagggcgagcccgugcgugugcgcuggggcagguguagugggggcuggaacgcgggguggggggagcaaguggcuauacacuugggggcaggugugcgggugugcgacuugguagcugucccuugugggggccggcuagccugcuggggugagcaaauaaguguucacgugugugugggaugaagugugcacggguguggggucaaguguguauguugugugugaggagugcguguguguuuagggcaagggaagaccugagagaccucguccuugauuuggguuuuccggggagaagggccaggaaggacuugcaccuccaucccugguauggaaugguuuuggcgcugugauugagguuucugggagcucuuuggauuugagagcucaaauucgggucacacucaggccugaauuguccugaucuggagaguaggcagggguguguuggggaguagggaaaagugcugugcugggcuuccuggccccuguuuuuagcaccaggucaagggcuggaagcugucaucccuguggaauuguuuucuuuccauugccuucuggaggugcaggugcaaguuaguccgccugccucccuguguuaaguguugauauccuuaaacacggaagcuguccgguugucugcaccugccguggcuucuacccaaggacuguugagugacccucaggaagccuccuaccuggcugcuaaaaaugggggcucacagaucacacagcaggccuuacugcacguggacugcacgcgcagcuguggucaaaacaugucugagcagaguuuaaucacugaugaagugcucaugggcaagcaccuugucuaucaggaaggaaggcagcugcgggugugauugugguggcaaguuaaggcacugagaaggugugcagggaagauccuacugcguuguguguguuggcuugguuggagucaggaugaacgaauguagagggacugugugguggcugcuacucucucaugguggacaug

SEQ ID NO: 12694 - RNA, 2328 nt, Homo sapiens
aguacuuuccggcguuguugacccuauuucccgugcugcaccgcagccccuuucucuuccgguucuaggcgcuucgggagccgcggcuuauggugaguguuggccgcgcggcauccgaugccauccgcgacuuacggguggcggcggggcgcgggcugcggagaggacuggugaccgaccgugugucugucgggagcaaaagcugcggggugggaauggugcuucuagguccuaggagggggauggcagggaaagccacuuuauuggggaaugcagcuuuccggggguaaggaguugauuucagggcaucauuaccuggguuugggaggccaggacuggcguuuggucgugcagaguaagccgagacucguggaggcugcacauucucugccugcaggcucauucugaccagaauggggggggcagagguggcccagccuggcgagcccuuaacccugaucuccacuuuugucuuccaggugcagacauggccaaguccaagaaccacaccacacacaaccaguguaaguuuuuugggcccugccuacaucccagacccuggcaaggacugguucaggcaaacugggacagagaugaaggggcacguuuccauugugggccugaggcugauugauuucacccaguaauaacuuuaggguuuauagguuuagagaucuacuugagauacagaguguuuugcauuuaguaguaaggguuucccauaucucaaguguagcugcuguaggaaguguugguucucccagacuugccagcugugauguuggguggucuuauuagaggaaaguucuuuguuggcuuaauucccuuuuuuucucccacagcccgaaaauggcacagaaaugguaucaagaaaccccgaucacaaagauacgaaucucuuaagggggugagugcacugaaucacauggaagugucuuuucuugguuccaggugcacagucaaggccucucauguaguuuuucucuagcuuuggcuucugccugagcacagccuaacuggcccacccaaagccugcaauuccuuuuucuacccuaccagacccauaauaaagcuuuccuuggucuccacagccugaaguguaacccucuggucaggguguaaccugccuccugagggcaguuuggcuaucucccuugcuuggcaguggcacuuaggguaaggaguggccuugucugagugcgugcagggcacauucccacacugaccagccuuaugaccuccaucugacccagugcuggaguuggggucagcuucucuuccugugucaggggguucuaaggauuagcugagaaggcuggagggucuaggggagagcugagcauguccccagucuguuccuucccuuuacuuuugcucucuguuccguggagugaaucacaaacucugagccucaguuuccccauaucccaccuuggcuauaagucuuuuggaccagacuugguauuuaauugacaccuucuucuaaagaggggagggggugucccugaggggaugucaggaaaaaacuuggucgaaccccugcuguaggaaguugaagccccacaaccuuggcagacagggcagcaaagcagcuuguaauuuuguucuugaaggaggucugcacagcauuacccagguggcguauuggcucccugggguggugguacacuuucucuggaaauaguuucaagagguuggguauuuccacauuugagguugacuugaugcugucuuuagaaugcuggguaccccuauggagaggggcagcagggagagacuuggggacccacaugcugccaccuguaccuuuccugcuuuucagguggaccccaaguuccugaggaacaugcgcuuugccaagaagcacaacaaaaagggccuaaagaagaugcaggccaacaaugccaaggccaugagugcacgugccgaggcuaucaaggcccucguaaagcccaaggagguuaagcccaagaucccaaagggugucagccgcaagcucgaucgacuugccuacauugcccaccccaagcuugggaagcgugcucgugcccguauugccaaggggcucaggcugugccggccaaaggccaaggccaaggccaaggccaaggaucaaaccaaggcccaggcugcagccccagcuucaguuccagcucaggcucccaaacguacccaggccccuacaaaggcuucagaguagauaucucugccaacaugaggacagaaggacuggugcgaccccccacccccgccccugggcuaccaucugcauggggcugggguccuccugugcuauuuguacaaauaaaccugaggcaggauuuguua

SEQ ID NO: 12695 - RNA, 2331 nt, Homo sapiens
ggaguggagcaaccaccucacuuuccauauggacagcugaaggauagguaacuugaaaggugugcgcugggucagaucugaggucuuuuuugagaaaugcugagaugaugcaagcucucaaaaggcacugcagaaaccaagcauuucaaaggucaaaggaagauuuucaagggaaaaccaaagccuuggauggcuagaggaguucuagauuugcaagcggcaaccugaaagcagguuaaauauauauacauacauauauacaucuauguauguauagauguauauacacaaaacauuucucucauaagaggggcuuuacauaauugauuuuuguuuucagaggcauugcucagucuaucuugccuugguaucuaccaagcagugucaaaacuucuagagaauugggugugugugagcaugugugcacacgcgaaagugucuguguguguguguguaagugaagguacucaacuaagugucacgucagauguaagcagguugacagcaacagcacagguuucuuucauugcaaauaacaaccaaugucaguuuggugccugccacaguugggggcccugggaggcugacaccgagaggguggucagcaugccagaugcuuguuaggggcauacgauugacaccaguggagcuucuggaggggcuggaagccaaauugcaaagagggaggaggugggcugccaugccaaggcuucagcuggucacagagaguucugagcagcauggcccuucagacgugugcuguauggggaggaggugccagccaggcucuuacaccccuacauccaucacucccugcaagggggcugccauagggcaaggggacugucuucagacaagacagcccccaaagagggcugauagcugagggugaucuuccggccacugggagaauagaccuucaauuccugaaggggaauuugggcuacacaucacuaugucuaccaagggaaugaaugacuggaaagaaggaagggagggacagaggaagggagagagagaggugagagagaagggaccgagaggcaggggaguguagggagggaggaaggaggaaagaaggaagaaaggaaggaaugaaagaggaaggagggaaggaaggaaggaagcaaggaaggaaggaaggagggagggagggaggggaggaagaggaaaggagguggcuguacugugauguguuaugaugggagggaucacuaggucauuuuaaucuuucugagucucaacuucucaauuugcaaaugagaucauccuuaccuguuuuacaaagccauuaugaggaucaaauuuaugcaagcccuuaaugcauugcacagaacuauacaaauaugagcuuguacgauuacauaaugcuccaagagucaaggagccccacuaaaaacaacgcagacuuguagucucuaggccaaugguugucaaacauaaaugagcaucacagucaccuggggaaugauuaaaaugcagauuucugggcugucuccagaggaucugaugcaauggauuuggguuggagucugagaaucuguauuucuuuuuuuucuuuuugagacggagucuugcucugucgcccaggcuggagugcaguggcgagaucucagcucacugcaaccuccgccucccggguucaagugauucucuagccucagcuucccaaguagcugggacuauagaugcaugccaccacacccagcgaauuuuuuguauuuuuaguggagucaggguuucaccauguuagccaggaugaucuagaucuccugaccucuugauccacccgccucagccuccuaaaguguugggauuauaggcaugagcccggccgagaaucuguauuucuaacaagcuccaggugaugcuggcacugcugguuccugaaccacacacucugcaaagcacugcucuaggcuaccugagcaccaccacgcaguuuuucaugauuacugugaugguuauucuuaaguauccacuugacugugccauagggggcugagauacuugguuaaccauugccugggugugguuagauguuguucauaggaggggguucuggaugagaugaagguuugauucaguagacugaaucaagcagauggcccucccccgugcgggugggugggcaucacccagucuguuggaggccugacuagaacacaaaggcugagcaagggacgauucagacuuuuuggccugacugucuuccagauaggccauuguucuucuccugccuuuggacucggacccggaauguaacuauaucauuggcuuuccugggucuucauuguguggauuguagauuuggggaguuuucagucucca

SEQ ID NO: 12696 - RNA, 12897 nt, Homo sapiens
cuuuuuaacaaaaugcuuuauuucuauuuuuaaaugagaggcauucccaugaaauaucaaaaggcauuuacauguguuguuuuaacucuucuuuuuugaucacacaaaguagguagaaaagaucugcugaaauagagcaaaucagaaaccaaguaguguaaggcauuaggagauacaugaagagaaucgcuauuugcuucuuguacagcguguggcaagucaugguuaguagucaucguaguugacgcuggcuccaugccuaaagccguaggggcuccggggaccaauugcagagucuucaucauagugacguugguaguaaucgccauaguauucauguccauuucgaucucuguuaagccaauaggugaugucaucuucaaauuucuggaggaaaagagagagaaugauagagaauggauuuaaggucaugcaguccccuaagaccuaaucuuaccuauggcuuuucuucauggugguuuuucuucaacgauuaacaacccuuaguaacucccuguuaccguauucuugugcucagaggccaaaacagucagcaguauucacucugauaaaagcuaucuuuucccaaaggagugcaggcccauaccuuugcaaacuuuuguaaaauauuugcuaaguguauuccagacuuaaauguuuuucucucucuugguaaaucaaauggacaggugcccaaauaccauaacaacuuggccugacccucagaccacaucucacuguggcaaacacugucuuaucuuccuaccccauuccugugccuggcccuuuauacugcauguaguagaugcuuaauaaauguugccugaguuagaucaaccacugcauuggccuauuauagugccagggcagagaacuggggguacauuugauggugacucuuauaccuguguuguugguuagaguguacacagaugcauuuauuuauucugcaaaugcuuugagaugggcacugugugucaugcccugugcugggcacuggagggcugccaaaaacagucgucugugccuucaagaagccuacuguuccugagugacagauaugagaagagacaguugcagauaauaaaagggauagagaagcuaaagcugaguaaguaguguagaaugauggucagguuuugguuugggcaacugaucuuggcuauuaauacauuuuuuuuaaaggagagacuaauuuuucuuuggugguggugaaggugcaagauuaauuuagacuaggacucgugugcugaugcucaggacaucgcaagagauuuagugugagagcaaaaaggcagggagaugacagaugggcugggugaacgggucaugccauuggggugcagggccaguuuuucuccaagcguggcccaugcaccccaacauccaaaucacaaaugcagguucucaggcaccagccacuccaugccuccugcauggaacuuucugauguuugggacucagcaaccuguuguuauuuuaacaagacugccaaugaacauuaauuaauauugagaacuuugugaggcuggaauccccagccuagcccgugucuguggucucuggggcucaguggucauccacucuugguggguacugggccagcuagugcugggcuaaagagcaugauuccaauuucucacugccauucucuauaccuggggucugaaucaucugagcccaccucagccucugccuugggaaggaggacaccgacuucuuuggcuccaucucuaguuuugcuuucccauaauacaacauuuuuggccauggugaaacaaucuugccucuuggguuuucucauuuuauuuuauucauuuauuuauuuuuuaagagggaguuucacucuuucacccaggcuggagugaaguggcaugaucucagcucacugcaagcuccaccccccaccagguucaagcgguucuccugccucagccucccgaguagcugggauuauagccaucugccaccacgccuggcuaauuuuuuuguauuuuuaguagagacaggguuuugccauguuggucaggcuggucuccaacuccugaccucaggugauccacccaucucggccucccaaagugcuaggauuacaggcgugagccacugugcccagccucucauuuuacaaguuugcuugcaguuuuagcuuaaauauguauuuucaaaaauuuuuuaaaaucuuugaugaauacagaaauaauauagauuaagauuuuaaaaucuguaugugagagaagagcauagaaaaagaagaucauauuccuuugccagagaccacuagugacacuuggauguagucauuguacucuuuuuaaugcauauuaaguuacuguaaucuuauuugauccucaucuuuauucugguuuugucaccugacauuauuugaguaguuucugcauguuaaacucucuuuuuuuuuucuuuuuugagacggagucucauucuguugcccaggcuggagugcaguggugcgaucucagcucacagcaaacuccgccucccggguucgaaggauucuccugucucaguccccugaguagcugagacuacaggcgugagccacacaccuggcuaauuuuuuguauuuuuaguagagacgggguuuugcccuguuggccaggcuggucuugaacuccugaccucaggugauccaccugccuuggccucccaaagugcugggauuacaggcaugagccaccaugcccgucccugcauguuaaacuccuaaugcccauuuuaaugauggucaucaaagaaaugcaaauuacugaaggaggauauagcauuuucaucuaucaaguaagcaaacauauacuuuuaauuuucaaugagaacaccagaugcugcugaagacgccagaaaacuguugcucuuacaugugacucacaggaaugugcaguuugacaauacucagagauacuuaaaugugauuccacccuugccccaggaaccucacugggaagaauguggucuaaguaaaaggcaaacuguacagagaugcaaauaacagcaccugccuuuuggguuguugugaaugugaaguaaguucguaccucuaaguacuuagaaucaugcuuggcucagaguuuggcuauacauguuuaccuauuugcacagaaaaagaaaaaaaaaagcaaaaagacacuuagggaacaaguaauauguccaaugguuggaaaugugaaggaaauuuugguauagccacaugauuucacuuuauguagccauuacaaaugauaugucuaagggguuuaguuuuuuucuucaccuacugcaguauuguguauacaccgucuaaaugaaucaugugcccauuuugaaaaacacauccaacugcccauuuggagguccugccuaugaaaagcccaucugcucccugguggggcagcacaggccacagguccucccuuuacgucucacacagggagcucagccuccucagucaccauggauggaugcccaugcggcagcaucuaugacuuccaugggcugccgucucaccuccacgugcaccccagcugggagccuacgaucauaaacucuuugucuuucauucaaugaauacguccaccaaugccaucuaggcgcaugaacuguaaaccaucuuuuccuauaagugcauugacaaauuuuccccaaaaccucuacaaagacccauccucucuuuacaggucccuuuucaucucuuuucauuaucaucauagaucccggcaucccuguuguuucugacagucuucaaguuaaaaguuaauagguuuugggggauugugaguuauuuuaagaauacccuggcaaaacuguucagccaaguuaaaaggguucccgagaaagucagauucucgaugaaucuagguccccgcuguuuugguucaugacugccguggguucugccuccugaauguacccugguggaaacuuccagccaucgcccuuacaccauagguaacaugauccagugccugauagcacuuggcauaugauggggcucuuacucuaggaaugaacagcaaagcugaauuuucugcuuccuauuuccccgagccaggccuccucccugccacccuucccuguggaagccaggccugcagccggaggcaacaccuaccgcuucgucaaagcccauguagagaaacugcugguaccacugcugcaccucgggccgaguccggucccacagcugccgcuucuggcgcuucaggcugccaaggaauucuuuggcuuuauucucaucaacggccacuuuagucuuaguuggaacaggugcugaaaucaucaauuccccauccccaaagcacaaagaaugacuuccuuccucacuugcggugaaucccuguuauacaucccaucccccaccaccauguguaggaggguuuugacucucaacuucauucuuacuugcaugugacaaugugacacagccucguagauucugucaccaugcuuccuguuaguaaguguuauuugguacaacccuauaaaggggcauggacuaaacuucaaccucuagguccucaggguagaaaugaaauucagcucaucuccugcagcccacucgcacccagggcccaggccuuucccggggcaaauggcccaccccucaggcuccgcauucaggaaacagacuggauaucuagugccacacagguauacgggcauguccauugcauaugccaacacaagaggguugugcuuggcucaggagauuauguaagaaaaaggaacuggaaugaugagccccgggugagcagggaccagacccugcccaacaguacagcugauucucacaccaggcugcugggacacagaauccccuuaagccagugccucucugcgccucacagucugaccauugaugcaggauacugacccgcacccucacacugcugcugcuaacgucuuuccaucacagucucaauuguugaaauggaaccacuuccgcaggaugugcucgaggaagccacugugccauuaggcguuuuucuccugcugucacguuuucagccucuguccccguaucuauaaaaguggguggacagucccucucgaugacguuaggaaaaaugcacaggaucauggaaaugcaggccuggugcauucguuggucguauggacaaauaccagcagggguuuuuguuuguuuguuuacaaucccuugagggauuguaacacuguuuuguacacaguaguugcucaauauguguuucuugauuugaacugagucaaggcugcgggaugcacaccaaggaguugugacugccucagcagcuugcucaccuaugacaaacuggcucugugagggcguuguugaucccugggcauccgugagguaaggcucuggccaccacacagcacagggagggggcccucugagccgccucagagauugggggugggccagggcuucuuggguggcuggaaccccaggaaaagaugcugggaccgccccaagccuguucuccagccaccugugggagggccccugagcagcaacuggggagugugggaagaaugacugaggaccccacuucagggaggaaguucagccugcuagaaucccccacaaacuaggagggaaagaauaacugacuaaauggucacaucagaaguguggucacacuuuuucauuucuaagggauucuuaauuuuacagauagagaugaaaguugggagagggaaaaugacauucacgagaccccacaauugauccaccugaucugauuacagcagguccagaaccuguguguugugacccccagacuguucaauuucuaugacauuuuguugcugucacauuuaucuuagaugcauuauucaaaacagaggcuaauaacaagaaaggcuuuccuguuugaaacccuuccccaagagcucuuuggauacacggacuaccgcaacacugcuguuccacgccugccccaccaacugaggauuauguguuccaaagauagucucuaaagugcuccaugguccuaaaauaaauagcaugcaauuaacacuguacuacuguuucuuuuauuuuugaguccacacugacagguuucagaaaaauaaccuucagacauuuacuggcaauaauauuuaucuaauaagauaccacaccacauaccaacagaauaagcccuucauaucugcuaaccuuuuaaggaguaaacacuuuugauuuuccaaauacaagacuccagugagcacaauccauauugccauuucauuuccauccaguuaagaaugcaucccuuauccauuugggguauauuuaccuucucguuuuugaagcaucagcuugaguuuauuuccacuuaugccaccuaaaggaaugaaaauugaaauccauaucagaguuauacugcucccuucaauuuaucaaaggcaaaaaucagagugggagaaaagaacugcgggccccugccuugauuuggcaacuugguaacaucacaguauuuaacacuugcuguauucccuguccugcaggacaaacaauucaggcugcccauggcuaauacuggugauaaugaccacagccgaccaaggguauuacuauuugagcuagucagagugaugcuguucuuuuagcccugugucuuacuacgaggcgcagccaucugucaagcgcaucuuccugcaaauuuucacuucaugguguaauacguugaauagugaauaguguccuccugaaaccccuauccaccagaaaccccugaaugugagcuuauuuggaaauggggucuuuucagauauaauccauuaaggaucucaagauuuuuauuuuuuuuuuauuuucuuuucuuuucuuucuuucuuuuuuuuuuuuuuuuuuuuuuuuuuuuuuacagccuuacccaucacugagagggucucaagauguuaucauacgggauuuagauggacagaaauccagugacugguguuuuuauaagaagaagagaggauccacggaggucacccaugugaagacagaggcaggcagaaaugggagucaggcucccacacacuggggaacuugccuuugcucucuaaaagugcagcccaguuuuguagcuugcccagaucacccuaaaaucaaguaugauuuguaccacuugcuguuauuuguauucacuuuuaaaaguguuucugaucagcucaaucauuuuuaauagaaaauaccuugucuggccugauagaacacacgccuccacccagcgaacuggcuugcagaccuauaggagccucugacccuuaacuguugcaugacaucguaaguagugaguagagcaacuucggguguaaggaacuggagucaggccccaggauggagguaauggugaccacuuucucagcaggguucuuagccucuccuuccauggacaggcuccagggggucuagaaaggcauguaaaauugcguuugcaucugccaaggcacaguuuucugggaauaggaaccauagcuuuugccagacucuuaaaagugucugugacccaaauaaaauuaagaaugccugcuuuguuugugaauuauacaucaauaaagcugggggaaaaaauaaauguuuuaaaagagaaccucugcacaaagaauuuacuguggaguuggggcgaagaauauauccauaaacaagagucacaagcuggcugccucaccugaggcugcauuuuauuagcauacccagugucuacaaauuuugaauuugaaugccucucagcccaagucacuuggcacacucaugguccguaagcagccaccuaaccuacuagccuccuguagcauuuggauuaaagugcuaccuggcugccuucagagucauugggccauccagggagccugcuggccugcccucugggaugggacggggaaccugcuagaacuuauuaagucuauuuccugcuaagugccucccuucuaauucacggguaggguggccacacuuucugguuguccaggaacagcccugguauauaccucuuguccuuguaaauuaaugauagugccuccuuuugcucucaaaaguguuucagcuuggaugauaaauuacauggccucccaauuuuuugagguuuaauggcauggaaauggcuucauaagaucucuagggaccacacugaagggccagggaggagagguggugguuucccucacaccuucccuaugagagcugggagucugcuggguggccagcuaagauaucggcguagugcauagcagccugugggagagcugcagugguuuuuguugucugugcucaagucggucuauagugauguaguuguuuaaaaagcaauugcaaucuuaggcuguuuaauaaaggauacuuaaaaaaagaaaguaacuguccugucgcuguuccaucacagcucugaacagaccuccccucuacuauuuaguucaguucacaucaucucacuugaagaaggucauagaaaaaccggaguuguggucaaaggagaguguccagagaggacuagcgcccaaacauguguuauaugagaagaaauuaaaggaauuuagguguuuaaccuagagaaauaaaacuuguggagcugggugugguggcucacaccuguaaccccagcacuuugggaggccaaggcaggcgcauagccugagaucaggaguuugagaccagccuggucaacuuggugaaaccccgucccuacuaaaaauacaaaaaauuagccuagugugguggugcaugccuguagucccagcuacucaggaggcugaggcaggagaaucgcuugaaccugggagacagaaguugcagugaaccaagguagcgucacugcacuccauucugcgugacagagugagacucuaucucagaaaaaaaaaaaagaaagaaagagagagagaaagaaagaaggaaggaaggaaggaaagaaagaaagagaaaaagaaagaaagaaaaaggaaagagaaagaagaaagaaagaaaagaaagaaggaaagaagaaagaaaagaaaauaaaaaagaaagaagaaagagaaagaaagaaagaaaaaagaaagaaagaaagaaagaaaagaaagaaagaaagaaagagaaaggaagaaagaaaaagaaggaaggaaggaaggaagggaggaaggaaacuugugggaggagagccaaugcuuugaggggccacugggccauagguuagggcaugaaguaagguuucuaacgcccagauagacagccacccaagaugggacaaauggccuugggggguuugagauuaagaguugcuggaggcgucugagcauaaauaaacauagaugagcacuugaccaggcuacuguagaggggauuuucuaauuagaugggggugggacuacuguuuaacgcucuacuucccuuccaaacuuaaauucaaugaagaaaucuaugaaaauauuugccaagggagacagauauguuccuuggcacuaauaauagcauucauuaaugucuuaacaucugucagucucuaacagcucacaggguaguacauacagaauuaaguauggccccuccaucuguuugccuucugugaaagugcuuaacaauuaaugaaugaaauguggucugauguugaaauagacacugcguguaggcauuugcgaugaggcugcaauuucuugcagcaaauguaugucacuauuacuccagaaaugagagccucgccaaaccuuagcuauagauggaaaagcacaaauaagucccaaauuaugaauuaugaauguugcugcugugccagguacuauacacugaacuccauaucaguacauauaacuggacacuacacuaaauuuguuugaggaaaaggauaaggaacaauagaauagcugugauuuuuuucuguauuaaggacuuuucacccaauaucaucaguuguucauucaaggcugcaauaauaagcacuccuuaauuuauccaauccaguugccuagcauuagcucucccagcaaauucagagcugcaaaaugcuccuuugaaggugcuuaauauuaauaaauugaucaagaaggggucacggucauuuucuuuauuaaauguuugugagugaggaagggcguggugguucaagccuauaauccuagcacuuugggaagccgaggcagaagcaucacuugagcccaggaguucgagaccagccugggcuacauagugagacucaucucuacuaaaaauuaaaagaaaaaaaaaaaauugccaggcguggagucaacacaccuguagucccagcuacucgggaggcugaggugggaggauugcuugaguccgggagaucaaggcugcagugagcuaugaucacaccacugcacuccugccuaggcaacaaagugagacccugucucaaaaaaaaaaaaaaaguuuggagguggcauaaagagucaccuuugggauuacauaaagauuuucacuguaggcugggcauggugguucauguuuguaaucccagcacuuugggaggccaagauugguggaucaccugaggucggcaguuugagaccagccugaccaacauggagaaaccccaucucuacuaaaaauacaaaacaaaaacaaaaaccuuagcugggcguggugacacaugccuguaauuccagcuacucgggaggcugagguaggagaaucgcuugaaccugggaggcggagguugcagugagccaaggucacgccauuacacuccagccugggcaacaagagcaaaacuccaucucaaaaaaaaaaaaaauauuuucacuguauaagaacuuucacaucccagcucggugaugauauuuuaacugaguuauugguauaaacuaaauaaaauacaaguccugaaaauaaauggcuuguagccagugcucacuugacuuauucagaugugcuuuuuucuucuucuucuuuuauuuauuucuuuuuuuauuuugcgacggaguuucacucuuguuacccaggcuggagugcaauggcacgaucucagcucgccgcaaucuccuccucccagauucaagcaauucuccugccucagccucccgaguagcugggauuacaggaacgugccaucacgucuggcauuuuuaguagagacgggguuucuccauguuggucaggcuggucucgaacccccgaccucaggugaucugccccccccccccccccggccucccaaagugcugggauuacagguaugaaccaccaaggccggcccagaugugcuucuuaaaguggcaagaacaaagagugggaggcagguaaaccauacaacgggaaaugacugauuagcuucgccugugauucuaagguggaacaauaauccuccccaccugaacagaccucaccacgccuccugcuguuuuagcaaccccggggcuccaucccagggcuccuacugaauguccccugccucuucucaccucgaguucaguuuccauaccuguuucgaaugagcaaaauacagaaacugagcaaccgagugagccucccuuuuacauuaggcagugcccagcugcuuugcagugggacagcgccagucucaggcucuugggcaagucacuucauacaccaguaacucugagguaacaaucccugccuccccuaguuguaagcuucaaaggcagucauguguccuugaggccacuugugaaccauaaauguuccuccuacccagugaaggugguaacucaggacaaaccacggcuucagauuaugguuccuaaaguggggccuguggagcccagcgaucagauaucggagcacccaucauucugggugugcgugugaaugcacguuuuacagagagcgagcagagaauuucagaguuuucaaccgauucgcugggagcuccacgaagcaggaaagauuaagcauuacuccuuuaagagccuuuccccucucuggggugugaggccugugcccagcuuugcaaauugcaacuugacccagcugggaagcgcaagucaacuugguugcuaagcgacugccuggaagggaauggcggugauggugccauuugccuccucuggguuaccagcugcguaaagcccccacaacccuuuugccccuuacguuaagccacgaaacacuacuugcccacccuucggacgccuggcccuccuugcccaagguugcccgggagaucugagacccuccccuugaccccgguacucucuccacccucacaagggcaccacuucgcacuugugcgagugcaaaaccccagacccgguccucuaccaccccuuggcccugccuaggcuaaggaugggucccuacgccgccaccccaucaccgaucgcucuccccgggcaccauggaagcgccacauggggccaaccccuggugccgcuaucaaucagccuggcaucgccccgcucaccugggccccagcacaggagcaggagcagcgccagcccggucagggccaggacagcaggccgcgcgggggaggcagccauggcggcggggcgcgagcaggagggcgaggggcgcacuucgaggugcugcgagggagaaccgggcgcgggagaggggugcgagcgggcaggcgcggccgcggguuaucccugcgucgcugccggggcgggacccagcgggugggcgccgcgccagagggcugagggccaagcggcugcgcccagcgcacgggcgaguaccaccgagguccucucucccgccccggccccaaggggaacgcagccccugggcuccaaggccaaggaugcuuggccacggagaaccgccggcggcgggggccgcguggccagcgcugcccgcagcgaaagcgguuaggacaagcuggguuccggagacccaaggaagggcagaaggcaucgggagaagggacgaggcccccuggccacucagagggaggacuugccggaucccagcgcuggggugucuccuuggcucccccacuuccuccgcccgccccagccgcgccacuguuccccuuacuccucaccccu

SEQ ID NO: 12697 - RNA, 2165 nt, Homo sapiens
aauaguuaagagauuuuauucuaauagcuauaauuacagugcuuguuugucgaaaugaaaacugaaaacaaguauacaaaacaguugauuacuaaucguguauugaaagcaguaagagguuccacgacaccaaauagaccaguucugagguuuccccaagauaaauuuaacagcuccagcuucaguguuuaucaaaauacaaaagaaaaaaguagagguugucuuuuucgauggcaaaucggacccuugcaggcugagggagagaaagcuacaucacacacagagguggggugcucccgaggggcugugggucuagguggaccgccugcccggcuugcacgcgcuccugcuggugaggccccagacauccugccaaagugucugagcgagcacgaguguuggggacgacggacccacucuggccacacggcgaccgagggacagauggggcccugcgucccauaggcugccugaagguggguagggcggccugcggcauagugggguggcugugggcucccagccuggccccugggaaccgugggagcacagggacaagcacauggcuauggaaugcagggugacccaaggacaagcgaguugcggggaucucuacugugaccaugcagaauugaucgcagucugcugcgccaccaccaccucauguucccgaggggaacagcugggcuggcgacuggcauccaggccguaacugcaaaucuaugcuaggcggggucucccuucuguguguucaaguguucucgacuuggauucuuaacuauuuuaaaaaaugcacugaguuuggguuaaaaaccaaccaccaaaauggauuucaacacagcucuaaagccaagggcguggccggcucucccaacacagcgacuccuggaggccaggugcccaugggccuacauccccucucagcacugaacagugaguugauuuuucuuuuuacaauaaaaaaagcugaguaauauugcauaggaguaccagaaacugccucauuggaaacaaaaacuauuuacauuaaauaaaaagccuggccgcaggcugcgucugccacauuuacagcacggugcgaugcacacggugaccaaaccacggaggcagcuucuggcacucacaccacgagccgcacguuugccacaugagaguaaagcagagggcaagaggagugagagggaggggggucgcguucacuucugguuccggagcugauuggacagccaguccaguccuucauagagcccgucgccgcugguggcgcagguggccugaauguaccaguuccuguggcguagugagugcagccccagcuugucugugaucucggccgcauucauggcguuggggagguccugggggaaggaaggguuggugggaagggcuguccacaggacagagaaaggggccccaccagccuccaguaaccccuaccaccaggcggaacccacacuggcuccucacauuccccaggcuggcccgggcgccuaccugcuuguuggcgaacaccaggaggacagcaucccggagcucguccucggccagcauccucaugagcuccucacgggccucguucacacgcucucugucauugcuguccaccacgaagaucaggccugccgggcagccagugucaaauggucaugggaacacagccccccugccgcaucuaugggcaucgaugccccaucuaugggcuggcccccccucucuagaagcaggagugcccaugggaccaggccccagccacuuaccuuguguguucuggaaguaguggcgccacaggggccggaucuuguccuggccacccacgucccacacagugaagcugauguucuuguacuccacgguuuccacguugaagccugggugcgggaugcagggugaggccuuguaccuuggcccagcccagcccagcccacucccugcuggcccccaccucaccuauggugggaaugguggucacgaucucacccagcuuaagcuuguagaggaucguggucuucccugcagcauccaggcccaccaugaggaugcgcauuucuuuuuugccaaaaaggcccuugaagagguuggcgaagauguuccccaugcuuguggacagguggaaggacacuggccagggacaccuggagagacaaggugcuccaugucugguucug

SEQ ID NO: 12698 - RNA, 83147 nt, Homo sapiens
caaaggggcauaacaacacaggggaacccaaagucuacaccccuuaaccuacgaccuuccaaaaucauguccggagcuuucgccgacaccgcagacuccuuagcggcuaagcgugagugcgccggcucccuugccucgggucagcagcaccccggggcuggggcuccugcagcagccgcaccaaaaaguuucauccacaaccuuaaguuuggaaacuaucguuugccaagcgaaggguucccauuauuccuggcuggcgguccaucuccuugcccgucucucggggagugauucgguccgggacaccaggacucugcuuggaggccugcuguugccuaaaaaccccaagcgcgggccucuucaaggccccagguucgagauccgaacccuccaguaauguccucagacuccucccccuucacugcagcccgggcaauacucgggccuagcuccugagagcggcgccguuggcuuacguagcagcacgugauuggccaccgcucccuggcaggccgggauugguggaagacgggccgaccccgccccucgcccccgccuccggcccgaggccgcacggguguccucgcgcugcuaguccgcgcgcagccuggcaguuugccgcuuccucguccuccauccugcguccauggccaccgcugcgacugaggagcccuucccuuuucacggucuccugccgaagaaggagaccggagccgccuccuuccucugccgcuacccggaguaugaugggcggggggugcucaucgcaguccuggacacgggggucgacccgggggcuccgggcaugcaggugaggcggcccccgagggcccgggcgcgggggcgcgggcggccggggacgcggguggggacacagucucggagcccggcaggccaaagccccgcucugcggccgaguccgggccggggugggcagcaccggggugggcagaggucagagccaggcgcgggagggacgggcgcccgccaaggggacucaacggcgcacagugccagggucgcugggcgggcgagggcccggaccccagguugggccgugguccccccagcucaacaaaagcagcgugcccggcgcggcugccuggggaagccugggucccccuuuggccccagggacuccccuuccuucucgcuucggcgcugccaggccggaccccccaggcuccuucccuccacgccgccuuccucugccuaccccucgugccucggacaccggucccagccugacguuuuuaaagagaauuuuacagcuuuuaucauuggggugggguggagacaccagauaggcaacugacaugugagaacuuaauguuuagggaucgggagauuugguuuggggaagaauaguuugucuuuaagcacgaaagcuggguuuccagaagauaacccaguccucuuccggaauuguuuccugugguaguuuuguguauucuauuuuuaaacggucuucugcagcguguuugcuuagggucauugaaucuuguggcuuagucuucguuuacauaaggagaauucaguuagguuugguuuuggcgagcuucucagaccuuaugaaaauaugcgacuuuuuuuuuuuuaaaccugaaaacauacgacgguuuuuaaaaauuacuuaguuuuuugccuuaggcaacuuuaaaaucuguagauucaagguaucauaccagaagguaguuuuuuugaaaguauguugucucucguuaaaagcauucuguuuaaagucuuuaaaguuuaacuuuuguacuuuuaacccuuuacugaaauccaguaauaaaauuucaccguuauucaagauccaucucccagcaucccugacuaauccuacuguaugcugaucucucguugaucagccccuggcuaucuuauccuccuuucuacacuaaacacucauccuccuccccacaaugucccuucccuucuggauccuuuaucgugcuuucugauuauugagguagcauuuuggaaguaacgagggggagucuggccgaaucugcuuagaaaccccugggaaucuugauuccugguguguguucuucagcaccacucuggaguacagcacaucuuuugugaaucagaagaggaucagguacugaauucccucccgguaacuggaguuauauaguugucguuguauuaauaacuuaaagacuuagaacaaugacagcuaucaacucauuuggggcuuuauuacaaaguaauaaugcuuuucauucagcuguggaguguguuuacuuuuuauaggaugagugggaggaaaacagcugggauaagugguucaccgguucuuuugucaggauaauaagagggucagaaaaguuuggagaagugcugcuugguagaauuuguugguagaauuuccagaucuguuucucacauuauucuguuacucucucuaaaguaacaauaauuuucaccccacagccuuguugugaaaauugauuauaagaggacuggcuaauuacaugugacuuuuuuaaaugcucaagaaaaauauuaaacuauuuuggcaaugauauuuauucuuuuuuguauauauaauuucaacuuuuauuuuagauucagaagguagaaguacagguuuguuacauggggguauugccugauguuaagguuuggggugugauugauccugucacccagguagugagcgugguacccaguagguaguguuucagucuuauuuccaccccuucccuuugggauccccaguaucuguuguucccgucuuuguguccauguguacucaauauuuagcucccaccauaagugaauagaaguuuaugcuggaucuuucaucaccaacuauuuggaggguaaauauauguuagauauuugcauguaauaaauauucagaugauaaaauauugaaauaaaaugaaagcauaagucuucucuuuuaacaaccuugacucagauauuggccuaaacauagccaguuaaaagaaauuggguacgguggcuugcaaacgugaggauuuuuuuuuccuguaccuuuaacagauuuauuuuguagauauauguguacaucauuaagauuagaggauggauagaaagaaaaaggaaggaaagaaugaaauaggaggaagaugaggcugaacuggcaguuuggaaagccggguggggucugaauaaaggacuagaggcacaagugaaaacguggaagaacacaguggguugucucagucuuuggugacuuccuugggcccaauucuuuugugacaggucugugggcaugaucaaguggaggauggguggcaugagaagaguaguaguuacguaagugauuucauauuuccucagcagauauucaggcaccuaccaggugccuaaguuuguguuaaaugauauagucuugcaaacugucacucuugcagagauugacaaggauuauuggggggauggggcagggauuggggcagcauuggccaguaagagcuggacuggucagguuucacagaccagauggaacuuggacuagaccagaauauauguaugcaauagccaggaggucucccuuccaccagucuuguuucucuuugauccauccuucacauuucuagaguuagauuccuuaaaaaaaaaaaaaaaccuuguauuauacccucauuuaaaacaaagccauuuuggaaucucaacugcuuuuguguaaaaauuaaaaaaaaaaauugaaugguauauaugaggccauuugccauccaacucuggccuccuuauguagccucaguucucaucauuucuuauguccauagccccuucauccccaccuuucauccuuugccuccccuugaacauuucauucuuacacucaccuagauguuucaggucuuuuugccaauacaugccuuuacauguggcguuucaucuuccgucaggcuucuaccauccgucaucuguaaacuccugcuucauccuuuaagauccagucgggucuugacaccauuauguuuuggaaaaucaacugauuuaauucugcgcgcccccuccccccaccaccucguauuuauguguguuugccauuguguuagggccugcagcuucagaggugaguaaggcccaaucccuccuaagaguuauuuaggcuuuuugucucuuugcuguuauagcaauuugcuuagauccccuuaauagcaccugaaauauguauuuuaguguuucuguuuagauaacuuuuuccugguuaacuuaaaaaucuuugaaagcauguaucaaaauuguaugacaugugcuuguaauguuaaauguuuuuguugaauggaaaaaauauauaugggcauaaugaaggaauauaauuuccucauagagggaaaaaaaagguuugaggagguuacgaguaguuucauaaaacucuauuuuuacauucacuaaaauuuuauuaccucucuuucaguuagcuuucccucauuccccccaaguuggguuuuguguuuuuacauguuuuuguaugcuuucauagauaguguccuaaccucuuuuuuuuuuuucccucaaagacagggucucacucugucacccaggcuggaguacaguggcacaguggcaggaucaccacucauuucagccucaaacuccuggguuuaagcaagccuccugccucagccacugcaguagcugggaccauaagcaugugccaccauacccagcuaauuuuuuaauuuuuuuguagagacagggucucacuguguuacccagacuggccugaccucuauuauuuguuguccuguuuugucaucaucucucuacuuacuuuuucuuuccaaccaauaguaaccuuuacaaaagcaaagauugucuuauuuauauuaaucauuauauucuuagaauaaaagucacugguuaauauuuauuaaaucuuuauuugcuuaaaagaauauuuucaguaccuuuccugaaauuuuaagucaacucauuaacuuuguguuguuuaugauagauugcaaacuucccgccauuuguucugguccucucugcaaauguccuaccuuuuguucugguccucucugcaaauguuuggcaaaucuuccaaccuucacuaacuccucuaccuuacugguuacauugaagacauacacuaacuuagauucuugacauuuugggaaaagcuuugggcaauuucuguuucauccagccaacauagcccaguaagcauuucccagucucccaccccaggacccaggauuuaauaccgaagcucuuaccgauacuaacugcccaugcuuucagucccucuuucccaugugaagccucccccuucucagagaugagugauauaguuccauuguuagcaguucagcuuccuccuuuccuuuacuucucccaaaacaccauggcaaauccucaggggguuugccuuuuuaaaacccuccucugacccuacauuucuguuuuugucuuuuuaugucuagugaagugguuuucuuuaucuaauauuaaaguaagaaauucauggauaggauaauugcauguauaauaauuuguaaugaaaauuuguguguguaggagagagauccuuguaaguaaagcauguggaaauaggugacaaauaagccauuaaaucccauuaggcuuuuuuccuuugcuaauauauugauaaugagguuucuaaugagagaucuaucugacuuguuagugcucucuuguuauucuugaucucaagucacucagguuugcuuauugaggugaagauaggugauuuggguucuuagugcuacuguauaucuuucaaauuucauauuggaauacauuuuaaaauaggugauuuucuuauaugauuaguacaugaccuagcuaguuuuaauuuuauaaaguaguaucaacuuaauuuuguuuccauuuuuauuuugguagauuuucuuacauuuuucucuuuuuuaauuauauuuuugagacauauagccuaucucuucagaaucaguaucugauuuaaguuuuauaguuguaucaggguuugguaugauucccacagugauuuuuuuuaauuaugacuuugaguuuucugaguauuagaauucuuauuuguuacuauuauaggacaguucccaagaaguaaacauccaacuugagaauuaccauacaugaaaauaacagcugugccugggaggccuuuaugaccccuucagcuaucaggcccucaguuguuccauggcaacaagauugaaaugagauuugggguccaccaaccacccauuugcuuuguccgguaaaggaaaaaaaaaugugugcuuuuguuuucuccacaucgagaauuucccucuccuucuucaggguauaccuuaauuacagagcuuggagguuauugcagaggaaauacuuguguuggggugaggggcauguuggucagaaagacccagagcaguggacauuaagcuuugucguaaagagugugaauucuccagguggaauuggagucugaagacugugcucuuccacuuuacugacaguuucuacgguuuuuauguuucuguuucuuucuugaggauggaguuuuuuuguuuuuuuguuuuuuuguuuuucguuuuuuguuuuuuuuucagucguugugucucuguuuucuggcugauuccugcugguaacucaguacauauuccugaaugcaacaaauucccuuuggaaagccagccaagaaagagcccagaaauuauuuucccacaaaaauguguaaaaauauauauuguuacuuguagcaaucauguuauggcucaaaugaaaauuuguggacuggcaagaaaucaaaccuuugaaaaucagucuuagugcuaaguaacuugugucuuguaauucaguaaugaaguauucauugaaugccugacaggcacugcuagguaguggguauauguauguucgugaauaaaguagacauggcucuugccuucauggagcuuucuauucuaauagggggaacagaugaagaucaccuacuuguaucauuagaaauagaauuauguucugugaaggaaaugagguacagugagaaaaaauaauccaguuuaggauggcagcuaccuaaaggaggucaucgaggaggccuuucugcaggagggacuuuaauagaaaacugagagaagauagaauccuguggaacaacugaagagauaaagaauucuaggcagaaggaaccuguuuaaaaagucaugaggcaggaaaaaguuuggcauguuucaggaauugaaaggagguuggcgugguuagacuccugaguaacgggguggcaggggucagauggugcgaggcuuuuuaugcgaguauucugagugcuccaugaauacauugaugggcuuaaaggagaggacugauaaaauacagcuuguuuuaauacagguugaguaucgcaaauucgaaagucuccaaugaacauguccuuugaacuucauguccaugauuuuggagcauuuggaauuuucagguuagggucacucagccuguauuacuuuugauggggccaagaguggaaacugagggaccacuuagguaauucaccucauggaggcaagagaugguggugguuuggaaaguuaggauagugguagugaaaaugcaauggauuugagcucucuucuagacaaagaauuaacaggauuuccuguuagcuucgcugugaggagucaacugaaguaaagaaucagaggaggauuguuaaguuuccagugugaacagcugggcguggggauuccugggauggcaaagccuggagaaaaucaggugguggggggcauguuaagcuugaacuuuguugcguuugaggugcuaguguggcauccaauaauggugccauuaaaugguaccauuacuacuaaacauuuuuucccccuaaagcucuaaacuuguccagcccacagcucaccaucuuuagaucuuuucucaaauguuaccaucucagcaaggccuuccuugaccagccaaacuuauguugaaaaccccacacugaccaucucccuucccugcuuaauuuuucuccauaguuaauuuucaccaucugacauguucuuuuuuuucccuaauacccagugugauagcacaucugacauguucuuuauuuuacuuuguuauuaacugaacugcuuucucgcuauaagaucgucagggauuuuugcguauggaucacugccauauccccagcaccuaaaauaggguguggucuauaguaaaugcucaguaaauauuuguuuauugaauauaugaaacgacuugaaggauucuguaguguuuccacgauuaaauuuucuuacuaguauuuguucaggcuuuuggcuuaaaacaguucaguucucuuuuuuaagugaauguagauuuuguauauacacacacauauauauguggauuugcauuguuuaggaauaaaaaccuaaaaucuaccauucauauuuuaauuuucuuaauuuucagguuacaacugauggaaaaccaaaaaucguugauaucauugauacaacaggaaguggcgaugugaauacugcuacagaaguagagccaaaggauggugagauuguuggccuuucaggaagagugcuuaaggugagaccuuuugucuucuuuuugaauuuuuuuuuuuuuacucuugccucaaagcaucuaauguuuuuaccuuacauuugguggugguauuaguuauccauugccacauaucagauuaccucagaacauccugguuuaaaaugacaaauauuuauuaccucggaguuucugugagucaggaaucuggguguggcuuaacgggguuccagucgcccuggagguugcaaaugguuagccauggcugugacuucagcugaaggcucagcuugggagaagaaggggaaguuuguuuccaagccuacuggugggucacuggcaggccuuggcuccuugccauugggccucuccgcagugcugcaguaccuggcagcaccuucccugggggagugagccgagagaguccccacgaugaaagccacaggcuuuuuauaaaagugaccuucuaagggaccaccuaucacuugacuauauugagcucauuggaagugaguuaauaaaucuagcacacacuuaaggggaagggauuucacaagaaaugaaucauuggagcugucuuagaagaagccauuauuuuguuguuugaugagguaauuagaauugggcgguauuuuucagugagcuugccaaauuuuauguuuugaauacaaagauagagaaaguaaccacaucauagcuuugccuucauguuuuacugucccuucauaguauucccaguuaacuugaccaugaagaaauacuuaggcuauaguagcuguuaacuuaaauggccagcuuugucuuuuuuuuuuuuuuaaacuucuuuuuuucuuuuuuuuuucgagacauagagucuugcuccguugcucaggcuagagugcaguggugcaaucuuggcucacugcaaccuccgccucccggguucuagcaauucuccugccucagccucccaauuagcugggauuacaggugcccgccaccacguccagcuaauuuuuguaugauuaguagagacaggguuucaccauuuuggcuaggcuggucucgaacucuugaccuugugauccgccugucucagccucccaaagugcugggauuauaggcgugagccagggcacucggccuaccagcuuugucuuauucuauguccuugguagaaaggccuggguaagcuaaacguaaaaaauaauuauaaagcaagcacagaggagcucaugagcuaaggagcaugaaggauggauggcaagaauuugugauccuguacucuuaagcagcauuaguuuggaacauaaaauuaugguuauuuaguuagcuuuucccaccuuuugccaucuaucugaauuguucuuaggucuugucuuuuaaguaagcuuguuguggcagcauauuggcuuucugugccguguaauaaagcaccacagacuuagccgccuaaaaccuuguguauuccuguauuuauuauaucacugauuccaugggguaggaguccaggcauggcuuuuugugggucucugcucagggucucacaagacugcagucaagauuaaaggcucagcugaggcucaggcuucuuuuccaaguuuacaugauuguuggaaaaauucauuucauugcagcuguaaaacucaugauagcuugcuucuucaaggccaguaagagaaucucugaccuuggugaugaccccagucuuucuuuuaaagaacucaccugauuaguucaggcccgcugagaaucaugucacuuuugauuugcucagaguccuuaauugcgucugcaaaaucccuacaccuucuuuacguaccauaacgcaaucaugggagugacaucucauuauauucacggguccugccuucacuuaggggagggacgugggucuucuuagaaaucugccugucaugggcagauagcagccauuaauaauccagguucuacuuccuuuucuguguguuaggaacugauuaucuguguccccacccccugccaaaauucauacauugaagcccuaucccucuuuguguugguauuugaaaguugggccuuugggagguauuuaggguuagaugagguuaugaguauguguccccucaggauaggauuaguacccuuauaagaagagacaucagagagcucucucuagagcaagcucuuucuagggcauaugaggacacagcaagaagguggccucuguaagccaggaagagggcuuucaccuaugcucaaccaugcuggcacccugaugcugagcuuccagccccuagaacuaugaaaaaauaaguuucaauugucagagucauccaguuuacggugcggguugagaaucccuuaucugaaacgcuggggaccagaaguguuuuagguuucagauuuuggaauauuugcauugaauauaccaguugagccucccuaauccaaaauccgaaaugcuccaaaauccagaacuuucugagugccaacaugacacucaaaggaaauggucaauggagcauuucagauuuucggguuagaaaugcucagccuucugaauuacucuagaguuuggccugucuucccccaagucaaccuuguuauuagaauauguuucaaagggaaacuugggauuccugugagcuaugguacucugagaagcuagagagaauuccuaguaagucuugcaggcuuagagccauauaaaguauuacucgagcauuuauuuauuuauauuaauuuugagauggagucuuacucugucgcccagguugaaguacaauggcacaaucucggcucaccucgaccucugcuuccuguauucaagugauucuucugccucagccucccgaguagcugggauuacaggcaugcgccaugacacuuggcuaauuuuuuuguguguuuuuaguagagauggaauuuugccauguuggccaggcuggucucaaacuccugaccucaagugauccacccaccucgaccucccaaagugcugguauuauaggcaugagccaccaugccuggccucauuuauuuuuaaauagcugcaguaaucccggcuuuagauaaaccacaugaacuaauaauaucacuaguguucaaagguagaauuauauguguaccauauguauugcuauuaaauaaagucaaaaaaauuauaagguuugucuuuucucagcuuggugacguauuucuuuagcucuaacauuaaguauucucagccccucauuguggguuuuuaaacuuaauuuuuaauuguguucaguaugucuuaauaguuuaaaaagacaaauauuuuuacaaggcuucuaacaaaaagaguuaaauccugucccacuucuccccuacuguuuucuacuuuaacaguacauuaauacauuaaauuaucuucaguuuaaaauaacaugcuaauauuuuuuauuucuugauuuuuuuuucuagucuuaaucuuuacuuguagaauuaauauguggaagaagagaguuuaauucucagguccuuuauuuccaagaauuuuuuuugcauuuucucuuagguaacuuccucuccguuguuuugcuguuuuuuucuggaacuccuguuaauugaacauuggaccucuugacuugauccuccaauuuuuaaauuuuuuuccaccuuuucuucauugccuuaaucuuuuuccuuccugagagauuuccagcauuuucucaacauuguaacccuugugugaauuuuuuaaaauuuugccuauuuuuaauugcaaaagccccuucauguucacugggagcauauuuuuguaucauguaugcaacauuuuaucucugagauaaaauuuuaauuuuuuucuauuucauuguuucuucccuccccuuccuccuguucuccuuucuuagucuccuauucugcuuccuccucuccuuucucccuuuuucuucacccucuccuuccucuuucucugccuccucuuccuuguucucugcuuuuuauguuagauauuuuguuuaggugucuaaucaucccuagcugucuuauuuuagcaaggcacaagaaaaggugauuggaagcuccucugcuuauguagggucuuuugguggguuucacuauaggguaaugauaacauuuaggggaacccccauaauaucaguauacacuauauuuuuuucccucaggaugcccaguuaccuuaaagaaguccuuagcccauuuggccugggguuuaggggaggagugagcaagaagucuggccguagguauucagguaaccacaccaugcaaggggccuggagugaugucaugcagacucauuuuuaugucucauccuuuuuguauuaguuccuuuucacauugcuaugaagaacuacaugagacuggggaauuuaugaagaaaagagguuuaaucgacucacaguccuacaggcuuaacaggaagcaugacuugggagucccaggaaacuuacaaucauggggaaggugaaggggaaacaagacaugucuucucaucaugauagagcaggaaagagagccagcaaagggagaagugccaugcuuuuuuuuuuuuuuuuuuuuuugagacggaguuuuggucuuguugcccagacuggagugcaauggcgcgaucucaacucacugcaacaucugccacccggguucaagcgauucuccugccucagccuccugaguagcugggauuacaggugucugccaccacacccggcuaauuuuguauuuuuaguagagacaggguuucaccauguuggccaagcuggucucagacuccugaccucaggugaucuaccugccucagccucccaaagugcugggauuacaagcgcgagccaccgugcccagcccccaugcauuuuuaaaccauuagaucuuguaauaauucaucaucacaagaacaacaagggggaaauccacccccaugauccagucaccucccaccacaucccuccccugacacgaagggguuauauuucgacaugcgauuuggguagagacagagccaaaccauaucaccuguucuuugcuuuguugacaugucagcuuuucucugguucagcuugguuggugaaguuugggcaggaugugggauggggcaaugggagugcucuuauacaaauuuuccgccagucuucuuagucagaacucucuucuccauccauccauaacauguacucacacacauguucaguuuaauuuuuuucagggaugugcagguguuuagauauuuugcaguagucaauaaaaggaagaauuauuaaucacugggauucugacuaguugcaucucugcaacucuuuaguacauaguuuucagaaagcagcacaaugaagucuucaaguuucuuugauguagucgugcauuuauuuauuuauuuauuuauucauuuauuuauuuaugacagagucuugcucugucguccaggcuggagugcaguggugugaucuuggcucacugcaaccuccgucuccuggguuccagcaauuuuccugccucagccucccaagucgcugggauuauaggcacccgccaccaugcccggcuaauuuuuuguauuuuuaguagagacuggguuucaccaugcuggcuaggcaggucucgaacuccugacaucaggugauccacccacuucggccucccagagugcugggauuacaaaugucagccaccgcgcccagcugucaugcuuugaaaugaauuaaauguuuauagucuguuuuuuccacauagcccauaaacugcuaacagacuuuuauuuuucugucaguuuaagaucaacuguuaaguuaggugcuuugaacacuuuaguagccucauucucuaaggaugauauuccuaggcuuccuugagaaaccagugguaagcuacuuaugaccuaugguacucccaugagcagauaaaaguacaaaagugaauagaacuuuaaaaccuuuuauugcaaaauauacauacauaaaauacauaaaacacauauauacaguuuuaugaauaguauagcuaacaccauuguacccacccagaucaagauaaagaguauugccguacaucagaaacuuccugcauccuccuauaucacagccuauuucaacuuuugugauaaucauuccuuugcuuuuuuguguguaguuuuaccauaucuguguggcuacauaaaauauauuguuuaguuuugaacuuuacauaaacagucucauuucauucauaaaauuucaucauacgucauuuuucccuugguguugugagauuucagauuccugagacuugcccauguugucacgggcagcaaugauuuauuaaguuucauugcugugcaauaugccaugguuuguaccuacuacauucuauccauucugcugugauguguguguauccugugcacauguguguggaugucuccagaaugugugcauaggaguagaauugcugaaucauggagauaugucacuaggucaugccaaacaguuuuuccaagugcguguuuguuuguuuuuuaacuggacaggacaucuucuugaccaagugucuguauuaaaggacauuuccaggccgggcacgguggcucacaccuguaaucccagcacuuugggaggccaagcacuuuggaucaucugaggucgggaguucaagaccagccugaccaacaugucgaaacccccucucugcuaaaaauacaaaaauuagcugggcaugguggugcacaccugaaucccagcuacuagggaggcugagacaggagaacacagagguugcagugagccaauauggcgccacugcacagcagccugagugacagagcgagacuccuucucaaaaaaauaaaaaaaagacauuuccacuagcaguguauaacaaauguuuucugaccccaugaucauagagauauucuccuauauuucuaagaagugucacagcuuuucucuucuguuuguucuagaauucaccuggaagugauuuuauaugcuuaguuugaagaguucuguuuccuuuuuucuguaaaaagacccaguugucccaacaccauguguuccacaauuuucacucuaauuuuuaaugccuucuuuucacuuggcacccuucaaaauguggugagcuucugaagucucuuucguauucucuuugucccuucguuuuuggaugcuuccccgacuuccuuuauucuaauuuuaguagcauuuuggaaggaagcacaguaccuuuuucauuuuaccacauuuaacuggaagucauuuuaaaaaucaacacuuagucuuaaauauuuuugguuuuuaaaaaaaauaaaauaaagauaaauccaggcauaaugaaugacuuggccagauucagcaugguacuuagaugcagugacagccaaaggaaacugugcgugugcccuggccugugugaugaggcuggcaagacugaaaucauuuggaagcaaaagccucuaagagggcuucacugcaugguacccuaacacucagaugacacuuagcccguuaagaaaaauguuugauuuguuaggcauccucucuuuaagagagucagagaaaugagguguaauugguaauuaaaaagauuacguguaucauaugacaaucagucuuaauacauuguaguuacuguguuauuagaaccauuuuuaagauaccaaccuaaaauggucaaauguaaagauuuuauucuuagaaaaaauaacuuuguuuauguagaauacucaaauaugcaaaauaaaauuucauaauugccucauaaaguuagcuuuacucuaacuuggcuaaaguuagaucagauagcccagauuauaacuuuuaucugauuuuuuugguguaauuuuuguaacuagucugccuucgugguaaggaagauacauaguugugauuugagaaguaucugguuccauggaccgugcagacuuugaucucauuuauaauuaaauuaugucuauuggauuguuuuuauuguacuuuauguuuuuuuaagaaauugugauuaaauauaacuuaacgacuuucuauuuugcaguuauuuuaauuaguuacuucauuuaaucuuuuggcauuucaugauuuucuguaaugucuguacaaagaaguugcugcuagccaccuguguagugggacaguagugaauaaauacuuggaauuuaaaagcuagugacuacuucccuuuuuguuguugcagugcuuuauuguuuugccgugggcuguugcaaaaacauuaaaguucagaauuccuauucuuuaaagaagguucaguuuugagugaaaagugcuagcuuguaugccagcguguuugaaauuacacauucugcagacauccaguugauuuggaagugauuaauggcacagaggccuucaaaaggucacuauuuaguauuagcuccuugaagcucugugaaugauuguuuuccucuauuuaguugugaggaaauuucauccaaaaguuuucugccugggaaguaauuggaugaaggacauggggaugaguuaaagguauugcacaagugaggauugaugaggcuaccagcucugaguguuucaaccuugucauuuauacauauuuaaaagcugguuuugaugaccacgguuccaugauugcaaagaauaugaauacucuacauuuucuugauugaucauucauguugguugaugcucaguucacuuuuuuguucacaagaauaagguagagauuuucuuccuuuuacagaugaaguagaagccuguggguuccuucuaguuagugauagaguuuggauucagagccagauuuaucugacuuuaaaucccauauccuuuauacagaauuuuugguuuccaugauagaacuagguuccaguuuucaacuuuccucuuguucaggcaaguaauuugauuucucugcugcuuugcuuucucuguuuguaaacuaggcguacuguuugcaucgcucuacuaaaaguuuaaaguguuuuaaaacacuuugagaucguuuaaaagauuauuacaagauuuuagcaguuuauugagauaguguauguugaaagcacuuuuuaaaccaugaagcauuguauaaaugaagguauuauucuaguugaauuauuuauggaugagaaaaaagaagugauaaagacauuaaguaacuacuuagaguauuaaacacguuguuguacaugagcauccuuauccaauuuaagcuuauuagaguagaaguaauauacuuuuuugcucaguaguguaucauuggaauuggaaagcauuuagugaaugaacagguuacucuuuuuuuuucuguagauuccugcaagcuggacaaaucccucaggcaaauaucauauuggcauaaaaaauggcuaugacuucuauccuaaggcacucaaggaaaggauacagguaauguacaaucugguaccaaugaguuguauucuucugacuugucuucuuccucagauuuuauuccuacugaagaaaaagaaauauuucauaaaaucucauuaacuuaguuuuuugggugguugguggcuuucaaacaaugacugcuuaaagauucugcucaauggaaugucauccguguaaacuugugauucuugaucuuggguacauggauaaguuuagggaaucugugaauacacugaaauuauauucagauuuuuguguuuuucugggagaugggauauagcuuucacuggauuuuugaaggacuuuuuuuuacuugaaaaaggcuaaagacaguggauucaaaauccagaccaccuuuucguuucuguuccuguaguuucugugauaaugucccuccccuguuuaacuagccuucuugcucccaguuagucaucauuuaguguuaagguaaguguuaauucaguccuaaaacugcugaaguguaagaaguaccagugugccauuagaaaaauaagagugguaagcagaaugauaaagagccugcuuuaaaacaguucaauagaacuuucugugauaauggaaauguuugaaauguucaguuucugcucuaaccauuaugguagucacuagccauguugcuauugagaauuugaaauauguuuagugugacugacgaauugaaauuuuaucuuaguaauauuuuaaaauuuaaguuuaaauagugucauguggcuagugacuaccguuuuaagaaugcugauacaaguagcugauacaaguaccuaauacaaguccaggguugcagcuguaaaauaagguauaauccugggaagugagcuugauggauaagauguguggggccuugccucugucguguuauuuccccaagggccugugaagcauaagaaguuacucagauuaccuuauuugucaguuucuaaucauucugcaaaacaaacaagaauaaugcguauaacuucuauuacauaauauguuauuuuaaaauuucaggcuggaaugcaguggcaugaucacagcuaauuacugccucaaccuccugggcaauccucccauguaguugggacuacaggcacgcaccaccacacccaucuaauuuuuguauuuuuuguagggaugggguuucaccauguugcccaggcuggucucgaacuccugggcucaagugauccgccugccucauucucccaaagugcugggacuacaggugugaaccauugcaugacugcauuuuauauaguauauuaaauguaaucagcuguguugauaagaugugauuuaauaugcaaauauaguguuguugaaguggacuguuccuuuagcugcguugggaguuaccgugaguuaaagacacugaagauaaagguuaaaaccaauuucagugacauagaacccuaucaagucaaagaggauggaaaaaaaaauagggaggacauugaggaugccugcauugucugucaaaaugcagcuguagucuuacucuaguccucugcguacacuaggcuuauggcauuucccaauuuuguaugggcccagaauacaacauuuucuuccuuuuaaugacugggaauucagucaguauucuuggagaagagaagguuuuaaauuggggaauaugauacauaaaaauacaucuggaugugucuugguaaacuucucuuaaacccugggugcaaugaauugacuaaccaguuuuuaguaagugauccauggcuuuaucugcuucauuagaaacuuuuuuuuuuuuucucuuugagacagagucuuacucuguugcccaggcuggagugcaguggcucaaucucugcucacugcagccucagccuccuggguucaagcgauucucgugccuuagccucccaaguagcugggauuacaggcaccugccaccccaccuggcuaauuuuuguauuuuuaguagagacgggguuucaccuuguuggccaggcuggucucgaacuccucaccucaggugauccgccuaccucagccuuccaaauuguuaggauuacaggcgugagccaccacacccggccaaaaaugauuuuuuaaaaccucucuaugagaauuguguaguaucacaacuguaccaacaaaguccacauauaaaugccugucuagguuuaccugaguauuugucagccuaauuguaagguaauuuuucugucuuugcagaaagaacggaaggaaaaaaucugggacccuguucacagaguggcccuugcagaagccuguagaaaacaggaagaauuugauguugccaacaacggcucuucucaaguuggugcuagucgauuucauuuaaacauuacccuagaaccauauucccauagaguuucuacagaacuaauagacuguuuuuccacaaguuuucuuuuuucacaaauuuucuuuuaaguugguuaauuuuacuaauuuuuccuuuauuauuuauccucaagucaauguacauauguaugaauuuuuaaaauuuaacacauaauacacguaggguaaaaguacauaaauuguguuugguuaugaauucucccaugaaagcugcaccuaggaauuucucuugugccccuuccuugucacugcucccuuuuuccuuccgaaagacaaccaccaccuugacuucuaacacugcagaugauuuugccuauuuugauuuguguaaaauggaaccauauaguaugguuuuguuuuuuguuuuuuguuuuuuuuuuuugagacggagucucgcucuguuccaggcuggagugcaguggugugaucucggcucauugcaaccucugccuuccggguucaagcuauucucgccucagccuccugaguagcugggauuacaggcacgugccaccacacccgacuaguuuuuuuuuuuugcauuuuuaguagagacaggguuucaccguguuggccaggcuggucuugaacucccaaccuugugauacgcccaccuuggccucccaaagugcugggauuacaggcaugagccaccgugcccggccuauguauucucuaauuauauguauuauugucacuuuuaaaaaggguuucaaaauacuucauuuuucaguuaauauauuagaccucaagguccuuguuucaaaacaugggaggguguaguccuugguucccauauacugauuuguggaauugauacugaugaacugauuaucucuaagucaccugaauuauuuuaaaaguaauuaaguuuuccgggcuuuauccccugauaauucugauuuacuaagugggauuagaaacagcaucgauguuugugauagccuuuacaugauugugauuugcgugaaauuuaguaauuauuggccaagauaauaauuugcuauccuacuaguuucugaugugacagccucagauuaucauaaggacaaauaacuugcucaggauugcacagcuaaguugcugaauugagauuugaauccauauuucuucccucuagguuaauacucacaccacacuauuuauagaaggcagauugauuuuaagcaauauuaagugcuuuugaucaaagacgacuaccuuuuucaauaaauugccaaauaguaaauauuuuuaguacucucuuaugacugcucaacacuccccuuguaucaugaaaaccuaggcaauauguaacugaaccaggaaggccauguuccaguaaagcuucauuuacacaacuuugucacaggcuagauuuggcccaugcaccaugauuugucaaccccugcuggaucuuaauauaguaacauagucuagagauauucgucucaauuucaguauuuauaugccuuucuaucucccagcuuauuucuguuuaaaccagucauuuuccuaauuauuugaguaccuaacuuauuuuuuuauauacacucuagguuagagaaauguuuuggagagguaacaccugcuagugccaguuguugucuaguguguacguaaucgaauuuaaagcacuugguuuuauucaugaccacagagcuaaaauaaggcuucacuuacccccauuaaaugcuucuauuuaacauagcaguuucuaaaagauauaagaugauucauggguuuuauuauuuauuuggauucuuaagaaauaaauuugagauagaauagguccugauauaaaaaucuaaaagucaauagauaaccuauuuuguagcaguuuuagaguugcuuuuggaaauaaguuagauaacaaauauguaacaagcauaucuuggcuaaauggaaucaccaacguguagcacaguguauuucccaaagcaggccuagugagugaauaaaugagauugaguaaaauaacuguuuuuuagaucuuuauuaauuagaucuguauuaauggguaucugcuucauugaauugaaugacaaguugcauagauagaacaaaauuuucuuacauuuuuucaggguaaaauaauuuuacuauggauuaacauuguaucuuuggcuguauguuaauacaacuuuuagaaggacagaauguacuaauguuaaucaguuuuccaacugacuaggcaaauaaacuaaucaaggaggaacuucaaagucaaguggaauugcuaaauucuuuugagaagaaauacagcgauccuggcccuguauaugacugcuugguauggcaugauggcgaagucuggagguaaacuucguguauuuuauacaucuucauuuacaaauguuuucuuuucuacucugaaaaacauuaaaugcucagagcugcacagaauuuugguuuauucgugauaucacucagcaaaaucauuuaagggccaaauuggcaucuggguaguuuuggacaagccccuugaacuucuaguuauaauuauugacacuaaaccugacuuuuaucugauuuaaauaaacuuacuucauuaauaauuuauuaguauguugaccauccguauauuuggaaauguuuccucauuuguuaauugagauaguggugcuuacagggcuuugugaaaauuaaauuugauguuucuagauauaguaagcaaucaauguacgcuguugcugcugcuguuucuauuacuaaaacuaauaauaauaaugcgauuuauaccaaguuacccaucauguacguuuuuuaguuucuuuuuuagugccuuauauacugcauaugugcuucuuggaguugauuagucugccuucuugaguuacuaucugcaugaaaacaggaagacauuguuaauacagauauuuagccauaugugugcuuuaggauuucugcaaaaaaaaaacaaacaaacagggacuauuucuuaaacuuguagucaagaauuacuuguagucugcgucccugcuuauacacaaagaauugcaucacaagguggggcacacacagaucaugccaugacugcuuccucacugcucucacaauuguucaccuucacagugcacccuucuuaaaggaggguucuccucccacgugugcagguacuaacucaucuuucaucaaagguguaugcaauguuaaguugaaugagaaauuucugcucaauuuggggaugaugguguuaauaaaauaacugcacauaacucuuucaaucuagauauuaaauauuaaugcacuuuuguguguauucauacauguuguuuuguugugugcauaugcauacacguuuugaaaaauuauuuuccagaggcuuuauacagaauaauaaaccuugauacauccaccaucugggguaacaugauacagucacacucagugauaagccuuaggugcguuuuagugugggaaaggaggcaagguuaaauucaaggaaaaugcuaaauacgaaacagaguauauuuaggaaaguauauacuacaaaagaacuuaaagaaauacuaaaauauuagcagggauugaguagugaggcaauaggugguuucauuuaaaguguuugcucuagguucugaaaacacugcagauuacuuugucuuaggaaaaggaauccggagucaggauguccaggguaccaguguguguuuccacaagauuuccuuggucuucaaggugcuugauaaagugacucacuuguagcaguuuguugacaacuauucuaaggguuuuguuuagaacuuuugaguuagaaaugaaauuuaaucuaacauuaagugaaauaaaaucugaaaucucagaauaacauuuuagaacauuuuauuauaauaaaugaauauagcauaauuauacuuucaggugguacuagauauaauguaacuuuuuugcauaauacaguauauccuauagggcuuugaucucagagauccaaaauuuuuugaagagaaccuuguagaucccaggguacauaagguuaauccaguccugucugcagauguucucauuucacauuucaaaaaugccaaccauuucugaagggagguaaagugaccuauucuuuaaguaccguggguuuuuuguuuuguuuuguuugaugacgaauguccagucugugcucucccugccacauuucugcuaauuguuuagcgcguaucucugcacuuaacggguggccucagaugacucuguucugagcaucugucaggacgcagagccucagacucauugucacuccaaauggaacaaaaacugguugagagaaacaguguuuacagaggauuacauaaaggagaagcuauuaguugauuucuuuacaguggauuuugaccuugcuuaugucauguuuccuuuuagauucuugaugaaagcucuagauucuuuccacagaaaauugagagaugugugaaaaugucgagaaauacauaaaacaaaagccuuuucucucauccuccccacuuacauguacccugcucuguguaugagccucauuuugauauccuuucucuguauucuagcugcuacuugaauucagucaacuagaccuucagaaaguuauaaccuugcaccacauucauacuuguccucugucguguuauuuagagaagucaguaauaauuuauguuuugauguguugguuguauuguugagucauuccaaugauggugguuauaagaaacugaccuguggaaugugucacuguauuugcugugagaauguuguuaaggaugaugauuucguuaauuccuuaaucauguggcagauguuuauugaguaccuucuuuguaccagguugacaccauagaagcuacuccauggacucuagauuccauggaagcaaguguugggaacgucugaaccagucuaggaagaaucgagaaagauuucccaaaaguauuaauaacaucuuacauugagacuugaaggaucaucacaguaaacuaagcagagagguagaaagggugggggaaagauccagaggauguuggaggaacugugagaaguuugguguggccacagaggauaugaugggagcaggaggugagggaggugagcagaugauuauuaggggcauugcucuggaguuucaauguuaagagccguuggaagacauggaagguuuucagcaggagucaaauguaggggcagagcaggccaucagcucaucaggcaacagcgguaaggaagagacaguggaaauaggcggacacauuauggagaugggacugugcgguuagaugggcugggggaagaacagagggaggacuuuguagaugacuuccaggauggaugcuggccgauugcauaaauuuuggagacaagugcuacuucuguagcauguggaagauuuggugacaugcauuuuacccacuaaucucaagccugauucuguuuaauaugugacuuguuugcucuuugcuucauuuucuccauaaguguuuaguuuccuauaccuucguauauucuauuauuugaaauuacaucagucauauuagggcaaugcauaaaaacaaauuuuuaagaauccuuuuuuccaaaguguuguaauuuguuaaugaaauaugcuucaguauuuaugauaaaucaucucucugugcucuaccaguaggcuucuauuaauuuacuuggcaauuuugacugacuugcauagcuuguuaaaauacaguucuugcauuuaaaacauacuuagagcuaaaaacauaauauugaacuuuuaaugauguucauuucauuuaugacuuuuugaauauuaaguguauuuuguuuuaaucaggcuaucuucuaaaguguucggaauauaauuuaaaaacuauuuuaguuaguaaaauggaaaaaacaugaaggaagacaaccauaaaguaauguagaaaaugccuucugugagaaauaaauuuaagucuguuauaacuauaggacugaagcucaguaaaauucaccuaguuucaaagagcuuguguaagccguuagauucuugaagccauuacuaaaagaagcagcuggaaguuagaccuaggccaugugucugaacuauccuaaacugcucuaaaacucuaagccaaguuuuagcuguaauucuuaagaguccaggugguuuuuaaccuagaguuuugugaaggaggguauuuuuaaagcacuuugugcaugauuuaagaacugguugcuguaagcuaucuuaccuaauccuuacugcccacucuaagaaacaggcuaaaccaggcagucauuauauuuauauuuguugugguagagguaguaguauaguaaaauaguggagagacuauguuacaugauuuuuagaaagguaagaaaauaaauuuuacugucuccauuucuuuuuaauuaauagagccugcauugauucuaaugaagauggggacuugaguaaaucuaccguguugagaaacuacaaagaagcccaagaauauggcucuuuuggcacagcugagauguugaauuacuccguuaauauauacgaugauggaaaccugcucuccauugugaccaguggagguaucccauuucagauugaccaaugagauauagauuuaugaggugauaaagugguacguugcgauagcucacagcaaccuucuagagaauuuuaagcuagagaucguagcuaaaggacuagguccagaaucauaaaggugauuugauuuaccugcaagauguuguuuuuuaaggucauaaccaugugggauccaguccaagaauauaaaagcauguuccaacaucagaaaauccaucaauaggcugggugcaguggcucaugccugugauccuagcaccuugggaggccgagguguguggaucaccugaggcugggaguuugagaccagccugaccaacauggagaaaccccaucucuacuaaaaauauagaauuagcugugcgugguggcacaugccuguaaucccagcuacucgggaggcugaggcaggagaaucguuugaaccuaggaggcggagguugcagugagccgagaucgugccauugcacuccagccugggcaacaagagcgaaacuccaucucaaaaaaaauccaucaauagaauuuaucucaugaacagcaauuuugccucgaaaucuuaacucuugagaaauucacccaugaguacagagaaucagauaaaagaauccucacuacggcacucugugugauuucaaaaaaguuggaaacuaaauaccuauuaacaaaaaaauauauuuuuuaaacaacuguguguuauucuuacugugaaauacagucauccuuugguaucuggggggauugguucuggaaugucccucagaugcucaaguaccugauacaaaaugacauaguguuuguguauaaccuacacacaugcucucccaugugcuuucagcaucucuacaugacuucuaauaccuuauaguauguaagugcuauauaaauaguuguuauacuguaguuuuuuaauauuuauauuuuugauccgugguugguuaaauugcauguaguuggugcggaaccuguggauacagagggccgaauguauuauauagcaaucaaaaugcuguguguauaaaccccuaauacauaaauuauauugaaaaaauauguacugaugauaaaacuuguaaaauucuaaaacaugccgaauaguacuaugcaguguuuauagauauguguguuuauaucgugaaaauguuaaauauauagauggaaagauuaugcacaccagcuccaggaugguggcuacuucugggggaaguucucccucccaggguagggggaaaaaggagaaugaagugggaugacuuuaacucuuuaacgucccccuccuaccucccaguucauugagguauagcuuaaguacaaaaacuucacauacauacauauacauaauuugauaagcuuuuauguaaauauaucaguauauccaggaaaccaccacaaucaagguaaugaacauacucauuacccccaaaaguuugcucucucuauuauccagccuuucuccacccacaucccggggaaccacugaucuguuuucugucacuccagauuauuucacacuuuccagaauuuuauguaaguggaauaaaaaauaugguuuucuuuccuucacucagcauaaugauuuugagauucauuaauguuaugauuauaaagcuggcucuuuauuucugaguaauaguucuuuauauagcuacaccacaguuuguuuauccagcuucccauugauggacguuuagauuguuuugguaucugucgacauauauuuuuauuuauuuuugggcugauagcugagagaaccaguuggauaugguaaacauguacuuaauuuuuuuuuuuccuuuuuuuuuuuuuuuuuuuuuuuugagacagagucucgcucugucgcccaggcuggaguacagguggcacggucucggcucacugcaaccucugccucccagguucaagugauucuccugccucagccuccuggguagcugggauuacaggcgcguaccaccacaccuggcuaguuuuuguauuuuuaguagagacaggguuucaccauguuggucaggcuaguaucaaauuccugaccucgugauccacccgccucggccucccaaagugcugagauuauaggugugagccaccacgcccggccacuuaacuuuuuuuuuuuuuuuuuugagacagagucucgcucugucgcccaggcuggagugcaguggcgcgaucucggcucacugcaagcuccgccucccggguucaugccauucucuugccucagccucccaaguagcugggacugcaggcgcccacuaccaugcccggcuaauuuuuuguauuuuuaguagagacgggguuucaccguguuagccaggauggucucgaucuccugaccucgugauccgcccgccucggcuucccaaagugcugggauuacaggugugagccacugcgcccggccuuuuuuaagaaauauucaagcuguuaccuaaaggggcuguacccuuuucacucccaccauggugugugagaauuccaggugcucuguauccucagcaacacuugcuguggucagucuuaauaguggucauucuaacugguguaagguguuuugaaggaaaaaaucacauuaaacuugugcucucccaauuuuaucuggggaaagaaauaagaaagccagaauccgcaacauugggcgaauguuuucuugcaugacagcagcuggcuagagcagaggagucucagcauugcugcagacccuguuucaaagccacauagagaugccugccuacuucuccuggagcuccaacacacuauaguccccaaacauuaaggcccagugccaguugucauuuaucauugugcuuguauuauuguuuuucugagacuagugggauauuucucuauauucaugucuuuuaagaaacuuuuucacuaaaaggcuaguuuuuuguuuuaguauuacuuuauauauaacauguacaaaaacagauacaaaucacaaguuguacaacucuuugaauuaccacaaaguggacacuucuuuguaacuacaacucaggucaagaaaugaaacauaaugaaacucccaucaugccccuuccuaaucaguaauguacccucccaccuccuacaguuaacuacuauccugaucuccauugccacauuaguuuggaccauaugauguugcuguuuuugugaucggaaaugauaaaauaguggcaguuucagaugguucagccuuuuuuucauuuauaugaaaauucaauauccauuuuuguaugugacuucuuuaguucagccuuauuuuugugagcuuuaucucauaguacauaguaguaguuuauugcuguauaauugucaguucuaugaauugauguacauguaaccauuuacuguuaaugaaucuuguggugguuuuuaaguuuuugaauuuuauaaacaguguugccaugaacauuuuugugggugucuuaguuacaugugcacacauuuugguauuguguguaccuagagguaggauggcuggcucauaggcuguggcaguguucagcuuucacuccagccagcaguguaugauauguacuuccauccacacuugcuuugucagccuuuaauauuuuggcaauucuaaaagguacguagaagcaucuuuuuguggcuuaauuugcguuuccuagaugacgaaugaaauuaaacaucuuuucguguguuuauuugcccuuuggguaucuucuuuuauaaaaugcuuuuucaaauguuugaaggggggauucucccuuuuuuuauugugaauuugaaagauuuuuauauauucuggauauaaagcucuuugucagcuauacauguugcaaauacuuuccuuugugacuugaguuuuugcucuccaugaacaggguagcagaguaauguguauucuuuuuaucaugauuaauaauaugcaaauugaauugaauaaacuuucaguccaugagaauguuuugucauuuccccaccuuugugucucuaggagcucaugggacacauguagcuaguauagcugcuggacacuuuccagaagaaccugaacggaaugggguagcuccuggugcucaaauucuuuccaucaagauuggugauacaagacuaagcacaauggaaacaggcacaggccucauaagagcugugaguguuugugaguuguugauucagaagauuaaugauuaaugaucuuggauauuuuuagguuuauaagugcuccuaguuuaccaagaauacauugaacuauauauaguguacaggacuuuuaacaaagcaaaaauauuuacuaauuuauuuuuaaauuauuuuuauuaaauauuauuaggauuuggccuaaccuuugugaaaaaauuacuuacuucauacucgucauuucuagcaaaucuccuaacaagcaauuuugagauacuuaaaaagaaagaccucuuagccagcuuucuccaucagccuaagaggaauuuaaaaccucagcuaacauucuguacgucauuuuaacguaggaaaguauauuuaauuuuagugauuuuuuaaccuaggaaggaccauuccauucccucuaccucugucccccucuaaccccacucuuuucuagaaaugcuaguuuuuuguuuuuuuuuuuaaugacuacuuuuuuaugugucuccuccuaccuuuuuguguuuaugugcuuauauguccagguauauggugauaugccuggagguaacuuauaaauuagaauaugauuggcuaagaaacuauaggauuauauauaugcccuuauuuuacuggcuaaucuguuucuguaaauugcugccuaaacuagagucuuaaucucuuuaauagaugauagaaguuauaaaucauaagugugaucuugucaacuacaguuacggagaagcaacucacuggccaaauucugggugaguguuccuugacaguuguuuagccauagaaccuuagccagugaagaguaugagauguuuuucauaaguggauugagugucacgguggaagaaagaacaguugcagugguuagaugauaacuguguucaagaggacuuucauccucuugaaguccuguuuggcucguaggccgcacacccccguuccuguguucacaucugugacgauguuaaugcuguucacugcaccaugccugaagucucaacucugagcaugccugugcuguccuuuguggcucuuccuugguuaggucucccucacaguucuucugagauaugcaacccacagacucugguguuuuuucacugucagaugcacugcauccucacuucucuucccaggcaauuuagaucugacaaucugucuaucauuauaauuacuaguuccacaagcacucugaagccauccucaguuguauauacauacccgacagacgcccagacuugcugaaauuuugcuauucucuuuagugacuugcaucucaucugcaaaacuuacuguugguugcguauguucacuaacucggucaguuuucacaucuccucaauccauucuagugugucuaggaugcacccccacuccccuccuuccucguuggcuucauugucuuucugcugccaaauccagugucauggccuugaccuaauguuaccuuccuuuuuuucuucauaguaguagcuauuugaaauuaccucgaguauuuacuuguugaucaucucucccccauucccaucaccaagcuaucaucugguuuuugagacaucacuuuacgguccucguaacaugcacccuguuaucaugagucauuucauucuucccucuucucucacuucuuuauuuuacuuaacuguauuucuuucucuacuuuaacuuucauccucuugaagcccucuuuugcuaauauucuucccuuucucagauacucacacuuacaacuuugaaggguccugugcauggcucuguaccuuuuuaauguuaacuucauuuucuucuucaugguauaaccucaucuccucuacuuaaugucaguauauuuuucuuguuugcugucaagcucuaagcagguuucuuacacuuuaaaaucuugcucuuaaguucuuccuagugccuuaguuaccuuuuccacaaaaguuacugguucuuuuggucaauuucuacucauaauuguauguacgaaucuucugaggugugucuucaggacuauguuaacugggggauggaaauagaaccaccuauugcccgagucacuacuaauauuuuacuaccuuguaguauauuuucccauauauauuguuuugcaccuagcacuuuccccacguuuaauuuggccuuauaacugcuucccuacccuaaagcccaaguaggguauaucacuuagaauggcuguaucauguuccaccaaggguggauguaccaaaauuuauguagccauauauuuaaacaagguuuugguacuauauacacuuugggaauagaggcugauuauauguucaaaggaauucucucuuuuucaggagaauuugugaaguaauuaaugaagcaguauggaagcauaauauaauuuauguuucaagugcuggaaauaaugguccaugccugucuacaguugguuguccagguggaacuacaucaagugugauagguuaguuuccuguuuuagaaauagauuuguuuagaaacaagcaaacaaaaaacaauaguuaaugaaauguuaccuguaucucugcuacacguaagacacuguacaccuuaaguguguccucaggaaacuuauagucugguaggggaaccagcacaucuagaacugaccguaauuuaaaguggacugaaauaagugguuucauagaaauacacaugcaugcuuuuaggugcauuagcauauuuagucuaaaauauccugggauaaauaauccugggagauagguauuuuguauccaaaagcaaaguucuuaguaaaauguaugguacauaguagacuuuccuuguuuccuuauuaaauuuuauucuuccaucguauuagagagaggacugguguugagagauuaggcaguuuacucaagugaacaguggauuuggaaucaggauccccguuuguuuucuuuucuuaaugauuaaauccaucccacagguguuggugcuuauguuucuccugauaugaugguugcugaguauucacugagagagaaauuaccugcaaaucaauauacuuggucuucuagaggaccuagguaggugcagguagaacgcggaaccauuacguauauucgguuaaacuuuacacuguugagaagggcagaguuuuagauaaguuugcuaguuuuuuucuguugguuuuuacuuuuuuuucaguauuuucauuuugauuaacagucucaucucagggacagauaaauaaaauaaaugaaauaguuucauuguuacauggagaacaucacuauucugaguauaaauucuuauuccuauauccauaauucuucauuuauaagaaucuaaagaaaaaguagggacuuggauaucuuuauauaguagugauggccuuguuuuaaauaguuuuugauauuugaacuuuggugaaaugaaagcccuaagcuuuuauaaagcaucacagucauagggcccacguaccuguggcucaugucuuugaaguuauaacuuacuuugagcaauuuugggugagauccaaaaguaaacaaguucugacugagaaaugaagucuaucucuuuugguucccugaagcccucugaacuacauuuaucugauucugugaacugauuuucugaagagguauauuaaguccuaauuuauguaauucuucguuauaucaucagcggguacaugcaccuucugaaaaauaaagccuauuuuaauucaucuguuuggaguuaauuuauaaaaagaauagacuuugaauuuaguucagcaaauaccuuagugccuacagugggcaaggcauaaacgaacaguuugugaucugaguuucaaaugccauuuuaguaugaugggacuccagaggugggagcaaucacuugagcccuucauggagaagacgguauugaaguugaccuuaaaggauggauaggauguugagagacagaagaaaggaguucuauaugccaagaauaacaugaacccaaagaugagcagguuucaguguaaaguuuuuugaggacauaacuaguaacugaguauguuugaaguauaagauuaguggggaauauuggaagauaagauuagaaaaauugauugugcucaggugagaugcaauaauguuauauucuuugaguuacagauaucuuccucauuuucucuaggugguuuccucuuuaaaaaauaaacuuaucuuaguagcuuauuauaaagugucauugaaaacaaccaggccguggauauccacauggaucagaaagcuuugcuuugcgcugucauuguagacugccccugccagcccagcuaaagacacucaauaagaguggcuuaggagaagagccaaaagucagcaaagcuugauguguuuuuguucaguuaauaaaaguguaaaauuauuaaacuuauucucuucuaaaacugaguuuggaauuuuaaguuuuaucuuauugucaauguaaaaacaaaguauuagagaauguuuaaaccagccuuugccgauacucgccauagagcauuuaaagaauuauuuuaagaaaacaccaaggaguucaugaauuaugggggaagcuuggauuaaaguagauacugauucacaaagcagauguucuaagaauugaauuuguuucauuuuucauaaacaugaaauaauauuagaaauaauuugcuuuaauuauuacauuagaugguauaaaauaugaaacauugauuaauggucacugaacagagcauguucuguaaucuuugaaaaacgcugccucugcaucagcauugacugagacacacagcaacuacugacuuccaggcauuugcacguguggcauauuucuuaaagacguauuaccaaaugucugggccgggugcaguggcucacgccuguaaucccaccacaccacuuuuggaggccaagguaggugaaucacuugaggucaggaguucaagaccagccuggccaacguggugaaaucccaucucuacuaaaaauauaaaauuuagcugggcaugguggugggugcauguaaucacagcuacauaaacaggucgugaaauuuuauuauauauuguaauugagaagaaaaauauuaacuggcuuuuuuugaauuuuaaggaaacauuucuguuucaugagacuuuuuuuuuuuucuuuccugaaacagagucuugcucugucacccaggcuggagugcaguggcaugaucucggcucacuacaaccuccaccucucagguucaaccaauucugccucagccucccaaguagcuggaauuacaggcgcucaccaccacaccggguuaauuuuuguauuuuuaguagagaugggguuucaccauguuggccaggcuggucuugaacuccugaccucgugaucugcccgccucggccuccgaaagugcuggaauuacaggugugagccacugagcccagcugagacucauuuuuagaauacugauuuaaacaucuagaaaugcuuuaucauuuaccacuuuaacaagcuaguggaaaauuaauaaagagcaauaaguagucagaauucaugacucuuuccaguuauuuuuuccaaugcuaucaaauaccaaugcucauucugaacaccauuaggcaauacagugcaaacaagaagguagaaaaucacccuaaaccuuguuaucugugauaugugcaggugacauauugaugaacauccuuuuagucauucuuccaugaauuagugggagaugacacuguucaggcacuuuuguagccuacuuguuauucaguauuacauugugagcaucuuuacaggucaacagauauuuaccuaguaguaauuguucuaagaugguuccuaaaagaggugcugucagcccauuucaagaggaauauauauguauugcuuucaguucucuauaaaaaauguaaagccaaauugcucuaguguuucuacccaagaguaaaaauaguucacucaguugggagaugguauaaggagagucuggcagccucuguggggaauguauggccacuuagccagggaggcggaagugugcuauucugugccauuccuucuuuacuuggggcagaggacagagcuuuguuggaugauaaugugguuaugaauucugaggguuuuaauucaucagacuuugcuuguuugaagcccucagcuggacaguccuguuagacuucagcuguccaguauggcagcagucagggacgugagguuagucugcguuaagaugugcuguaaguauagaauguacaccaaauuucaaagacuugguacaaaaaaaacaauguaaacuaauucauuuuucuuuguaucuauuaauuacauguugaaaugcuaauauuuuugcuaugucuaguuaaacauacuaaaauuaauugcauuaaugucuuguuagcuuuuuuuaaguguggcuuauagaaaauguuaauuuauauggcccacauuauauuucuauuguacagugcuauauuagaccuuaaacagaaggaaaguuucuuauuacagauaagagagauguacacucaucaaagagucagaacagugacauuuauuuucucucucuaaauauaccugacacuguggccugucacacaugcccagauauguauauacacacagacauuucuguacacuuacaaggaaaaaauaaaugcugccuaugggaaaauggcucugcuggguguuuucccccauugauucuucauaguaguaucugugucacuauuuguaaugagugcaguuaguacauaguguuauacuauuggauuuaaccaguggucgucuuaaaaaugcccauguauguuuagcuuucaccauccuaagcaaacuucaauggcuuuccauuuagugcugacggggcccuuggugugaguaucagugcgccaggaggagccauugcuucuguuccuaacuggacacugagagggacgcagcugaugaauggaacaucuaugucuucccccaaugcauguggaggcauugcccugauccuuucagguaagcguguucuuuauuguccuuacauuauugcagaccaauauuuuuguuuucugaagcucucaugguaagaacaugugguagaauugauaauucccugggcacaaaguagaguuuaagguaacgaauaacuuaugugauaaugauaauuugaauguguguuuauucagcaguauauuuguuggcuguccgcuguuaacgacugucaagcaguauuuuagcucuggggcuaaauuagugaacaaagcaucaaaaauagcugccuauguggagguuacaucauuauauauauuauaguugggauaaacagacucugaacaaaauaaaaaacuguagauguugcauguuagagguuaauggaugccgugagcaaaaugagguagaaagagaaggagggauuucuagaguggugcacaggauuaaauagaguggcacugggcuuagccaggacucagauuuaggguagccaggcugcugugaagcucccuccucagaaacgucccucuuuaaguugucucuccucugccuccuuucuuccccgcuuuucucacccacaccacaguuucuucugcucaccacaucuccucagcauggccuguccacacuggugcuaucagcauaagccugugaugauguaccacuucaagugcuacauccuucucuagguugagcccacacucuuaggauggauccuaacaugacccucuuucuaguucucuucagccucaccagguauuucaaggccucuuggccuccaucuuuggguguacugcacucugccucgaaguccugucugccauguuguggccuugcagacuccuguacauucucuaagaggcggcuuaucugucaguuccucugaugucugacaauaucaucaauguuuauguguuuaaugagcucuggagaggacaagaaugauacagcacucaucuuaugaauugguggccuccauauucuucccauaaaacaguaauucccaaccuggcuguacccuagaaucaucugagaguuguuuaauaaauaacaaucucugggacaguccucagagauucugauuuaauuggucugucaugagaccucagcaucuuuuuugcuugaguuccccugggguuuauaacauacaguuggguugaacaccacagccaacagccaucuuguuuaacccagcaguguuugaaagaaaaugucauucacaugcuuuuagauaucugcuuuguacguuuauauuacgccacaaagcccacaccagucucucugcccaccacauaaugagaacacagugauuuuuguggaaugaagccuucauguaaugcaagcaguuugagucagacuguuuaguucaggucuucaaaaaagauuuuaaaaugaguguuagaacacaagacauuaacaccagagggucuacaggugaucgaucauacuggugggcggcuaagguuucagauagugagugcuacacuacuuguuuuuguuucuuaauuuuaggucugaaagcuaauaacauugacuacacaguucauucagucagaagagcucuagaaaacacugcagugaaggcugacaauauagaaguauuugcucaaggacaugguauuauucagguauuguugccuauaugaaaaauggguuguaaagcaucauugagauaauaucuuagauauuauuggguaauauuuuguuuuauaacagugauucaguauaucugaauuauggauuauauggccauagaacuacaagcaaaaaggauacacaaacaaauuuuguaguuaagacaaaucuguugcacuaagaucaagaaauguaauagauggaggccauguagagguuagaaauucaaagaaaucgaggucaaaaacuggccaaucauaacggcauagggauuaguuccuaaauuuggucacuugagaauaacagugugaauagaguggaguggaagaugugacugguguuguuucuaaaaauguagaauuguccucuuaguugggguacuagguaguuuugagaggugaauauagacacuaacuuuuuguuuuacaacugaaaucaaauugauugguaauuugcaacaaaauauuuuuugacccaaccauuuauaucuuaccauguauauuauuuucacuagguugauaaagccuaugacuaccucguucagaauacaucauuugcuaauaaauuagguuuuacuguuacuguuggaaauaaccguggcaucuaccuccgagauccuguucagguggcugcaccuucagaucauggcguuggcauugaaccuguauuuccggagaacacaggucaguaauaggcuggcaguaagcugacguauucacauuugcuguuugaaugagugguaucauaauaaagaauugcuguuugggccaguguugugaagagaauacaugaauugacaguaugauuauuuuaaaucuuagucauaagagaaaauauuagagcaauuugggguccuuguacaauggcaauuuaguuagcaucuuaaacuaccagggaaaacaguagaaugagccucagugacccacagcuuuauuaaauuguggauaauaaaauaucaaauuucuuuuccacuuuaccuacuuagguauaagacagagcuuucuguugaagaaugaaaaguagaagcagucuaggagaacugcagcucgauuaggugugaacaaaaauaaucaucgcuauuaucuggcugucuucauuucaguugaauacuaugaccugugugcaguaaugaaaacauucacuuaaacucuuuauuuuaaggucauaccagugcuuggugaaaguauaaaugaaucaugaguaaucuaaauuguaaggaagauuauuugacuguuuuauuuaagcuguguuuuggaugcauuuuacagccaaccaaaccaagucgcuaaauuuuuuuggaaagauguaacauuuuuaaauggaaaaaaggaaaaaaauacucaucuuuaauuuuuggucuuuuucgugccagaaaacucugaaaaaauaucccuucagcuucauuuagcucugacuucaaauucaucuuggguucagugucccagccauuuggaacucaugaaucaauguagacacauaaacauacguguggaucccaggggcuuaagagaaggauugcauuauacagagguauugauguaucuucauuuuuacuuucuucacucuuuaaaauguuuaaaagguuaaaaaaaaauccaaaguauauuugcaauauauugcuuucuugcuaagaaauaacuagaccuauccaucugccagguuauucaguucuucuggugugucuauauucauuuaagcagugaguuucuaaagaaucauauuuuguccuuguaugaauaaguaaaaggaaagaagagguacagcagaaccuuucaauuagaucucccucuaacugguguuuucuuuugucagcuaaacaaagcugcaguugcuuguuguuguuguuguuguuguuuuaagagacagagucuugcucuguugcccaggcuggaguacaguggugugaucgugguucgcugcagccuugaacucuugggcucaagugauauucacaccuuagccuccugaguagcuaggacuaguggcgugcaccaccaagccuggcuaaauuuuuuuauuuuuguagagacaggaucucucuauguugcccagucuugucuugaacucuuggccucaagugauccuccugccuuggccucccagggcuuugggauuacaggugugaaccaccacacccagccaguuauaccuuuuaguacucagaugaagaaagcaucuguuaaacaaauaguuguaaaccaggcauagaauaguaucacaacaguaucuccacaucuaaaguugucuguaguacuaguuugagcuaauuuuucaguugggaguaauuaaaaugcacuuauuuuguaccugacgucucauuuucccauuucaacuggucaaauguugcuauacauuuguuugggcuguuugcuauuaauuaugugaccuagugucaggaaauuggugucaaccucugguuaagaccuugauuaaaaguagauugauuuauucugucaguaguuuagaccuucccccgcucuuuuaaacauuuguuuauggauauugacacuuaccgauucuuuuuucaagguauguggcuaugauauagcauccccuaacgcagguccgcucuucagaguuccgaucacugcaguuauagcagcaaaguaaguaacagguuacucacagcuuacugguacaucuaagauuuuaaugacuauucauggagucuuguggacuuuuaaugaucacuaauacagaaccagguaauggggauuuugucuuaguucugcucccagcuagcauuuuuaggugucauguagucagccauacugacucuugugugcucugagaguaacugauggcaccuggcaucugcccuaccucugcaucaaaacuauuuccaccacagucacucugagcucugcauugcccaguucagaggauaacucaggcuucgucugacccgaucccacuguaguauuugacaauauuacuucacuccccuccauuccugcccuuuuugucucugucguuuuugggauuuacucucuucucuuaaugcuuccacuuuucuaguuaucuacuguagaagcagaaguuaagaaacucuuaacuucccaucuuauuccucuggaaccaaggaaaaaucagcagauuauauuacuuccugcuuaaaguauaucaguggcaccuccaaaggucaaguucaagcuccuuaaaauagcaaacaaugcucccucacaauuauagcccuagccaguguuuccugucauuccguacaccaaauuacacauuuuggccaacucacugauuuuggcacuugaggauucucaggauuugugcaugugcacagcugauaacuugguuucaauuuccugucucuucaguuaaugaccaggugcauuccuggucaucccugggugaagggagucccuucuuucugcuucguggcacauuuuacgugccccuggacagacuuuagccaauauauuguaauuuuuuauuuaacuuacacucuuucacugugagcccaccgaaggcacagagacuacuguuauacaggauguauaaaauaaauuaucuaguggaugaaggugagauugggauugugagaguacuggaaaccaaguggaaauucuaaacuaacaguucuguuacucugguaaauauuaaguaugcaauagaucucagcccaugagaaacacaggaugaaauugaggagaauaaauuuaaaaagugguauacauguggaaaaauugugcaacaguuaaauucucagccguauauucccucgaaguccaguaguaauuuagaccagguaauguguaagaccuucaggagucagcugccacgccaucuccuucaggaagcuucccaggcuccguaacucuucuugucuaucuggagcaucuuauguuaaaugucucugaugaugauucucuccaugcuagauugucuagguuaaagaaucauauuuucuucuuuguuacguuucuagcuccuaauaacagggccucauguaguaggcacucauuuaaccguuuguccuacugacaagaauuugucucuagcauaaaauuuguuuccgugguggguaguuaugcauuugaacuuuauuucauugauuucuuacaaaagugcuuugaaaguaguuugccuuucuuuacuguuuuacaucaugggaguguuuugaagcuacaggaggagcuuaauuuaacacaagucucauagcuauaauaccagugacauaaaacuuuaucauugauuuuaauaucuaggacucacuguaguuuggaaucugguaauuggaaaauucugugaauguuguagaaugccuuuaacaaaaaagagaaugcuuuuuuaauagugugugugaauguaucuuacaaaucauaaaauaggcaaaaaguagaaucaucuauacucugcuauucagagguuaucucugcuaaccuacugcaaaaauugaacaauaucguaccuacuguuuuguaaccagcuucuaagucccuguguuuauuuccaaugaauuguuauuuugcguuuauccaaugaaaucuagaguaucuguggucuuauaauaaauauauacauuuaauuacuuuuauuaauuuucagaguaaaugaaucaucacauuaugaucuagccuuuacagauguacacuuuaaaccuggucaaauucgaaggcauuuuauugagguuccugagggugcaacaugggcugguagguaaaauuaaaaucugugugaccgcuuaucucuguuuacguucuaaugacuauagcuguaugagguucguuuaucuguagcauguauuucccugguacuaauauauguauuuggguaccuuagacuuucuguaaaguucaaaacguuuuuaagaucuaguacaauuuugcauuggcccauacaggaaauuaagccaucuuaagauguuuuuaauauuuaagguuugagcuuaguuuagaauaaugccuuaccugguaauaauuuuuuuuuuuuuuuuuuuuuuuuuuuugagacagagucucacucugucgccaggcuggagugcaguggcaugaucucggcucacugcaaccuccaccuccccaguucaaacgauucuccuuccucagccucccgaguagcuuggacuagcaggcgugugcuaccacgccaggcuauuuuuuguauuuuuaguagacacgagguuucaccauguuggcuaggauggucucgaucucuugaccucgugauacacucgccucguccucccaaagugcugggauuacaggcaugagcaacugugcccggccuaauuuuuaaaauacuacaaaucaguuuaaacaaugcagcuguugcuuaaaccucaaacuguuaaacucucagaauuuuagaaauagagcuuuaaucuuugaagcucuguuuauagaagauuuucacuucagugucucugaaauuuugagaguaaaugauugccuaacacaaagcucuugaauuaacauguuauaguccugugagagugcucaugucauucuuuuuuacaagagcuguggguguaccauauuuuccuucacaaguuguguguccuaaauuuacaauuuagcagucaguauagaaggguaugucaguugucagagcucacucccauugauagaaggaagcaaauacgggcagucaagaaagugucacccaauuuaaauuaguagccagcauuguugauacuucuuggauuuggccccucugcuaagcacuuuacagagauuaucuugucuagucccgucagaacccuauaagguagauaggugucauuaguaaaaauggcuuguauuuuacuuaggaguguguuuuuuguacuuguaugaaaguacagauauauuuacaucugagacuuuauugaaaaugaaauauugaaaucacacauguaugacuugguuugggaauaacugguuguauuugguuccccauaccauuuucuggucaucuaucuguaugcuguccaucuguuugucaccugguaucacaggaaauaccagacuuuucuuguuuuuuguaauuagguaaaggcaaaauaauagcaaaagcugagagcuaaagcagugaauugaacagcacccaauauagccuguuaauuugcacacugguuuauaauggagcuauugcagcagugagaggcuucugaggauaaucggguuguacuacacucauucauuaagcauauuuuucuguaccaucugugccaggcccuuuucagugggcuaagguggugagcuacuuagacaaggacccugcuuccagaggccuugagagcaucuaguccaagauauugcaguuaagagaacuggauuagagggaggcagcacagaguagcggcaaggccacgggcuuuggaaauugagaagucuggguuuggauccacacucugccauacgcuaaugguuaccugggggcagguuucuaaauuuucuggacuucuguuucaacuguaaauauagucguuagucuguuguaaggauuagggauuuuauaguacuugguacauagcuugucuucguugggauuacgcucacacuugacaguacuucuagaggguggagucagaguugcuguguucagcauuccuggggucccauucucauagggccccugggacuuguagagcuccaggcucugguaaaaugugcacugguaaauuaaagaauacaaaucuaugguuaauuaauacugaauuggguacuuguuuagugauaaauggcacugauuuaugauugguuuagguugguauugaaaauaauuuguuuuuuuaaauaaaaauuaucaaaugaucuagaaugcaaguaguuaagagaauuuaacagucuuaguuuuauuucaaauaauuagaaauauugucauaacacuagauuuuguauucuuagcaacugacuagguucugagagcucucugcacaccugguuuuaugagccacggcauugcgccuugcuucaguucccuugaauuagcuuggguguucuuuagaaaagcugccaaucuggcauugcggugaucuuggcuuaccuccagcgcuggcucagaguaaaguuaagcauaaguagucgugccaggcuuuguagacgcacacaguacacaaguagaccaagaagagagauuaggaaaaguuaucaaugaggaauugaggcaugauaacaaauagagguuuccaaaaauauaaccuuccuuacuuuaucuggaauugacugguuuucagcuaaaacaaggagggauuuuaaaagguacccgauuaauguaauuguguaugcaucuauggacagcuugcuguuuccagguguuugcagccucaugguggugguucauuuuaauaccaguuucuuucguucccauagaaaaucuucuagucuucuaccuuuauuaauauuuuguugauucuuuguuuuuauggaaauaugcagauuugaguguacauuuuauuuuugaucccuauuaugucccuacaugggaauuaucccuaagugggcauuauuaaagccacuuuaugucaauuuuaggucuuauaaguuuaaagcuuugcuucuuucuuucuuauuuuagaagugacaguguguucguguucuucugaggugucagcaaaguuuguucuacaugcaguccagcuugugaagcaaagagcauaucgaagccaugaauucuauaaguuuuguucucuuccagagaaaggaacacugacugaagcuuuuccuguccuaguaaguuuaauuauaguuuauaauccuaacacaauuuauuugccuuuuugguaugggcuaagacuaaguauuugcauuugauuuuauaguuuguauuuagcauguugggauuauauauuuuuuuaaugccaaaaaaaugaaguagaaaaauagaaaaucuaaucaggguacuugaaaucaaguuggagguaauuauggcuguaauucuugaauagcauagucaaagaaacauacuagucugguagauucucgugccuuguaguuaggacccugauuuagauuauucuuuguuguacuauagauuaauuucuuuaagaccuguuugcuugucacuuaacuuauuuuacuaaugcuguguuguuaagcuaugaggcuaauuugcauuauaggaaaacugcuacugcuucaugucuaaguuaucucagaugauggcagacugcauucuuaucugugguguuggaaaugaugacuagucuuucuuccauagaaggugaaaguacugauguucuuccuucaaugcgcuccuuuguguuuucaguugguucugggauuuucccaguaucucuugguuucugguuacuuucauuuguguucuuccauggaucaguguugcuucaucuuuuuaaacuuuuaaaucacugauuacuagaaaacuuacuuuaaaacucagugcuaagagcagguguuuuuuuuuccuuuuccuuaucuuuauuuuuuaauagggagaaagauguaaaugaccauaaugucauuuuguuuugguugccagguagcugugagcccaaacucaauugugccuauugaguaugccuuacaaaguugaaguaucuuuauugugucguuauacuugauuauuuuucuuuugguccuaauuuuuuauuucacuucgaaauaauaaaaucacauuugcuuuauuauaugugcuuucagaagcugccuaggaucuuuuaugacaagaagcauaggguuaugaguaaauaacuauguauauuuaaauacaccauaucucugcaaaugauuugucuaacucuuacuuagcauagcuguuaaaauuuuugaguuuucuugcuacaaacaggaaaaguuugaaaacagaauugcucugaaacagcuaguauuuauauucuguaauuugagaaaaauaagaaaagagauauauuuuauuuacuuuuauuugcaggguggaaaagcaauugaauuuugcauugcucguuggugggcaagucucagugaugucaacauugauuauaccauuucuuuccaugggauaguguguacugcuccucaguuaaacauuguaaguuccacaacauuuucaugauuuuuaaugucaguuacuuguguuacuggagaguaacuucauugguuagauuuaaacuuuaaugaggggaaauuaccugugguucugaagauagcaguaggcuuuguguguggguacuuauaaacuuuauauuggacacauuuauuuuagguacaaaauauugcuuauuuuuaguaaaguuugagaaaguaauuugagaaauccuuuguagcaugcaucggaaggaaucaaccgcuuugauguucaguccuccuugaaauacgaagaucuggcucccugcauaacuuugaagaacuggguccaaacacugcgguaucauucaauguuuuaggaacuacagauauugaauauagauuggggggaucucuuacacucuuaaaaaagggccuuuuuuuuuuuuaauccaccugcaugcuagaggugagaauuuuauccuugccagcagaucucugcaaggcagccccaguaucagcuucuagcuucacugucccaccugaccagcaaagucaaggaugguggauagccgaucccagucaugacuaguuaggaucaguggacauuaaccuuuuuauuucuugcuguaaaauagcaaguuaacauucucucugauauuauuuugugaauccuaaugcagucauuuuuagaaacugcaauaccauuagaaacuguuuauuaaaugguagaaacuuaaguacuguagccugcuguuugugccucagcagcuccccuuacaaaagcagggcaccuugaccuguguucacauacucacuguguuauaaagauaccugguuucuuuuguuuaaucugaccuuaacucaucggcaugaagccuagucuuaaguguauuaaaauaaccaauuagggacaauagucagugacacggugaugucuaaagauauacugcuuccuagaauuaucaauaaaaauuaaaacauccagcuuuugaagauauauccaacuuauaucauccugauguuuucuuccuaaaucuaaaaaauuggagcuaaauuuagaguagauuauguuucacugacauuuuaaacuauauuuaaaacuuacucuucagugucaguuuucuccuuuauaaaaucuguacauuagcaacuuccuucagaggacuacuaaaaauaugaaauaacauucccucggccaggaggagggcugaguguggccccugccaucuggugagcagcaggggucuggggaggucugugcugcacacaacacaguacugucaacaguuugcacaagggguacaaaucagaaccugucuugcaacacuuuuaguugucacccuaguguuaggauuugguuguauugagagcuguuuguucacauuugaaaauguuuuugccaugaaaagauugccuuugucauauuuauugcaaaaucuaaacuguauguauugauaugauucaaucaaauaauuauguaaguuagugauuaaaauauuguagaguauacugaaaaggauagcucucaggaagguucaucugcacuuuuugcaauauguuacagauuuuguugcauaugguuuuauuugucucauucaaugaacucuugaaucaaaccaguuauguaguuuccucauuacagcccagugagugcaaaaacaaaaccuuuaggaucaagagauguuuugccaaauaaccgucaacuuuaugagaugguccugacauauaacuuucaucaaguaaguguuugccuaguaaaguguacccuuaggaugaacuuuuguguuuuauuuaugauucauagaaucaaaaauggaaggacaguguauaugguauauauaaaaaacagaaucaagugauuaacaguuaauuuggaauuacucuuuaggaaauuauaauuuguaauuaaauaccauucaguuguaaagucacaaaauguaauugaguggugaccuagccuuaagccuuaguuuauaaaaucacugaucacuguccauuggugccaucugacccaggggugauuagauggcucagaaauaccaucugccuucuggugauggugcugggccugauugcuuucugcgaagaaggcacuggaacagggaaaggucagaguagcucccaggugggauggguggcaaaaguaauggaggccaguguaaaugcuggaccaaagaauuguuguaagaucaaugagauuucaauaaaacuguuacugaaacacacaucaguuugguuauaauguuagggaaauggauugguuucagugaauuuucacauuucaguuuuauaaaguaauuagagguccugaaguauguauauguugcuuuauuaaugaauacacauagccagguguguauuuuuaaaaguuuguaagagagcagugacuuuuauaagugcuaaaauacuguguguucuauauuuucaaaauuuuuuaccacaaguauuuuuaauguuuuuuaaaugaaaaagucucaugucaauaacaauauuaaaaauuuguaucagaaauuauaugcaaaucaugccaaguaaucuuuuuuguuuuuuaauagcccaagaguggggaaguaacuccaagcugcccacuacuuugugaacuauuauaugaaucugaauuugacagccaacuguggauuauuuuugaccagaacaaaagacagauggguucaggcgaugccuauccacaucagguauaaaauugauggugauuuuuagaauuaacggaagcuguuuccugaacuaacaaaauccugguuucuuguuaugguaauguucauacuuuaaaaaaaacaaaaauuauagcuuuguguuuaguacuuuugcaaacugugagagccuguuuguuguagucggugaagaacagauggugucaacuauuucaccauguaguugugcugaauuagaggaggacaagggugaaccuugcccacacuggccagcauaacuuuuggugugugguguuucuccuuccuauacacugauucuaccuaucugaagguagaaucaucaaagcaugcaucaaagagaugcgagccucuugaaaugauccuaagucugagggggcuaaagagagcacugcagcaguggccgcaugucuucaguucauuuguacuuuuaaauuuacuaccucguuggacaacucuguaaugagcacuuacuacauaccaggcacuaugcuuugugcuguuuuauugaagggaaaaaucacauaauuuauagacauuuuaucccuuagauauuacugcaaagaaaugagauauuuccuguaauauguauaauuuuauguugacaaaugaaaauaauuuauggagauuuuuuucaauuaguuguuaaaggaaugguaucgauuuuccucaaagcaaguagcagucacaucucauuacagacuggccuacugcagugcuauuauuuugguuacuuuuuaaaucucagaaaaaguggcugacacaggauacagcaucucuuccucuugaaccuguuaaguggauaauagauuuguaucccuugaucucuauugguuuccuguuuuuuuccugucuguaauaaaggagugacauuuugguuguaauuugaagaucagcugggcaugguggcacaugccugugaucccgucuacucaggaagcugaggugggaggaucgcuugagcccuggagcucuaggcuauggugcacuaugauugcaccaguuaacagccacugcacuucagccugggcaacauagugagucccccucucuaaaaggaaauaaggauuaccaguagucauaaguuacacguguguguguguguguguguguguguguguguguguguauuuguccuagauauucuauggugccucaauuuugcucauuuuuuugguaguguuucuuauaugucucugagggacccaugaacuagaaaaucacugcuuuugucauucucaagcagacacugaguuuugcuaaaagugugggaguauucugucguucuggaaagaaugagggcuuugaagucagaccugacuucagcucucuuauacuuuacucugugugauguuaggcaagucacuugaugucccugauccugucugcucaccagcguacuagggacuuuauguguuauaugaacgucuggauaguuaguuccuugcacuguaccucacauauuaugaacaagucugugaaugguaacuuucacuuuauccucuuucagugauuuccguugacuugguuaaacuuaacuuuucccaaauguuguuuuucuuuuucaguauucuuugaaacuggagaaaggagauuauacaauucgacuacagauucgccaugagcaaaucagugauuuggaacgccuuaaagaccuuccauuuauuguuucucauagauugucuaauaccuugagcuuagauauucaugaaaaucauaguuuugcacuucuagggaagaagaaaucaagcaauuugacauuaccacccaaauauaaccagccauucuuuguuacuuccuuaccugaugauaaguaagugauaacauugcuuauacuuacugcccaucguauacacuguaguccuuuuaaugucaguuuaugacaucuaggcuaaauuuagaggauguagucauuuuuuuuuuggcugaaguauuucuuccuuugauuuuugaagucuuagcuaugggaaugaauucaguguggaauuguuuucauguuuuuccccuuacuugucuuugugaaacuuucucuuuuguugcuuuuuuucucuuugaauucucuuguuuagaauaccuaaaggggcaggaccuggaugcuaucuugcaggauccuuaacauugucaaagacugaacuaggaaagaaagcuguaaguauuaguuuuuuaaacacugaaauuaccuauuaaaaaauuucauuucuuuaaagauaagaauuaauuccacauuucagaauggauaaaagagaagauauacucuuggggaaaaaaauuuaauccuuuuuucccagguuacuagugaaagucaguuaauauuuaguugucuuuuaaaauguaugcuacuuuugaaauauuuaggcuucuuuuucacaagccuacaguacucaggcccugaaccugucuuaccuccuacggcuaauacacuugaacuuccugugaaacauguaaauacaaaucaaacuuggcuuaaauacaugugauauuuaagauuagaacauguuauagaaauuuaaccaauaagauugguuguccauauaagauuauggacauaggaauaaaucagauuaucuuggggugcuuuuaaaaaguagucagaacaauuacccuaaaacauguuucuucacacuucuacagaccuaucucauuggaauuucacaugguuaaguaggaaaauaugagauguuucuuuugguauugccuuuuaauuucaaaaugaugcuuuuuuuagaaauauguuucugguuguuguacuuuagacauauauguuacaguuuuauaaguaccuaccuguuuuuguuuuuuccuucuauguuuucauuacaaauuuauuaugagaaugauguuuauauagaucuaucaccuuuugucauaauaaucauuuuagcucaaugccaguaaaaguugucauucuuaacaguuuugcauuucucuguacuauuacuucuuacagagcuaaguaagccugcuacauaaaugcuguuaucaaaaugaguaguucucauacaucuuaagaauuauauuuauuuuuugccacuauugaaccaaaagccauuuauuuacugucauugaagcauaauuggggaaacuugugcuuagaaaguugccuacccugacauuucuugggucucauuucaguuuauacuguuuauacauacguacuuuaguauaauuugaaguaaaucaauaguuaaugguuuguaauuaauacaugcacugauuuaagaaacccugguaguuuuuuuuguagauuucauuucacaggaagcauagcugcuccagcuauugggcgucagcugugaauuuucguucagaugacagaugacacuuugaagagucugcuuacuugugaagaguauaacagaaaagcauuauuaguaaaagugggcuuuuagcaauucagaaauaguuacuacuucccaguuacauuguuuuaggagacaauugugaaauuaaauuauaaauaugugguguuaacuaugguagcuauuuaucaagggagaccuuccugggagaaagcaguaacuuaaagcuguugaguucauuauaacuuccaucacauuguuuauguaaucuuuucucagugguuuagcguuuucuuguuuuuugguaguugggaagguaacuuucacuucacuuugacuuucacaguaacuuuguugcuuuuuauaagaaugcauaggcaaugggguuguugugguacccuuuaaucagacuagaccaucaacuaaauuuacuauuuuaagaaaugcuuuuauaagcaauagauuuugaucuacuaaauuuuucaauaagaaguugacauguacucuuaguaauaacauauuugaguacuuuuucuuauguaaggaaugaaaguggcaauguugcuuucuuuaaaagcaugccaucuuaaucacagaccugagccuucuaagugguguaacacagguggaacauaaacugaaagacaauuagacagagguucugucuccauccuguguagauuaugcauguuuucuuacagaaugucguucuaacucccaggggcagucugcagcaaaacgacaaggaaaauuuaaaaagguacugauugucaguucuuaaaaaagaugucuuaaagccuuauuugcauauuaaacuuuuuucugucacuauuauaaaccuuuuuuuuaauaagucucccuuaguuuccuuucuuugcauucuaaaguauagugcucuuagcuguacuuagaagcauuguugacauacugcuuuucuaaagguuuuuuuuuuuuuccccaccauaaauuccuggaugacucauuuucucuguguauacaaaaauuuuaaugcuauucauuucuugcuacagauaugauaacaaguagcaauauuugaaauuuuucauauuuacaauuuuauagagagauggaugugauaauuuuuuuuuuuuagccauauaagcuaaagcacuuauuuuuaaagucuaaaagcacuuuuaaauugggugauuugauuaauaaaauguugcagcuuuuuaaagcgaacuuuauucccugcucuuguauccauucugguucugaaagaagagaaacaauaaagaucaauggauguagcaggaacagaaauaaggacuguucacugacaauuaaagcuuaugcuaagaacacagauuuuaagcccaucgcuacuaaguggucugaucagccucucugcagcauauuaagcaaucuuugauuuacugcuggggccagauuuaacucagaaaagaaaaugucugcuauaaauauauuuuagggccaggcgcagugacucaugccuguaaucccggcacuuugggagggcaaguugggcagaucccuugagcucagcgguuugaaaccagccugggcagcauggugaaacccugucucuacaaaaaaaugcaaaaauuagccaggcgugguagcacacacuuauagucccagcuacucuauuggaggcugagguggaaagaucgcuugagccugggagguggaggcugcaguaagcugagaucacaccacugcacuccagucugggugacagagugagacccugucucaaaacaaaacauacauacauauauauauauauauauauauauauauauauauauauauauauauauauauauauaaaagggaccacauauuuaauaagcuuucuggugaagacgugcuacgucauucaacauuuucaugauuucuuuuuaaacagaaagaauuacagugggaaaaucaguaauguccuaauguauacuuguuaauuaguagugauauggaacuggggaaucaccauucuauaacagcuuauccuuuauuaaaaugucuucugaaauguccauauuauuacauaauaguaaauaauuuguccaaacaaaauacagauacuaggaaucaucuuucuggagaaagaucuaaagaucaguauuucucaacugggugucuugaccguuugggggccacguaaugggauaaaaacagcauuuuuuuaaaauaggaaaugucaguucaucagacucauaaaauuguaauuucauuuuauguauuaauguguauaucuuugggacauuguaaaaauaguuugcaaguuacugcuuuagagaacaaggaauagguauucuaggaaucuauuaaaaauagaaggcacuuaucacgaaggccauagccaauuauuuuucuucuuauuuuuguugaccuuuugcaaguuuggguagauuuuguuugaauuagguuguauaguuaggaaaacacugaaugaauaggaaggcauuuacuuggugauuaguaaagcuucauuugaagaacuuggcagcuagaguuaucucugcucguuccuuucugucuucaaugcaaguacacaauaaagcucuuauuuuagaaauaauuaguauuacaguuuuauagucacauuacaaagaaaaaaauacauguauaauuuccgguugauuaagauaaauagcauuuuguauauaauucuuaauagauuuuuuccucuggguuucagugacuugauuugaaacgguaugucacccuuuuuaaaauuccuuguaaaaugcaauaauauauuuucuguuuguuuguauguuuuuuuaagagacagucucacucuacacuccaggcuagaguacaguggcaugaucguagcucacuguugccuccagcuccugggcucaagugauccucccaccucagccucccuagaguggcugggacuacaggcgugugccacuaugccuggcuaauuuuuacuuuuuauagagagaggucuuacuacguauguugcccaagguggucuaaaacucccggccucggacgauccuccuggcucagccucccaaaaugcugaaauuacagacaugagccacugcacccagccugaauauugucacuuuuaacagaucauaaauagcauucaaauaugauauaaauuuuaaaaauaguuuaugugaagcuuuuaaauuuuugaguauucaguuacuaacaauuuuaagaacuaaagaaauugccauuuugaaccacaauuuaacuuauagugcguuguguugcccaaagaguaguuauugguuuggcaggugaguuugacuuucugaauaacacuguucaguuugaacacuguugaaauacuucaugaauagcuggaaugccuuuuuucuaaacuuaacauuaaauauauacuguagagaaaucuucauagcauuucugcucugaagauucuucuugacugucuuuuuaaaccauaaucaagauuucucaagaauaaagguacaaaauuauuucuauuaaauugguacuauguuaaccccuugagaauugucauaaaaauauuaauauuuauuggcacaaagaagaaauuauugugauacagcaagugaaaauagcgccauuuuucuuuugauuagaaauuaaaacuaccagguuuauaauuuuuacuaauaaaaaauucccuguccugaaacaucuuguaggauuacacuaacauuuauaauuguuaauuugauauauuuaacauguaaaaugcugauuacaaaaccuugauuuuuguuucacuaagauaauucaucauaaacuuucuuugucucuuuuuuugcuuuuaaugauagucuaagguuacuaggauaucuuuuuucccacuuuugauaggucuuuguuagaauuaauuguaaauccuaaauuaauuuuaauagauuguucauuuuaaauucaauucucuuuucucuucuguacuaaaacaauagcaaauaccucugagucugaggaggaagugccucacaacacauaggcugccugccuaagagcagcauaccucucucccugauacggugaggaggugugggaagcucagggagaaagacuggagaccacucuucuagcacacuggguggcagagaagcucaauuccauggagaauggagcuauauuaacagaaaguaaauauuggaggccacuuagccccuuuaauuccuagauguguugucuuugcuguacagaugacacugaugcagucuguuuccauaagaacuuggugguagaagaucagcucagauuuugcgcuuaccuuggcuuugcucagggcagugccuacccagagagugaaccucaagaaggagaggagcaggacaggcagcuggguccugaaagagcuagcccaagcaauagaccuguuuccuuuucccagucucauguuucacgugaggccuuuguuuacagguucuggcccccugaccucagagggagaaugacagccaguggcuacaaauggauuuauaugguuaucugacaucaaagugguuuucugugcuuuaaaugagucaguguggagauaggauuauuauuuuguguuggaauacuauuagaacuacaaccauaguuccuguuguuuacuguuacaucauuuuauaccccgaaauuguguuggugaaaauauuuaaaaugggaauauuugugucguauaugcuccuaaaaauccuauuugcgggaggugaggacuugcaguauuauuuuuuuacucaaccagaguaaagcuuuuucagugaaugucuuuuugggaacauuuguuucaguuuuacaaacuuuguuaauuaaaaugaauauaguauuuuaauuuagcaccauuuuaaaugcaaaccugaagauagaauuugaggaacugacuuaauaaauaacgacuuaauuaaggacacccaguuacugugccaaaaacaaaucuagcagguauagcaugugauuucauuucccaaauaaugcuuuaccuuucacaagucaagacuuaucugugaauaaaauaaauacaguuacucuccauuucucugcugcugucuucaaagcaaaacuucucaaaagaaucacagacauguugacuuccauucucuuuucaucucugucuccuccagccuggacugcuccacuguccccugacacuguucuuguccgggggggucaguaggcucugugcugccggguuuucaguuccuuccuucuucgucguacacugccucucagcuaaaugggcaguugaucauuuucucuuucuucuuggugguuuuuccucaaggcuuccgugaucccaggugcuuuuugcuuuccuuuucucacucacagagcugcuuuuuccauucacuaucccuaacugaccuuauucauccacauauuuuucaacauugucagcaacacauugguucuaccuuuaaagaagaucucaaaucuauucauuuucucccauuucugcgacccauuuuuagucuaaggcaguguaggguuuccuagguuuguuuccuaacuuguugucuucuugccuccaccuuuacccucuauaaucuauuuuccaaauagaauacaaaccaaaauuuuaauccauacaggaaccagagucauuaaacaaaaagcagaaaucuuuaaucaugucacugucuuuuguaaaacucuucugguaugcuucuuagugcacuuggaauacaauauauaguauuuuuucuuuucuuuuuuaaaccauauucugucaagcccuacuuaaguuggcugcugccugcuuucucagaagauacagcugugcuugcuuuauacccagcucaggucuuuacacuugcucaucugcuccuuguucauugagggucguuugcguaagauauuaccucuucagaguggcuuucuauaaccacuuuguguccaucggcucccccucguuaccugacagucauucuauccuuuucuguuuuguuuucuuccuaucagaugucagcaucuggucuguucuuuaccuauucuagcauuaccuggcacaucgcggggacucaguaaguccuguugguuggacucaguaaguccuguugguugaaugaaggcauaagcguccccuuaaauuuacuuagagaaucuuuucuuaguuugaacuuauuucauccccuucucagauuuaaaaugugaaaggucaguguacuuuugucaucugucugccaaguaaagccaagaauaccaaauauacucaaauggagaaaaguauguucuuaucucuuuuauuuuaaaggagauauuugaaguaucaguacucagcaucaguuugugagaaaauuacugugaccagagauuggaauuuuugguguauugugacccuuagaaucuagaauacaguguaguacaacuuaggugcagcccauguuacaugacauguagcuguugaagaugauuuugauguauguaaaauuaagcauauuaaucuaagaaucucucuccacauucguaggauguaaucccuguucauuacuacuuaauaccuccaccaacaaagacuaagaauggcagcaaagauaaggaaaaagauucagaaaaagagaaagauuuaaaagaagaguuuacugaagcauuacgagaucuuaaaauucaguggaugacaaaguagguuuuuaaauguauuuuaauucuuuaaauguuuaguucuauuuucccaacuauaacaauauuguguauauauacauagaccguauuuaaaauuauuaacagcaguugguaggauuauaggugcuuuuaaauuuuccucuuuuuauauaaauguguaauuuauuuaaauuauaaauauauaauuuugugauuaaauguuuuaauuuuuauuuuaaucacucuaauuuguucuuggaagauaauuuuauuggaaaguauaaaaaagaaaaaucacuuuugcccacaauucauaaauagucauuguccucuuauuauuauuuuuuuccucuguguuuguacauguagcagugugaauaaaauuaguuuccauuuuucaguuacuuuuuuauuaugauuuaacagccguauaaaauacuauuuuuaaugucuguguuguauaugguucuauggaugcaacauaaucuauuuaaacguuuuauuuugcauauauauguuuauagcuuuucuucaugaugcugcgauaaacauuuuuauacauaaaggugauuuuuuaaaauuuccaucauauugcaucuuaaaaguaaaaaucgucucgcuguguuuugccaaauugcuuucugagaugaguauaauaauuuacacuccaucuagcuguguaugugugcuacuacacaaugcaaaaaccagccauuacugcugucuuaaauuacgucucuaguuauuauuaaaggagagcuuuuuagauguuaucauucguuauuaguauagcuucugacaguugagcauauucuucaccuuuuuuucuauucagacauuagguguuucuggucgauuaaaacuuuuuacauaaaagauauuaaugcuuuucuguacuugccacagauuuuacucuaguguacucuuugacuuugggcuugcuuuuuacuugaaauuuauucuauguagucaagucaguugcuuuuuccaucuguuaugcaauauuucuuuuacugcugauauucuaugggaauccucuucagcugauuauguaugcauccuugcaguuauaugguuuuagagggaauagaagucaucaugaugugaaaauauuucccagagauugaaccauuguaaugucaguucacuugcaaauauaccuuucccacuuaaaacuaaauuguaucuccacuggaagucaaagucuucaggucugucucugccugauuuuaggaugucauaaacaguugacaauauaauauaaauucuucaaaaguaaaauugcagagauugucuucuggcaugacagccugaggagacccaugaugcugguccccaguaaaacuagugaaaauuauuuaaaaacaaaacaaaacaacuuuuuaaagccucuggaaaugguccaaaggacauugagcaaaugaagaagcaucuauucaaaaauaccuacaagaauuggauaagaaaagcaagagucugugauauuugaaccaagaccacugccucccuuuccucucccaguuaaugagccagaaauuuuacuucagaucuugccuucaagagcuccagcuccugggggagggaaggcuuuccuccuuggaggaggaggacgucaucauuucucauccugaccuacugccaguugcagcggcucaguuccagcugagugcucucaagagguaggggcucucuuguaaaguacuguugggaacacuggggccccaaugcccaggaggcugugguuccauaccacacgaggcaagcugagaagaccacaggagagugcuaagcuccuuaagugggggugucacucaaagaaaaacaugccauucuuccacucccuguuccagagcuugggcuuagugauuuugccaguguggccuaaggaguucauaaaacugauagcuccuaauuucuugcugaaggaauugacuucauuugcaacagaagauggagaaguccgugugccuuaagggcucucucaaaaacaguggagaaaaaaggaaugaaaaaaaugaacagagcagagccucagagaaaugugggacaccauuagugcaccaaaguccauggaacaggaguaccaggagaacagagagaaagcaaaaauauauucagugaaauaauggcuggaaacaccccauauuuauugaaagacauuaaccuacauauccagggaacucaaugaacucaaaguaaaugcaaagaaauccacaaauagacauagcauguuaaaaauacugaaagucaaagauaaggagaagaucuugagaggagcaagacaaaaacuccucaucacuuacaaggaaaugcuaguaagguuaacaacugacuucugagcagaaacaguagaggucagaaagcagugggauaauauauucagagugcucaaaaaucucaaccaauaauccuauauccagcaaaacuguccuuuaaaaaugaaaaugaaauaauucccagguaaacaaaaacagagaauuuguugcuagcaaacccaccuuauaagaaguacuaaaagaaguuauucagccugaaagcaggugaucucuggcaguaauuugaauccacauuggugagaguggggaaagaaacacugguaaaguuaauuauuauggaauuauaaaagacagcauaaaguucucauuuuuuuccuguuaacuaauuuaaaaagcaguucuguaaauauuguguauauauuaggccuauguaauauuuaaauguaauauucuguaauauguauuugcuuauagcacaaaggagcaaaacuguauugggcuaaaaaaaugacugcagauaguaaaguaauuauuauaacaguuaauuaauugguguauuacaguaauagauacaacagauagaauacuacuacagaaggaaggagaggggaauagagcuauaaagggauaacauuucuguaucucacugaaauuaagcuaggaaaaaucugaagcugauucuuauaaguuaagauguauaugguaagccuuagagcaaccacuaaaaaaaaaauaaaaaugaacuugaaaaaaaucauuaaauaaauuuaaauguucauuuaaaaauauucacuuaauacaaaagaaagcuguauaggaggaacaguggaacaaaaaaacaggauacaucaaaaacaaaaaauaaaaucgaagaccuaaguccaaauauaucaauaauuuaaaguuuacaggaaauuaagagaaucccauuuacaguaacauugaaaaaaauaaaauguguaggaacauguuuaacaagagauguaagaauuauacgucaaaacuacaaaacaauuguugaaagaaauuuaaaagaccugaguaaauggaaaagguauucuuugucuguggaccagaagacuuaauaucauuacacuauucuucauauugaucgaaugauucaguugaauccccaucaggauccuuuuauagaaauuaacaagcugauucuaaaagucauaugugauucccugagacucagaauagccagacagucuugaaaaugaagagcaaaguagggcucacacuuccugauuccaaaacuuaaauagaaagcaacaguaaacaagacaguguuauacuggcacaaggguaagacauauauagaucaguggaauagaauuaagaguccagaaauaaaaccaugugacuauggucagcuaauuuuuaguuuuggcaagggugcugaugcaaagaccauuuaaugaggaaaggauaguauuugcagcaaagggugcugggacuggauagccauauagaaaaagaaugaaguuggacccuugccucacaucauauauacaaguuaacucaaaauguaucaaagagcugaaacuacaaaacucaaugagacguagugguaaacuuucaugaccuuauauuuggcaaaagauuuuuaaagauaccaaaagcauaaguaacauaagaaaaaaaaauagauaauuuggacuuaaucaagauuaaaagcuuuugugcuuuuagcauagcaucaagaaagugaaaagaacggccuauuugcaaguuacauauuuguaaggagcuuguaugcaaaauauauaaagaacgcuaaccuuuuuuuuuuuuuuuuuugagacagggucucucucugucacccaggcuggacugcaguggcacgaucauagcucacugcagccuugaaccccugggcucaagggaucuucccacuucagccucccaaguagcuaggacuacaagugcacgccaccacccccagcuuauuuuuuuaagggaugggaucucacuauguugcccaggcuagucuggaacccccggccucaauuaauccuccugcuucagcuucccauaguguugggauuacaggcaugagccaccuccacacccagcccccagaauauauaaauaauuccuacaauuucauaauacaaaggcaaauggcucaauuuuuuaaaugggugaguaaucugaauagauauuucuauaaagauguacaaaugaccaguaagugcaugaaaaaaugcucaaaaucguuagucuucagggaaaugcacaucaaaaucacaaugaaauacaacuucacacuuacuaggaugacuggaaucauaaagucagaugaugaguuuuggcaaguauguggacaaagcagaauccucagacacugaugguaagaauacaaaaaugaugcagacuuuuuggaaaacaaucuugacugcucuucaaaugauuaaacuuaguuuccauauggcccagcaguuccacucccagguauauacccaagaaaaauaaaaaccuauauucacacaaaaacauguugaugacaguuuauagcagcauuauucauaauggccaaaagguggaauguccaucagcugaugaauggacaaacaaaaugugguguauccauacaggggauuccuuuucagccaugaaugggauuaauacaugcuccaacaugaaugcaccuugaaaauaguauguuaagugguaguagccagucacaaaaagaccauguauuauaugauucuauucauauuaaauguccagaaugaggaaaucuauagagauagaaaguagauuagugguugcuuagugcuggggaggcuggggagaucugauagcaaaaggguauggcgguuucuuuuuguauugaugaaaaauguuuuaaaguugacuguugugauaguuacauauaucuguuacuaugcuagaaagcauugaaauucacacuuaaaaugggaaaauuguauggagaaaaaauugaaaagguuguuuaccuaauagguguuuuagaagaaaacagcaaaaaauuauuagcauucccuagcaaaacuuuaaaaaccuuagaacauuuuuuggaaaaaaaaauuuauaauuaaggugcaguaguuuuaaaauguaaaacgaaaguguugauuuugcccuuggauaauuguuagcgaaaagagaaaaacaggacuuaauuuuuuuuguacuaagaauuaguguaaauuuuguugucuacaaguuaaauuuauuuucauagaaaguuaguuauaguaucaaaaucccggucaaccuuauuuuuauacuacugugcaguuuuguuaauauauuaagugacuuuaauguaaguuacccacuucuggugcuaguuuguauguuaauuuguuuuuauccugauacauauaaucagguagaauugggaauuuuauucagccuccgcgucggggaacauagaauaacucuuuauugacucaagacuggaauuuucagaaaaguuuaaauuuuuauuuuuucuagaauuuucagaaaaguuuaauagaucugagacauuuuuaaaucuuuuaaucuuucuagcuauuugugaauaugcuuuucuuccuuuuaaauaaauauaauagcugguauguaagaaagcuauugaugcauauuuuuauuuggauaucuuauugaacucuuaauuggaauaauuuucaguuugauuuauuuauuuauuuuuuuuaauuaauuaauuaauuuauuuauuuuuugagauggagucucacucugucacccggcuggagugcagugguuugaucucggcucacugcaaccucugccucccagguucaagugauucuccugccucagccucccgaguaucugggacuacaggcaugugccaccacccccagcuaauuuuuguaguuuuaguagagacgggguuucaccauguuggccaggauggucuugaucucuugcccuugugauccgccugccuuggccucccaaagugcugggauuacaggggugagccaccaugcccagcccaguuugauuuauuuuuguuuucuaguuaaccauuuauacuacuugccaauaaugauaauccuugucaaugacuauacuuguauuucaaauuaaugucuuauuuuauuggcuuaaacuuccaaacaauguuaaauaauagagaagacaaauagucuuuuuaaaagaaaaaaguaaauauuucucuccuucuuacauacauaggcuggauucuagugacauuuauaacgaauugaaagaaacauauccuaauuaucuuccucuguacguugcacgacuucaucaauuggaugcugaaaagguuagacauguucauucugauauaucuuauuuuguuuguaauuauauaaguuuguguuuugaggaaaagugcauuaucuuucucuucuguucuugcuaacuaaaacauguuuucucaaauugaauguuguguuaagcuguuuucaugaagguuauuauaagaccuagccacuacugugaguuuaguuuaggauucuugcucaugcuuggucaaugagauuaguaauagagaagauaccuuaacgauuguuuucaugaccuuaaccuaaagggcaaggggcagaacguaguaauccuggccagauggaaaucugaacgccuucacugaaagaauuccuacuuugcauuaacuuuguuaaugauucucauuugugagaguuggccauaguucuagucugucaugacauggaccaguucucauuauucaucaaagcagugggaaagugcuguccuaaucaguugaaaaucaucaaggguuuagagugaaccagaggguauuuaaaggagauuucuuaaaagacuuuaacaagagagaagcaaauuguugggaacaucaugguaaucacaguuagacuguugauuauaauguuuacucucaucuuuguguuuuucaugauggaucagaaagaaaugguuucaucagcuagggcuuucuuuuuuuuuccuguguucagguagugugcaacuagaguaaugacaauagccaaucacauuucuagaaucuuaagaaauacagaaaaggaguuaccuuuguuaaaaaaaaaacuuuacauuuuuaugaaguuuauauuuugcuuacucucaccauuguacuccagcagggaauguaaauaagguauuuuuauuaugcaucugagcucaaguuuuauagagauaccagcaauuagaaaaaucacaguaggagauagcagggagccccugggcuacaagucaauuacauaguuuacucacacugcaguuguaggucucaugguugagacagcagaagugaaauugcuuucguauacugauugauauaccuauuuuuuauuauuucuuuuuuccucuccaggaacgaaugaaaagacuuaaugaaauuguugaugcggcaaaugcuguuauuucucauauagaucaaacagcccuagcaguuuauauugcaaugaagacugaucccaggccugaugcagcuacuauaaaaaaguaccuaaccaguaaauaaucuuucuugcaucucauuuccuaguuaacuuguuuaaaaaguagggacuaauauuauagaggauauugcuuuucugauguuuguuauauccuuauaaugggaauuaucacuauuuggauacuccccuccuuagaaauuuuaaaauaauuuuguccaaucuuuuuaagaguaagcccaagaaaaguaguuugccuucucuacuguuaagugcugucaagguagagggauuugaauaucugugaucaagcaguccaaccacuugaggguuuaugugaauuggaccauaucaggaagacaaaaauuaacaaucuauaaaauaauuuuuaaaauguuuauuguccaguaacaugaaaaaccuaauauuugguuuguaauaauuacaugacaaaccuaauacgugguuuguagugaaauaaaugauaauaaaauuagguuaaaacuaucuggcaacuuuuaugaaacugguuuuauaguauuagggagaauaggaggagagaauuuauaguuuugccuuuauaaaaccuaaugcuguguguaaauagagaagcuucccuggguuuaugagugguugguaugguuccuuccaugcaagugugauuuccguauguugguguaauuaaugguccagugacucugaaccaagcugccauuuggucacuuucacccuuccaugaacucuuaaaccaucaccucaugguagcucucccagugucaguuacuuguuuaucacuuuuguuuauuuuugacuuacaggaucauuaacuagguagaaauauccugauucuuuugugguuauuauaacuaauaaaccaaaacuauucaggcuaccugaaaauacuaaauuuuccuuaaaaauuuucucaguuucagucaguauuuuuuucuacauaaaauacuuggauuccaaacugcuagaauucuuuccauuauaucauuuauauugauacuauaggaucuuaugaaucuuacaagcaauaauuuucaagugggauagaauauauuuaaaauugcuucuuuggccacuauuauuaccuuuucauauuuuucaaaagaauagucucaaaacauugccauuuuguuguuguuguuaauaauaacagaaaauacagccaccauuuauuaagugccgauuauguauaagggacuauugagggcauuuuaaauacauuguuuuauuuaaauuuagucuuccaaacaacauggaaggcaggggccuuuguaucccccuuuuaaggaagagaaaacugaaguucagagaguuuagaugacuuggcccaggugccacugcuaggaaguuggaaagcacauagucaaaucaggaucugccuccacagccaaugcccuuucuuuucucuguauauucuucucccuucuugagaagguuaacauaacucaguauuaucucacagaaaaaggagcaucgucugccucccacccauccucauuguguuccuuucugucucagggugaucauuguuaaucuuauugcaagaggaggcuggccuuggucacuuuaaaacugucuuccacagaucaccagugauaaccaguugcuaaaaagaauggcccauuuugagucuucuuugagcucucugcagcccccgacauuaacuaucccauauacuuucuagcuuuuguuauuuuuuacauuuugugaaaauaauaugauuuucucaaacucggguguuacaugaaauaacacauaugguuuucucaguuuuaccauccacagaggaaacucaaucucagcuuacagugagccauaaacuaauacgauauuaguuuuguuuucuuauuggucuuuaucacuguuuuuaaucucuuuuuuuuuuuuuuuuuuuuuuuuuaguuucuacucuuuggagauuacuagacauugacuaucauggcuauugaaauaagcugggauaaaacuagaaaagaagccauaaaacuuuguaaaaacgcuaagaguggagcugcuuuaaguuuuuagcgacacugggucaacuuguuuauccuuguaauuaaagaauuucuauuucucuccaggccuuugcuuuggccugacugaaauagacucugaccagguuguguuuggacagaagacaguauucagaguugaaauauuauacaagaugcuaucaggaaauacuuagcauuucuuacagaugucaucuaugggcaaguagcagccaacuuaagcauuaauuucucauuuccaugcaaaauugcuuucucuuaaaucaguaacaucaaaaauuguaaaaugccauuuucuaaucuuaaaaaauauuaacuuuuaguuaauaucauguuuuaguuaaauuuaaacugcacuuauuuaggcauuaaaauacugauuccaauuaaguugcuuccuaaaauguagcuauuaucuugauggauaccuaacuagauuugauuucaagguccuuauugagcaaauacuucauguaaggcaucacugacaaggacuuaaaacaugagcaagauagucucuacucuuaugaaacuuaucaucuaauauagaagaugaaauugccagauaggaaauuauuaagagauaaugaaauacaaguauuuuuaaauaaauauuucaaauuguaaaagccuguagaaagaaaagcugacuuucaccugaguggaaaaagccucauguacuauaaagguauucaaucucagccagucaguacaaaaccuaaggagaggaaaggaauacuccagauauguagaauuuagauuacgugauaagaggaugcuaaaauagaaagggaucuuacagcuaauuuaacccaggucugacaaaugcagauuaccugugucacccccagguugccuucugauuucugcaucauuccagcccuucucugggcagccaggauccaucaggcagcauuugccgagucugcccugcagacucuggccgagcgacggaugaaaggagugcucagacacagguauccagugaaagagugggcuaggggacugccagcacuaagggccaaagagaguuagcagucccccugagccagcgacgcucacauuuauuuaguagagauuuaaugacaaaggcuuggagcaaacacaauuuguggguaauaaacauugucgacccccaaguagagagcaguccugcacaugaaugaucaaagguugguuuuuggagacaggaguagucaaauuugucuagcgcaaaugaucaaagguugguuuuuggagacaggaguaaacaaauuuaucuagauaaguuccuuuacauucccuuguuaucugccuuuugcucccuggcuccagauaagagaauuuggcugccuucagccagauccucuuucaaagcuuuugcaaaaccucccagccuuccaagaagguuugcaucuuucccucuaacuuuuaccuaccacucugaccaauuuccuacaucuccccauuuucuguuuuuuugcaucagguuuuguugauugaagaguacagaugugugcagcaacugguuugucuggcguagugguuacugcuuguauuccagcuuugcauccuagaauuaguaaauaacauaagacaaaaugaguauaaucaguaacauucuuuuccaaucaaggagugacauguaguguuucuuggcaccucaguccaaugugugcuguuacuaaggaaccccacugaggguauguuacccccuuccagccaagcaguuacuuuauuggaggcugggaagguggugucugcccagguaacagggcagaagaaaggcaaaucuaaaugaugaucccaauagcguguagcagguauggguugcaggcagagugagagaauaagaaggguuaauacccaaaagaguugcaguguacaacggaaagcauagcaaggaacaaauuaucuggagugaauggugucuauguccagagcaggauucauucagccuucugaguuuucuucaacaucucccagguaaugucugggguuugugucgucugaagaagcugcaucauccagggcuaugggucccacagggucauuuucuucauuucugguaccggguuggguccuagccacgcuaugguaugguuugaugccucgugcuggaauccaaagaggaccugagggggugugaacacaagcaugucuucuucccaguguuaacaauucaguugaaccgcaccauacauuacuguuuauaucuuuccauaaaacugcagguuuaugucuugagagguuuuagcaaaaugcucuucuauagcugauugaaauuuaucguuuagauuuuaaaaaguaaggguaaauaaggcuucugccaguaguguugcaggguccuuacucauauucacuuuuuuguuguuuucugagcauauuuuuaaggguggauuggacacguucuacuguggccuguccuuggggguugugagggaugccuguggauuguuggauguuccacauaugacaaaauugcugaaauuuugagcuggcauaagcuggaccaauaucaguuuuaauuuuugugggccgcuccauaaaugcaaaaguuaaaagaagauguuuaauaacauauugagcagacuuuccaggaagagcauguaugcuaauuaggugagaauugguaucaacggaugcauguacauauccuaguuuuccaaauuuagggauguguguaacaucuguuugccauaacugauuagguucuaguucucuaggguuaacaccuguugaaggaggggacaugcgugugagcuggcaauuugggcauugcaggauaauuuguuuagucuuuggguaaguugaaaucguuuagauaaauuuguccaauuuugguggaaacauugaugcgaauggguggcuuggucaagcagugaugucauaaccugcaggucugcuugaucauugccauaagcuagggggccaggcagugagcugugggcccaaauguauguaauaaaaauaggauguguacauugauccaccgauugcugaaaucaaagaaaaacugcacacagggugggcuugagaguggacuuaauaagggcuguuucaagguucugcaauaaauaaacagaguaagcagagucacuaaccauauugauuggcugagcaggaaaggucucuagggccaguauuaaggcuccaaccucagcuuucuugaguguuaguaaauccagaacaagugagggaauugugcagucuccaccaaauaaccacuuuuccauuuuuaccagagccgucaauaaaaagcauuaaagaauuagguauuguggguggggggguguggcggugaaccacuuuuguaggcauaacuacaggaguacuagauaauaacugaaguaguuuauuggcaggaagggcauguucuauauggccuuuguaaucagagagugcuauuugcaggucuagagauaagggcaagacugcuuugaauugcuuuuuacuuaaaggacuuccgaugacaucacggucauaaccuagcaacugauugcaucaucugcggccuaaauagaugguuuuacuaacuagcuggguacagggagauagaguuuuaguucugguaugugagcaaaaaacucauuuuaggaagcauagcccuggggacaucuguccuauuaauccuguuggggaaugcuuaguaggaaaaacaaacaauugaacugaauauugaauaucgugggucugugcaauccuguugccucugaaaaauagcaugcucuauuuccucaauuucccuuuuugcugcaggaguuaaauaccugggagagucuagggcuguauugcccuuuaggauagaaacagguuuuguaauguaucaguuaugcccaagguggggugaagccaguuaauaucuccuaguaauuucugauaaucauuuaauguguguaaguugcuaguauuuaacuuuuuaaggucuuacugaccgguaaguuagaauguauccacgauauuucuaaggagaagacaauuguacuuuuucaggugcuaugauuaaaccucuuaacuguguauucuuuacgacagaggcauauagacuuacaaguccuggcuccguuggagcugcuaguaaaauaucauccauaaaaugaauaaucuugcaauuaggaaagucuuuucuaauggggagcaaagccugauuuacaugauacugacacaguauuccuugaggaaguacuuuccaaugaaauuggcgagcuggccuuuauugauaacugguauuuuaaacacaaauuuuucucuguccuguucugcaaggggaauaguauaaaagcagucguuuaagucaauaagacuauaggucaaacuacaggaauugccgcuggggaagggaggcccuguuguaggggccucauagguugcaaauuagcauugauagcccguaagucaugcaaaagucuccauuugccagacuuuuugggaaugaggaaaaugggcaaauuccaagggcuguuugacaguuguauauggcuggcuuuuaauuguuccucagcuaauucaugggcucuuuguaauuucucucccuuuaaaggucacuguucuaccuaaauaagauuuugagagagccucaucagggguaggggagaaacaacaguggccauuauuagaaagagaucugcagagugaccucaacccucuuguaaaugggcuagcggcuccguuuucuuuaaugcuuuuccuuaucucuuuauaagcguuaaaaguaacggguucauacaccugauuguguugucaauuuugcguuaccaggcaggccaagagcuccccuucuaaugccgcuugccuaagacagggucccauagcuguagcauauuccuugucuuuucuccaauuuauuggaggacggggcucaggcaaaaccuccguuuccucuuuguuaucuuugcccgguaacagcggggcugagggagaagggggaggaaccauggguuaugggaaacaacaguuugcauuaggucccuuaauugagccugcgaaaccgagccuccacuagcuuuaagcagcuguuucauuacuuuuauauacuguugcuguugagcugauaacuguugucccaugaugaaacccuagccugaacaauucccucgaacuuggaaaucccaagcgggcaccagugacuuacugacugcgcagucucuucaccuucauuuucgaggguuccauugugauccauugcagcguuccucucauggggcaccaccugccaagucugucccucagacuauggccgagugacagaugaaaggaaaggaguacucagacacagguauccagugaaacagcaggcuagggacugccggcacuaggggccgaagagaguuagcagucccccuaagccagugaugcucgcauuuauuuaguacagaauuaaugacaaaagcuuggagcaaacacaauuuguggguaacaaacauugucgaccccccaaguagaaagcaguccugcuugugaaugaucagagguuggguuuuggggacaggaggaaaccaauuuaucuagauaaguuucuuuacauuccauuguuaucugccguuugcucucaggcuccggauaagagaauuugacugccuucagccaaauccucuuucgaagcuuuugcaaaaccucgcggccuuccaagaagguuugcaucuuucccucuaacuuuuacccaccacccugaccaaucuacaaguaucagccuggguguggaaaccugccuugucaacccauugcuguuccaagccccuuucuccuucacaaaaucaggauaguaguugugcccgacaccuuggauuguuggaaggcauaagcaaaggacugcugagaagacauuuaaggauggcaccuggcaucuaagaggagggggaaggaggguggaucaggcaauggcaagccaugcagaugccccacagcuuggaagucccaaaagucuacuuguaaauccuuuucuucuuaauuccaguguaaacaagcaguacccagaaacaucucuacaaaaaggcagugaaaguugguucuucaagcuuugaggcacugugcugagaagcacugagggaucuuuuaggcauaguuucauuuacauugcaaauguauugggguugguaauugcccucuuugaugaacucugccagugugaaggaauuucucuacuacccacauugccucccugcccacuuucaagguacaggaucaaaugggcuuugaaccucugagaauaccccggucuugggcaauguuucagcagcggcauuuucuaugguacuuagcguucauguucccugccaugcggccucuuagauuaacaggacuccuuggugcgcaggauuaaugugggugagcccuugagccuucaaguuguuggguugauggcugucuuuccuacugcggauccuuguugaugguacagucccggcaguuuucacaugcuacacauuucacucugagucuuucagagucacucuuagcuguuaguuuguuccacagcuaagugccucaaucaucaucauuuucucaguacuuuuaguccucauuguuuucacguguaucugacauaaguuggacagaaugccucaaauaagcacacauucuagagacuaacacuuuucccuggaguguagguggugguuguauuucauucagcaaugauuuauugaguuuccauucugugccgggcauuguccuaggcacguggaaugcauugaagaaaacaaagaugucugcccuggaucaaggcaaugugccguagugauuaagagcacagauuacagauuucuacugcuaagcuuagaauccuggaucugccacuuccuaacuggaggaccuugaacaaauugcauagucucuuugggccacaguuucuuccuuugcaacauggcaguaauuaauagucucuuacucagaauuguuuugaaugugaaugaauuaacauguuaaaaugcugagacaguugcuggcacauucagaguaaagcauuacauuuauuuguccuagucaugaacugaaaguuuuaagacauaaccucuggguauacacauagacaaauguguaaugauuacuauuuauaagaaaacugaaaacucaaaagucguuuaccugauuaagaguuauauagcuaaaaaaauuuagaauagugauuaaccuuucaacucuguugcuucuggcauuccguuucaaccaggugcagcuacccuaacucauuuaaucuauauguguaauauaguagcucauuugauguuuauuaauaaggcaucauauuugauguacaauacaauuguacguaccuggauauacaguauuucugcauuauaaaucuuaggcaaaagaauacaugaauuuaaauucagauaagaauuuacuuuuaaagacauuuuacugauaucugaaauauuuuuuaauuugcuguacagugacauggacaaacaaaaauccacccucguagaugcccuuuguaggaaagguugugcccuggcagaccaucuucuucacacccaggcucaagacggagccauuuccacugaugcagaaggaaaggaggaggaaggagaaaguccuuuggauucucuggcagaaacauuuugggaaacuacuaaauggacugaucucuuugacaauaagguaacguuucugcuucuuguuucagcaaaguucuugggguuaccucacagaccucucuugugccccauugcugguuaaaagaggaagaagauaaauggaaagaaucuacgcugggcucugaauaugacauguuuagccuaguacuucauguuugucucaccuuuuuuuaaaaaacauuauuuuaugguacugcaaacuggcuguuaaaccacaauaauuuuaaaaacaguuugagaauauguguaguaggcuuuuaguuaaaccaguuauguauguagcuaaauuaagaaagucuucuagaaaaugccuucaggcccacccuucucuaguuauaugcuaauuuguuggugguaggagauugggggcagguugaggagacauacugguuaguuguuacuuauuuuccucaaaacucuugaauuucucaguaauuaucaucuugauuuguagcuaaucaguuuuaaaacccaauucauaaaagcaucguugaugaacuuuuuuggauuuugguuacaaaaacauuuuaaaucucuuuuagcucucuacuauaauucuugcaauagcguuuauacaaguuauuaaucuucuuuuccuguggaaauaaaauaaaguaaauggagucaguaggauuccccucgcguaucacagaccaucauuuuguuuuaguagacaggugcuuguucucagaauuaacugguaauuugcaguaaagaacccuggaagugggaagaaaauucuuauaugguucagauuuuuccaacacaguacaguggugcauuuaaagaagguacucaguuacucaguuauauuugggaaacugaaggagccaguauugcagcagaggucaggaauuugaaucugaaauuagagcccuugaguuuggcuccugccucuaccacuuuuauguaugaccuuaggcaacuuacaaaauuuugauaccuuaguuucuuaucuacacgaccugccuuaggcugugaugaaugaguauuaaguacaugcaaaguccccaacaauauuugcuguuauugcaaacaauuauugaaggccuaugugccaaacacuacuuacuacuggaaacauaaagaugaauaagaaccugcuuucugucuuugaggaauguaacagagauugacaaacacuugaugaacauauaauaaaauuguuauagaucauucuauuuuugcaauacuacuacuauauuaggggcuaugcauucuauuaccuguuuacuguguuuacugugucuauggcaacaauuguuaaauacuuuaguugccuuuacaauacaaaucagugucaggauuuucuuugaguacauucuccacauuccaaaguagagaccaaaaauauauauaaaugauuauaaguauauuugacagaugcaguaauuacagguaaaaacuuguaccaaagaaaccauguuuauauaaucuaauacuuguuuuuuuacuucuauccucauuugcaauuuuggcauuuuuuauuucuauccugauuugcaucuuuguaauuauuuauguuagcucugguuucuugugcaugaagagguauuuuuaaguggauuuccacggcuaauaauuucucauauuaguuuucuucccaaaaaacagaugguucauucuguggaauacucagcucuuuugaagacaccaauuuucuuuuucaaaguuuuuaaaaauguacucuauguaccauauucauuucaaaagcuacacuucuguuaaagccuuaauuuuaugguuaaagcuaaugccuuaaaauguaaauuauuuuauaaacaagcuuuaucauguuuuacauuguagguuuugacauuugcauauaaacaugcauuaguaaauaaaauguaugggagaggccuuaaauuugcaacuaaacuuguggaagaaaaaccaacaaaagaaaacuggaaaaauuguauucaaguaagugauauuuaaaaugucacuguuaagcaucacuuugauauugcauagugacaagauaacuagaaaggauuaggacugugauauagcaauacugguuuuauugugaccaguuauuacaguaauuagcguaauaugaacuauagaauaaauauaugagagacagucaauaagcuauuuaaauuuuaaaaacacuuuucacugcuauccaaaaaacugauacuagccucaaauguuuucaacaagggcaaaugcauuuugaauuuuguaaccguagaagccaguuuuucuuuaugaaggaaacaaauccuuuuaaaggcauguugccucaacucuaaaaugguucaacuucuggaguuuauauuugauuuuauucuucauuugagaugguaggcauuuuuaaaauuaucuuaccauauacaauauuaugugcagagaaauuuuauaguugagguuucugcacaaguuaguugucaaguaaaaaaauuuagcugauuucuacagaaguuacuuuagucugaccucgucuuugaacaugcuuaauugguuuaugccuaaaggauacgugaaggcaggggaguuugguggugccagauucagcuaaagggcaaguccagguuaauuauacuuuauauguaagguacccuuuggauguaaaacugaucaguagguuccucugaaaauguuugauaauuagaguaagcuauauucauauuuacucuuagagcuuuuuguuuaccuucaccagucaguccaaauuguaagacauuuuaaauuagcuccuccagaucuuugacuagauuaagagaacucuuucuggagccagguguugauaugucuaaugugguucucaucauguggaaucugauccgugagcacuuagguuuguaaagccagugaucccugccgacguucacaucagggaguguuucuuaacuugucugcccuccacucugccccccccgcugccuguucuccacacagcagcuggaaaagaugccuuuugacaccugcuguugaaucuccaucacauuuggaauaaaauccaaacucuccccagugguccauaaggccccugccuaccucuccagacuuauuucauaucacacuugcccauacaaacucugcuucugccacaccagcaucucugcuuagcacaaacagccacaccuuuuccuaccaaaggaccuuagcacuaacuacucuggcuggauggaaugucuuucccagauuuucgcacagauuucuugucauucaaacucaacuggaguaucaccuccauagagauccuuucuuaaccaucuaacuccccaguuaguuuauauugugucaaauauuauuucuacuguacaccugauaaauaucuuauuacuuguuuauucauuuauuaauuugcuuauuauuugcuuuuccugaaagugggaggugaauuuguucagugcuguuuucccaguguuugacaugauaguuacucagaaaaaaugaaugaaaggaacuuagguugguaggaaggaaaggaacaaguaaguuggaaggaagaagggaggaacacagguuaauaggaaagagggaaaaggacaguugguagggauaaugaugagaacaauagguugguugguaggaaaguugguugauaguaagaaaaguugguuggugggaaggaggaucaaugggugggugacgguugguggaaggaagguucuauaugcuacuaccuuacuguuacuauuuaauacagaauuuauucuaaauacugagcuuaaaaaucugucacuuccuuuauaauaauauauuauuguauuuuguuguagcugaugaaguuacuuggauggacccauugugcaucuuuuacugaaaacuggcuccccaucauguauccucccgauuauugcguauucuaaaauaggaaacaagacuuuaaauuuuaaaaaaggaaguuuuauagugaauggguauaaaaacaaauuuguggcauuuuuagucuaaugcauguuuucauccacuauccaguacugauuauuaaaaugacauguauuuaucagagaauucacugacguguggcuuaauacauguaaaucuagaccucugacaucaugguguuuucuuaaugccucacauugcuggcacggggaugugcccugccugccagcaccuaggacuucgaguuggguugcagcuuaugacaugcaugauagguuuuggaagguaacuuuuaacugcaaaccuauaaaguacuauuuuuuauuuuauaaaugaacaggguuuuaacgugcucaacuuuaauuuuuuucaauuguaugaaggccuuaaaaaagcuacauuaagcguagcuaaaauuauuuauuggacuaaaaacuaacagaacuucauuuccagaauuuuuuuuuuuuuuuuuuuuuuuuggcaaauguuuacauucaauuaaggggaaaaaguagaaccagcacaaaugaguggcaguugcuggagcauaacugcuucaauaaaucuucaucuugggguaauuacaggcaagucauuuucacauccucuugagguucagagcaucagaaugaacucuaugaauacauguguaagugccagacagcugaaucuuuaucagguauuguaaagauacacauaugauauguuuauuaaaauugaaauaauguaaaacacaugaauaaauuugcaaaaccaagaucacaguacaccauaugcacucugguaccuuaauuuuuuuuuauaaauaauaaaagugaauauugaagcuucuuaaaguuggucuuaauuuuucauaaauaaaauuugggguuauaacagaaauaauacauuaaauacauagacaaaaaaaguuaaacauaagauaaucuauuuuacaguguuucuuauaggcuuacaauuauuugaauguauuuccaguucuuguaugauuaacuuuugugcauaucuaacuuuuuauuauuuuuaucuuuggcuacugcacgugcaucucucgucauuccuccaccaaauaaacagacaaaaguaguauugaaaaguuuacagucccuuaucuaauggcaaauuguguguauguaugauuuuuuuaucuuguucucuuaagauuuacugcugcuuaaaauuacuaccaguaauccuuagu

SEQ ID NO: 12699 - RNA, 48594 nt, Homo sapiens
uuuacauaagcagaugcauacaaacuccagaugugcucuuuuucuuacuguggguugugucuucuauaagggaaaaagaaauauuuaucauuucuuuuacugcugaggggaugggugcggcucucauauuucagaaaggggcuggaaagugagggaagccaaacuuuuuccuauuuaaggccaaagcaaaggaaucucaguggcugaguuuuaugacgggcccggugcugaagggcagggaacaacuugauggugcuacuuugaacugcuuuucuuuucuccuuuuugcacaaagagucucaugucugauauuuagacaugaugagcuuugugcaaaaggggagcuggcuacuucucgcucugcuucaucccacuauuauuuuggcacaacaggaaggugaguagguacugauuucaagaaacuuuaugggauuuuugucuuucuucuccucacaaagagggguguaaaggggaaaaucaguugccugauucaagauaauuuccucuauaagcuccagauugugaaacguugaacugaccauggcugugcuuuuuacauuacuugaaaaauaaucgcguuauguguguuuuuaagaguucugugguuaagauaagauguucuuguacuaacuuguuuucauguuaaaggcacuggaaacuuuuaaaaauggcuuuaaaauuuuucccuccuggauuguuaacaucuuggaauacuuccccaggcagucuggaaguuauuggucucuugcaauaauuuuauguuccucuuugucugcuggauucuuuguaagguuagaauauugagcauuguuuucugaauaagaaugccuuucaaauaucauggauuaagaacagucuaaaggaagauucuacgcauuaucagaaucauugaauauauuucuguaaaauggcuacaagauaccuauaaacauucuucaaagggaucaaacugcuaaaauauuuuauuauuccuguuuuuauuuuguuucaagaaugauugauuaauucaucuuuucuaguagcuugauauuaagggacuaauauuuuccacauauucuacguuuuaaccacauucgcauuaaugaagaaaauauuuuuuaaaauguuucaacaggagguuugacuuugcugcaaacaagguaaagauacuaguacuguuugacuucagaaagcuguuuugcuauauuuucuaauaauugcauguaauguuuuucauauucuaauuuccccuaaaaacacauuugucucauuauuuaugugaaaauauucuuuuauuuaccauagucaugaaaaugcugaacaaauuggaauacaaacuuccauagaaauaaauauuuaagugcuaaauguaaagauagcuaggagaaauuauuagacaauuuuuauugcacauaacuaaacaugguuacauuuaaacauauagauuuugcaaaggacacugcaugaaaauuugguuuuuguuuguaauaucaaauguauuuguuguccucauagcuaauacauguaaauguguguaugaggggagggguagauauacaaugaaaugucuucaguuauauucagcccauggacacaaaagaaaagaaacacccauuuuccuuguucccuuaauuuccucuccuccuuaccccuccucuccuucgcuuugcccuccuccuuaucucucuccaccccuuuuggcuccuuuagacuucucuucacucaucaccccaccccuuccuaggcaagcccauaucuacuccucucuccuccucugucuucccugccuguuacucccucccuacuccccauguggccuccuuaugccuccauuucuuuuuuuuaguucucucucuccuugccuccucacccuuucuuuccccugaacucucaauccuucuuccuuucucauuccucuccccuuuuccucccuauccugcucuucccaggagaugcuacaacucacaguccuuuuuuaggauaccaaaugacuacuaucccccaccaaccauuuauugaaaagacuacaaacuuagggguuuuagcucaaaaaauugcaacauauuuguaguugccucgugguugcaagcuuuuuauaagcacuguggcuauuuuucuucccaauccaacuuuaguggggggguguuugccacuuacaguaccuugacaucacauuaaguucuguuuauuucccucuuucucuuuagaugcaaaaaauaaucaauaaguauaaaauuuugcugauauguguuuguguguucuuaagcucaaaaagaguugaaagagaacuguucagccuauuuuuuuugucaugaguaaaaguaaaguugaagugacuuaagacaguacaucuuauguucccuguggguuuuacaaggaaauucugcuauuagauaagcuuuggaaaaguuacaggagguaucugaauauacagcacacugagagcugucauaaaguucuggggugggguuucuuauauaugcccucauaacuucagagacggcacagcucuaaugaacacucacuucuaguucacucacaggcauuuucuggauacaaacaaguccucaaaaagaauuuuggucgucuuacaaauuugugaacauuguauuuaauucauguguuuuaauccaccaauggagaaacauagucuguuuuauauuuccuguagauuauaaacaugccaaguuuuaaguacaaagaugcgucaccuaguggcugacaagccagguuaccauuuacauaacgaaugccaauauuaauguuauguagcuggcuuugguaguuuauaaugagcuuuaaaaaauucauaugcgugaauuuuaaauguuaacacugcucuccuaaggaaauuaguauguuacggauaaauauugcaaacacauauacugacacgaaaacacaaugguaacaauauucagagucuuuuuggaaauuagcuuaaauguuacggccacuuaaaaauucuacauaugacuauuguuuaaauacauuuuucaugucucugauguaguccuuauuugacauaaguauuuuauucacugcuuaauuguuagauagauuauagacagcuguuacuaaguaauacugcuccauuagggcagaaacagaaacuuuauuuuaauuaaauguguacuaauguuugaguuucuauauuuugcuacagugauaauuccaguaaaauaaacuguaggccucuaguuguuuuagaauuuuaaaacuguaaauggacucagagaaucaguuucuuauuagacgucaugagaguauauuuuuuucauuaugcuuuaagagggaauuuguaacuugcucagguaacauucaaguuuucugguuuguguuugucccuacaauuaaacacacugaacuaacaggaaaagguuacauacauuuaggaacaauugcacuuuuaaagggagagaaugcauaguugcucacauaucucagugucagucaccuaacauggaucagugcuuuauuugagauuacaaaacuagaaaaugacggagucaaggcuaggaccaauauucuguucagucuuagauaauuauagaauacacauuaaaaucagauauuugaauuuucuuaauuuuguaacuauuugucauugaaaggagauacuaaaaaaauuauauaucguccuagaaaguacaugaacuaauaaugcauuucuaaaggugaaaaaagaauagguauuuuucuguuuaauauucaauuuuauagagaguaguacguuaauuuuuuuaaaccccagaagcucaggaucuuaucauuuuaaaagaaauuaucaccaguucugugugaguaaauaaaguauuauaacacuuuguguuuuucauccaugauaccuuguauuuacuuaccugagcuuuuuuucuagggaaagaaaaaugcucagguaauaacagagccuugaaaaauuuggauuuucaaaacuaccuauuuauguauaggccuuuagaucaucugauguugaauacucuuuaagugaucuaaaggccuacauauaaaaagguauuuuuauuaaauucuggaauuaaacauuucagcauuacaagaaaagaaagcaaauccacuggaacaauucugggaaagaaggaaagacugugauuaaaugccucuuaacuacuucagauuccuggauugaugucuuaucuacaggcuucuuuuuaaaaaucaagaaugauuggcugugaguuuaccaggauuauaguugaggcuaaaggacagcuccucaggaaagccccuguucuacaucuacggucacaugcuggaccuugaguugucacucagagaaaagagugccaucuaccgaaacuccacaguuuccauugugaauggcuucuuuggugcagaguuccaaaaauuauguagcccagcucuuuaauuuuguaacaucuaaugauaucaccgccuugaagugauuaaaguagauugcuuaaagaauuaaagcuuuaaagaugaaagauguuauugcuuuugcuggacaugaggaacaguuguaaaguuuccaggucuacaauaacuuucuggaacccucucagugaacuguuucuuguaaaaguuuucccuaagauaaaagcucaaucccauuguuuccacacucaaaaaaaaaaaaaaaaaaaagaucauauaguguaaaaaaaaacucuccagacuuuucaaaggggaaacuuugccuguuucaugucaagaugacaacggaaaaaaugagauagcuauucuuacauaaaucauuugugaacugcaguugggggaguuacauuaaccaccagaguuucagucugugucuaaugaaaacacagcagaaguggauuccuuucagauuaacuaauaaaacccuuguuuuuuuccaugacugaggucaagcacugcuguuuaaaauguagucuuaaugaacaaaaugaaacguugaaagaggacgagucaaaaugcccaaaagauguaaacaucaaagagaaaagauccagaaauuauuaaaaguuaaacuucccuugaauucuaguauuaagaaaguacugcuucaguaaaauggcauauauuuuucugaaacuguuuuucuauaguauuuuguguggaggaugacagagacugcauuucucaaguaaauuaaaaucacagaaauacucuuuggaguugcauagcauguucacaacguuccaguuucauucagugaaaacuucugaugaacuuagauguauauuaacaugaaucauuuaguaacuauauuuucugaaaaacaguguguuaaugagacaucuuaaacauauuuuugcauuggaugcagaagucuuuucugucugguacuauuguuguuagaacccuacuuuuuuguauauagcaaaauguaugcaggguuucugagucacacauuuauucuguugguggucuggaugucaucaggguagcuuuagagauauaacccuucuucauaaggucaagagaaaauaaacaggagaauuuaacuccagauggcaucuuccuguuuugaggccagauagaaaaauauuuugcaaagaacuguuguccuucaaaauauaccuaucuagauucagauuuuaaccuugcagggauaaaaaaucauaugggacagagcuuuggaguuggcuucuuuaaucguacucaguuuugaaauagcagaaagaaaauagaaugcaguaauuaagaguaucaaauuuagagaaagccuucuuacacucagaucuucuuuuucacccugacuguguaaccuugggaaaauuacuuaauguuucugcaguuaagauuccucaucuguaaaauuaggauuaugacagcuguaagcucauaaggccuuugggaguaugaagcaaaauagauauucaaacuacucagagcagucccuacaagauaggagguacuauagcacuaguuuuacuaacgcuggcaaauaaaauuacucuaaggaagaaauuaaaguacuuaguaacuuagugauaaggauggugaaauguaaaauuuuauuuauaagacuauacaauuuaaaguuguuugccaaauguaauaagacaaguagaauauauucucuucaauguuuuuauaauuugacacuaagaagauuuuauuauauaugcaauugcuggugguuagauauaugauacuuaaaauuuucuaauuaucuaauuauuuuuauuuuuaacaggauaaaauauuaaucaacuuaaaggacauuucuaaggagauugaauucuaaaagauuaaucuuuuagacaauucuaaaagauuaaucuuuuagacaauucuaaaagauuaaucuuuuagacaauucuaaaagauuaaucuuuuagacaauucuaaaagauuaauugaauucuaaaagauuaaucaacuuaaaggacauuucuaaggagauugaaaaagcauauaucuauaaaauaugaaacaagaaaauaucuacaaaugauaauuuaucaacuuuuuuuccuggagguagcaagaauaaauaaaaucuuauuuucuaugcaaaacagugcuuuuaaauuaaaauuauucaccuagaaugucuacagauacuuucuucagaguccuuuuuguuaaguaaucuaacauauuuuaagauacucugauaaauacauaagcagcagaaaaaauauuuuauuaaaauuuauguuuuccaaacaauaucauuuaaaaggcaaaccaaacauuauuucaauuggaaacuauaugaaugccaaauacccacauguacaaaauauucagcuuucuaaaguaaugaaaauaauuaugauaauuuauauaucauaucugugauucuuagauuuucagauuauacaacaucuuuucccagauaaggauuuaguaagaagagaaaaggaaaaaacauucacuuuucauucaagccaaauuaauuaauuuaauuaggugcuuuagggaauaauauuauugcuccaaaaauaguauuaagacaaacauaacauucauuuuuuguccaaacaauaugauuucuucaagucagcaugauuuaacaugaagaauggaaacaaaaaaaucacaaaauaguaagcuuuaugcacaucuaaaaauauaaaauuauguuauuuggcuuuauuuuucucuaaaauuccaaaauagaaaacuaggaaagaagcagcuaagagugguuuaagacauguguuagcuucaauauguuuuauauuauagaucccagcaaggagaugauugaguuuaauacauugcuugugugaucacaaguaaauuucuuucagaauuguacuucguaguaaggaacagaaacaccaaaugacaugggagauggaauuuaaaauuaauuauaaauuggaacagagagauuuaguuuaaacaacuaaaauaauggaaauaauuggaaaguccauuacuuuucaauaguagaaugaaauuauuugccuuuuauuuaauauuuuuggaaaaaauuaacuuauuuuuuuaaccgaagcuacucugaaugcagauaucuaagaaaugaagagaauaauaugagaugacuuacuucuaaaucccauuuucuauucuauuucuaaauguugcaaauggcuaacuagagcauuuuuauuccucuagaaacaaaacauucuuuuccuugacuuugccaugauuuucgcacauauuacuagguauuaaaugaagguccaugaaacaucaaucuaagagcuuuaacuuucaguagaauauauugcuaacuauauuuugucaugcauggaauaauaaaggaagcuauacaaaacuauuuuuuucagcaaagguaacuaagguagaaaaacagagaaagggcuaauuuucagccacaaguuuuuacaggaacugacuucucaggagagccaaauuuauuucaaguggaugugaaauaaguuauggcaauaaauaaaguugcauuaauucuuauuuuuuaaacauuccaacucucuuuuuuuuacuuaaaacaauaugacuuucuaaaguaaaacaaaacauacaugcaccauguugacugucaugugcaggugagaagagaaaaauauuuuaagaauaugauaauuuuuaaaauugcacuaaaauaaucuuuauauugaggccuccguguuuuaaaaaguacuauaauauguuucuaauaaaauuuagaaacaauaagcuaaauaacaacguuaauacuuauaacauugcauuugacccaauuuuaacaaacucauuuacaauuuuaauaagucaauauugugcucauuuauuuaauaauuagcagaacaaauggaaaguacuguauuucuaaugaugugaggacacccuuaaugagacauaaacauaggaggaugaauacacaggagggaaaaguauuuauguuaauuucuaggcagaucaagaacauauagaagauacuuaaaauaggaaauguuugagccuagcuuuaacuauuaucuucauuugucuuuaauaugccuuuaguauucaauggcuguuuuucauaauccacgugcuguauuaagugugaaaagauaugccugauccagaggcaaugagcuaaaagaaucaucuguacaaucuaacaaugcuuuugaggauggaucuggagggcuuaaaauacacauuauuaaugggaaaaucuugggcugaaacuaaucuguaggaauauuucauauaaaguugauuuggagaaaauuuuuaagugguucauuuugagaaaaggaaccaauguaauuacaguguuccauguaauuuuacugcacaaucuuccaaacccaaauuuucggaccuuuucugcagacuggugaacuuaguacuuaaauaugaaacgccaguucugucuagagaacaaaaugaguuuaaugcauagacucaccuguuauuacucuucacaccaauguguaaaugacuguuugcucuucuauuaaauauauuuuccguaacaccauucaaauaggccuacuucauuuccacugagauaagcauuuugguauucagcuuuuauauucacuaagaauuaagaaaugcuguuuuaaaagcuuaggaaauguauauagaaaauauaucccauguucucauauauguguuucagacauaggggaggaauuagaauaaauuuucuaaauaaacaaauuauuugccuacuuaaaauugcaauuaaaaaaugaagcuuuccuucguuagcuguaaacuacauugagaaauuguaacauaaaaaagaauggauuuuuaaaacuucuugaguagaucaagugucuuguacaauaucauuaaauuuguaucagaacacauaaauggaaaugagguggggaagcaauugcaguacuuucuagagucuagguuuugaaauucuuuuuggugaacauuuacuaaaucagcuaaacauuucaacucauuuaaacacaaaccuaaauuauuauuacccuagacagagagaugauauagcaacgggaccucgaaaaggugaucuuuuguggcugcauguagugcccagauggaaaaaucuuaggaccacuaaaaggccucuugaccacuaggcggcaaaaacuaauuuugaacuacuugccuacucgguagcaggccucuuucaauagacauuuuaaauaucuuggcuuugagaaaauaaaaauuucaccaucucacaaaaauauaaauuacugaacaguacaucauuuguuguuugcaaaaauuuuugcagaugcuuagaaacuuauuauuuauuuacucaauuacuggcaaacuaucauacuaauugucaagaacuaaaguuguauuuaaccacaauacacagcuaaugccuuaagaauugagaccagguuuuguuuuggcaauuccuaagcugauucauaguuaauagcugcugaaauuucaguaccuuguauauaauuaugaagcaagucuaaaauuuugguugaagcaauuuuuuuuaccauuuuaagccacaaauacagaugguuaugauucauauuuucccuauuauuuuuacuuauuccuugccaauguuuauuuuaaaaacaucuuuuucuuuucuuuuuggugauuuggaaaugucuuuacauccauaugggauauacaauauauuaugucauaucauguugagcuacuaaugccaaauagagcuaacagugacauucaauacacauaauaaguucuguuaaaacuuucccaggaaaaucugguagaguuuuaugcugccaagauuagcucaguuuuccccugaauuucucaacuagguugauaaaauccagaaagucuucagaguuagugacaaaaucaucucuuuaguuuaaugcucccaucugcuguuaaggcaaagaauagcaauuggguagaagagcuuauuuucaauguuccuuuaauaaauaaauguuuaaaugcuugugugauauacauugauguuaauucuuacuauaaaugaaauuaaaauaucugcuggucuuaaggaaaauugacuauggugugccaauuuuauguuaacaagcagauaugauauuuuaauuaauuucuugcuacuuagcaaauuacauagggcaaguauaauuuucuaaugaaaggaagaaauuauuuguuucaaaccuuuucaacuuuggcuauuguuaauaguccuaacagaguaacaaaaaucaccuuucagcaaaaccuaaggaaacuucacgucaucuaacuuguuuuucagcuguugaaggaggauguucccaucuuggucaguccuaugcggauagagaugucuggaagccagaaccaugccaaauaugugucugugacucaggauccguucucugcgaugacauaauaugugacgaucaagaauuagacugccccaacccagaaauuccauuuggagaauguugugcaguuugcccacagccuccaacugcugugaguuuaaagauaaacuguacaucuucaauauucauauuuagacacaugaauagcuccuauaucauaggagccuaaaagggaaugaaagucauguucaucaaauagccauguuuguauuacgaguaaaaagugaccguuucaauuuaaagauaaggauugguuagaaucuggguuacuaaauaauaugcaaauucugugucuuguuuaacuuguuucuuuuccauuuauuagccuacucgcccuccuaauggucaaggaccucaaggccccaagggagauccaguaaguaaacauucuucaguagaauaaaauuaauacuaaugauaauucuaguaagaguuugcuuuuucuagauuugagcuuucaucauacauucucuucauuaccacauauuugaauaauggcaccaaacaacagacugagaauccauaauuguacguguaaagauuucaauuucccaaacuucauauuaugucuucacccccaugaucaguuuaaagaaaauguguaggucaauauacaaaggaauacauuauacuuaaauuauucacaagauuuugauuaaaaaguauguguuauaaagaaaauauauuacuuauauuguuuccuaauauuauaaaguagagaaacaacaaucugauaaugauugugaaucaccaggauuuuucacuauuuaauuuauuuuuaucucuuuuuuagggcccuccugguauuccugggagaaauggugacccugguauuccaggacaaccaggguccccugguucuccuggccccccuggaaucugugaaucaugcccuacugguccucagguauaacaauuacgguacuuaaaaaauucccucauaaaacuaucuaguucaucuucuuucuuuacucgauauuacgucucacuauuaugaguucuuuguaucuguucucugauucaguguauuuaauaaauccuuauuuagugcuucuauguauuaggcacuauucuaaguacuuuauaaguauucauuuuuccucauaaugcuaaugucauugcuacuauauccuuggaaaauuugcuaauuucucagcagauauauagcauacacauuauguuuaagaagugaacuaugaacuuaacaaaaaaaauuaaccuaaauaauuuaguuaguacuguauccauacuuuauucuccuacuaauaccaaugucaaagccucuaaaaguuuagacaaaaagaaguugaagaacuguuaguauuccuauugaacaggauuauuucugccuaugaaacugcucuugcuaauacuucagagcacaccuugcuucuccugaagcauggcagccaaauaaaucugcagguaaaacaaccaaacaaauaaauaugacaaaauuucuguugcauggaauuaggugaaacgagaaaauauauuacacaaauuuuugugagguuaaaaagugcauuucaaaaagcaauucaacaagaaccaaaguauauugucuaaguuauucuuauucuaguaaccaaacagaaccuaacucuagaccuggaacuuagaauuuaaaaaaagcuucaaagaaaucuaauaagcauaugagccuuucuacuauuuuuugguuuauuuucuauggagauguuuauuuuugagugaaucuuuuagucauauuaaccagaauccaggggauaugaauuuuacuuguaucauuaaguguuugaaaaauaauuugacuucauuuuuuugcucaaaaugagaagguguauuauaugaucucgagacucuuuuggccucaaacagccuaugauccuauguuuguaaugauguagcuacugcuuagaaauaauagcuuaaguaagcgcauaauaggaaaaauuggggggaacuaacauugaacacaguggaaagauuugugcaucccacaagaaaaugcuucuguaggauaucuaacgucuaaaucuacagaaagacacgauaaacaagauaauuagugaauacauaccacaucuuuuggcacacaaaaaccuaucaguagacaguagauguugcaugcacuucuaaaugcuuuuuaaaagaauuaugaacugucuguuaaaaugaucauaucuauuugucuccuugccacagaacuauucuccccaguaugauucauaugaugucaagucuggaguagcaguaggaggacucgcaggcuauccuggaccagcuguacguacaaauguuucucagcauuuuggagcuuuauuaucuuucugguuuguaaaaucuugaaugguugcucuucuaggaauucaguauuuuuauggaauuguacaaaauagcuuaccccuacuaagguuggaaaagaaaaugguagcauuaucauguucuuucuaucuuauucauauuauuaaaccuauuuuuaaucacauauaaauuuuuacuaaaaaaaaaaaccaaagucaacacuuauuaacaucucagaaaaguguuuauaagagaaaauggaaauauacaaacuauuguuuuauaaauuuacuaucaguauuuagaaacagcauguuacaaaacugaagcauacuguuuucagcuugcugaagguuuucuaguuuaaucuguauuucugaacaaugauaaaucaauuguccuauguaugaugauucuugcaugaucauauaaaucucuaugucaauuaacucugugauagauauaucaacauaauuaugggacuuuuggguugauuuacauuauuauuuuagauacuugauuauaggauuucuagugugccaauaaauguuuuucugcacugaguuuggcugccaagcgagaaauugcuucuucaccagugcaauauaacccuaacauugcagggauuuucauagcauuauguacuaguuuuuccagauuuuuaauucccuuccuuaagaguucaggacaacauuuuauaacauuuauuaauaauuuauauagaaucugugagaauuucauuacaguaauguuugcuugcuaagaucuucauuauagaucucaugaauaguuaucaaaaaguuaucaaaagaugagauauaguuguucauaguuuuaacaaugcgagugucauugcuuugaagcauggauaaaguguauuuugcauucauuuauuuuguuuuucauucaaauucacauuccagggccccccaggcccucccggucccccugguacaucuggucauccugguuccccuguaaguauagccauuggugguguuuucuuccucauuuuuagaaaaaucaaauuaauauauauucugcuauaauucagccauuccagcaugcauaaucccaguuaacuagagaaaucauaaccaagaaacugauuaaggcuucaaagauggaauuccauauuuaauuccuuuccaccaacaguuauuagcaauugaaaucuugguaaaauuaaaccacauuaauuugcauguaauaugacuuuuaguucaaaaccauucaguuuugauggauugcaaugaauggaaugaaauacauuaacuucauucugaucuaaaaauaauuuggucucaauauuuauaaacuggaguaaaauuugcugauuacauucacaauccugauuucuuacugucaagauguaaaugaauuauaugaagauuuuguuacuuuaaaauuauuuacauauucuacucacuagggaucuccaggauaccaaggacccccuggugaaccugggcaagcugguccuucaguaaguaacaauuaaauuuauauuuaguaagucgauaauuccauauggaaccuaccuuuguuuucuaaaacaaguauaggucuuuacagaaugaagauuaaauuuacccuuaaguuuguaaauaacgaauagcauuuuauugagucuuuuggacucuuucaauuguuagcuaucuuagagacacuaguuaauaaaggaauucccucaucauuagccaucaaaauaguccacuucccagagcugauaaaaauucuguauauauuaaauauagauuucauuuuucuguaaacacucaguucacucauaucuaaucuacugauaaauauaguuauauauuuacauauguaaauauacauauacauauaucuuagacaguagaaauaaacauaaucuuagagaguccuuuagaaggauaugcucuguaaauaagcaaguaaaauaguuuaaauacaacauuucaugacauuuagaaauaccuuuauauuuagauauauuuaauauuccuaaacguguagaaaugcauuuggauuuauaaauacacauacguaauauaugaugcuuuuaauuuuuauuaacaguaaguugauauaauagagguauaauauuaacucaguaaguaucauuuucauuaucagaaacauuaaaaguauuuucuaaaaggagguuccuuccaggaauacauacacuguguaauaauaaauuguaacagaaaaauuuacaaaucuauucauuuuuuauuuccuuauuuucagggcccuccaggaccuccuggugcuauagguccaucugguccugcuggaaaagauguaaguuuuuaaaacuuaaauaagaauacagcaaaauuuaacuugguguauucuaaacaguauaugcuuuaugucagaaucccagaagaaaaaaaaauguuauucaaaauauuguugucuuaacaacauuuuaguuaauacuaauuuuugaguagcuauacaguauuugcguuucuauauauaucauuuguugaauuccaaaauaaaauccuuaaagugcuuuuugacugcggagaagacucauccauugaauauauuauuuaacuggaggagaaauaggugucucugccugccucuuuuaaugaugaaauugauaccacuauuuaaugaacuugagaaguuauagauaccuucaauucaauggcauuccuucuuucccucuuaaucuccaauggcaaauucuuuucacuggcuuauguuauuucagugauuagaagcaccugcauuaucucuuuauaagcuuauaucaaagugggaaaggucuuccucaugccuucuaccaagaaagcugaucucaacuauacauuuuguggaaccauuuuaaugaguccuuugugagaaaaaugcaaaguaaccauuuugcuuauuggcuacaauguauuuucucauacaugagcaccuacguauucuuuauuucucuaccuagggagaaucagguagacccggacgaccuggagagcgaggauugccuggaccuccagugagucuucagcaucuaauaaauuaauuggaauaaucuuagcuugaaaacuauuauguaauucaauggaauuaaacuuaaaaacagaaaguguuuuacuacuagauugugauucuauuugaagguucauuaauauuuuuucauucauuauuuuuaggguaucaaagguccagcugggauaccuggauucccugguaugaaaggacacagaguaaguagaguuucuaaguuguuuacaagguauuccacugggcuauguuuacuugccuaaccaauuuuacuggacaauuaugugccaaaaaauaugauucugacaauuaauuaauuugauauuuuuaagucuacuaaguuuguuuguugaccaaacuagucauuuuuugcaaaauaaaggaguugauuucuaguguauaaaguacucuugaaaaauaucguuuucuuacuaccacuaucagaaaaauaaaaacauuuugugaauuauguuuuuuauugacuuaauaugauuuauagauugaguugaacaacuuuauucuaugcaaaauauuucguacauucaaccaacugugccuacaaccuaucaacugaauuauaauaaaaucuaugaaacucauguuugcuacucuauaguuaaggcaacuuucuuaucagacuaaauugcacuuucuaguuuucauguuuuccuguuguaaaaucaguaugaaauaucuucaaccccuuuaaacaaguuuuaaauuauuuaagcuaauuuugcaaguaguguuaugaagaccaauuagaaaaauaccauguaaacuuuaucaaucauucuagauuauuaacagauuuuaauaauuuugcugguuuuauacauuuccuagggcuucgauggacgaaauggagaaaagggugaaacaggugcuccuggauuaaagguaaaucacaacaaaaaucauauuuucauaaguaaauucauuaaauauuaaagcuacauauaagauucauauugugagccuuaacuuguuuucugaaauuuaccugaauuuuaccuauuaggugugaauaaugguaaccaauucagauauucuauuaacgcuuccaugaaaaaugacaacuugaagagucuagauuagaaauaguugagcaucuuaguauaacuuaucaauuacuucacuuuagucuuuaaguuuuuaaauacagaaauugagauuucugguaaauaaaauacuaacagaaaauuaauauuguuaaaauguauaucuuuuucuaggcucuauaaacuuuuccauaauauucuguauuuaaaaauauauaauauuuucuuccucuuuuguaaaauaguaacauauuuuauauguaucuagggugaaaauggucuuccaggcgaaaauggagcuccuggacccaugguaauuauguuucuuauguauaauuuucaguuuuauuauuaaccucauuguuaccuaaaacuggcuuugcucccaccccaacuguucuuacacaugucaagauuagaguaaaaccauauuucaauuuuacucuguaggguccaagaggggcuccuggugagcgaggacggccaggacuuccuggggcugcagugaguauagcugcuaacaucacacaauuacaacccaaagugacagauuuuuacagccucaguaaaguuucaggcuguaaaaauauguuaggaaaaagaccuuccuacaaaauuauacucaaugauacugugauaaaguuuuggcuauaguuaaaaggaaaugaauaauuguuuuacaauuauuaucucuauugagaauuuuuguguuaacuuuucauaugucauuugagccauuauaucugcauucaguccugaaaacacagacuccaauccuucuacauuugauuguugcuguauauaucagaauuguaauaauugacuuuaaaauacauaauuauuaagcagauuuuaauguacuugaagaaaacucaacucacuugagucagaauuuuggucaaaauauuacucaugaccagccauucagaauuaaaaggauauuugauguaaacuucucuuuuuagggugcucgggguaaugacggugcucgaggcagugauggucaaccaguaaguaacuuucuaucucuuauguguuguaggguaaugagaaguuauggauuguggauuauuuaauauuuuauauauguauauacucuuagguauauauauaugcauauguauaucucuaauauacacauuagcaucucuguugaccauuuuuacaauuuaaaaagugaaaaaauauuguagccccaauacuuaauauuguauauacacuccugugauuaaaacugacacugagcccauaaacaaaaucuagguucugacacucauucugcuugaucaacugcuaacauuugaauggugcucccaauguuaguuaauauccuauguaagacauggcacuuuaaagaguccuacaaaauggauaaaauagauguuaccuccauuuuguagacuggaguacaaaagcccagggaaaaguagccugcacuaagucacagaauucauggcaaaguagggagaaaccaagaauuucuaacuuuagauuucacucuuuucuuauuuuaccacauuguuucucuacauaauauccauaaaauaugaauaucauuuuuaucugcauaaauaucuucuuuacuuuauaugugcucacuuauuuacuaguaugucagcuuucauuuaguugaaaaagagcucuugaaauuguauuuaauuuuuucagggcccuccugguccuccuggaacugccggauucccuggauccccuggugcuaagguaaacauguguuucuauagaaggguauaaaaauaucuuggaggcaagagaaaagcauuagauugcuucuugcaacugauuuuuuuaaucagucaaauggauagcuuuuaucuauacaugucuuuaaagcccuauucuugauucuaaaagagguguugucccuaguauucaacuaucuugauauuucuucugcuaccuucuuuuuuuccccagacucuuucuaggaaacugauaaugcaaucacacacacauaguuacauuuuucucugccuuuacgauuaaugauuccuugcuuuaccugcaguauagagucccacuacuccaacuuuugggagauguguuuaaacaggacugaagggugaaguggcuaagugaguagaagugguaagagaaacugacuacacaagguuuuaccauuagggugaaguuggaccugcagggucuccugguucaaauggugccccuggacaaagaggagaaccuggaccucagggacacgcuggugcucaagguccuccuguaaguaucauaguugagagggaguaagcauaguuucaugcuuacuccaugaaagcauaguuucaugcuuacuccaugaaagcaugugcuucaauauggcuaucagugaaaauuacuuugaaaaaauuguugcuuagugcucuaaaaugauccuccugugacacauacugauuugauuaguaguaaaaaugauaguuuuugacuguugcacuauuccagaauucaugauuuuuuauguuuauauaaaagaauagaggauagacuaguuuucugaugcuuucaagaaugugccccaagcuaaucaccaaucauaaaaauucagagaagaaccaaauucaaaaucucuucuauuuauguaucauuuaauaauuuauacgaaguacauauuaucucuaauuuauuuagauaaugaugauucuuuugaccacauuucauauguuguguuauaguuggaggauucacuuaaucucuacaaagcauaacacucaucgauacauuuauuuucacacaaacaacuucaaauauauacgaacuauuugcauuacuauuaauacauuaucuguuuuuuguauacuuagggcccuccugggauuaaugguaguccuggugguaaaggcgaaaugguaagcuguccccacuccucagccuuaucucauccacacauuacuggcuucuuuugcauuuugcaugacaauagauuugugauauuuaagugagauauucauaaaagaacauucaaguucggcuaauauagugucuuugguuuguucuuagggucccgcuggcauuccuggagcuccuggacugaugggagcccgggguccuccaggaccagccggugcuaauggugcuccuggacugcgagguggugcaguaaguugccuuguuuuuucucuguugacugaaagguauaguuuaauuccaucaacaaaaaauuaauagcaaaauuuugcuccuguucaguugaauuuauauugacuucacucuugucuuauaacuuauaacugaauuauguguuacuggugaugauuuguuagucgaauccucccuguguuucaaccaagacuuuguuauacuuuagggugagccugguaagaauggugccaaaggagagcccggaccacguggugaacgcguaaguuuuacugcaacagaucugguuauuucuugaaaaaaugcaacauaauuagaaaguaaacagguaaaaacuuugaacuaaauucagucauaauuucuuuauuuuaccaucuuuuuuuuuuuucagggugaggcugguauuccagguguuccaggagcuaaaggcgaagauggcaaggauggaucaccuggagaaccuggugcaaaugggcuuccaggagcugcaggagaaaggguacguuuuccauggggcaucuaaaagaaaagcagcaucacugucaucuaaauaaaacuaccuucagggugagacagccaauuuuucuuaaguugaguguucagugaaaauauuguuuaaagcauucuaugacauaaaaauauuugccacucaagaauuaugaaaaagaauugaaauccuuuggacugaaauacuugucuuucauuauuuucagggugccccuggguuccgaggaccugcuggaccaaauggcaucccaggagaaaagguagauaacuuuaguuucuauguuccuaaaugcuagcaccacaaaugggcaguucuuguauacaauuucucauucaugaaaaccuaaauaucugaagaauauauauuagaguuaagaaaaauuccuaauauaaugcauccucuguucaacaacuuuccuggcuuuguaacuaaagccacuuacuuacccucuaugagaauccuuuacuuaucuguuaauuggaaagcauuuaucugagcaucguugcaagaguacaguaaacuaaaaugccugaaaagucuuugaaaacucuaagguuacaucaaauaugauuucauagcauuaagauauuugauuuuagcugcacauaauuauauuuuuaagcacagugaauacuguuuuauuaagcaugugauguucacaaaguugcuuuaaaauuuuuucaauauggcaauccaagcuaagauaacugauuuuauguauaaauguuucagcaacacacgaacccuuuuuaaaaguucaaaugacguccucucuuuguaaccaaaauauuguugcuaucuagguuagugaaggcuauuuuaauuuuuuuaaaauuucuuucacuacuuaggguccugcuggagagcguggugcuccaggcccugcagggcccagaggagcugcuggagaaccuggcagagauggcgucccuggagguccaggaaugaggguacagagaaacauuuguuugaaugacacuuuaauuuagacagaagaaaggcaagacaaaugaagacagaucaaaagcaacuuaaaucaaucagauuacauauuuuguaaggcaccaaacaaaacaaaauucuuuuaaguaaacuuaagccgagauaguucaaggagaagagaagauagaacacuugccuuagauacuuuauagacaggaaaaaagaugugcaaaucugaggcuucacauguaagugaaaauaucaaaaucauacaaauaguguauguaguaauuuuuuauuauuucauuuuaaaucaccuaacaacugacuucuuuacuucagggcaugcccggaaguccaggaggaccaggaagugaugggaaaccagggccucccguauguacauuuuuaaaaucucauuuuaaaaggccaguuaaaauggaauguauauguuggccuauccuugaguguguguguguguguguguguauauauauauauguauauguauaucuauauauauacacacacacacacacacacacauacuauauauauagcaugcuuuaaucuucucuuuaucaaaccuuuauuaauguaauuuuuucuuauuagggaagucaaggagaaaguggucgaccagguccuccugggccaucugguccccgaggucagccuggugucaugggcuuccccgguccuaaaggaaaugaugugaguuccuucauuaauuucuucaauaaauauuugacuggaaggcuuuuauuuuccauauggaguaaagaaauggucaaaacucagucuccucuucaaagcauggaggaguauaugaaaaucaaauugcauguaggaagggagcuaaauauauaauugguuaugguuguauguguguguauggagcaggcagauaaaaaauaugaaacaggcugggugcgcuggcucacgccuguaaucccagcacucugggaggccaaggcaggcagaucaccugaggucaggaguucuaggccagccuugccaacauggugaaacccugucuccacuaaaaauacaaaaauuagccaggcaugguggcaugugccuguaauccuagcuacccaggaggcugaggcaagagaaucacuagaacccggggggcagaggcuacagugagccaagauugcgccacugcacuccagccugggcgacagagcaagacucagucucaaaaauauguauguguguguguguauauauauauaugagacauauauauaugagacauauauauaugagacauauauauaugagacauauauauaugagacauauauauaugagacaauaauaugauuaguuauugcccuuugaggauuaguaaauaccgaccacuucuucuuuagggugcuccugguaagaauggagaacgagguggcccuggaggaccuggcccucagguacguagcuuuccucaauuuauuucuagccuucuaauagaugcguucaucuccaaccuucugacuucucucuguaaucuguauuauuucuacuucccuaacuguucuuguuuuuaggguccuccuggaaagaauggugaaacuggaccucagggacccccagggccuacuguaaguucacucauauaaaauuggagaugaaaauaggguggagguggggcaggaagaaugcuucaaaaauuacauaaucucugacaccauguuguuacaguuuaccaaagcaaugaugaaacuugcugaccuaguuaucuagcuaaaugcuagcauugaguuuagaguguacaugugugcuuuggguccagguccucccuuuucuucacaucacuacuuuuauaauuaagcaacaggccuguugaaauggauacuguagacuaaauauaaaaggauguuuacaacagaguguaucauuauacuuuucuaggggccugguggugacaaaggagacacaggacccccugguccacaaggauuacaaguaagaacuuguuauuuaaaugucacggcauaucugacugucaaauuuuuuugugucccuaauagauuauaauuuaucugaagcuuaacuugugauucugucuuucaucuggaaauaaaauuuuaggcaauguuaauagguaggcauaucuuccauguccguuccagagcacauuaauaaguuauuuaaaagaauuaaugaaacucaaauaauucuauuugguuacacuuauuuuuauuauaacauaaauccauauagccaagucuauccugccaugcuggucaauacauuuuuacguguagcaauugaaagaacagagagagaugaaaauggguuuguaaaauaugauuaucacguaugugucacuggauuuugaguggcacaacguuucuaccccuacaagaccacuggaacuuuuuuuuaauaucuugcagaaacauguguacauaugagaagcuuuucuauaagccauguuugagguaauuaccuaauacaaauaugauucuuucuagggcuugccugguacaggugguccuccaggagaaaauggaaaaccuggggaaccaguaaguuacguuucauuauucaaaacucagaaacaaaaagaauacacacuguuuguuugucaacuauuaacuucuuaauuuucuuaugccaugauauuugagauuuaacauuuaguuuugaaauauuaucaaaacaaagacaaauuauuuaaaagauaacuauuauauagaguuugaauuuuaccauaaaauagagaguucauaguuucaagauuugaaaaauuauacaguaugccaacaugacaaauguguauuuugcuuauauuuacauauuugcuuauauuuacauauuugcuuauauuuacauaaaaugcacucugauaugggccuaaucauauaaugccaaucucccaggguccaaagggugaugccggugcaccuggagcuccaggaggcaagguaguauuucaauuuauucucuaccuucuucagcagguuauagagcaauugauuaguaguauauuuuuaguauaucaagccaaaauacucuuucuuuaaaagagcaucauugcaaauguuugguaaguacacuuagagaaacucaagacacuuucaauacauuaaauuugcuuuaaucuggaagguccaauucucugacauucauaaucacuacagaaucaaauacgggcuuaaaauuucaaacggaaaaauauugccaauauguugauucuauguaggaaaacuguuuugguaaaaagaacuuuaaaauguugcucuugugaauaaaauaauaaguauuucaaugacagcucacacuuaaccagacuaaguauccaaguuuuauuuuagacacucuuuuaagcuucuaguucccacccagcuguucaacuauuuuuaaguauacaaauuucuagauuguucacaauauaauaaccuaguggccugauucaaaaugaugcaaguuaaggugcuuuguuuuuagcuuuggguugucuaauaugguuauuuacauauuuuugucacagggugaugcuggugccccuggugaacguggaccuccuggauuggcaggggccccaggacuuagagguggagcuggucccccuggucccgaaggaggaaagguaacuccacagcauuccauucaccuagguuuaaaaaaugcauuugauuuccuucugaucauuuauuauuucucacuuauuuucagggugcugcugguccuccugggccaccuggugcugcugguacuccuggucugcaaggaaugccuggagaaagaggaggucuuggaaguccugguccaaagggugacaagguguugacuuguuuucucuuaauuguucaauaaaucagucauuguagguuuuaaaaaaagcaacacuccuggaaaguaaucgacuguauuuucaaaauuaauguuaucauuuuauaguaagugaaauuuaagauggauuccuaaagcaacaaugaauuagaacacccaauauauaucccuacaaauccugagaguuacuccucuucuuggcugauuuucacugaagauacuuugaaucugaugacauuggcuuuuauuugacagggugaaccaggcgguccaggugcugauggugucccagggaaagauggcccaagggugaguauucccagugaggagaagcaggccuuaucuauaugucauaugggacaguccugcacuucaacuuuaauuuuuuccaaaaacuacucaagagaaauuagauauuuuaccaccuaaagacccgaaugacuugauuuauaaugaaauuuguggucuauaucuauggcuacuugauagaucuacagugacuaaagaaugaaaaagccucaagaguacgauaaaggucacaaacuagcauuugugagucacuaaaaucugagauaaucacugaaauuuaggauaaucaaugcugcucauuaagaaacuaaaagucaucaaaauucaauauaguaaguacuccucauuaauagacuuaauauuuaaaaauuguauaguauuuagcaacaaaaaggaaugaacaauugaugcuguacacacagcaaauuauacaaaccucaaggacaacauacucagugaagaaaauucagucaccaagggauacauacugcaugauuccauuccuacaauauuugcaaaauaacuuccuuguagagauguagaacagauuagugguugcuagcaguuaagaaugagaaagagagagauggauguggcuauggagacaugacacaagggagucuuauggugauugcacauuugaguaucuugauugaggugguagucaggcacaucuacacaugggauaaaauucuauagagcuacauauacacacacauaaaugaguguguguaucacuggugaaaucugaacaugcucuauggaugguaucaaugucaauuuccuaguuuugauauuauauuauaguuguguaagauguuaacauuaggggacgcugggagaaaagugcacagaauuucccuguauauuccuuugcagcauccuaugaaucuauaauucaaacuaaaagucaaaaacaaaacaaaaaacaucuccuaaauaugauuauaauuaagucuuuuaauaaauuuauauaauaguugccuuaaagaaauucauaaaugcuucgcuuuugacagacuaaguagauaagccgucauucagguaaaaagagugcucaauacuucaguuuuguaauauaaguaaaacuacuauuugaaaauuucaaguugaaaaauuuaauauguacaaugagacuuugagaaaacauuuaaauuaucaagcaauugaauaaagaaauguacuuuaauuuaaaaagacauuacuguaagaucuuacaugacauccuauuuaucuucuacaauggagauaaagauaaaugaaucaauaaacuauugcugaauccuauuuucucccagaguuauccccaaagaggcuuguguuuacugagcucugcaguauuuacacauugagagaaaagcauagcauucaagccauaaaaauuuuuaaaaaguauguuaucuaguuuauuagguaucuaugucuauauacuuucuguuugauuaaugcaaaaaacgauauuuguaucuucaaaauuaaaaaauauuuuuauuuccucuaggguccuacugguccuauugguccuccuggcccagcuggccagccuggagauaagguaacccuuaauacuaccuggauauaaaaagaaaaugucucucucuuuuggaugcaagacagugacauggcuucucuuuuuccagggugaagguggugcccccggacuuccagguauagcuggaccucgugguagcccuguaaguguuaaagacauucucaacauacuuuuuaaccccauacagacaguagcuacuuaugcuucccuuuuuggcaguuuugcccucaguucccugagccucaauuuggagauauuaucuucaaaaaccauauaaggaaccauauagcaugcaagggaauguuaaauuucuuaaaucuaacauucacaggagaccauuuuaaaucaggauuucuuuccuaaauaacuuuggaaaaaauacaugaauugcacaaguaguacauguuuguaauuagguauuucuuaagccuauagaaucuuugccugagacuccuucuagauuuaaaagucuugaccuucaggauuuaagacucuggaaagauauuuaguaaaugguuuuuaaaaauaaaucaguuaauuuuucaguuaagcuucuaccauauauugaaauacauaaauaucuauauauauaaauguguuaaauacuuuaaaauucucaaacuauuuuucuugcaaauaauaucacaguaggaggcagaaggaaucaaugguucugguauuuuccacuccuaauuuuauugagaaguggcaaagucuucagaaguuuauuggcuacucugcacauuuccugcuuaaaggaaagaaaagauaagaugauaagaugacauuuccugccuaaaggagaugacgcacacuucacugugacuaaggaggauauuuuucucuucagggugagagaggugaaacuggcccuccaggaccugcugguuucccuggugcuccuguaagugugaauauuuauacauacaugucccauagcccaggaucucuaucuugcugaaaaauuacaaaaguauagucaaguuugguuucuagucucauuuuagcugcucauucccuauaggauuauuguaccccuauuuuguuuuacuuuaccccuauugucgcucuuugaaagauggaaauaaaaacaccuguccugcuuuuaugacuggguaaugaacuaaagcaguaucauggauuuaaaagcacucugaauuuuuguaaauucuuccauuauaagaugguacuaauuaaaauuuucucuuaaauccggucuuucucaaaaaaauuuacuggugcugauuuucaaauguuuaauccuuagagacacuuccucccucccuaauggcaaauaaugcacaguuuaugcuuucuuggucauguucuuugaucaugaaaauauuuugauuggcuucauuuugucaugucuucagaaagccuuguuuuuaaauuuuauuucaacuccuuccaucugaagaauucuauauucugaagagaaauaauaauaagccaauuguaucauaaagagugucagcugagagauugcuguuguuguugcauguagggacagaauggugaaccuggugguaaaggagaaagaggggcuccgggugagaaaggugaaggaggcccuccuggaguugcaggacccccuggagguucuggaccugcuguaaguuccuuccucuuucucugucuaucuaucuaucaucuaucuaucuauugauuaucugucuaucucucccucucucucucccucuccccccucuguaaguccuaaguguucuaauggaaaaacauggagguuuaucaguaauuuaauauuuuauacugagauagcaugucauagugucaagaauauaaucuuuauaugaauauaguccaaguaugaaucucagcaccagcaaucuaaaaguuauuuuaaccucuucauagaguuccugguuuucaaaggcuuaaugcuuuucccaaauuuugauuuuggugcuauucuuacauaauuuccuuccauuucauauaggguccuccugguccccaaggugucaaaggugaacguggcaguccugguggaccuguaaguauugauccucuuaacuauuauugaaaagcauuaauugauaucaaccuguauaaaagcugcauuugagacacuaguuccauaaagagaauguaaaaauuguaaucgcucauucauacaugaguuauauguaaauuccaaggggaaacacaaaccauaaaugacuuucagguacaaugcagaucaugccacacauuauacuuuuuguuuguuguacaguuauuuguucuacuuuugaaauucaaaaauauauuaccauuucacagggugcugcuggcuucccuggugcucguggucuuccugguccuccugguaguaauguaaguaauuguuaaagucuuuucucaucauacacuucagaaagagcauucauguauguauaggaugagaaacuuacacauugcuacuuauuucucuaguaagucucaaauaaaauuauuugaaguaaguaaaaaaagaaagaaaaaaugcacuuuuuauuauaaauauucaaauuucaaacaauuauuuguaggguaacccaggacccccaggucccagcgguucuccaggcaaggaugggcccccagguccugcggguaacacuggugcuccuggcagcccuggagugucuggaccaaaaggugaugcuggccaaccaggagagaagggaucgccuggugcccagggcccaccaguaaguaacuucauuuuuuuaaauugauucuacuauuuugauuuuuaucacaaaucgauuagagaaaaacacugucacauaaagaugagcuaagucuucauuaucuguauuagggagcuccaggcccacuugggauugcugggaucacuggagcacggggucuugcaggaccaccaggcaugccagguccuaggggaagcccuggcccucagggugucaaggugaguauagucauuuuccacuacacucuuccuuccuuugguagccuucagagaucacuuaaccauaucaaggaugaaaaguuuuucugucacuggaguaaauuagccaggagauaauuuuuuuuuauuuuuagauuuuuaaaagcauaaauuuuaauaaauggcuccagaacacaaaacagggcauaucauagacaaaccuugaauauaaacacaaauaaauuaauaugaugaaaacaauauugccaucucaaacaccucuuuuaggaaacuugugaauauucuucaauuuguugacugucaguuuugaagggggaaauaguguuagcuuauagaucuuggaaagucuuucauuaaugcuaguuauccauccauucaagucaucuugcacuccugacucucuuucacuaguauuauauuccuauaacauucuagugcuuagcaucuaaaacauucguuugguaaacaggauaauaaaauugcauuuuuauuagggcucguauuauggcacuuuaaguacuucuuucaacaaaauguuauguaauauugucauaaaauuaauauuucauauuuaaguguguucaauugauaugauauuucugguaaguguauauucuucagauagagacaaauaaccuaauuuuaaggaucaccauacaccucuaguuucaugauggcucauuauuguuuuucccuauacuaaucauguuuauguauucaucucagauuacaauguacaguauucugaauuagauaaucaauguaacuauucagcccuuugccauccagagucacugagcaaguuagaaaaugcaagaagcuugcucccccauauuuuuucccauagcaggcauaguuuuaauuuuaaaauucaaugaagauuaaauaaaauaaguuuuuuaccugaaaauaaagauaucugauaacaccauuuuaauugauuucuuaaguugaaacaaaauguuuuucauuccuuuguauacagggugaaagugggaaaccaggagcuaacggucucaguggagaacguggucccccuggaccccagggucuuccuggucuggcugguacagcuggugaaccuggaagagaugugaguagcaguuuuuauucaaccagccagguagaauuugauaauuuauuucagcaaaggugaaauugagcuuuaaugucuaagaguguaaauauggccacauagcaaaguucuucuaucucuaauaacagaaauucuuucauuacaauuuaggauagacuuaaaagcucuuguucauuaguauuuacccaaugaauaaucauuuguggagaaaauauuaucucuaacuaaauuaggaaaaaaguuaguggggagaaccacaauugacauguuuucugagugaaaauauucuacgguuaucuaugguuagucuuuuauuauuuuuaaagaauuuaaaauuaauauuauuuauaauuaacaaaucauaauuguauacauuuauaagguacaaugugauguuuuaauauauguauacaauguggaaugauuaaagcaaacuaauuaaacuguagauuuccacuaacaguuuagaucacuauuucuuaaacuuuuauuuauuagaggucuguaaagacucuuuuuggauaucauuuuucuaaucaccucuccuccaugaauacacuaacuaucugucuggacauugugacccuuugaagggccacacugcuuuguaauaucuaagauuucuuacccccaagaaccaauuuuaacccccuugagaauuauauugcccugcugagaaugcauggaugaaauggcauuuggaagguuucaagaaauuuuauuuccuuucucauuuuuuaaucagggaaacccuggaucagauggucuuccaggccgagauggaucuccugguggcaagguauaauaaacacaugugcaauugauuuguguuaucaaaauaagugaucaucauguuuauuuuguaccuaugaauuuguucacagggugaucguggugaaaauggcucuccuggugccccuggcgcuccuggucauccaggcccaccugguccugucgguccagcuggaaagaguggugacagaggagaaagugugaguucccaaaagcagcaucugucuuguuugucuauuuccuucaauaaagacauuuguagguagaagguagaaugucagaucugccaaccaaaauauccacugucauuuguuuuacaguuuuaaugcuaguuguuccuuagacaaaugugugaauaagucaauaccagaaguacuuggcaguagucaauaaagaauucauuacugaaacccgaaaucauauuaaucagaccaacuaucuauaugcuggguaaaugcaaggccaaguuaacagggcucuugcccaacuuuucugucuagauccccugagaaagcuauaaacagggcuuuagcacuuugaaggcaaaaacaauauuaacuuccaauaauugcaugcauacuauaauucuauuauaaugaaauuauuuacuuuugaaaacgaaauugugucaacacauaaaacuaguuccguguaugucuucucaauugaauguuuucaucuuagggcccugcuggcccugcuggugcucccgguccugcugguucccgaggugcuccuguaaguuuugucauuuuuugguuuuauuuuguuuuguucuuuuuuuaacucauucuacaguguaggaaauauuuuauuuuccagcguguucaggaaaaaagaaugaauauauauauauauauauauauauauauauauauauauauauauuuguucuaucuauagauagaugauagauagauagauagauagauagauagauagauagauagauagauagaacaaauauaaacuuuccuuuaaugacaaugauauggaaagcaguucaggaucuaaaaguucuuuggagccaaggauagaaacaucaguuguuagggauccaugcaaugaucaguccaaaaugaaaacaaccacagaaacaaaucucauuuccuaucugaagugucuguugaugggggauuuuuuagcugauagaaagccauaaaauagauuuaauuauuauaaauucuauuuuauuuuuccaauauguauguguguauaugacuucaauucaaaauauguuucuaaaggguccucaaggcccacguggugacaaaggugaaacaggugaacguggagcugcuggcaucaaaggacaucgaggauucccugguaauccaggugccccagguucuccaguaagugcauucauuuuguuggaaaaucccuucaauguauacaaauuuuagagauuaagagaagaaagcuuuccaucucuaaaaauauguacuagaagagaugagaaauggauuugaaggcuaauuugaaacaacaaucagcaugacacaaugggaagauuaaagaaagaaaaaaaauuucaucaugauccccauguuucuugaucugaucuugaauguacaguuucccagugcuuuuuaaggccuucacuccuauguacacuuccuuucuuuccagggcccugcuggucagcagggugcaaucggcaguccaggaccugcaggccccagaguaaguagcacagaaagauauuacagguccacauguuucagaugucugcauuucagaaagauauucuggcauugugaugucaugauacuuucuuagggaccuguuggacccaguggaccuccuggcaaagauggaaccaguggacauccaggucccauuggaccaccagggccucgagguaacagaggugaaagaggaucugagguaagacaucacuuauacguauguguauuuaauuugcuacaaucuuccaauuuucagaaacacagcgcauuauguuuaaauugaaauagagagacgcaaugcauccacucaauuuagaaacugaacaaugacuuuaagacauucuccaucacauuaaaaauguuucuaccacacuauaacaggagaaaaauaccuuuuuaaaaauuugaucagguauccaucguaucagaauaaugacaucugcccaauuaaccaaauaaacccuguccacauugcuaucccacuagagaucucagaauuacaacauucauaauuaucugcguuuauguagugcauuuuacuucucaaacagcuuccaugguuacuauuuuguuaaugauacuaucauuccuaauacuuucuauuccaugccuuuggguaaaugaaauaaaaacaauuaucccaacaaauuacacuccccucugucaugucaauauuggaauuguagcucacagguguuugcuuacaucagucauccagaaggaagaaugauagagaaaacuugugcucugacacuacugauucuuacauaguggaacaauaucuuucuugauaaugaauuguaguuauuauaaaucggugaucacgugacccuaaaggcacccaaauaaaucuuuaguaaaauaauucugaugacacaaugaaugaauuauuuuuaaggcauuuucuuggacuagcaauguauucuuagaguggcgacugaaugugcauaccucaaugauccauguuuuacucauucuagggcuccccaggccacccagggcaaccaggcccuccuggaccuccuggugccccugguccuugcuguggugguguuggagccgcugccauugcugggauuggaggugaaaaagcuggcgguuuugccccguauuauggagaugaaccaauggauuucaaaaucaacaccgaugagauuaugacuucacucaagucuguuaauggacaaauagaaagccucauuaguccugaugguucucguaaaaaccccgcuagaaacugcagagaccugaaauucugccauccugaacucaagagugguauguuugguagucuuucaucuucauggcaauaggauuacagagaaagcugcuuagauuagaaugggaacgaaaaaacaucuacuuucaauggaaagcugaaauaguacuuuaagaaaguuaacugaauugaaacugcuugauauaaaagaguaaacuuugcagauguaaaauauaacauaacuucagaucaugccaaauacagaaaaauauaaagacauuuuuguagaaguuguaguauaaauuguaaguuauuugaguauaaaguaacauaucuuuuuuucucaggauuaaauauacauaauuugaugcagacaauuauaaucugauuauuguaauauuuacuuauugcaaugaaucuaauuauuaaaauuuucaaauuaaacaagugaaaaauuucagaauacuguauaaaauuaaauagaauauuguaauaguuuaagguuuugcauauauuggguuaaauauuucugaaaagcaaaauuauuucaaguuuucaaauaucuugacauggaacacugccuuugcuaggagucauuucuagaaauuacuuaaaauaggagacaagcaucaaucauagggauuucagcuuuagaacuauuggaacaaaucuagguuagacaaccagcuuauauuauuaagcaagauuacauauaauaaucaucuuuuuuuaaaggagagacuuuugcaaauauuauacagcaaucaaaaggucuuagcuuaguguaucauccuuauuagaaaccaagauguugcauuuuauuucagugcuuucuguagucauagcuaacucuuuuaccucagcaauuucaaucaaaaagcuucucuaucauucuauacauaaaaugcagacacauuagcagucaacauuaugaaugccuuuacagguaaacaaacaaaaucacuuuauuacuggauuuuauaaccaauucccauucuuuuuugugacuauucaggagaauacuggguugacccuaaccaaggaugcaaauuggaugcuaucaagguauucuguaauauggaaacuggggaaacaugcauaagugccaauccuuugaauguuccacggaaacacugguggacagauucuagugcugagaagaaacacguuugguuuggagaguccauggauggugguuuucagguaggaaaggauauaccuuuuuuuaaauaagucaccucuauauccuuuguauucuuccuauauguucaucacaaagcaaaguuacuagguugguacaaacauaauugcaguuuuugcuacugaaagugauggcaugcaauaaaaauauuuucacacauaaaauacucguacauaaaauauauaaacagcccauauuacaauaugcauacacauacuacaugaaucccucgcgugcaguuacaacugaaauguuugaucuguuuuauuuguucccuauuacaguuuagcuacggcaauccugaacuuccugaagauguccuugaugugcaucuggcauuccuucgacuucucuccagccgagcuucccagaacaucacauaucacugcaaaaauagcauugcauacauggaucaggccaguggaaauguaaagaaggcccugaagcugauggggucaaaugaaggugaauucaaggcugaaggaaauagcaaauucaccuacacaguucuggaggaugguugcacgguaggaaacauuuuucucaauauaggucauaaagcagucagcauuuuaguuuaaucaugcaaauuauuuugaauagaauaaauaaaauuaauaggaugaaauaaagauagcauuugguaugaauuacauacauugcaucuacugauucauugcagggaauguuaaaugcaacaaaauggaucuuagccuccagaugaaaaccaguugaaauaaaagcauuuaaaauuuaaauccauaaugcaaacuuuaucagauaauugggauaguuacuauauguuuugaauaauaccugucacauuaacucaguuugaaauaucuguuuuuuaaaauuuuaaagguuaacuucaaaucucucauuuguuauuguuauuugugaacaaagggaaaacucacuucuaauauuagcgaauuucauugugagagaccuauccucuuuuuaauaaaccauuuauaaaccuguuagcaauggccggaaccaggccuccugaggaugcacuggucuauagcaauugcccugcugcauuuacuaagaauccuuacaaggcauuuguuuaagaauauuguuuaucaacuaagaagauuacagcuuugaaguagagcaggucucauauacaugaauaauaacauggcacgaugaaugcuucuuuagaguaaaaagguuuucuuuaacuuguuaagucagaguugucuaaguaauuguaaugucaugaucauguacauuuuguccuuuuuuacagaaacacacuggggaauggagcaaaacagucuuugaauaucgaacacgcaaggcugugagacuaccuauuguagauauugcacccuaugacauuggugguccugaucaagaauuugguguggacguuggcccuguuugcuuuuuauaaaccaaacucuaucugaaaucccaacaaaaaaaauuuaacuccauauguguuccucuuguucuaaucuugucaaccagugcaagugaccgacaaaauuccaguuauuuauuuccaaaauguuuggaaacaguauaauuugacaaagaaaaaugauacuucucuuuuuuugcuguuccaccaaauacaauucaaaugcuuuuuguuuuauuuuuuuaccaauuccaauuucaaaaugucucaauggugcuauaauaaauaaacuucaacacucuuuaugauaacaacacuguguuauauucuuugaauccuagcccaucugcagagcaaugacugugcucaccaguaaaagauaaccuuucuuucugaaauagucaaauacgaaauuagaaaagcccucccuauuuuaacuaccucaacuggucagaaacacagauuguauucuaugagucccagaagaugaaaaaaauuuuauacguugauaaaacuuauaaauuucauugauuaaucuccuggaagauugguuuaaaaagaaaaguguaaugcaagaauuuaaagaaauauuuuuaaagccacaauuauuuuaauauuggauaucaacugcuuguaaaggugcuccucuuuuuucuugucauugcuggucaagauuacuaauauuugggaaggcuuuaaagacgcauguuauggugcuaauguacuuucacuuuuaaacucuagaucagaauuguugacuugcauucagaacauaaaugcacaaaaucuguacaugucucccaucagaaagauucauuggcaugccacaggggauucuccuccuucauccuguaaaggucaacaauaaaaaccaaauuauggggcugcuuuugucacacuagcauagagaauguguugaaauuuaacuuuguaagcuuguaugugguuguugaucuuuuuuuuccuuacagacacccauaauaaaauaucauauuaaaauucuccuguuuuuugucacuuuucaaagauuuaaaaaaugcacgucuacauuaaggaacuccaguaaucuugaaaaaguauauugaauucuaacucuauagauuaauaaugcaauaauuuuuaagaauauaaaauaauauaacauauauucagaguagagauaaugcucaaugaggaauccugcagauuuuuagaucauauuugcaggaaccccugugggacauacuggacacugagggcauucuguuugaaagggucaauccuuggaaaugguaacacaguaaaucaagguauucccaaacugggaauaauaagggaggaagauguugauaguuuaucagaaaguaauuguaauacgggucuauugaaauauauuaauauuaagaaaaauugacaaguaccacaugaucucacuucuauguggaaucuaaaagaguugaauucauugaugaagaauagaauggugguuuccaagggcagaagguggggugggguugggagauuuuagucuauggauacaaaauugcaguaagauagaaguuauaagcucaagagaucuauugugaaacguggugaccacagucaauaacaauguauuauauuuuugaaaauugcgaagagaguaaguauucucaccacaagaaaugaugagaaccugagauacugcauauauaugcauauguaucucugucuuccuacauauacauauauauacacauacauauauguauacacacacacacaaauauauauauauauauauauauauauauauauauauguauagagagagagagacagaacucaaaucaauaguaugaauuaauaaauuagauacuuggaguuuuauuuuagaccaagaaagauaucuggaacacaauguucugccuccuguauuuguaacuuaauguaucacagagaguaguucauuucauuauauauagcucuaacuuauuguguguuauugaucccaauacucaguuuaaugaacacacgaguuaaaauuacuuguuugccuauuuguuuauuuauuugcuaccaaguaucuaaagcccuaucucauugcagggaaguuacaguuagaugagucuugguugagguuagaggccauagacaguugcuuuccuaaccugucuugaguuaggguguaggcaaguggccaugugaccugagcuuggcaaaucagagacacacaccugaaggucucaaucuggggauaauuguauucacuucauauuacugcuguagcaaguuaccauaaauuuagugacuuaaaaccacacagauuucuugucuuacacuucugaacaucaaaagucuaaacugagucuuacuggacucaaaugcaagugucaaacaagguugucuuccuuucuagagacacuagggagaaacuguguguucccuuuuccagcuucuagaggcugcccagcuuccuugguucaugagccaguuccaacaucaaagccagaaauauuuggucaagucuuucucacguugucucauucugacauuggcucuucugucuuccuauuucacuuuuaaggaaccaaaugauugcacugggcccaaauggauacuccaagcuacucuccccauuucaaggucaguugguaagcaaccuuaaugccugcugcaaccuuaauugcuccuugccuugccaaaaaauguaauauauuuacuggcucuggggauuaggguaugaacauauuugagggagcauuauuccaccuaccaacaauagugaugcaaagaaguaaaaagaauuaaaaauccaguuugguggugaucacagcuauaguuggggcagcaaccgccagauaucaaaagaagcauggccaacagugccagaaauggcauccagugucuuguguuuaugauggcuuugccagguugcuuuuaggguaugauuuugaagauggcucugaaugucagcauucacuucauuuuuuguugauuuuaugcaccuggauucuauagcuuucucugaauuccucugaauuucagauaaaaauccauaaauuacauuuuuacuucagugagcuaaaguugguuuagauuguuuacaacuaagccugacuaggccagcaauugguaacagcagggcuggcaggaagcagaaaugcaagcaaauggaaagacucugagaucaaauguuuguacuaguuagggguaaaaauagaaaauccagcuuguauccgggaaugagaauuuggaaguccauggaaauaggauuaaucauuuaugauuacauugagugauuugcacuuuaaagacaaggcuuaaggagauaaguggccucuacuacacaacaguauguuugaauuucaugagaaauugcaggacugcaugugaauguggcugcugugaauggugaugaacagaaagagaaugacaaguucaaaucccuaacuucuugauuuaagacacagaagaaaaucuaugcccuuucccugacuaugcuaaaauaaaagcauacuaucuuucuggaaaaaaagaaaaaaaauucauauuuuugccaaagguuugagauacuaaaaaccaaauacaaaucuuaauucugcagaucaccagacuucaacauaaaucuaaauggauuuuccaauucucuauuugauucucuauaauugggaaacagcaagacccuggaaauuuaaaugggguuuauggaagaauucucuuuaaacauuccaguuucacauuaaguuucuuuagacaucugaaaugggaucugcauuccuugccugguaauuguucccccauucugaaaaugcaagcugacuacaagaaaaagccaauucucuucagaccucauucucaccacugcuuauugucuccagauuuguaacugaagucagaucccagaaugccucaggggguagcaauuuaaaggucaaucucaggaggagguuuacacauaaaaagaauggaaggauuuaacuaauuuauauuguuuaaaaucugagaaacguguguaggaguggauuuugagauacuagacaaaaaagaacagugaaauuuggauaaaauguaucaauauaugaauguaacaaagaguuauaggaacauuauaauuauuaacaugguugaacugaacucaggccucagagguugcccaaacugaaugaauuugagacauuacaaacuuucugacagguggagaauguaauucagaaacuuaagaagauagaaauauuggaaugaauuuaucauaugugauacaaccauucaccuucugaguauauucucaagguggaccaguacgguuuugagaaacacgugguggccugcaugccggcaccuuugaauaaucuccuugugugucuguagucugaagaaggaaguagaaaaaaaucuagcugaaauaggcuucuugauucaauggagaugacaggauccgagcuugcagaggacaaagggcaacucuagacugccggaaacaaagugagaaugauauuguacaagauagcaggacugucaugguagaaaaaauaaaauggcauaauucagaaguaauguugucgguggcugauugauaaugagaaugaugagaugucugggacagucacauuuaugucuuuuauaaacaauaaugacaaauauauuuaguucagguaaaagagaccucagaucagcaaccacacaggccucaagacuuucuucaauucccagacuauaagaugguuaauaaaccuagucuccuuaaaggaagcauaaguucagugcuuuggaggaaaucuccugcaauagaaucacaacugauaagcacuuaccaugggccaagcauuguucuagucacuuuaaacuuauuaauuuguguauuacucacuuguggcaucucaucuauuuccauaaugcuagucaucaauuaaauuaaagauaauucacaaauugacuucuggcuuuguggaacuaaagacccauauauucuauggacuaauugaaauucccaucaaaguuuugaauaucuguaauguagcaaguaauauaaagcuuuuaaagagaucauuccaggaagagagaagagcaauagcaugaggagaggaauguucuggauguguccaaggaaaaacaaagugaauaugguugugacaaaaucaguaucugggggaggaguacaagagaaagccauaggaaaagaggagacaaaucauguggagaccuauaagaagggugaccauaggugcagcuuugccuuggaaaguaauaguuuaugccuauguucccaaugucuaauaagauuuaguauuguagaacucagaaauauccugaucggaugacauuauauggucacccuaauuuuaucuggccacugaggauauuggcuguugccucaguuagaugagaagccacugugauaauggaugacacaaucuggcuugcaguuuuagaguauuucugugacugcuguuuagagacgacugacuguguguuaagagcagaaaccaugagaacagucaugaguccauugcaauagucuaagccaaggaugacagucgucuccaccagggugguaauaguagaagagaugaaaaguagucauguucuggauacauuuugaauacagagccaacaggaacugcugacaauuuggauguaugguuuaagagaaagagagauaucaagcaugaauccaaggcuuuugguccaaguagcuggaagaauagaguugcagcuaagauggggaagacuaagguaaaaaauuugaggaacucaguacuuugaagcugggcauguuacauuuuggaugcuuaucgcucuuuuaagcagacuugcuggaaaucagaggagagguccaggcuagagaaauaaauuuaagaguuucagcguauggcuuuuacauccucagaaauagaagagaucaggccaggcaugguggcuuaugccuguaauuccagcacuuugggaggccaaggugagaggaucaccugaggccaggaguucgagaccagccugaccaacauggugaaaccucguuucuacuaaaaauacaaaaaauuagccacaguggcacgcgccuguaaucucagccacuugggaggcugaggcaagagaaucacuugaacccaagagguggaguuugcagugagccgggaucaugccauugcauccagcuugggcaacaagagcaaaauuacgccucaaaaaaaaaaaaaaaggaagaaaaguagagaagaucaugaaauaauagaguguagaaagaagaaaauaugaaugccugggauacuuuaauauucacaaauuggagaacugaagaggaagcaacaaaggagagagagaaagaaugaaaggaaaccaugaaaguguagugacuuaggugccaggugaaaaaguuuaaauuucagaauuguggcauuaagggaagaaaugaauuuagagucaauguauuccaagaccacuaauuauagauuuuuaaaagcaaggucaauugcgguuauaugaguuuuucugucuauaaauggcagauagugaugcaaugcaauccuuuauaucauaguuacguuaucucguuauuaucucuuucaugauggaggauuaaauacaacuuucuucacccucaaacugacauuuuaacaaagauuauuuuacuuccuugacuaaaauaaaauguauuuuauaaagauugaggaugaaguuaaugcagccauuauaacauaauuagaacaugcaggaaacuaagaagaaaaauagaguauacguguuccagaucaguggcuauuuccuucaagucuucuaagcauauucuaacauaauugggauaauacuauuuaugcaauauuguaugcugcuuauuuuacuuaacauaauauuacuuuauccauaaaaauguauuuuuaaauuuuuggucaaauuaggagaaauauagaggaaacuguucuuacaggaugauggcuccaaaguuagaaaucacaucaaagggaacuuucuuuuaucuaguguauacuaaaauccuauuuuucuggguucugucuuagaggaauaugccuauuuuuaaaagugagucugaaacuaugaaaaaauauuuucuuuucauacauaauucuucacugagucauaacucacuaagcuagcuugauacaguauuggugaaaacauucuguacaacacagcauacuugaaagaucuccccaaaucuccauauucucuagucugccccauugaagguuuucagaaaucuugcaaauaaucacuuguugagucaaugccauaaacaaaaagacuaucaucuauggcuaacauuuuuuauuaaacaaguuuuuaucugauauuuugcucauccuuuuucuuuucauugcuuuaaucuuccugaaaaacaucuuuaccuuuaaaacuccugaauguuuucacuaaaaugcauugaauuacuuugcauuuuuggacaauaucugcuaugauauuuauuaacagaaaucagguugcccuuugagguccauaaaauuuagaaauaggaguuaugauauuucacgccaguuuagugauuuugugggauauacuuuccauuaucuuuaaaaugagauaccccauaauggaguaggaaaagaagcaaaaguuaagcucugucuuugguugaguucccugaaaacagacuguaaggcagcuaaugaugagcagaagauuuacuggggagucaucuugggagauacaucuguaaggaaaugagaaacguagguuuagacagagggggaagcugaccccaugcaauugauggagguuucaggggacucugcaggaaacucuggaacugagguggcccuucagaguugcuauaauucacaguaagagggaugggucuuuuuauuccugaaucagacagucauugacugugggcugaaauuuggaagggguggagguuacauuuguaaagcagucuucgugacugagggcaauucuaugugagagacacugcugugaacucucaguaacaacuauuuucaguggcugcuaucagcugcuaucaauguuuuggcuuugaaaagggcauacauguggauuaccaaauuauaagcuccuccuauauguucaguacucuucuaaacacuauagggaaauauaucacaugauuguccgucuuuagguguguguugucuaggguagauagguugaacccaaaugaaguugcacaaaagcauucaagacaagcaauuaagugcuaaauugugcugagcuaacuauaagagauaaagauaguagaugagaaaaauaauuggucaaugaugauuauauuuucaggacugucuucuuuaaaaagauaaaauguauuguacaauaaaaaagaguguuauuugaguaaacauuggagaaaaggaaaaccacuuuggacuaauaaacaaaagaagagaacaaauagaagaaugauuauccuauguccauagcacagugaagaacccaggcuaccuaaauccauucauuuuaauucagccacaguauugagcaauuacuaaaugcaaggcucagaaccaagugcccaagauuauucaaggagaaaaagagaucaugaaauuuaguaaaaguacgaugacacaagcaugucacaagacuuaacauaauaauuugaauuagagaaauacaagguacuagugauggcagcagcuguagccaucaugcaggcugcagcaaggaggcacagggaggcacagcuggggcugcacacuccauggagcuggugggaacccugacccuucugaguuggugcaggagcuccccaggugccacugcagcugcccaaacugcagcugcagacccaggucucccacucuguggagcaggcaggagcccugcccuccugggugggaguauagucaccaaagcuguggcuguggaucugagccucccugugcucuucgagggggcaugagcuucucaggugcagcugcagcugcccucccaggcccaggaccuggacaucucuguagccugcauacuugaggucccgggaaguuccccaucgcucauccccguaggcuugaggguaucugcucuggcugcuuggccucuguccucugcugccgcagcucugaucucaccccggguugcagcugagcccuggggucaugaauaacagugggacacagaguccugggcagaaguuggugggucccugguaaggccccaccuucaggcuagagagggccuaaagguuacgggccaggcugccugucccauggaccagaguggggacuuguggugccucucccaggccacccauggccauccaugaccaaucggcaggcacuuccuccccugugagguccauaaaagcccugggcucagccagagcagggcacaggauggagaggacagagagaaaacaggacaaccaacugcagagaggaacuaccccccucugcugagaacuucagagaccugcagagacgucugaaugaucugcagagagaagcuacccucuccagggcuucuucucugcagagaacugaacacuccacagaugacuugccugcggagagaaguuacccaccgugggucucaucugagcugcuguaaugcucaauaaagcucaucuucgucuuguucacacuucacuugucuguguaccucguucuuccuggaugcacaacaagaacucaggccgaggcaccauggccacagggguuuccagccagaaaauugacaccccgaagaucccguaacaugagaauggcacaaggaaugaacagucauguccacuuggaggcucucaagacaggcuacaugaagcagaugacaugugggaccaacuuuaaauaauauaauguuuuucagguagcaagagaaaggaagaccacagaaaauacuguaaggaaagaggugcagaguugggaggcauacuuggcaauuuaaauuaucccaguuucagagggagcaugggugucaagcagugguguugugagagacgaggcuggaaauacagucuagacaugaggccuuagaauagcaaggugaugacuuuuuauuuugucugcuucucaaucuagagucauaaaaagguauuaaauauugaaaggcuguugcuugaggagagcacaaaaucaagggaaacauggggagccauggccagauuuacaggcaaugaagagauacccauugugggaagaaggaggcagauuggaucuccauuuuaggaaagaugaggaugagacaaaacaauuuuagcagggaaucagaacaccuuuucuucaaagacuagacugaagaaagagucacagaguguagacauacuugcugggaaaauuagguuaaggagggaaauggggucaggcugaaggagaauaucaauagucaggcaagagacguuuccauuuaauaaggacugaguggaaauuuacacaaccucaggcuuacucgcagcuuucuacguggcaguuaaacguggcagugauucauuuggaagggugguugaacaugauaaaaugugugacugauuggagaauacuaggucagaggcagcuaagucuauuuggaaauuauccuucugcagaugguggaugaaaucaucuggcuccaagaugaaaucaucagggagcaaaacuuccaaaggaaaggggaaaagaacagcaugguguguacguggugagaaggaggauguggaggaaacgucaccaagggucugauucgggauacuguagcuuuuaaucguuuuugaaaaggaggauucaauuuugagggcucagguugugauuaauucagggcuaugaggagagagaggaaacugaacagaaggagggcuucauuagugcuauugauaaaaaugcuuugggacugauuuucaaauuuugucuugaauuuaaaccaccuggagacuguccucagcagagucagcaaaagcacagcuuugaaagaggcgaucacuuucuguaagaacccaacaaagcacagcauuaugcaaggaaacgucaaaugucucugggaggggcuuguacuuuagcuuccuuugagucuuuagggcuacaauucugacuacagauguuuucaauuuauguuguuuuuuuuuuuuucucauuaaauuggcuaacaauugugaucau
